(12) United States Patent
Bentwich

(10) Patent No.: US 7,618,814 B2
(45) Date of Patent: Nov. 17, 2009

(54) MICRORNA-RELATED NUCLEIC ACIDS AND USES THEREOF

(75) Inventor: Itzhak Bentwich, Kfar Daniel (IL)

(73) Assignee: Rosetta Genomics Ltd., Rehovot (IL)

( * ) Notice: Subject to any disclaimer, the term of this patent is extended or adjusted under 35 U.S.C. 154(b) by 96 days.

(21) Appl. No.: 10/535,164

(22) PCT Filed: Nov. 16, 2003

(86) PCT No.: PCT/IL03/00970

§ 371 (c)(1),
(2), (4) Date: Jul. 24, 2006

(87) PCT Pub. No.: WO2004/044123

PCT Pub. Date: May 27, 2004

(65) Prior Publication Data

US 2007/0134655 A1     Jun. 14, 2007

Related U.S. Application Data

(63) Continuation of application No. 10/604,985, filed on Aug. 29, 2003, which is a continuation-in-part of application No. 10/651,227, filed on Aug. 29, 2003, which is a continuation of application No. 10/605,924, filed on Aug. 29, 2003, which is a continuation-in-part of application No. 10/649,653, filed on Aug. 28, 2003, which is a continuation of application No. 10/605,923, filed on Aug. 28, 2003, which is a continuation-in-part of application No. 10/604,926, filed on Aug. 27, 2003, which is a continuation of application No. 10/345,201, filed on Jan. 16, 2003, which is a continuation-in-part of application No. 10/321,503, filed on Dec. 18, 2002, which is a continuation-in-part of application No. 10/310,914, filed on Dec. 6, 2002, which is a continuation-in-part of application No. 10/293,338, filed on Nov. 14, 2002, which is a continuation of application No. 10/604,727, filed on Aug. 13, 2003, said application No. 10/293,338 is a continuation of application No. 10/604,726, filed on Aug. 13, 2003.

(60) Provisional application No. 60/468,251, filed on May 7, 2003.

(51) Int. Cl.
C12N 15/00 (2006.01)
C12N 15/11 (2006.01)

(52) U.S. Cl. ................. 435/320.1; 536/23.1; 536/24.31

(58) Field of Classification Search ........................ None
See application file for complete search history.

(56) References Cited

U.S. PATENT DOCUMENTS 6,573,099 B2    6/2003    Graham
2002/0086356 A1    7/2002    Tuschl et al.
2003/0108923 A1    6/2003    Tuschl et al.

FOREIGN PATENT DOCUMENTS

| WO | WO 01/68836 | 9/2001 |
|----|----|----|
| WO | WO 01/75164 | 10/2001 |
| WO | WO 02/44321 | 6/2002 |
| WO | WO 02/094185 | 11/2002 |
| WO | WO 03/029459 | 4/2003 |
| WO | WO 03/070884 | 8/2003 |
| WO | WO 03/070903 | 8/2003 |
| WO | WO 03/070918 | 8/2003 |
| WO | WO 03/074654 | 9/2003 |

OTHER PUBLICATIONS

Somia et al, Nature Review Genetics 1: 91 (2000).*
Lee, R. C., R. L. Feinbaum and V. Ambros. The C. elegans heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in C. elegans Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 14, 1994 205-225 240.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.
Engdahl HM, Hjalt TA, Wagner EG. A two unit antisense RNA cassette test system for silencing of target genes. Nucleic Acids Res. Aug. 15, 1997 3218-27 25.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in C. elegans and is regulated by the lin-4 RNA Cell 1997 637 88.

(Continued)

Primary Examiner—James Martinell
(74) Attorney, Agent, or Firm—Polsinelli Shughart PC; Teddy C. Scott, Jr.

(57) ABSTRACT

The present invention relates to a first group of novel genes, here identified as genomic address messenger or GAM genes, and a second group of novel operon-like genes, here identified as genomic record or GR genes. GAM genes selectively inhibit translation of known 'target' genes, many of which are known to be involved in various diseases. Nucleic acid molecules are provided respectively encoding 8607 GAM genes, and 1096 GR genes, as are vectors and probes both comprising the nucleic acid molecules, and methods and systems for detecting GAM and GR genes and specific functions and utilities thereof, for detecting expression of GAM and GR genes, and for selectively enhancing and selectively inhibiting translation of the respective target genes thereof.

6 Claims, 29 Drawing Sheets

OTHER PUBLICATIONS

Fire, A., S. Xu, M. K. Montgomery, S. A. Kostas, S. E. Driver and C. C. Mello. Potent and specific genetic interference by double-stranded RNA in Caenorhabditis elegans Nature Feb. 19, 1998 806-811 391.

Waterhouse, P. M., M. W. Graham and M. B. Wang. Virus resistance and gene silencing in plants can be induced by simultaneous expression of sense and antisense RNA Proc Natl Acad Sci U S A Nov 10, 1998 13959-13964 95.

NGO, H., C. Tschudi, K. Gull and E. Ullu. Double-stranded RNA induces mRNA degradation in Trypanosoma brucei Proc Natl Acad Sci U S A Dec 8, 1998 14687-14692 95.

Verma, S. and F. Eckstein. Modified oligonucleotides: synthesis and strategy for users Annu Rev Biochem 1998 99-134 67.

Wuchty, S., W. Fontana, I. L. Hofacker and P. Schuster. Complete suboptimal folding of RNA and the stability of secondary structures Biopolymers Feb. 1999 145-165 49.

Mathews, D. H., J. Sabina, M. Zuker and D. H. Turner. Expanded sequence dependence of thermodynamic parameters improves prediction of RNA secondary structure J Mol Biol May 21, 1999 911-940 288.

Chang, P. L. Encapsulation for somatic gene therapy Ann N Y Acad Sci Jun 18, 1999 146-158 875.

Zhang, M. Q. Large-scale gene expression data analysis: a new challenge to computational biologists Genome Res Aug. 1999 681-688 9.

Grisaru, D., M. Sternfeld, A. Eldor, D. Glick and H. Soreq. Structural roles of acetylcholinesterase variants in biology and pathology Eur J Biochem Sep. 1999 672-686 264.

Fire, A. RNA-triggered gene silencing Trends Genet Sep. 1999 358-363 15.

Tabara, H., M. Sarkissian, W. G. Kelly, J. Fleenor, A. Grishok, L. Timmons, A. Fire and C. C. Mello. The rde-1 gene, RNA interference, and transposon silencing in C. elegans Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and v. Ambros. The lin-4 regulatory RNA controls developmental timing in Caenorhabditis elegans by blocking LIN-14 protein synthesis after the intitiation of translation Dev Biol Dec. 15, 1999. 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in Caenorhabditis elegans Nature Feb. 24, 2000 901-906 403.

Pitt, J. N., J. A. Schisa and J. R. Priess. P granules in the germ cells of Caenorhabditis elegans adults are associated with clusters of nuclear pores and contain RNA Dev Biol Mar. 15, 2000 315-333 219.

Hammond, S. M., E. Bernstein, D. Beach and G. J. Hannon, An RNA-directed nuclease mediates post-transcriptional gene silencing in Drosophila cells Nature Mar. 16, 2000 293-296 404.

Slack, F. J., M. Basson, Z. Liu, V. Ambros, H. R. Horvitz and G. Ruvkun. The lin-41 RBCC gene acts in the C. elegans heterochronic pathway between the let-7 regulatory RNA and the LIN-29 transcription factor Mol Cell Apr. 2000 659-669 5.

Fortier, E. and J. M. Belote. Temperature-dependent gene silencing by an expressed inverted repeat in Drosophila Genesis Apr. 2000 240-244 26.

Mourrain, P., C. Beclin, T. Elmayan, F. Feuerbach, C. Godon, J. B. Morel, D. Jouette, A. M. Lacombe, S. Nikic, N. Picault, K. Remoue, M. Sanial, T. A. VO and H. Vaucheret. *Arabidopis* SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense?Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. MAO and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells AIDS Res Hum Retroviruses Jul. 1, 2000 995 1005 16.

Nilsson, M., G. Barbany, D. O. Antson, K. Gertow and U. Landegren. Enhanced detection and distiction of RNA by enzymatic probe ligation Nat Biotechnol Jul. 2000 791-793 18.

Kent, W. J. and A. M. Zahler. Conservation, regulation, synteny, and introns in a large-scale C. briggsae-C. elegans genomic alignment Genome Res Aug. 2000 1115-1125 10.

Kennerdell, J. R. and R. W. Carthew. Heritable gene silencing in Drosophila using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in Nicotiana benthamiana Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAi in Drosophila embryos Curr Biol Oct. 5, 2000 1191-1200 10.

Anandalakshmi, R., R. Marathe, X. Ge, J. M. Herr, Jr., C. Mau, A. Mallory, G. Pruss, L. Bowman and V. B. Vance. A calmodulin-related protein that suppresses prosttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Paquinelli, A. E., B. J. Reinhart, F. Slack, M. Q. Martindale, M. I. Kuroda, B. Maller, D. C. Hayward, E. E. Ball, B. Degnan, P. Muller, J. Spring, A Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638 10 p. 638 only.

Thomas, C. L., L. Jones, D. C. Baulcombe and A. J. Maule. Size constraints for targeting post-transcriptional gene silencing and for RNA-directed methylation in Nicotiana benthamiana using a potato virus X vector Plant J Feb. 2001 417-425 25.

Elbashier, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in Drosophila using a GAL4-driven hairpin RNA incorporating a heterologous spacer Nucleic Acids Res Jun. 15, 2001 E55-55 29.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.
Elbashir, S. M., J. Martinez, A. Patkaniowska, W. Lendeckel and T. Tuschl. Functional anatomy of siRNAs for mediating efficient RNAi in Drosophila melanogaster embryo lysate Embo J Dec. 3, 2001 6877-6888 20.
Ambros, V. microRNAs: tiny regulators with great potential Cell Dec. 28, 2001 823-826 107.
Blaszczyk, J., J. E. Tropea, M. Bubunenko, K. M. Routzahn, D. S. Waught, D. L. Court and X. JI. Crystallographic and modeling studies of RNase III suggest a mechanism for double-stranded RNA cleavage Structure Dec. 2001 1225-1236 9.
Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.
Smallridge, R. A small fortune Nat Rev Mol Cell Biol Dec 2001 867 2.
Eddy, S. R. Non-coding RNA genes and the modern RNA world Nat Rev Genet Dec. 2001 919-929 2.
LU, C. M. miRNA bead detection Genaco Biomedical Products PHS 398 2001 1
Matzke, M., A. J. Matzke and J. M. Kooter. RNA: guiding gene silencing 2001 1080 293.
Grosshans, H. and F. J. Slack. Micro-RNAs: small is plentiful J Cell Biol Jan. 7, 2002 17-21 156.
Meshorer, E., C. Erb, R. Gazit, L. Pavlovsky, D. Kaufer, A. Friedman, D. Glick, N. Ben-Arie and H. Soreq. Alternative splicing and neuritic mRNA translocation under long-term neuronal hypersensitivity Science Jan. 18, 2002 508-512 295.
Paddison, P. J., A. A. Caudy and G. J. Hannon. Stable suppression of gene expression by RNAi in mammalian cells Proc Natl Acad Sci U S A Feb. 5, 2002 1443-1448 99.
Moss, E. G. MicroRNAs: hidden in the genome Curr Biol Feb 19, 2002 R138-140 12.
Banerjee, D. and F. Slack. Control of developmental timing by small temporal RNAs: a paradigm for RNA-mediated regulation of gene expression Bioessays Feb. 2002 119-129 24.
Elbashir, S. M., J. Harborth, K. Weber and T. Tuschl. Analysis of gene function in somatic mammalian cells using small interfering RNAs Methods Feb. 2002 199-213 26.
Han, Y. and D. Grierson. Relationship between small antisense RNAs and aberrant RNAs associated with sense transgene mediated gene silencing in tomato Plant J Feb. 2002 509-519 29.
Nicholson, R. H. and A. W. Nicholson. Molecular characterization of a mouse cDNA encoding Dicer, a ribonuclease III ortholog involved in RNA interference Mamm Genome Feb. 2002 67-73 13.
Puerta-Fernandez, E., A. Barroso-DelJesus and A. Berzal-Herranz. Anchoring hairpin ribozymes to long target RNAs by loop-loop RNA interactions Antisense Nucleic Acid Drug Dev Feb. 2002 1-9 12.
Giordano, E., R. Rendina, I. Peluso and M. Furia. RNAi triggered by symmetrically transcribed transgenes in Drosophila melanogaster Genetics Feb. 2002 637-648 160.
Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.
Mourelators, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.
Seggerson, K., L. Tang and E. G. Moss. Two genetic circuits repress the Caenorhabditis elegans heterochronic gene lin-28 after translation initiation Dev Biol Mar. 15, 2002 215-225 243.
Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.
Catalanotto, C., G. Azzalin, G. Macino and C. Cogoni. Involvement of small RNAs and role of the qde genes in the gene silencing pathway in Neurospora Genes Dev Apr. 1, 2002 790-795 16.
Boutla, A., K. Kalantidis, N. Tavernarakis, M. Tsagris and M. Tabler. Induction of RNA interference in Caenorhabditis elegans by RNAs derived from plants exhibiting post-transcriptional gene silencing Nucleic Acids Res Apr. 1, 2002 1688-1694 30.
Pasquinelli, A. E. and G. Ruvkun. Control of developmental timing by micrornas and their targets Annu Rev Cell Dev Biol Epub 2002 Apr. 2, 2002 495-513 18.
Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.
Beclin, C., S. Boutet, P. Waterhouse and H. Vaucheret. A branched pathway for transgene-induced RNA silencing in plants Curr Biol Apr. 16, 2002 684-688 12.
Eddy, S. R. Computational genomics of noncoding RNA genes Cell Apr. 19, 2002 137-140 109.
Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.
Kent, W. J. Blat—the Blast-like alignment tool Genome Res Apr. 2002 656-664 12.
Hutvagner, G. and P. D. Zamore. RNAi: nature abhors a double-strand Curr Opin Genet Dev Apr. 2002 225-232 12.
Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.
Pasquinelli, A. E. MicroRNAs: deviants no longer Trends Genet Apr. 2002 171-173 18.
Lai, E. C. Micro RNAs are complementary to 3' UTR sequence motifs that mediate negative post-transcriptional regulation Nat Genet Apr. 2002 363-364 30.
Schwarz, D. S. and P. D. Zamore. Why do miRNAs live in the miRNP? Genes Dev May 1, 2002 1025-1031 16.
Brantl, S. Antisense-RNA regulation and RNA interference Biochim Biophys Acta May 3, 2002 15-25 1575.
Li, H., W. X. Li and S. W. Ding. Induction and suppression of RNA silencing by an animal virus Science May 17, 2002 1319-1321 296.
Zamore, P. D. Ancient pathways programmed by small RNAs Science May 17, 2002 1265-1269 296.
Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.
Lee, N.S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.
Draghici, S. Statistical intelligence: effective analysis of high-density microarray data Drug Discov Today Jun. 1, 2002 S55-63 7.
Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.
Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.
Bettencourt, R., O. Terenius and I. Faye. Hemolin gene silencing by ds-RNA injected into Cecropia pupae is lethal to next generation embryos Insect Mol Biol Jun. 2002 267-271 11.
Hooper, N. M. and A. J. Turner. The search for alpha-secretase and its potential as a therapeutic approach to Alzheimer s disease Curr Med Chem Jun. 2002 1107-1119 9.
Liu, Q., S. Singh and A. Green. High-oleic and high-stearic cottonseed oils: nutritionally improved cooking oils developed using gene silencing J Am Coll Nutr Jun. 2002 205S-211S 21.
Zeng, Y., E. J. Wagner and B. R. Cullen. Both natural and designed micro RNAs can inhibit the expression of cognate mRNAs when expressed in human cells Mol Cell Jun. 2002 1327-1333 9.
McManus, M. T., C. P. Petersen, B. B. Haines, J. Chen and P. A. Sharp. Gene silencing using micro-RNA designed hairpins Rna Jun. 2002 842-850 8.
Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

MA, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. LIM, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates Drosophila growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the Arabidopis FAD2 gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yamane. Identification and characterization of novel small RNAs in the aspS-yrvM intergenic region of the Bacillus subtilis genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induced systemic posttranscriptional gene silencing in plants Proc Natl Acad Sci USA Sep. 3, 2002 11981-11986 99.

Park, W., J. Li, R. Song, J. Messing and X. Chen. Carpel Factory, a Dicer homolog, and HEN1, a novel protein, act in microRNA metabolism in Arabidopsis thaliana Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of Arabidopsis miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A Drosophila fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/Suspensor1/Carpel Factory, a Dicer homolog, is a maternal effect gene required for embryo development in Arabidopsis Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3'nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1. 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Calin, G. A., C. D. Dumitru, M. Shimizu, R. Bichi, S. Zupo, E. Noch, H. Aldler, S. Rattan, M. Keating, K. Rai, L. Rassenti, T. Kipps, M. Negrini, F. Bullrich and C. M. Croce. Frequent deletions and downregulation of micro- RNA genes miR15 and miR16 at 13q14 in chronic lymphocytic leukemia Proc Natl Acad Sci U S A Nov. 26, 2002 15524-15529 99.

Gaudilliere, B., Y. Shi and A. Bonni. RNA interference reveals a requirement for myocyte enhancer factor 2A in activity-dependent neuronal survival J Biol Chem Nov. 29, 2002 46442-46446 277.

Jones, L. Revealing micro-RNAs in plants Trends Plant Sci Nov. 2002 473-475 7.

Schauer, S. E., S. E. Jacobsen, D. W. Meinke and A. Ray. Dicer-Like1: blind men and elephants in Arabidopsis development Trends Plant Sci Nov. 2002 487-491 7.

Okazaki, Y., M. Furuno, T. Kasukawa, J. Adachi, H. Bono, S. Kondo, et al. Analysis of the mouse transcriptome based on functional annotation of 60,770 full-length cDNAs Nature Dec. 5, 2002 563-573 420.

Uchida, N., S. Hoshino, H. Imataka, N. Sonenberg and T. Katada. A novel role of the mammalian GSPT/eRF3 associating with poly(A)-binding protein in Cap/Poly(A)-dependent translation J Biol Chem Dec. 27, 2002 50286-50292 277.

Huttenhofer, A., J. Brosius and J. P. Bachellerie. RNomics: identification and function of small, non-messenger RNAs Curr Opin Chem Biol Dec. 2002 835-843 6.

Wood, N. T. Unravelling the molecular basis of viral suppression of PTGS Trends Plant Sci 2002 384 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry * No date in pubmed * 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell * No date in pubmed * 2002 S289-301 14 Suppl.

Tang, G., B. J. Reinhart, D. P. Bartel and P. D. Zamore. A biochemical framework for RNA silencing in plants Genes Dev Jan. 1, 2003 49-63 17.

Kawasaki, H. and K. Taira. Short hairpin type of dsRNAs that are controlled by tRNA(Val) promoter significantly induce RNAi-mediated gene silencing in the cytoplasm of human cells Nucleic Acids Res Jan. 15, 2003 700-707 31.

Ashrafi, K., F. Y. Chang, J. L. Watts, A. G. Fraser, R. S. Kamath, J. Ahringer and G. Ruvkun. Genome-wide RNAi analysis of Caenorhabditis elegans fat regulatory genes Nature Jan. 16, 2003 268-272 421.

Kamath, R. S., A. G. Fraser, Y. Dong, G. Poulin, R. Durbin, M. Gotta, A. Kanapin, N. Le Bot, S. Moreno, M. Sohrmann, D. P. Welchman, P. Zipperlen and J. Ahringer. Systematic functional analysis of the Caenorhabditis elegans genome using RNAi Nature Jan. 16, 2003 231-237 421.

Tuschl, T. Functional genomics: RNA sets the standard Nature Jan. 16, 2003 220-221 421.

Iyer, L. M., E. V. Koonin and L. Aravind. Evolutionary connection between the catalytic subunits of DNA-dependent RNA polymerases and eukaryotic RNA-dependent RNA polymerases and the origin of RNA polymerases BMC Struct Biol Jan. 28, 2003 1 3.

Shi, Y. Mammalian RNAi for the masses Trends Genet Jan. 2003 9-12 19.

Cerutti, H. RNA interference: traveling in the cell and gaining functions? Trends Genet Jan. 2003 39-46 19.

Zeng, Y. and B. R. Cullen. Sequence requirements for micro RNA processing and function in human cells Rna Jan. 2003 112-123 9.

Kawasaki, H., E. Suyama, M. Iyo and K. Taira. siRNAs generated by recombinant human Dicer induce specific and significant but target site-independent gene silencing in human cells Nucleic Acids Res Feb. 1, 2003 981-987 31.

Reiner, A., D. Yekutieli and Y. Benjamini. Identifying differentially expressed genes using false discovery rate controlling procedures Bioinformatics Feb. 12, 2003 368-375 19.

Doench, J. G., C. P. Petersen and P. A. Sharp. siRNAs can function as miRNAs Genes Dev Feb. 15, 2003 438-442 17.

Gupta, V., A. Cherkassky, P. Chatis, R. Joseph, A. L. Johnson, J. Broadbent, T. Erickson and J. Dimeo. Directly labeled mRNA produces highly precise and unbiased differential gene expression data Nucleic Acids Res Feb. 15, 2003 e13 31.

Boffelli, D., J. McAuliffe, D. Ovcharenko, K. D. Lewis, I. Ovcharenko, L. Pachter and E. M. Rubin. Phylogenetic shadowing of primate sequences to find functional regions of the human genome Science Feb. 28, 2003 1391-1394 299.

Kasschau, K. D., Z. Xie, E. Allen, C. Llave, E. J. Chapman, K. A. Krizan and J. C. Carrington. P1/HC-Pro, a viral suppressor of RNA silencing, interferes with Arabidopsis development and miRNA unction Dev Cell Feb. 2003 205-217 4.

Carmell, M. A., L. Zhang, D. S. Conklin, G. J. Hannon and T. A. Rosenquist. Germline transmission of RNAi in mice Nat Struct Biol Feb. 2003 91-92 10.

Dostie, J., Z. Mourelatos, M. Yang, A. Sharma and G. Dreyfuss. Numerous microRNPs in neuronal cells containing novel microRNAs Rna Feb. 2003 180-186 9.

Lagos-Quintana, M., R. Rauhut, J. Meyer, A. Borkhardt and T. Tuschl. New microRNAs from mouse and human Rna Feb. 2003 175-179 9.

Wilson, J. A., S. Jayasena, A. Khvorova, S. Sabatinos, I. G. Rodrigue-Gervais, S. Arya, F. Sarangi, M. Harris-Brandts, S. Beaulieu and C. D. Richardson. RNA interference blocks gene expression and RNA synthesis from hepatitis C replicons propagated in human liver cells Proc Natl Acad Sci U S A Mar. 4, 2003 2783-2788 100.

Lim, L. P., M. E. Glasner, S. Yekta, C. B. Burge and D. P. Bartel. Vertebrate microRNA genes Science Mar. 7, 2003 1540 299.

Maniataki, E., A. E. Martinez De Alba, R. Sagesser, M. Tabler and M. Tsagris. Viroid RNA systemic spread may depend on the interaction of a 71-nucleotide bulged hairpin with the host protein VirP1 Rna Mar. 2003 346-354 9.

Ambros, V., B. Bartel, D. P. Bartel, C. B. Burge, J. C. Carrington, X. Chen, G. Dreyfuss, S. R. Eddy, S. Griffiths-Jones, M. Marshall, M. Matzke, G. Ruvkun and T. Tuschl. A uniform system for microRNA annotation Rna Mar. 2003 277-279 9.

Findley, S. D., M. Tamanaha, N. J. Clegg and H. Ruohola-Baker. Maelstrom, a Drosophila spingle-class gene, encodes a protein that colocalizes with Vasa and RDE1/AGO1 homolog, Aubergine, in nuage Development Mar. 2003 859-871 130.

Hershberg, R., S. Altuvia and H. Margalit. A survey of small RNA-encoding genes in *Escherichia coli* Nucleic Acids Res Apr. 1, 2003 1813-1820 31.

Brennecke, J., D. R. Hipfner, A. Stark, R. B. Russell and S. M. Cohen. bantam encodes a developmentally regulated microRNA that controls cell proliferation and regulates the proapoptotic gene hid in Drosophila Cell Apr. 4, 2003 25-36 113.

Lim, L. P., N. C. Lau, E. G. Weinstein, A. Abdelhakim, S. Yekta, M. W. Rhoades, C. B. Burge and D. P. Bartel. The microRNAs of Caenorhabditis elegans Genes Dev Apr. 15, 2003 991-1008 17.

XU, P., S. Y. Vernooy, M. Guo and B. A. Hay. The Drosophila microRNA Mir-14 suppresses cell death and is required for normal fat metabolism Curr Biol Apr. 29, 2003 790-795 13.

Xie, Z., K. D. Kasschau and J. C. Carrington. Negative feedback regulation of Dicer-Like1 in Arabidopsis by microRNA-guided mRNA degradation Curr Biol Apr. 29, 2003 784-789 13.

Carmichael, G. G. Antisense starts making more sense Nat Biotechnol Apr. 2003 371-372 21.

Yelin, R., D. Dahary, R. Sorek, E. Y. Levanon, O. Goldstein, A. Shoshan, A. Diber, S. Biton, Y. Tamir, R. Khosravi, S. Nemzer, E. Pinner, S. Walach, J. Bernstein, K. Savitsky and G. Rotman. Widespread occurrence of antisense transcription in the human genome Nat Biotechnol Apr. 2003 379-386 21.

Boutet, S., F. Vazquez, J. Liu, C. Beclin, M. Fagard, A. Gratias, J. B. Morel, P. Crete, X. Chen and H. Vaucheret. Arabidopsis HEN1: a genetic link between endogenous miRNA controlling development and siRNA controlling transgene silencing and virus resistance Curr Biol May 13, 2003 843-848 13.

Ambros, V., R. C. Lee, A. Lavanway, P. T. Williams and D. Jewell. MicroRNAs and other tiny endogenous RNAs in C. elegans Curr Biol May 13, 2003 807-818 13.

Liang, X. S. J. Q. Lian, Y. X. Zhou, Q. H. Nie and C. Q. Hao. A small yeast RNA inhibits HCV IRES mediated translation and inhibits replication of poliovirus in vivo World J Gastroenterol May 2003 1008-1013 9.

Grad, Y., J. Aach, G. D. Hayes, B. J. Reinhart, G. M. Church, G. Ruvkun and J. Kim. Computational and experimental identification of C. elegans microRNAs Mol Cell May 2003 1253-1263 11.

Abrahante, J. E., A. L. Daul, M. Li, M. L. Volk, J. M. Tennessen, E. A. Miller and A. E. Rougvie. The Caenorhabditis elegans hunchback-like gene lin-57/hbl-1 controls developmental time and is regulated by microRNAs Dev Cell May 2003 625-637 4.

Lin, S. Y., S. M. Johnson, M. Abraham, M. C. Vella, A. Pasquinelli, C. Gamberi, E. Gottlieb and F. J. Slack. The C elegans hunchback homolog, hbl-1, controls temporal patterning and is a probable microRNA target Dev Cell May 2003 639-650 4.

Zamvil, S. S. and L. Steinman. Diverse targets for intervention during inflammatory and neurodegenerative phases of multiple sclerosis Neuron Jun. 5, 2003 685-688 38.

Ambros, V. MicroRNA pathways in flies and worms: growth, death, fat, stress, and timing Cell Jun. 13, 2003 673-676 113.

Moss, E. G. and L. Tang. Conservation of the heterochronic regulator Lin-28, its developmental expression and microRNA complementary sites Dev Biol Jun. 15, 2003 432-442 258.

Smalheiser, N. R. EST analyses predict the existence of a population of chimeric microRNA precursor-mRNA transcripts expressed in normal human and mouse tissues Genome Biol Epub 2003 Jun. 18, 2003 403 4.

Lai, E. C., P. Tomancak, R. W. Williams and G. M. Rubin. Computational identification of Drosophila microRNA genes Genome Biol Epub 2003 Jun. 30, 2003 R42 4.

No author listed. Whither RNAi? Nat Cell Biol Jun. 2003 489-490 5.

Bartel, B. and D. P. Bartel. MicroRNAs: at the root of plant development? Plant Physiol Jun. 2003 709-717 132.

Dykxhoorn, D. M., C. D. Novina and P. A. Sharp. Killing the messenger: short RNAs that silence gene expression Nat Rev Mol Cell Biol Jun. 2003 457-467 4.

Saunders, L. R. and G. N. Barber. The dsRNA binding protein family: critical roles, diverse cellular functions Faseb J Jun. 2003 961-983 17.

Steinman, L. and S. Zamvil. Transcriptional analysis of targets in multiple sclerosis Nat Rev Immunol Jun. 2003 483-492 3.

QI, Y. and B. Ding. Inhibition of cell growth and shoot development by a specific nucleotide sequence in a noncoding viroid RNA Plant Cell Jun. 2003 1360-1374 15.

Jackson, A. L., S. R. Bartz, J. Schelter, S. V. Kobayashi, J. Burchard, M. Mao, B. Li, G. Cavet and P. S. Linsley. Expression profiling reveals off-target gene regulation by RNAi Nat Biotechnol Jun. 2003 635-637 21.

Bashirullah, A., A. E. Pasquinelli, A. A. Kiger, N. Perrimon, G. Ruvkun and C. S. Thummel. Coordinate regulation of small temporal RNAs at the onset of Drosophila metamorphosis Dev Biol Jul. 1, 2003 259.

Sempere, L. F., N. S. Sokol, E. B. Dubrovsky, E. M. Berger and V. Ambros. Temporal regulation of microRNA expression in Drosophila melanogaster mediated by hormonal signals and broad-Complex gene activity. Genome Biol. 5:R13 (2003).

Heetebrij, R. J., E. G. Talman, M. A. V Velzen, R. P. Van Gijlswijk, S. S. Snoeijers, M. Schalk, J. Wiegant, F. V D Rijke, R. M. Kerkhoven, A. K. Raap, H. J. Tanke, J. Reedijk and H. J. Houthoff. Platinum(II)-based coordination compounds as nucleic acid labeling reagents: synthesis, reactivity, and applications in hybridization assays Chembiochem Jul. 7, 2003 573-583 4.

Borodina, T. A., H. Lehrach and A. V. Soldatov. Ligation-based synthesis of oligonucleotides with block structure Anal Biochem Jul. 15, 2003 309-313 318.

Johnson, S. M., S. Y. Lin and F. J. Slack. The time of appearance of the C. elegans let-7 microRNA is transcriptionally controlled utilizing a temporal regulatory element in its promoter Dev Biol Jul. 15, 2003 364-379 259.

Carrington, J. C. and V. Ambros. Role of microRNAs in plant and animal development Science Jul. 18, 2003 336-338 301.

Smale, S. T. The establishment and maintenance of lymphocyte identity through gene silencing Nat Immunol Jul. 2003 607-615 4.

Bridge, A. J., S. Pebernard, A. Ducraux, A. L. Nicoulaz and R. Iggo. Induction of an interferon response by RNAi vectors in mammalian cells Nat Genet Jul. 2003 263-264 34.

Seitz, H., N. Youngson, S. P. Lin, S. Dalbert, M. Paulsen, J. P. Bachellerie, A. C. Ferguson-Smith and J. Cavaille. Imprinted microRNA genes transcribed antisense to a reciprocally imprinted retrotransposon-like gene Nat Genet Jul. 2003 261-262 34.

Zeng, Y., R. Yi and B. R. Cullen. MicroRNAs and small interfering RNAs can inhibit mRNA expression by similar mechanisms Proc Natl Acad Sci U S A Aug. 19, 2003 9779-9784 100.

Schramke, V. and R. Allshire. Hairpin RNAs and retrotransposon LTRs effect RNAi and chromatin-based gene silencing Science Aug. 22, 2003 1069-1074 301.

Wiznerowicz, M. and D. Trono. Conditional suppression of cellular genes: lentivirus vector-mediated drug-inducible RNA interference J Virol Aug. 2003 8957-8961 77.

Lau, N. C. and D. P. Bartel. Censors of the genome Sci Am Aug. 2003 34-41 289.

Houbaviy, H. B., M. F. Murray and P. A. Sharp. Embryonic stem cell-specific MicroRNAs Dev Cell Aug. 2003 351-358 5.

Aravin, A. A., M. Lagos-Quintana, A. Yalcin, M. Zavolan, D. Marks, B. Snyder, T. Gaasterland, J. Meyer and T. Tuschl. The small RNA profile during Drosophila melanogaster development Dev Cell Aug. 2003 337-350 5.

McManus, M. T. MicroRNAs and cancer Semin Cancer Biol Aug. 2003 253-258 13.

Baner, J., A. Isaksson, E. Waldenstrom, J. Jarvius, U. Landegren and M. Nilsson. Parallel gene analysis with allele-specific padlock probes and tag microarrays Nucleic Acids Res Sep. 1, 2003 e103 31.

Boutla, A., C. Delidakis and M. Tabler. Developmental defects by antisense-mediated inactivation of micro-RNAs 2 and 13 in Drosophila and the identification of putative target genes Nucleic Acids Res Sep. 1, 2003 4973-4980 31.

Palatnik, J. F., E. Allen, X. Wu, C. Schommer, R. Schwab, J. C. Carrington and D. Weigel. Control of leaf morphogenesis by microRNAs Nature Sep. 18, 2003 257-263 425.

Klein, R. J. and S. R. Eddy. Rsearch: finding homologs of single structured RNA sequences BMC Bioinformatics Sep. 22, 2003 44 4.

Caudy, A. A., R. F. Ketting, S. M. Hammond, A. M. Denli, A. M. Bathoorn, B. B. Tops, J. M. Silva, M. M. Myers, G. J. Hannon and R. H. Plasterk. A micrococcal nuclease homologue in RNAi effector complexes Nature Sep. 25, 2003 411-414 425.

Lee, Y., C. Ahn, J. Han, H. Choi, J. Kim, J. Yim, J. Lee, P. Provost, O. Radmark, S. Kim and V. N. Kim. The nuclear RNase III Drosha initiates microRNA processing Nature Sep. 25, 2003 415-419 425.

Sledz, C. A., M. Holko, M. J. De Veer, R. H. Silverman and B. R. Williams. Activation of the interferon system by short-interfering RNAs Nat Cell Biol Sep. 2003 834-839 5.

Bergmann, A. and M. E. Lane. HIDden targets of microRNAs for growth control Trends Biochem Sci Sep. 2003 461-463 28.

Khvorova, A., A. Reynolds and S. D. Jayasena. Functional siRNAs and miRNAs exhibit strand bias Cell Oct. 17, 2003 209-216 115.

Schwarz, D. S., G. Hutvagner, T. Du, Z. Xu, N. Aronin and P. D. Zamore. Asymmetry in the assembly of the RNAi enzyme complex Cell Oct. 17, 2003 199-208 115.

Abbott, A. L. Heterochronic genes Curr Biol Oct. 28, 2003 R824-825 13.

Hake, S. MicroRNAs: a role in plant development Curr Biol Oct. 28, 2003 R851-852 13.

Carthew, R. W. Making and breaking with nucleases and small RNAs Nat Struct Biol Oct. 2003 776-777 10.

Krichevsky, A. M., K. S. King, C. P. Donahue, K. Khrapko and K. S. Kosik. A microRNA array reveals extensive regulation of microRNAs during brain development Rna Oct. 2003 1274-1281 9.

Mattick, J. S. Challenging the dogma: the hidden layer of non-protein-coding RNAs in complex organisms Bioessays Oct. 2003 930-939 25.

Nelson, P., M. Kiriakidou, A. Sharma, E. Maniataki and Z. Mourelatos. The microRNA world: small is mighty Trends Biochem Sci Oct. 2003 534-540 28.

Michael, M. Z., O. C. SM, N. G. Van Holst Pellekaan, G. P. Young and R. J. James. Reduced accumulation of specific microRNAs in colorectal neoplasia Mol Cancer Res Oct. 2003 882-891 1.

Allinson, T. M., E. T. Parkin, A. J. Turner and N. M. Hooper. Adams family members as amyloid precursor protein alpha-secretases J Neurosci Res Nov. 1, 2003 342-352 74.

Kawasaki, H. and K. Taira. Retraction: Hes1 is a target of microRNA-23 during retinoic-acid-induced neuronal differentiation of NT2 cells Nature Nov. 6, 2003 100 426.

Saxena, S., Z. O. Jonsson and A. Dutta. Small RNAs with imperfect match to endogenous mRNA repress translation. Implications for off-target activity of small inhibitory RNA in mammalian cells J Biol Chem Nov. 7, 2003 44312-44319 278.

Basyuk, E., F. Suavet, A. Doglio, R. Bordonne and E. Bertrand. Human let-7 stem-loop precursors harbor features of RNase III cleavage products Nucleic Acids Res Nov. 15, 2003 6593-6597 31.

Stevenson, M. Dissecting HIV-1 through RNA interference Nat Rev Immunol Nov. 2003 851-858 3.

Wienholds, E., M. J. Koudijs, F. J. Van Eeden, E. Cuppen and R. H. Plasterk. The microRNA-producing enzyme Dicer1 is essential for zebrafish development Nat Genet Nov. 2003 217-218 35.

Gibbs, W. W. The unseen genome: gems among the junk Sci Am Nov. 2003. 289:48-53.

Chang, J., P. Provost and J. M. Taylor. Resistance of human hepatitis delta virus RNAs to dicer activity J Virol Nov. 2003 11910-11917 77.

Wang, D., A. Urisman, Y. T. Liu, M. Springer, T. G. Ksiazek, D. D. Erdman, E. R. Mardis, M. Hickenbotham, V. Magrini, J. Eldred, J. P.

Latreille, R. K. Wilson, D. Ganem and J. L. Derisi. Viral Discovery and sequence recovery using DNA microarrays PLoS Biol Nov. 2003 E2 1, vol. 1, Issue 2, pp. 257-260.

Aukerman, M. J. and H. Sakai. Regulation of flowering time and floral organ identity by a MicroRNA and its APETALA2-like target genes Plant Cell Nov. 2003 2730-2741 15.

Stein, T. D. and J. A. Johnson. Genetic programming by the proteolytic fragments of the amyloid precursor protein: somewhere between confusion and clarity Rev Neurosci * no date in pubmed * 2003 317-341 14.

Szymanski, M., M. Z. Barciszewska, M. Zywicki and J. Barciszewski. Noncoding RNA transcripts J Appl Genet 2003 1-19 44.

* cited by examiner

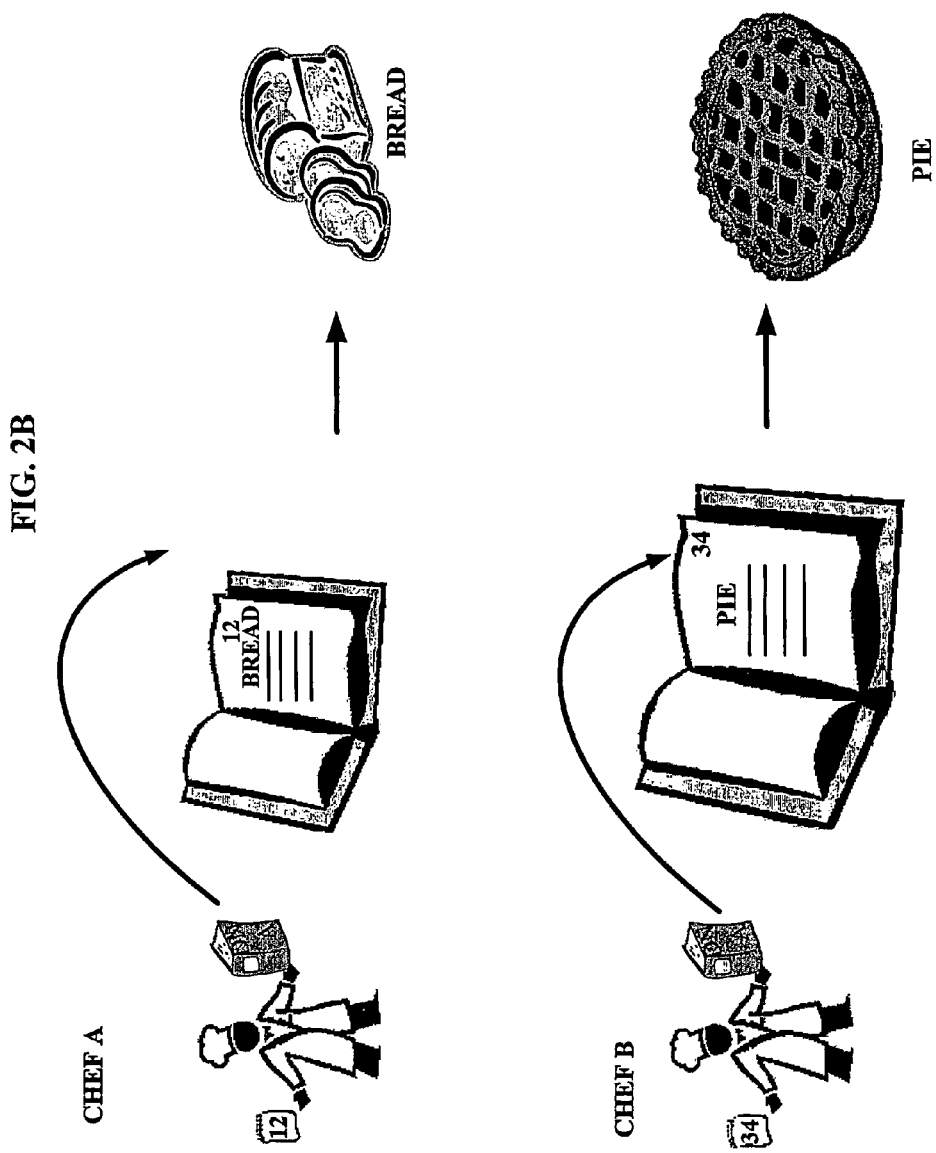

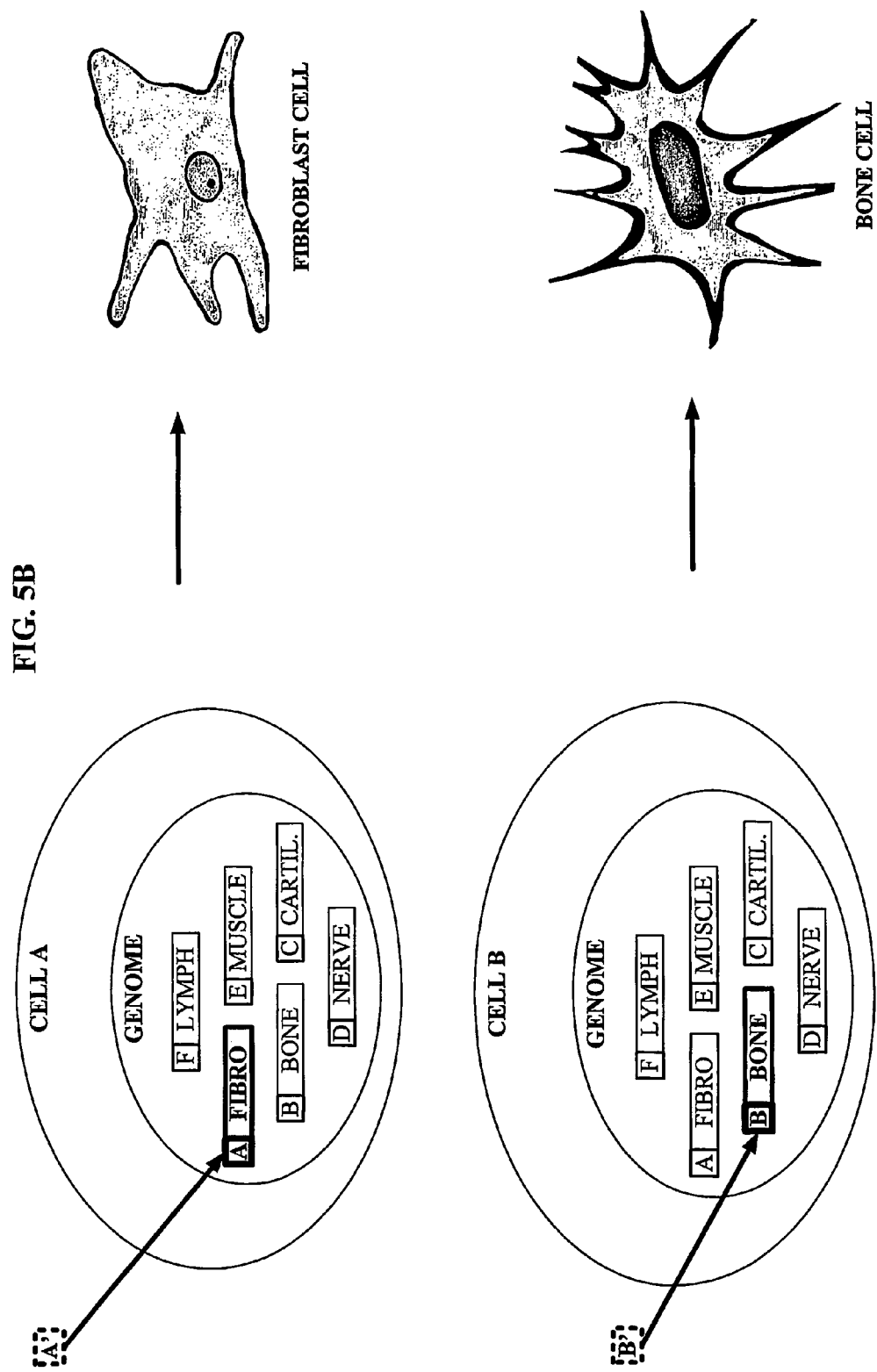

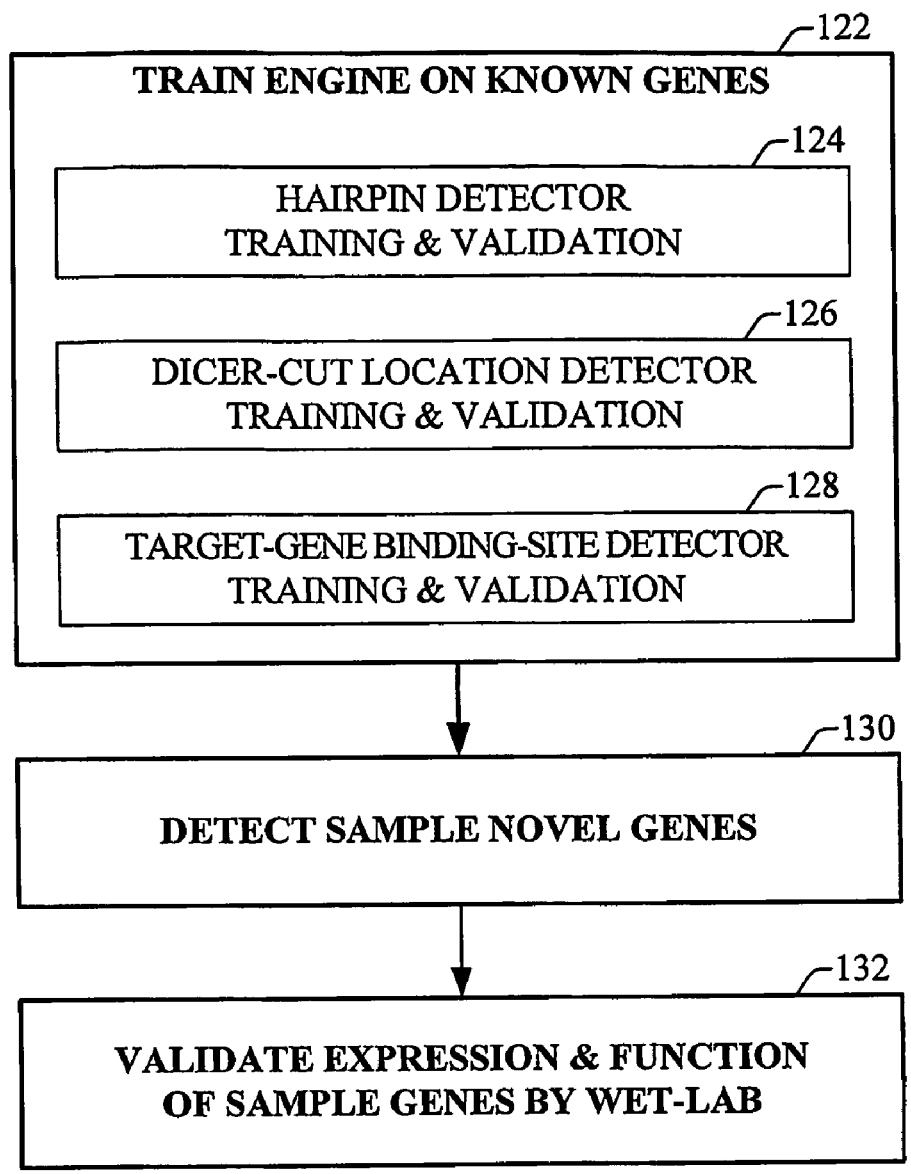

FIG. 21

| Detection Accuracy Group | Number of Published MIRs | Lab Validation | | | Novel GAMs of Present Invention | Hairpins in RNA Database | |
|---|---|---|---|---|---|---|---|
| | | Sent | Positive | % success | | Number | Expected |
| A | 82 | 10 | 5 | 50% | 562 | 564 | 282 |
| B | 146 | 91 | 32 | 35% | 526 | 813 | 285 |
| C | 38 | 30 | 9 | 30% | 625 | 2080 | 624 |
| D | 78 | 16 | 4 | 25% | 3034 | 11512 | 2878 |
| Overall | 344 | 147 | 50 | 34% | 4747 | 14969 | 4069 |

FIG. 24A

EST72223 (705 nt.)

EST72223 sequence:

CCCTTATTAGAGGATTCTGCTCATGCCAGG**GTGAGGTAGTAAGTTGTATTG
TTGTGGGGTAGGGATATTAGGCCCCAATTAGAAGATAACTATACAACT** MIR98
TACTACTTTCCCTGGTGTGTGGCATATTCACACTTAGTCTTAGCAGTGTTGCC
TCCATCAGACAAAGTTGTAGATGTTCCTTGGATAATTTGGACTGGAAGAAAAGA
GACATGGAAGGGGACAGATGGTGTTTAGGGTGAGGCAGATGTCATTATAAAGT
GACTTGTCTTTCATTAATTGGAGCATATAATTATTTTACCTTTGGGCATGAACTC
ATTTTGCTATTCTTCAACTGTGTAATGATTGCATTTTATTAGTAATAGAACAGGA
ATGTGTGCAAGGGAATGGAAAGCATACTTTAAGAATTTTGGGCCAGGCGCGGT
GGTTCATGCCTGTAATCCCAGCATTTTTGGGAGGCCGAGGCGGGTGGATCAC
CTGAGGTCAGGAGTTCGAGACCAACCTGGCCAACACGGCGAAACCCCGCCTC
TACTCAAATACAAAAATTAGCCAGGCTTGGTGACACTCGCCTGTGGTCCCAGC
TACTCAGGAGGCTGAGGCAGGAGAATTGCTTGAACCCAGGAAGTGGAG GAM25
**GCTTCAGTGAGCTGAGAACACGCCACTGCACTCCAGTCCTGGGCAAC
AGAGCAAGACTCTGTCTC**AGGAAAAAAAAAG

MICRORNA-RELATED NUCLEIC ACIDS AND USES THEREOF

CROSS-REFERENCE TO RELATED APPLICATIONS

This is the national stage of International Application. No. PCT/IL03/00970, filed Nov. 16, 2003, which is a continuation-in-part of U.S. patent application Ser. Nos. 10/604,727, filed Aug. 13, 2003; 10/604,985, filed Aug. 29, 2003; 10/604,926, filed Aug. 27, 2003; 10/605,923, filed Nov. 6, 2003; and 10/605,924, filed Nov. 6, 2003. U.S. patent application Ser. No. 10/604,727 is a continuation of U.S. patent application Ser. No. 10/604,726, filed Aug. 13, 2003, which is a continuation of U.S. patent application Ser. No. 10/293,338, filed Nov. 14, 2002. U.S. patent application Ser. No. 10/604,985 claims the benefit of U.S. Provisional Application Ser. No. 60/468,251, filed May 7, 2003. U.S. patent application Ser. No. 10/604,926 is a continuation of U.S. patent application Ser. No. 10/345,201, filed Jan. 16, 2003. U.S. patent application Ser. No. 10/605,923 is a continuation of U.S. patent application Ser. No. 10/649,653, filed Aug. 28, 2003, which is a continuation of U.S. patent application Ser. No. 10/321,503, filed Dec. 18, 2002. U.S. patent application Ser. No. 10/605,924 is a continuation of U.S. patent application Ser. No. 10/651,227, filed Aug. 29, 2003, which is a continuation of U.S. patent application Ser. No. 10/310,914, filed Dec. 6, 2002 and issued as U.S. Pat. No. 7,250,496 on Jul. 31, 2007. The contents of the aforementioned applications are incorporated herein by reference.

FIELD OF THE INVENTION

The present invention relates to a group of bioinformatically detectable novel genes, here identified as Genomic Address Messenger or GAM genes, which are believed to be related to the micro RNA (miRNA) group of genes.

BACKGROUND OF THE INVENTION

MIR genes are regulatory genes encoding MicroRNA's (miRNA), short ~22 nt non-coding RNA's, found in a wide range of species, believed to function as specific gene translation repressors, sometimes involved in cell-differentiation. Some 110 human MIR genes have been detected by laboratory means. Over the past 6 months, the need for computerized detection of MIR genes has been recognized, and several informatic detection engines have been reported (Lim, 2003; Grad, 2003; Lai, 2003). Collectively these informatic detection engines found 38 more human MIR genes which were later confirmed in zebrafish, 14 human MIRs which were confirmed in human, and 55 postulated human MIRs which could not be confirmed by laboratory (Lim, 2003). Extensive efforts to identify novel MIR genes using conventional biological detection techniques such as massive cloning and sequencing efforts, and several bioinformatic detection attempts, have led leading researchers in the field to the conclusion that the total number of human MIR genes is between 200 to 255 (Lau, 2003; Lim 2003 Science; Lim, 2003 Genes Dev). Recent studies postulate that the number of MIR genes may be higher (Grad, 2003; Krichevsky, 2003).

The ability to detect novel MIR genes is limited by the methodologies used to detect such genes. All MIR genes identified so far either present a visibly discernable whole body phenotype, as do Lin-4 and Let-7 (Wightman, 1993; Reinhart, 2000), or produce sufficient quantities of RNA so as to be detected by the standard molecular biological techniques.

Initial studies reporting MIR genes (Bartel, 2001; Tuschl, 2001) discovered 93 MIR genes in several species, by sequencing a limited number of clones (300 by Bartel and 100 by Tuschl) of small segments (i.e. size fractionated) RNA. MiRNA encoded by MIR genes detected in these studies therefore, represent the more prevalent among the miRNA gene family, and can not be much rarer than 1% of all small ~20 nt-long RNA segments.

Current methodology has therefore been unable to detect micro RNA genes (MIR genes) which either do not present a visually discernable whole body phenotype, or are rare (e.g. rarer than 0.1% of all size fractionated ~20 nt-long RNA segments expressed in the tissues examined), and therefore do not produce significant enough quantities of RNA so as to be detected by standard biological techniques.

BRIEF DESCRIPTION OF SEQUENCE LISTING, LARGE TABLES AND COMPUTER PROGRAM LISTING

Sequence listing, large tables related to sequence listing, and computer program listing are filed under section 801 (a)(i) on an electronic medium in computer readable form, attached to the present invention, and are hereby incorporated by reference. Said sequence listing, large tables related to sequence listing, and computer program listing are submitted on a CD-ROM (Operating system: MS-Windows), entitled SEQUENCE LISTING AND LARGE TABLES, containing files the names and sizes of which are as follows:

A sequence listing comprising 548,185 genomic sequences, is filed herewith on electronic medium in computer readable form, attached to the present invention, and is hereby incorporated by reference. Said sequence listing is contained in the file named "Patent12_Human_PCT_PatentIn_2.txt" (79,123 KB), which was created on Dec. 31, 2008.

Large tables relating to genomic sequences are stored in 7 self extracting files, each comprising a respective one of the following table files: TABLE1.TXT (839 KB); TABLE2.TXT (4348 KB); TABLE3.TXT (715 KB); TABLE4.TXT (545728 KB); TABLE5.TXT (1523981 KB); TABLE6.TXT (373091 KB); and TABLE7.TXT (125 KB).

Computer program listing of a computer program constructed and operative in accordance with a preferred embodiment of the present invention is enclosed on an electronic medium in computer readable form, and is hereby incorporated by reference. The computer program listing is contained in a self extracting compressed file named COMPUTER PROGRAM LISTING.EXE (168 KB). Compressed file contains 5 files, the name and sizes of which are as follows: AUXILARY_FILES.TXT (117K); BINDING_SITE_SCORING.TXT (17K); EDIT_DISTANCE.TXT (144K); FIRST-K.TXT (96K); HAIRPIN_PREDICTIO.TXT (47K); and TWO_PHASED_PREDICTOR.TXT (74K).

SUMMARY OF THE INVENTION

The present invention relates to a novel group of regulatory, non-protein coding genes, which are functional in specifically inhibiting translation of target proteins. Each gene in this novel group of genes, here identified as GAM or Genomic Address Messengers, specifically inhibits translation of one of more other 'target' genes by means of complementary hybridization of a segment of the RNA transcript encoded by GAM, to an inhibitor site located in an untranslated region (UTR) of the mRNA of the one or more 'target' genes.

In various preferred embodiments, the present invention seeks to provide improved method and system for specific modulation of expression of specific known 'target' genes involved in significant human diseases, and improved method and system for detection of expression of novel genes of the present invention, which modulate these target genes.

Accordingly, the invention provides several substantially pure DNAs (e.g., genomic DNA, cDNA or synthetic DNA) each encoding a novel gene of the GAM group of gene, vectors comprising the DNAs, probes comprising the DNAs, a method and system for selectively modulating translation of known 'target' genes utilizing the vectors, and a method and system for detecting expression of known 'target' genes utilizing the probe.

By "substantially pure DNA" is meant DNA that is free of the genes which, in the naturally-occurring genome of the organism from which the DNA of the invention is derived, flank the genes discovered and isolated by the present invention. The term therefore includes, for example, a recombinant DNA which is incorporated into a vector, into an autonomously replicating plasmid or virus, or into the genomic DNA of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant DNA which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibitor site" is defined as the minimal DNA sequence sufficient to inhibit translation.

There is thus provided in accordance with a preferred embodiment of the present invention a bioinformatically detectable novel gene encoding substantially pure DNA wherein RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial or accurate inversed reversed sequence of a nucleotide sequence of a second half thereof, a nucleotide sequence of the RNA encoded by the novel gene is a partial or accurate inversed reversed sequence of a nucleotide sequence of a binding site associated with at least one target gene, the novel gene cannot be detected by either of the following: a visually discernable whole body phenotype, and detection of 99.9% of RNA species shorter than 25 nucleotides expressed in a tissue sample, and a function of the novel gene is bioinformatically deducible.

There is still further provided in accordance with another preferred embodiment of the present invention a bioinformatically detectable novel gene encoding substantially pure DNA wherein RNA encoded by the bioinformatically detectable novel gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel gene is a partial or accurate inversed reversed sequence of nucleotide sequence of a second half thereof, a nucleotide sequence of each of the RNA segments encoded by the novel gene is a partial or accurate inversed reversed sequence of the nucleotide sequence of a binding site associated with at least one target gene, and a function of the novel gene is bioinformatically deducible from the following data elements: the nucleotide sequence of the RNA encoded by the novel gene, a nucleotide sequence of the at least one target gene, and function of the at least one target gene.

There is additionally provided in accordance with another preferred embodiment of the present invention a bioinformatically detectable novel gene encoding substantially pure DNA wherein RNA encoded by the bioinformatically detectable novel gene is about 18 to about 24 nucleotides in length, and originates from an RNA precursor, which RNA precursor is about 50 to about 120 nucleotides in length, a nucleotide sequence of a first half of the RNA precursor is a partial or accurate inversed reversed sequence of a nucleotide sequence of a second half thereof, a nucleotide sequence of the RNA encoded by the novel gene is a partial or accurate inversed reversed sequence of a nucleotide sequence of a binding site associated with at least one target gene, a function of the novel gene is modulation of expression of the at least one target gene, and the at least one target gene does not encode a protein.

There is moreover provided in accordance with another preferred embodiment of the present invention a bioinformatically detectable novel gene encoding substantially pure DNA wherein the bioinformatically detectable novel gene does not encode a protein, RNA encoded by the bioinformatically detectable novel gene is maternally transferred by a cell to at least one daughter cell of the cell, a function of the novel gene includes modulation of a cell type of the daughter cell, and the modulation is bioinformatically deducible.

There is further provided in accordance with another preferred embodiment of the present invention a bioinformatically detectable novel gene encoding substantially pure DNA wherein the bioinformatically detectable novel gene does not encode a protein, a function of the novel gene is promotion of expression of the at lease one target gene, and the at least one target gene is bioinformatically deducible.

Still further in accordance with a preferred embodiment of the present invention the function of the novel gene is bioinformatically deducible from the following data elements: the nucleotide sequence of the RNA encoded by the bioinformatically detectable novel gene, a nucleotide sequence of the at least one target gene, and a function of the at least one target gene.

Additionally in accordance with a preferred embodiment of the present invention the RNA encoded by the novel gene complementarily binds the binding site associated with the at least one target gene, thereby modulating expression of the at least one target gene.

Moreover in accordance with a preferred embodiment of the present invention the binding site associated with at least one target gene is located in an untranslated region of RNA encoded by the at least one target gene.

Further in accordance with a preferred embodiment of the present invention the function of the novel gene is selective inhibition of translation of the at least one target gene, which selective inhibition includes complementary hybridization of the RNA encoded by the novel gene to the binding site.

Still further in accordance with a preferred embodiment of the present invention, the present invention includes a vector including the DNA Additionally in accordance with a preferred embodiment of the present invention, the present invention includes a method of selectively inhibiting translation of at least one gene, including introducing the vector into a cell.

Moreover in accordance with a preferred embodiment of the present invention the introducing includes utilizing RNAi pathway.

Further in accordance with a preferred embodiment of the present invention, the present invention includes a gene expression inhibition system including: the vector and a vector inserter, functional to insert the vector of claim 10 into a cell, thereby selectively inhibiting translation of at least one gene.

Still further in accordance with a preferred embodiment of the present invention, the present invention includes a probe including the DNA Additionally in accordance with a preferred embodiment of the present invention, the present invention includes a method of selectively detecting expression of at least one gene, including using the probe Moreover in accordance with a preferred embodiment of the present invention, the present invention includes a gene expression detection system including: the probe, and a gene expression detector functional to selectively detect expression of at least one gene.

BRIEF DESCRIPTION OF DRAWINGS

FIGS. 2, 3, and 4 are schematic diagrams which when taken together provide an analogy that illustrates a conceptual model of the present invention, addressing the genomic differentiation engine. FIG. 2B depicts an analogy for differential gene expression between cells.

FIGS. 5A and 5B are schematic diagrams, which when taken together illustrate a 'genomic records' concept of the conceptual model of the present invention, addressing the genomic differentiation enigma;

FIG. 10 is a simplified flowchart illustrating operation of a mechanism for training of a computer system to recognize the novel genes of the present invention, which mechanism is constructed and operative in accordance with a preferred embodiment of the present invention;

FIG. 21 is a table summarizing laboratory validation results which validate efficacy of a bioinformatic gene detection system constructed and operative in accordance with a preferred embodiment of the present invention;

FIG. 24A is an annotated sequence of EST72223 (SEQ ID NO: 548181) comprising known miRNA gene MIR98 and novel gene GAM25, both detected by the gene detection system of the present invention. The sequence of EST 72223 includes the four marked sequences: The sequence of the miRNA-98 hairpin in bold (SEQ ID NO: 548182), the sequence of the mature miRNA-98 in bold and underlined (SEQ ID NO: 548183), the sequence of the GAM25 hairpin in bold (SEQ ID NO: 548184) and the sequence of the mature miRNA of GAM25 in bold and underlined (SEQ ID NO: 548185).

DETAILED DESCRIPTION OF DRAWINGS

Figure 1:
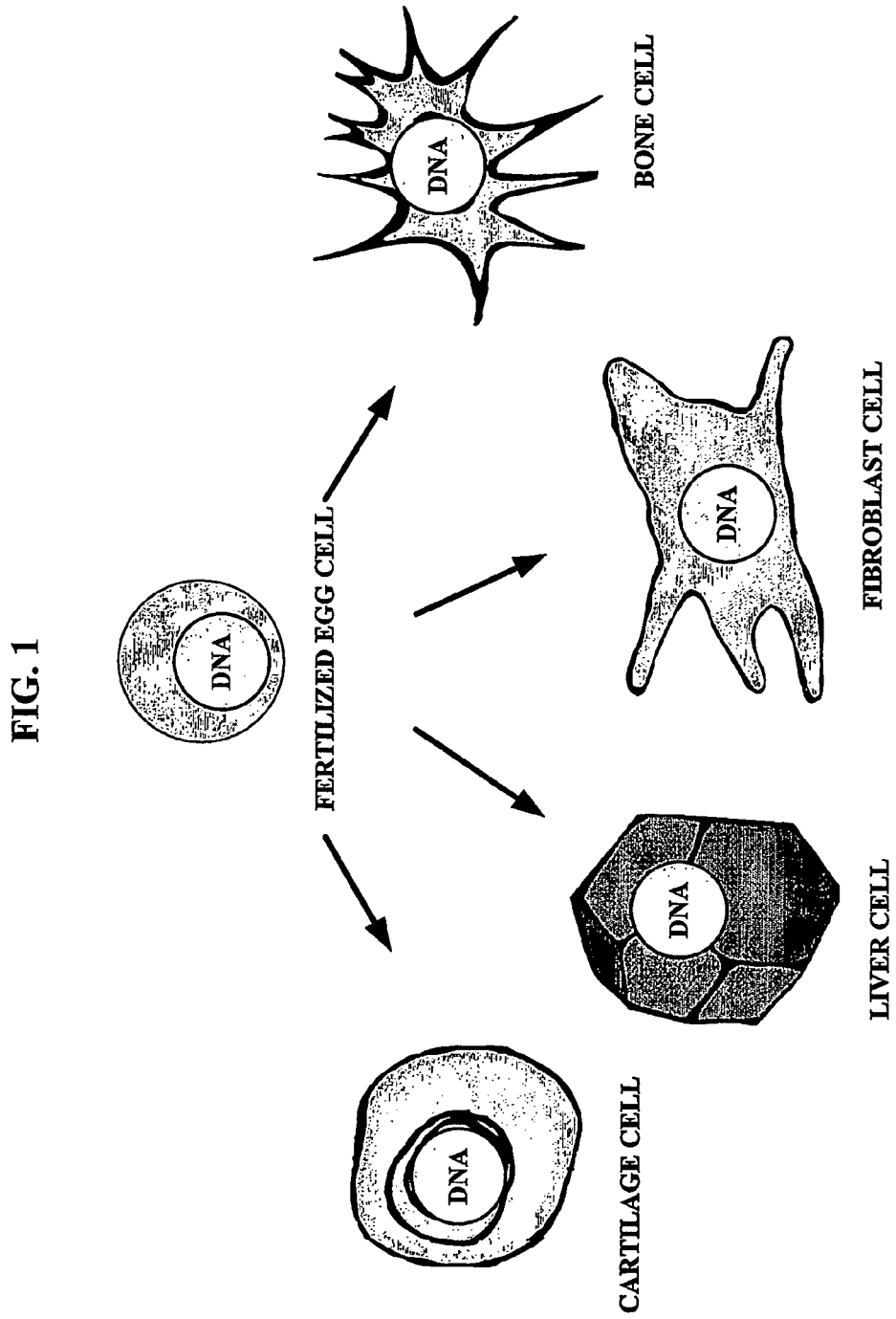
FIG. 1 is a simplified diagram illustrating the genomic differentiation enigma that the present invention addresses.

Reference is now made to FIG. 1 which is a simplified diagram providing a conceptual explanation of a genomic differentiation enigma, which the present invention addresses.

FIG. 1 depicts different cell types in an organism, such as CARTILAGE CELL, LIVER CELL, FIBROBLAST CELL and BONE CELL all containing identical DNA, and deriving from the initial FERTILIZED EGG CELL, and yet each of these cells expressing different proteins, and hence acquiring different shape and function.

The present invention proposes that the inevitable conclusion from this constraint is, however, strikingly simple: the coding system used must be modular. It must comprise multiple modules, or records, one for each cell-type, and a mechanism whereby each cell at its inception is instructed which record to open, and behaves according to instructions in that record.

This modular code concept is somewhat difficult to grasp, since we are strongly habituated to viewing things from an external viewpoint. An architect, for example, looks at a blueprint of a building, which details exactly where each element (block, window, door, electrical switch, etc.) is to be placed relative to all other elements, and then instructs builders to place these elements in their designated places. This is an external viewpoint: the architect is external to the blueprint, which itself is external to the physical building, and its different elements. The architect may therefore act as an 'external organizing agent': seeing the full picture and the relationships between all elements, and being able to instruct from the outside where to place each of them.

Genomics differentiation coding evidently works differently, without any such external organizing agent: It comprises only one smart block (the first cell), which is the architect and the blueprint, and which continuously duplicates itself, somehow knowing when to manifest itself as a block and when as a window, door, or electrical switch.

Figure 2A:
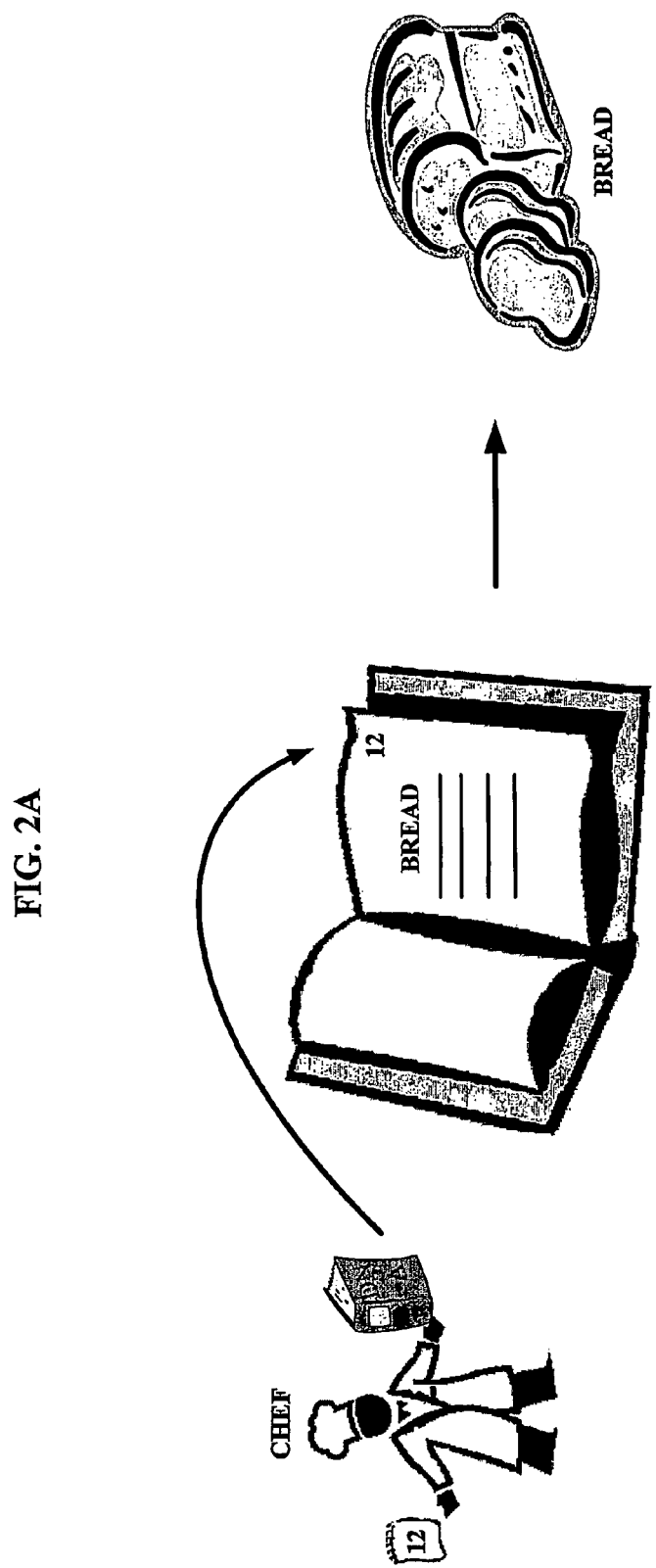
FIG. 2A depicts an analogy for gene expression.
Figure 3:
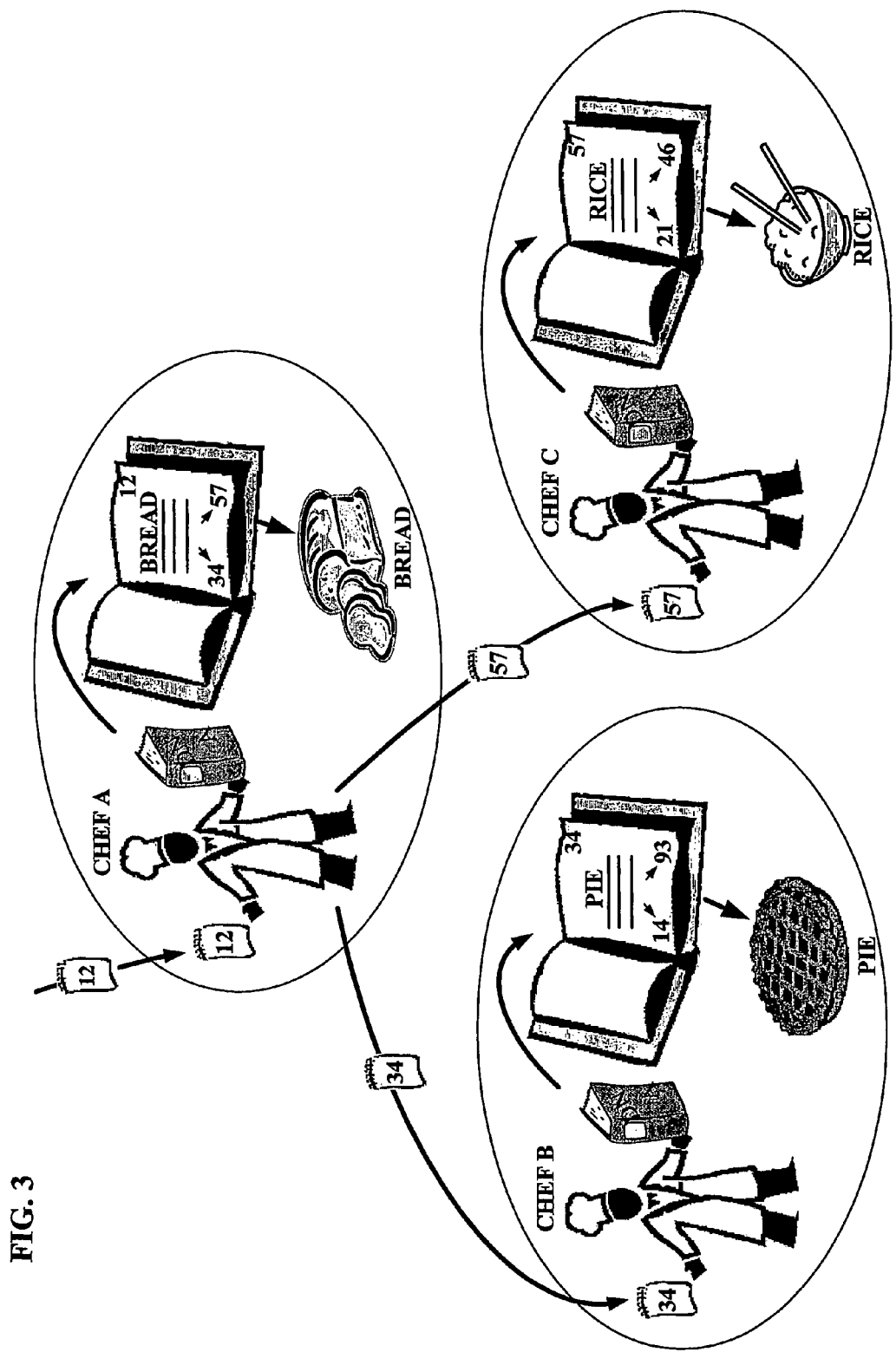
Figure 4:
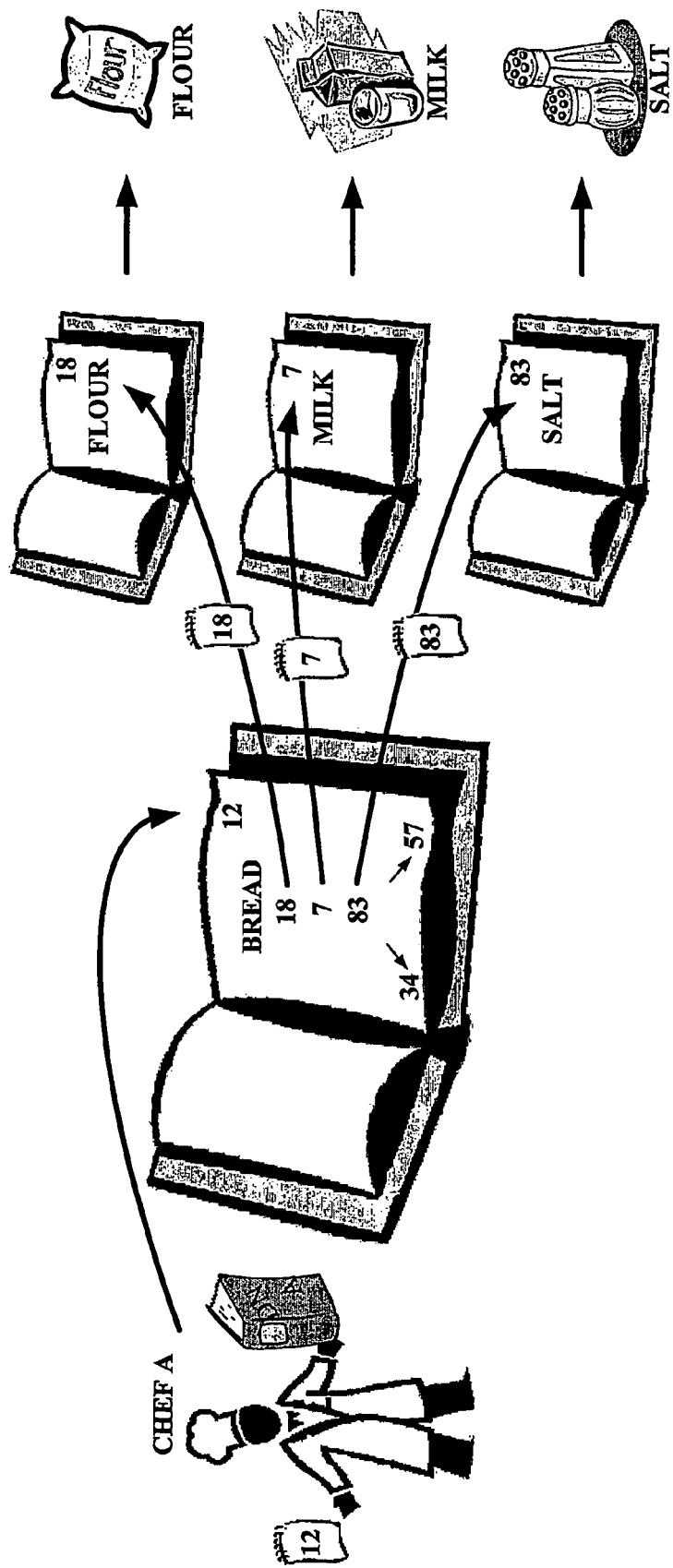

Reference is now made to FIGS. 2 through 4 which are schematic diagrams which when taken together provide an analogy that illustrates a conceptual model of the present invention, addressing the genomic differentiation enigma.

Reference is now made to FIG. 2A. Imagine a very talented chef, capable of preparing any meal provided he is given specific written cooking instructions. This chef is equipped with two items: (a) a thick recipe book, and (b) a small note with a number scribbled on it. The book comprises multiple pages, each page detailing how to prepare a specific meal. The small note indicates the page to be opened, and therefore the meal to be prepared. The chef looks at the page-number written on the note, opens the recipe book at the appropriate page, and prepares the meal according to the written instructions on this page. As an example, FIG. 2A depicts a CHEF holding a note with the number 12 written on it, he opens the book on page 12, and since that page contains the recipe for preparing BREAD, the CHEF prepares a loaf of BREAD.

Reference is now made to FIG. 2B, which depicts two identical chefs, CHEF A and CHEF B, holding an identical recipe book. Despite their identity, and the identity of their recipe book, since CHEF A holds a note numbered 12, and therefore opens the book on page 12 and prepares BREAD, whereas CHEF B holds a note numbered 34 and therefore opens the book on page 34 and prepares a PIE.

Reference is now made to FIG. 3. Imagine the chef of the analogy is also capable of duplicating himself once he has finished preparing the specified meal. The format of the book is such that at the bottom of each page, two numbers are written. When he has finished preparing the meal specified on that page, the chef is trained to do the following: (i) divide himself into two identical duplicate chefs, (ii) duplicate the recipe book and hand a copy to each of his duplicate chefs, and (iii) write down the two numbers found at the bottom of the page of the meal he prepared, on two small notes, handing one note to each of his two duplicate chefs.

Each of the two resulting duplicate chefs are now equipped with the same book, and have the same talent to prepare any meal, but since each of them received a different note, they will now prepare different meals.

FIG. 3 depicts CHEF A holding a recipe book and receiving a note numbered 12. CHEF A therefore opens the book on page 12 and prepares BREAD. When he is finished making bread, CHEF A performs the following actions: (i) divides himself into two duplicate chefs, designated CHEF B and CHEF C, (ii) duplicates his recipe book handing a copy to each of CHEF B and CHEF C, (iii) writes down the numbers found at the bottom of page 12, numbers 34 and 57, on two notes, handing note numbered 34 to CHEF B and note numbered 57 to CHEF C.

Accordingly, CHEF B receives a note numbered 34 and therefore opens the recipe book on page 34 and prepares PIE, whereas CHEF C receives a note numbered 57 and therefore opens the book on page 57 and therefore prepares RICE.

It is appreciated that while CHEF A, CHEF B & CHEF C are identical and hold identical recipe books, they each prepare a different meal. It is also appreciated that the meals prepared by CHEF B and CHEF C are determined CHEF A, and are mediated by the differently numbered notes passed on from CHEF A to CHEF B and CHEF C.

It is further appreciated that the mechanism illustrated by FIG. 3 enables an unlimited lineage of chefs to divide into duplicate, identical chefs and to determine the meals those duplicate chefs would prepare. For example, having been directed to page 34, when CHEF B divides into duplicate chefs (not shown), he will instruct its two duplicate chefs to prepare meals specified on pages 14 and 93 respectively, according to the numbers at the bottom of page 34 to which he was directed. Similarly, CHEF C will instruct its duplicate chefs to prepare meals specified on pages 21 and 46 respectively, etc.

Reference is now made to FIG. 4. Imagine that the cooking instructions on each page of the recipe book are written in shorthand format: The main meal-page to which the chef was directed by the scribbled note, merely contains a list of numbers which direct him to multiple successive pages, each specifying how to prepare an ingredient of that meal.

As an example, FIG. 4 depicts CHEF A of FIGS. 2 and 3, holding a recipe book and a note numbered 12. Accordingly, CHEF A opens the recipe book on page 12, which details the instructions for preparing BREAD. However, the 'instructions' on making BREAD found on page 12 comprise only of 3 numbers, 18, 7 and 83, which 'refer' CHEF A to pages detailing preparation of the ingredients of BREAD—FLOUR, MILK and SALT, respectively.

As illustrated in FIG. 4, turning from the main 'meal page' (e.g. 12) to respective 'ingredients pages' (e.g. pages 18, 7 & 83) is mediated by scribbled notes with the page-numbers written on them. In this analogy, the scribbled notes are required for seeking the target pages to be turned to—both when turning to main 'meal pages' (e.g. page 12), as well as when turning to 'ingredient pages' (e.g. pages 18, 7 & 83).

The chef in the given analogy, schematically depicted in FIGS. 2 through 4, represents a cell; the thick recipe book represents the DNA; preparing a meal in the given analogy represents the cell manifesting itself as a specific cell-type; and ingredients of a meal represent proteins expressed by that cell-type. Like the chef equipped with the thick recipe book in the given analogy, all cells in an organism contain the same DNA and are therefore each potentially capable of manifesting itself as any cell-type, expressing proteins typical of that cell type.

Figure 5A:
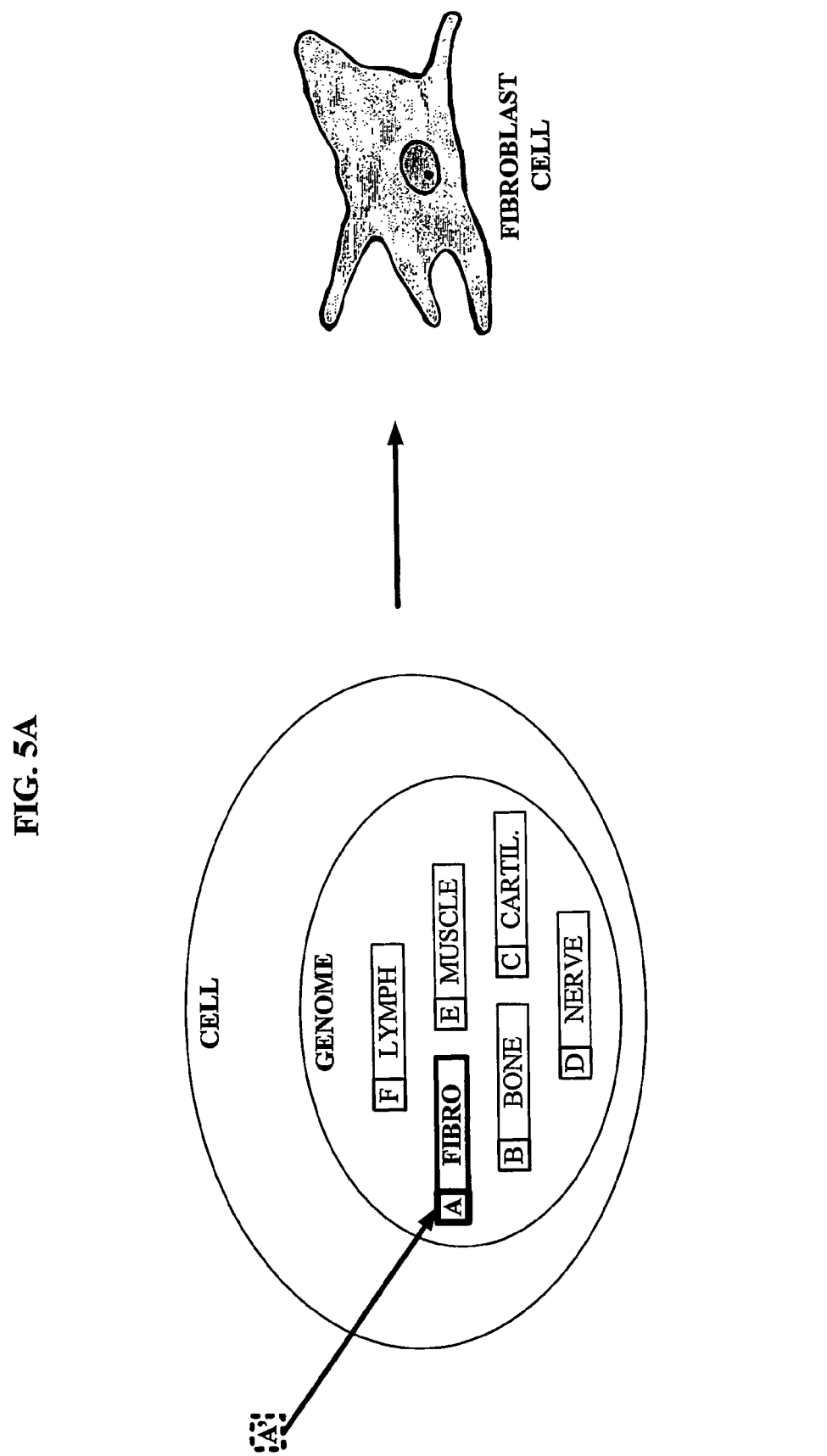

Reference is now made to FIGS. 5A and 5B which are schematic diagrams, which when taken together illustrate a 'genomic records' concept of the conceptual model of the present invention, addressing the genomic differentiation enigma.

The Genomic Records concept asserts that the DNA (the thick recipe book in the illustration) comprises a very large number of Genomic Records (analogous to pages in the recipe book), each containing the instructions for differentiation of a different cell-type, or developmental process. Each Genomic Record is headed by a very short genomic sequence which functions as a 'Genomic Address' of that Genomic Record (analogous to the page number in the recipe book). At its inception, in addition to the DNA, each cell also receives a short RNA segment (the scribbled note in the illustration). This short RNA segment binds complementarily to a 'Genomic Address' sequence of one of the Genomic Records, thereby activating that Genomic Record, and accordingly determining the cell's-fate (analogous to opening the book on the page corresponding to the number on the scribbled note, thereby determining the meal to be prepared).

Reference is now made to FIG. 5A. FIG. 5A illustrates a CELL which comprises a GENOME. The GENOME comprises a plurality of GENOMIC RECORDS, each of which correlates to a specific cell type (for clarity only 6 sample genomic records are shown). Each genomic record comprises genomic instructions on differentiation into a specific cell-type, as further elaborated below with reference to FIG. 7. At cell inception, the CELL receives a maternal short RNA segment, which activates one of the GENOMIC RECORDS, causing the cell to differentiate according to the instructions comprised in that genomic record. As an example, FIG. 5A illustrates reception of a maternal short RNA segment designated A' and outlined by a broken line, which activates the FIBRO genomic record, causing the cell to differentiate into a FIBROBLAST CELL.

Reference is now made to FIG. 5B, which is a simplified schematic diagram, illustrating cellular differentiation mediated by the 'Genomic Records' concept. FIG. 5B depicts 2 cells in an organism, designated CELL A and CELL B, each having a GENOME. It is appreciated that since CELL A and CELL B are cells in the same organism, the GENOME of CELL A is identical to that of CELL B. Despite having an identical GENOME, CELL A differentiates differently from CELL B, due to activation of different genomic records in these two cells. In CELL A the FIBRO GENOMIC RECORD is activated, causing CELL A to differentiate into a FIBROBLAST CELL, whereas in CELL B the BONE GENOMIC RECORD is activated, causing the CELL B to differentiate into a BONE CELL. The cause for activation of different genomic records in these two cells is the different maternal short RNA which they both received: CELL A received a maternal short RNA segment designated A' which activated genomic record FIBRO, whereas CELL B received a maternal short RNA segment designated B' which activated genomic record BONE.

Figure 6:
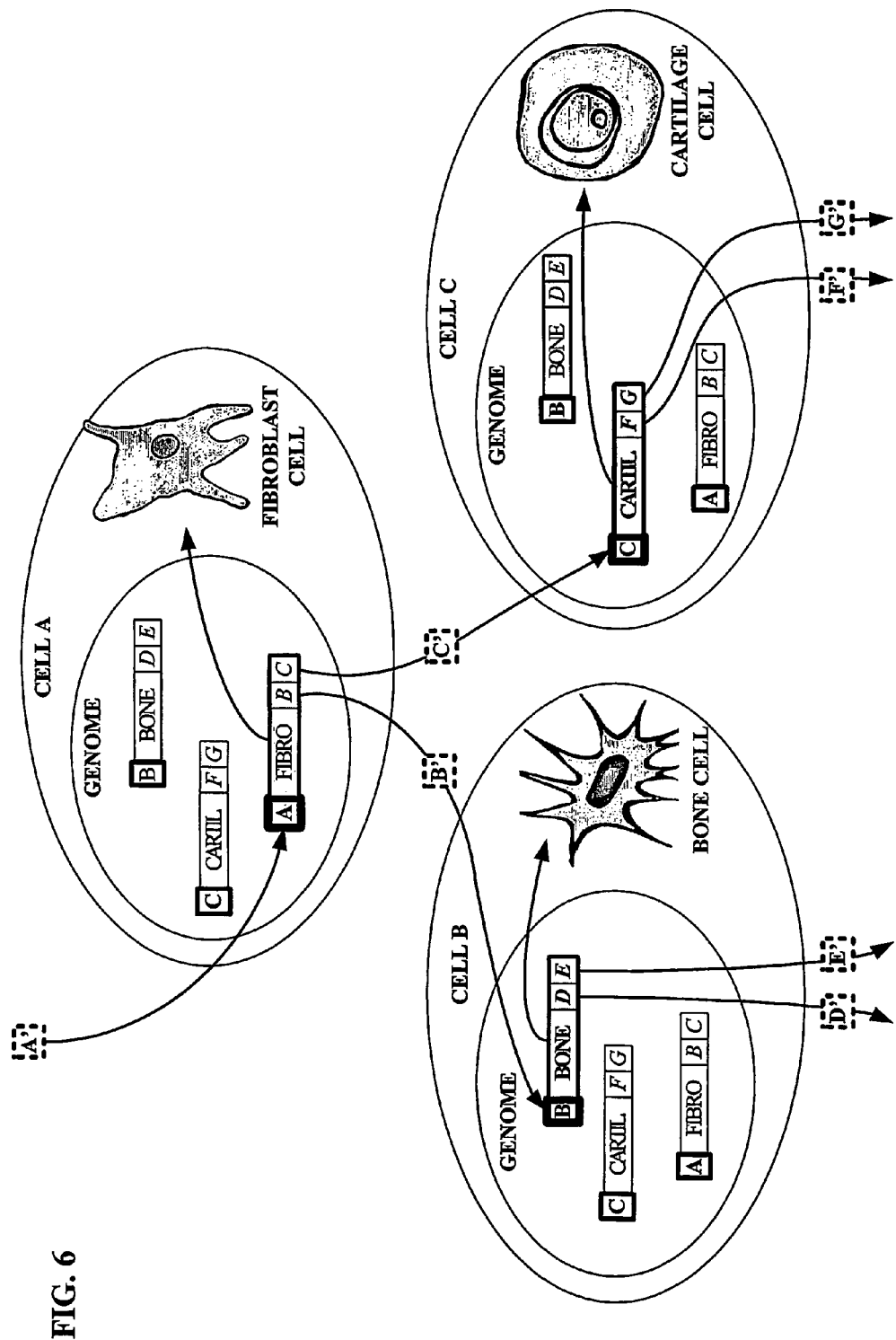
FIG. 6 is a schematic diagram illustrating a 'genomically programmed cell differentiation' concept of the conceptual model of the present invention, addressing the genomic differentiation enigma.

Reference is now made to FIG. 6 which is a schematic diagram illustrating a 'genomically programmed cell differentiation' concept of the conceptual model of the present invention, addressing the genomic differentiation enigma.

A cell designated CELL A divides into 2 cells designated CELL B and CELL C. CELL A, CELL B and CELL C each comprise a GENOME, which GENOME comprises a plurality of GENOMIC RECORDS. It is appreciated that since CELL A, CELL B and CELL C are cells in the same organism, the GENOME of these cells, and the GENOMIC RECORDS comprised therein, are identical.

As described above with reference to FIG. 5B, at its inception, CELL A receives a maternal short RNA segment, designated A' and marked by a broken line, which activates the FIBRO genomic record, thereby causing CELL A to differentiate into a FIBROBLAST CELL. However, FIG. 6 shows further details of the genomic records: each cell genomic record also comprises two short genomic sequences, referred to here as Daughter Cell Genomic Addresses. Blocks designated B and C are Daughter Cell Genomic Addresses of the FIBRO Genomic Record. At cell division, each parent cell transcribes two short RNA segments, corresponding to the two Daughter Cell Genomic Addresses of the Genomic Record of that parent cell, and transfers one to each of its two daughter cells. CELL A of FIG. 6 transcribes and transfers to its two respective daughter cells, two short RNA segments, outlined by a broken line and designated B' and C', corresponding to daughter cell genomic addresses designated B and C comprised in the FIBRO genomic record.

CELL B therefore receives the above mentioned maternal short RNA segment designated B', which binds complementarily to genomic address designated B of genomic record BONE, thereby activating this genomic record, which in turn causes CELL B to differentiate into a BONE CELL. Similarly, CELL C receives the above mentioned maternal short RNA segment designated C', which binds complementarily to genomic address designated C of genomic record CARTIL., thereby activating this genomic record, which in turn causes CELL C to differentiate into a CARTILAGE CELL.

It is appreciated that the mechanism illustrated by FIG. 6 enables an unlimited lineage of cells to divide into daughter cells containing the same DNA, and to determine the cell-fate of these daughter cells. For example, when CELL B and CELL C divide into their respective daughter cells (not shown), they will transfer short RNA segments designated D' & E', and F' & G' respectively, to their respective daughter cells. The cell fate of each of these daughter cells would be determined by the identity of the maternal short RNA segment they receive, which would determine the genomic record activated.

Figure 7:
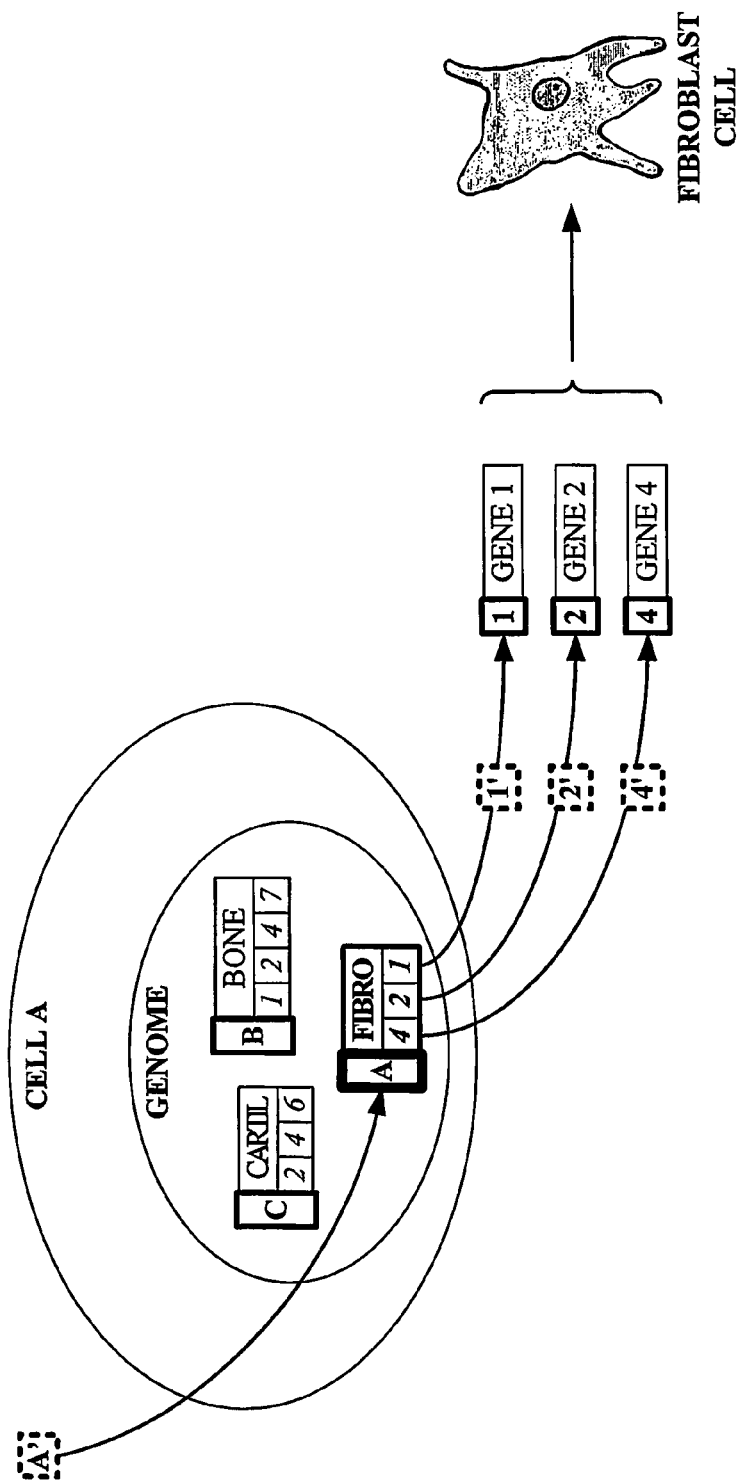
FIG. 7 is a schematic diagram illustrating a 'genomically programmed cell-specific protein expression modulation' concept of the conceptual model of the present invention, addressing the genomic differentiation enigma.

Reference is now made to FIG. 7 which is a schematic diagram illustrating a 'genomically programmed cell-specific protein expression modulation' concept of the conceptual model of the present invention, addressing the genomic differentiation enigma.

Cell A receives a maternal short RNA segment designated A', which activates a genomic record designated FIBRO, by anti-sense binding to a binding site 'header' of this genomic record, designated A. Genomic record FIBRO encodes 3 short RNA segments, designated 1, 2 and 4 respectively, which modulate expression of target genes designated GENE1, GENE2 and GENE4 respectively. Modulation of expression of these genes results in CELL A differentiating into a FIBROBLAST CELL.

Figure 8:
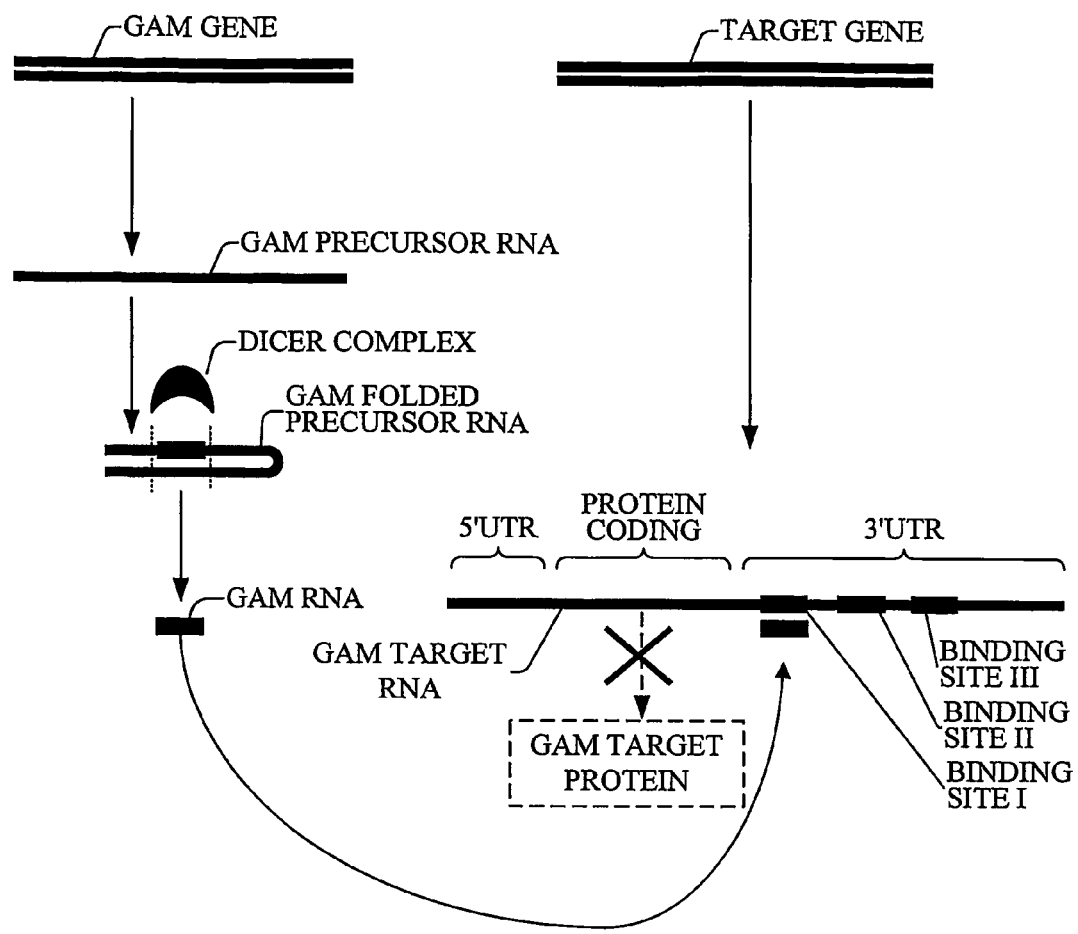
FIG. 8 is a simplified diagram illustrating a mode by which genes of a novel group of genes of the present invention, modulate expression of known target genes.

Reference is now made to FIG. 8, which is a simplified diagram describing each of a plurality of novel bioinformatically detected genes of the present invention, referred to here as Genomic Address Messenger (GAM) genes, which modulates expression of respective target genes thereof, the function and utility of which target genes is known in the art.

GAM is a novel bioinformatically detected regulatory, non protein coding, micro RNA (miRNA) gene. The method by which GAM is detected is described hereinabove with reference to FIGS. 8-15.

GAM GENE and GAM TARGET GENE are human genes contained in the human genome.

GAM GENE encodes a GAM PRECURSOR RNA. Similar to other miRNA genes, and unlike most ordinary genes, GAM PRECURSOR RNA does not encode a protein.

GAM PRECURSOR RNA folds onto itself, forming GAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurately or partially inversed reversed sequence of the nucleotide sequence of the second half thereof. By inversed reversed is meant a sequence which is reversed and wherein each nucleotide is replaced by a complementary nucleotide, as is well known in the art (e.g. ATGGC is the complementary sequence of GCCAT).

An enzyme complex designated DICER COMPLEX 'dices' the GAM FOLDED PRECURSOR RNA into GAM RNA, a single stranded ~22 nt long RNA segment. As is known in the art, 'dicing' of a hairpin structured RNA precursor product into a short ~22 nt RNA segment is catalyzed by an enzyme complex comprising an enzyme called Dicer together with other necessary proteins.

TARGET GENE encodes a corresponding messenger RNA, GAM TARGET RNA. GAM TARGET RNA comprises three regions, as is typical of mRNA of a protein coding gene: a 5' untranslated region, a protein coding region and a 3' untranslated region, designated 5'UTR, PROTEIN CODING and 3'UTR respectively.

GAM RNA binds complementarily to one or more target binding sites located in untranslated regions of GAM TARGET RNA. This complementary binding is due to the fact that the nucleotide sequence of GAM RNA is a partial or accurate inversed reversed sequence of the nucleotide sequence of each of the target binding sites. As an illustration, FIG. 8 shows three such target binding sites, designated BINDING SITE I, BINDING SITE II and BINDING SITE III respectively. It is appreciated that the number of target binding sites shown in FIG. 8 is meant as an illustration only, and is not meant to be limiting GAM RNA may have a different number of target binding sites in untranslated regions of a GAM TARGET RNA. It is further appreciated that while FIG. 8 depicts target binding sites in the 3'UTR region, this is meant as an example only, these target binding sites may be located in the 3'UTR region, the 5'UTR region, or in both 3'UTR and 5'UTR regions.

The complementary binding of GAM RNA to target binding sites on GAM TARGET RNA, such as BINDING SITE I, BINDING SITE II and BINDING SITE III, inhibits translation of GAM TARGET RNA into GAM TARGET PROTEIN. GAM TARGET PROTEIN is therefore outlined by a broken line.

It is appreciated that GAM TARGET GENE in fact represents a plurality of GAM target genes. The mRNA of each one of this plurality of GAM target genes comprises one or more target binding sites, each having a nucleotide sequence which is at least partly complementary to GAM RNA, and which when bound by GAM RNA causes inhibition of translation of respective one or more GAM target proteins.

It is further appreciated by one skilled in the art that the mode of translational inhibition illustrated by FIG. 8 with specific reference to translational inhibition exerted by GAM GENE on one or more TARGET GENE, is in fact common to other known miRNA genes, as is well known in the art.

Nucleotide sequences of each of a plurality of GAM GENEs described by FIG. 8 and their respective genomic source and chromosomal location are further described hereinbelow with reference to Table 1, hereby incorporated by reference.

Nucleotide sequences of GAM PRECURSOR RNA, and a schematic representation of a predicted secondary folding of GAM FOLDED PRECURSOR RNA, of each of a plurality of GAM GENEs described by FIG. 8 are further described hereinbelow with reference to Table 2, hereby incorporated by reference.

Nucleotide sequences of a 'diced' GAM RNA of each of a plurality of GAM GENEs described by FIG. 8 are further described hereinbelow with reference to Table 3, hereby incorporated by reference.

Nucleotide sequences of target binding sites, such as BINDING SITE-I, BINDING SITE-II and BINDING SITE-III of FIG. 8, found on GAM TARGET RNA, of each of a plurality of GAM GENEs described by FIG. 8, and schematic representation of the complementarity of each of these target binding sites to each of a plurality of GAM RNA described by FIG. 8 are described hereinbelow with reference to Table 4, hereby incorporated by reference.

It is appreciated that specific functions and accordingly utilities of each of a plurality of GAM GENEs described by FIG. 8 correlate with, and may be deduced from, the identity of the TARGET GENEs that each of said plurality of GAM GENEs binds and inhibits, and the function of each of said TARGET GENEs, as elaborated hereinbelow with reference to Table 5, hereby incorporated by reference.

Studies establishing known functions of each of a plurality of TARGET GENEs of GAM GENEs of FIG. 8, and correlation of said each of a plurality of TARGET GENEs to known diseases are listed in Table 6, and are hereby incorporated by reference.

The present invention discloses a novel group of genes, the GAM genes, belonging to the miRNA genes group, and for which a specific complementary binding has been determined.

Figure 9:
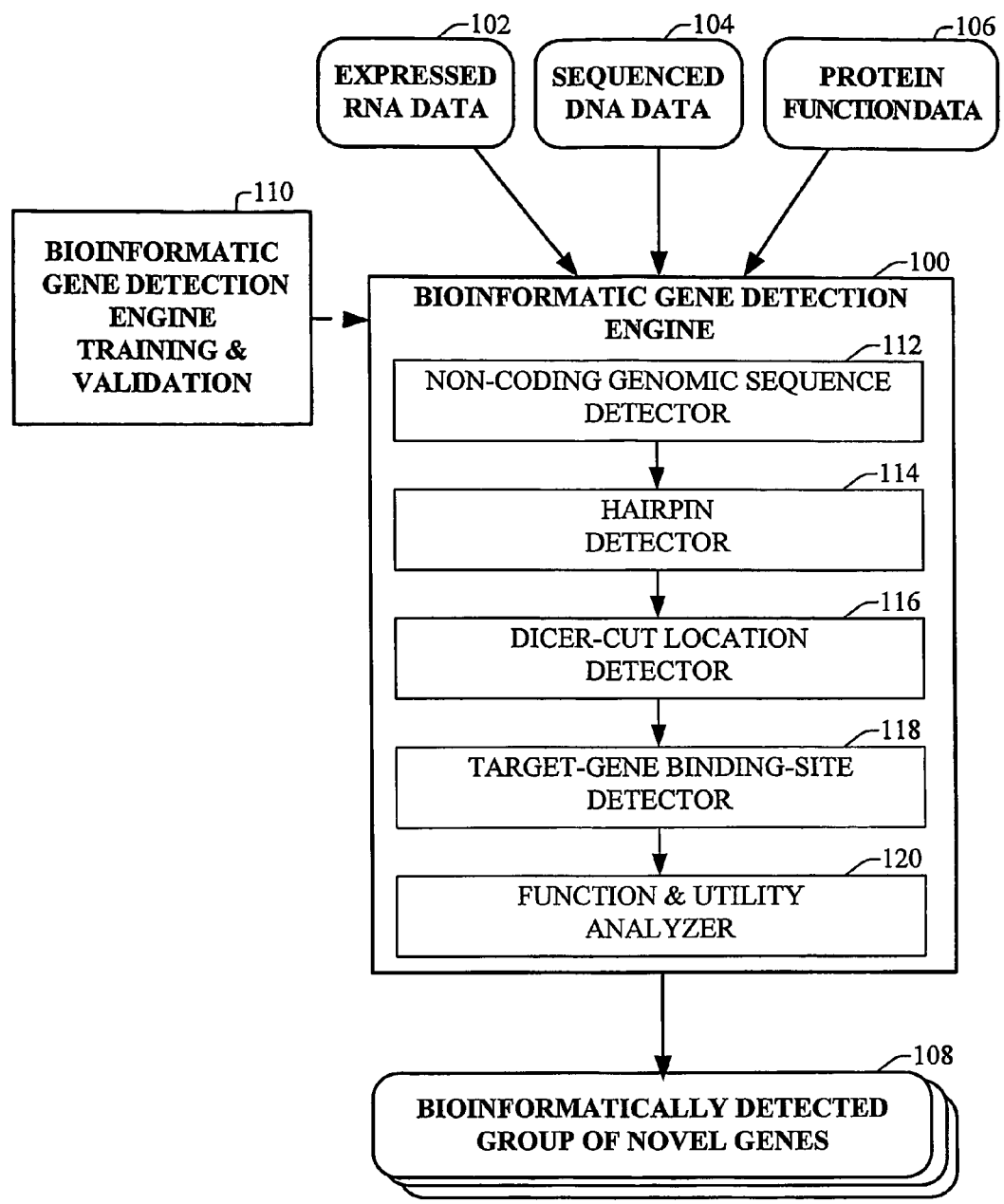
FIG. 9 is a simplified block diagram illustrating a bioinformatic gene detection system capable of detecting genes of the novel group of genes of the present invention, which system is constructed and operative in accordance with a preferred embodiment of the present invention.

Reference is now made to FIG. 9 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102 and sequenced DNA data 104 may preferably be obtained from data published by the National Center for Bioinformatics (NCBI) at the National Institute of Health (NIH) (Jenuth, 2000), as well as from various other published data sources. Protein function data 106 may preferably be obtained from any one of numerous relevant published data sources, such as the Online Mendelian Inherited Disease In M an (OMIM™) database developed by John Hopkins University, and also published by NCBI (2000).

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further described hereinbelow with reference to FIG. 10.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described herein below with reference to FIGS. 11A and 11B.

A hairpin detector 114 operative to bioinformatically detect genomic 'hairpin-shaped' sequences, similar to GAM FOLDED PRECURSOR of FIG. 8. The hairpin detector 114 is further described herein below with reference to FIGS. 12A and 12B.

A dicer-cut location detector 116 operative to bioinformatically detect the location on a hairpin shaped sequence which is enzymatically cut by DICER COMPLEX of FIG. 8. The dicer-cut location detector 116 is further described herein below with reference to FIG. 13A.

A target-gene binding-site detector 118 operative to bioinformatically detect target genes having binding sites, the nucleotide sequence of which is partially complementary to that of a given genomic sequence, such as a sequence cut by DICER COMPLEX of FIG. 8. The target-gene binding-site detector 118 is further described hereinbelow with reference to FIGS. 14A and 14B.

A function & utility analyzer 120 operative to analyze function and utility of target genes, in order to identify target genes which have a significant clinical function and utility. The function & utility analyzer 120 is further described hereinbelow with reference to FIG. 15.

Hardware implementation of the bioinformatic gene detection engine 100 is important, since significant computing power is preferably required in order to perform the computation of bioinformatic gene detection engine 100 in reasonable time and cost. For example, it is estimated that a using a powerful 8-processor server (e.g. DELL POWEREDGE™ 8450, 8 XEON™ 550 MHz processors, 8 GB RAM), over 6 years (!) of computing time are required to detect all MIR genes in the human EST data, together with their respective binding sites. Various computer hardware and software configurations may be utilized in order to address this computation challenge, as is known in the art. A preferred embodiment of the present invention may preferably comprise a hardware configuration, comprising a cluster of one hundred PCs (PENTIUM™ IV, 1.7 GHz, with 40 GB storage each), connected by Ethernet to 12 servers (2-CPU, XEON™ 1.2-2.2 GHz, with ~200 GB storage each), combined with an 8-processor server (8-CPU, Xeon 550 Mhz w/8 GB RAM) connected via 2 HBA fiber-channels to an EMC CLARIION™ 100-disks, 3.6 Terabyte storage device. A preferred embodiment of the present invention may also preferably comprise a software configuration which utilizes a commercial database software program, such as MICROSOFT™ SQL Server 2000. Using such preferred hardware and software configuration, may reduce computing time required to detect all MIR genes in the human EST data, and their respective binding sites, from 6 years to 45 days. It is appreciated that the above mentioned hardware configuration is not meant to be limiting, and is given as an illustration only. The present invention may be implemented in a wide variety of hardware and software configurations.

The present invention discloses 8607 novel genes of the GAM group of genes, which have been detected bioinformatically, as described hereinbelow with reference to Table 1 through Table 6, and 1096 novel genes of the GR group of genes, which have been detected bioinformatically, as described hereinbelow with reference to Table 7. Laboratory confirmation of 50 bioinformatically predicted genes of the GAM group of genes, and several bioinformatically predicted genes of the GR group of genes, is described hereinbelow with reference to FIGS. 21 through 24C.

Reference is now made to FIG. 10 which is a simplified flowchart illustrating operation of a mechanism for training a computer system to recognize the novel genes of the present invention. This mechanism is a preferred implementation of the bioinformatic gene detection engine training & validation 110 described hereinabove with reference to FIG. 9.

BIOINFORMATIC GENE DETECTION ENGINE TRAINING & VALIDATION 110 of FIG. 9 begins by training the bioinformatic gene detection engine to recognize known miRNA genes, as designated by numeral 122. This training step comprises HAIRPIN DETECTOR TRAINING & VALIDATION 124, further described hereinbelow with reference to FIG. 12A, DICER-CUT LOCATION DETECTOR TRAINING & VALIDATION 126, further described hereinbelow with reference to FIGS. 13A and 13B, and TARGET-GENE BINDING-SITE DETECTOR TRAINING & VALIDATION 128, further described hereinbelow with reference to FIG. 14A.

Next, the BIOINFORMATIC GENE DETECTION ENGINE 100 is used to bioinformatically detect sample novel genes, as designated by numeral 130. Examples of sample novel genes thus detected are described hereinbelow with reference to FIGS. 21 through 24C.

Finally, wet lab experiments are preferably conducted in order to validate expression and preferably function of the sample novel genes detected by the BIOINFORMATIC GENE DETECTION ENGINE 100 in the previous step, as designated by reference numeral 132. An example of wet-lab validation of the above mentioned sample novel gene bioinformatically detected by the system is described hereinbelow with reference to FIGS. 22A and 22B.

Figure 11A:
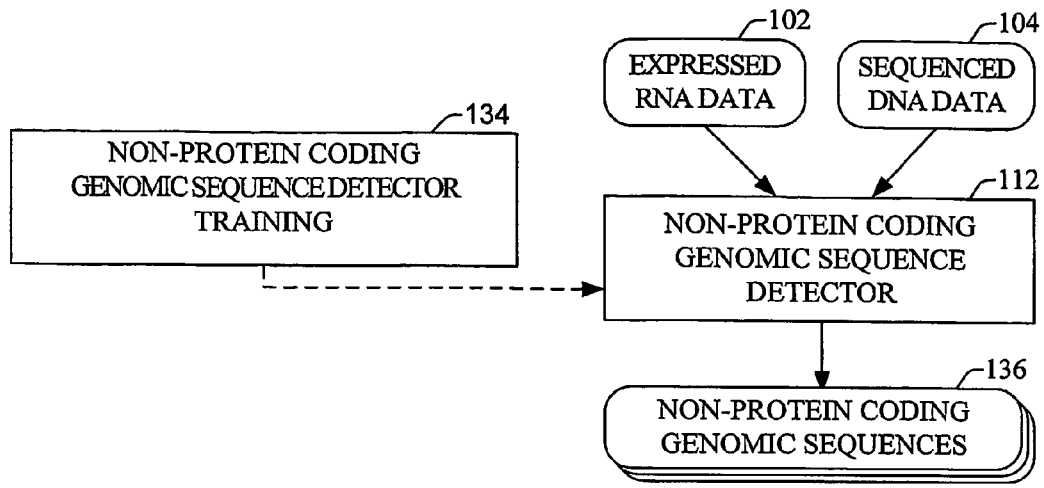
FIG. 11A is a simplified block diagram of a non-coding genomic sequence detector constructed and operative in accordance with a preferred embodiment of the present invention.

Reference is now made to FIG. 11A which is a simplified block diagram of a preferred implementation of the NON-CODING GENOMIC SEQUENCE DETECTOR 112 described hereinabove with reference to FIG. 9. The NON-PROTEIN CODING GENOMIC SEQUENCE DETECTOR 112 of FIG. 9 preferably receives as input at least two types of published genomic data: EXPRESSED RNA DATA 102 and SEQUENCED DNA DATA 104. The EXPRESSED RNA DATA can include, among others, EST data, EST clusters data, EST genome alignment data and mRNA data. Sources for EXPRESSED RNA DATA 102 include NCBI dbEST, NCBI UniGene clusters and mapping data, and TIGR gene indices. SEQUENCED DNA DATA 104 includes both sequence data (FASTA format files), and features annotation (GenBank file format) mainly from NCBI database. After its initial training, indicated by numeral 134, and based on the above mentioned input data, the NON-PROTEIN CODING GENOMIC SEQUENCE DETECTOR 112 produces as output a plurality of NON-PROTEIN CODING GENOMIC SEQUENCES 136. Preferred operation of the NON-PROTEIN CODING GENOMIC SEQUENCE DETECTOR 112 is described hereinbelow with reference to FIG. 11B.

Figure 11B:
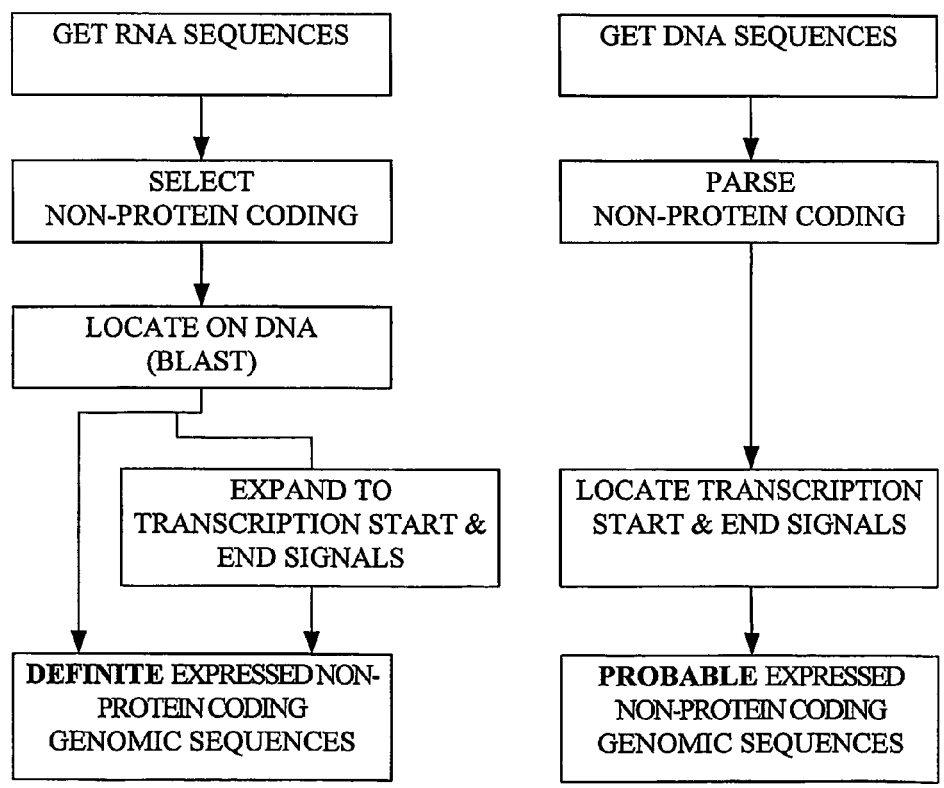
FIG. 11B is a simplified flowchart illustrating operation of a non-coding genomic sequence detector constructed and operative in accordance with a preferred embodiment of the present invention.

Reference is now made to FIG. 11B which is a simplified flowchart illustrating a preferred operation of the NON-CODING GENOMIC SEQUENCE DETECTOR 112 of FIG. 9. Detection of NON-PROTEIN CODING GENOMIC SEQUENCES 136, generally preferably progresses in one of the following two paths:

A first path for detecting NON-PROTEIN CODING GENOMIC SEQUENCES 136 begins by receiving a plurality of known RNA sequences, such as EST data. Each RNA sequence is first compared to all known protein-coding sequences, in order to select only those RNA sequences which are non-protein coding, i.e. intergenic or intronic. This can preferably be performed by sequence comparison of the RNA sequence to known protein coding sequences, using one of many alignment algorithms known in the art, such as BLAST. This sequence comparison to the DNA preferably also provides the localization of the RNA sequence on the DNA.

Alternatively, selection of non-protein coding RNA sequences and their localization to the DNA can be performed by using publicly available EST clusters data and genomic mapping databases, such as UNIGENE database published by NCBI or TIGR database, in order map expressed RNA sequences to DNA sequences encoding them, to find the right orientation of EST sequences, and to exclude ESTs which map to protein coding DNA regions, as is well known in the art. Public databases, such as TIGR, may also be used to map an EST to a cluster of ESTs, assumed to be expressed as one piece, and is known in the art as Tentative Human Consensus. Publicly available genome annotation databases, such as NCBI's GENBANK, may also be used to deduce expressed intronic sequences.

Optionally, an attempt may be made to 'expand' the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data, by extracting those DNA sequences which are between known protein coding sequences. Next, transcription start and end signals are sought. If such signals are found, and depending on their 'strength', probable expressed non-protein coding genomic sequences are yielded. Such approach is especially useful for identifying novel GAM genes which are found in proximity to other known miRNA genes, or other wet-lab validated GAM genes. Since, as described hereinbelow with reference to FIG. 16, GAM genes are frequently found in clusters, therefore sequences near a known miRNA are more likely to contain novel GAM genes. Optionally, sequence orthology, i.e. sequences conservation in an evolutionary related species, may be used to select genomic sequences having higher probability of containing expressed novel GAM genes.

Figure 12A:
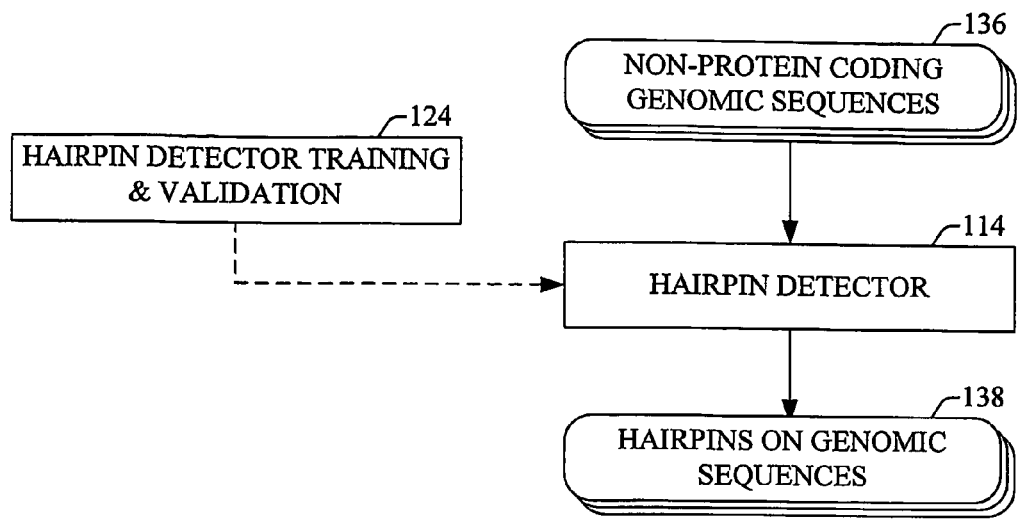
FIG. 12A is a simplified block diagram of a hairpin detector constructed and operative in accordance with a preferred embodiment of the present invention.

Reference is now made to FIG. 12A which is a simplified block diagram of a preferred implementation of the HAIRPIN DETECTOR 114 described hereinabove with reference to FIG. 9.

The goal of the HAIPIN DETECTOR 114 is to detect 'hairpin' shaped genomic sequences, similar to those of known miRNA genes. As mentioned hereinabove with reference to FIG. 8, a 'hairpin' genomic sequence refers to a genomic sequence which 'folds onto itself' forming a hairpin like shape, due to the fact that nucleotide sequence of the first half of the nucleotide sequence is an accurate or partial complementary sequence of the nucleotide sequence of its second half.

The HAIRPIN DETECTOR 114 of FIG. 9 receives as input a plurality of NON-PROTEIN CODING GENOMIC SEQUENCES 136 of FIG. 11A. After a phase of HAIRPIN DETECTOR TRAINING & VALIDATION 124 of FIG. 10, the HAIRPIN DETECTOR 114 is operative to detect and output 'hairpin shaped' sequences, which are found in the input NON-PROTEIN CODING GENOMIC SEQUENCES 138. The hairpin shaped sequences detected by the HAIRPIN DETECTOR 114 are designated HAIRPINS ON GENOMIC SEQUENCES 138. Preferred operation of the HAIRPIN DETECTOR 114 is described hereinbelow with reference to FIG. 12B.

The phase of HAIRPIN DETECTOR TRAINING & VALIDATION 124 is an iterative process of applying the HAIRPIN DETECTOR 114 to known hairpin shaped miRNA genes, calibrating the HAIRPIN DETECTOR 114 such that it identifies the training set of known hairpins, as well as sequences which are similar thereto. In a preferred embodiment of the present invention, THE HAIRPIN DETECTOR TRAINING & VALIDATION 124 trains and validates each of the steps of operation of the HAIRPIN DETECTOR 114, which steps are described hereinbelow with reference to FIG. 12B.

The hairpin detector training and validation 124 preferably uses two sets of data: a training set of known miRNA genes, such as 440 miRNA genes of *H. sapiens, M. musculus, C. elegans, C. Brigssae* and *D. Melanogaster*, annotated in RFAM database (Griffiths-Jones 2003), and a large 'background set' of hairpins found in expressed non-protein coding genomic sequences, such as a set of 21,985 hairpins found in Tentative Human Concensus (THC) sequences in TIGR database. The 'background set' is expected to comprise some valid, previously undetected miRNA hairpins, and many hairpins which are not miRNA hairpins.

In order to validate the performance of the HAIRPIN DETECTOR 114, a validation method is preferably used, which validation method is a variation on the k-fold cross validation method (Mitchell, 1997). This preferred validation method is devised to better cope with the nature of the training set, which includes large families of similar and even identical miRNAs. The training set is preferably first divided into clusters of miRNAs such that any two miRNAs that belong to different clusters have an Edit Distance score (see Algorithms and Strings; Dan Gusfield, Cambridge University Press, 1997) of at least D=3, i.e. they differ by at least 3 editing operations. Next, the group of clusters is preferably divided into k sets. Then standard k-fold cross validation is preferably performed on this group of clusters, preferably using k=5, such that the members of each cluster are all in the training set or in the test set. It is appreciated that without the prior clustering, standard cross validation methods results in much higher performance of the predictors due to the redundancy of training examples, within the genome of a species and across genomes of different species.

In a preferred embodiment of the present invention, using the above-mentioned validation method, the efficacy of the HAIRPIN DETECTOR 114 is indeed validated: for example, when a similarity threshold is chosen such that 90% of the published miRNA-precursor hairpins are successfully predicted, only 7.6% of the 21,985 background hairpins are predicted to be miRNA-precursors, some of which may indeed be previously unknown miRNA precursors.

Figure 12B:
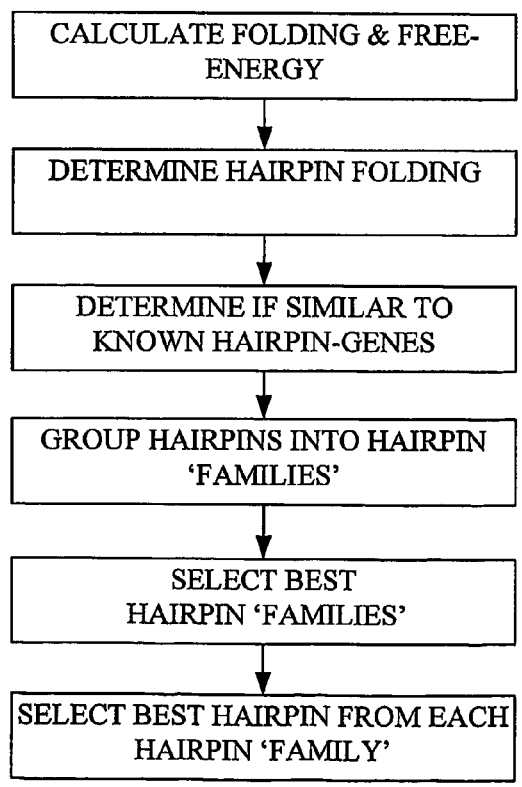
FIG. 12B is a simplified flowchart illustrating operation of a hairpin detector constructed and operative in accordance with a preferred embodiment of the present invention.

Reference is now made to FIG. 12B which is a simplified flowchart illustrating a preferred operation of the HAIRPIN DETECTOR 114 of FIG. 9.

A hairpin structure is a secondary structure, resulting from the nucleotide sequence pattern: the nucleotide sequence of the first half of the hairpin is a partial or accurate inversed reversed sequence of the nucleotide sequence of the second half thereof. Various methodologies are known in the art for prediction of secondary and tertiary hairpin structures, based on given nucleotide sequences.

In a preferred embodiment of the present invention, the HAIRPIN DETECTOR 114 initially calculates possible secondary structure folding patterns of a given one of the non-protein coding genomic sequences 136 and the respective energy of each of these possible secondary folding patterns, preferably using a secondary structure folding algorithm based on free-energy minimization, such as the MFOLD algorithm (Mathews et al., 1999), as is well known in the art.

Next, the HAIRPIN DETECTOR 114 analyzes the results of the secondary structure folding, in order to determine the presence, and location of hairpin folding structures. A secondary structure folding algorithm, such as MFOLD algorithm, typically provides as output a listing of the base-pairing of the folded shape, i.e. a listing of each pair of connected nucleotides in the sequence. The goal of this second step is to asses this base-pairing listing, in order to determine if it describes a hairpin type bonding pattern. Preferably, each of the sequences that is determined to describe a hairpin structure is folded separately in order to determine its exact folding pattern and free-energy.

The HAIRPIN DETECTOR 114 then assess those hairpin structures found by the previous step, comparing them to hairpins of known miRNA genes, using various characteristic hairpin features such as length of the hairpin and of its loop, free-energy and thermodynamic stability, amount and type of mismatched nucleotides, existence of sequence repeat-elements. Only hairpins that bear statistically significant resemblance to the training set of known miRNA hairpins, according to the abovementioned parameters are accepted.

In a preferred embodiment of the present invention, similarity to the training set of known miRNA hairpins is determined using a 'similarity score' which is calculated using a weighted sum of terms, where each term is a function of one of the abovementioned hairpin features, and the parameters of each function are learned from the set of known hairpins, as described hereinabove with reference to hairpin detector training & validation 124. The weight of each term in the similarity score is optimized so as to achieve maximal separation between the distribution of similarity scores of hairpins which have been validated as miRNA-precursor hairpins, and the distribution of similarity scores of hairpins detected in the 'background set' mentioned hereinabove with reference to FIG. 12B, many of which are expected not to be miRNA-precursor hairpins.

In another preferred embodiment of the present invention, the above-mentioned DETERMINE IF SIMILAR TO KNOWN HAIRPIN-GENES step may may preferably be split into two stages. The first stage is a permissive filter that implements a simplified scoring method, based on a subset of the hairpin features described hereinabove, such as minimal length and maximal free energy. The second stage is more stringent, and a full calculation of the weighted sum of terms described hereinabove is performed. This second stage may preferably be performed only on the subset of hairpins that survived prior filtering stages of the hairpin-detector 114.

Lastly, the HAIRPIN DETECTOR 114 attempts to select those hairpin structures which are as thermodynamically stable as the hairpins of known miRNA genes. This may preferably be achieved in various manners. A preferred embodiment of the present invention utilizes the following methodology preferably comprising three logical steps:

First, the HAIRPIN DETECTOR 114 attempts to group potential hairpins into 'families' of closely related hairpins. As is known in the art, a free-energy calculation algorithm, typically provides multiple 'versions' each describing a different possible secondary structure folding pattern for the given genomic sequence, and the free energy of such possible folding. The HAIRPIN DETECTOR 114 therefore preferably assesses all hairpins found in each of the 'versions', grouping hairpins which appear in different versions, but which share near identical locations into a common 'family' of hairpins. For example, all hairpins in different versions, the center of which hairpins is within 7 nucleotides of each other may preferably be grouped to a single 'family'. Hairpins may also be grouped to a single 'family' if the sequences of one or more hairpins are identical to, or are subsequences of, the sequence of another hairpin.

Next, hairpin 'families' are assessed, in order to select only those families which represent hairpins that are as stable as those of known miRNA hairpins. Preferably only families which are represented in a majority of the secondary structure folding versions, such as at least in 65% or 80% or 100% of the secondary structure folding versions, are considered stable.

Finally, an attempt is made to select the most suitable hairpin from each selected family. For example, a hairpin which appears in more versions than other hairpins, and in versions the free-energy of which is lower, may be preferred.

In another preferred embodiment of the present invention, hairpins with homology to other species, and clusters of thermodynamically stable hairpin are further favored.

Figure 13A:
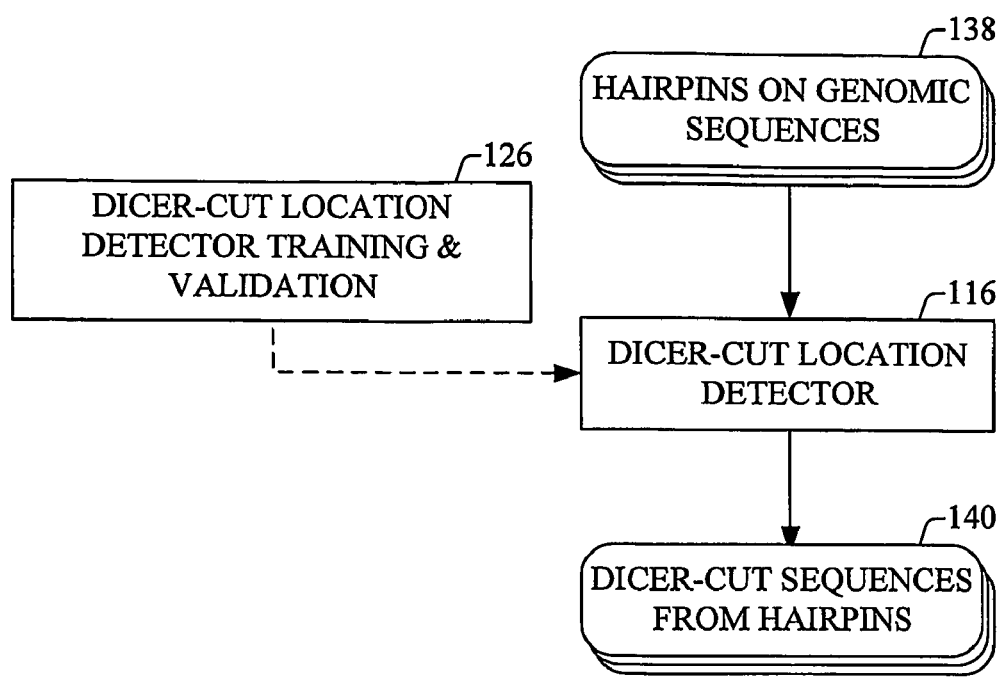
FIG. 13A is a simplified block diagram of a dicer-cut location detector constructed and operative in accordance with a preferred embodiment of the present invention.

Reference is now made to FIG. 13A which is a simplified block diagram of a preferred implementation of the DICER-CUT LOCATION DETECTOR 116 described hereinabove with reference to FIG. 9.

The goal of the DICER-CUT LOCATION DETECTOR 116 is to detect the location in which DICER COMPLEX of FIG. 8, comprising the enzyme Dicer, would 'dice' the given hairpin sequence, similar to GAM FOLDED PRECURSOR RNA, yielding GAM RNA both of FIG. 8.

The DICER-CUT LOCATION DETECTOR 116 of FIG. 9 therefore receives as input a plurality of HAIRPINS ON GENOMIC SEQUENCES 138 of FIG. 12A, which were calculated by the previous step, and after a phase of DICER-CUT LOCATION DETECTOR TRAINING & VALIDATION 126, is operative to detect a respective plurality of DICER-CUT SEQUENCES FROM HAIRPINS 140, one for each hairpin.

In a preferred embodiment of the present invention, the DICER-CUT LOCATION DETECTOR 116 preferably uses standard machine learning techniques such as K nearest-neighbors, Bayesian networks and Support Vector Machines (SVM), trained on known dicer-cut locations of known miRNA genes in order to predict dicer-cut locations of novel GAM genes. The DICER-CUT LOCATION DETECTOR TRAINING & VALIDATION 126 is further described hereinbelow with reference to FIG. 13B.

Figure 13B:
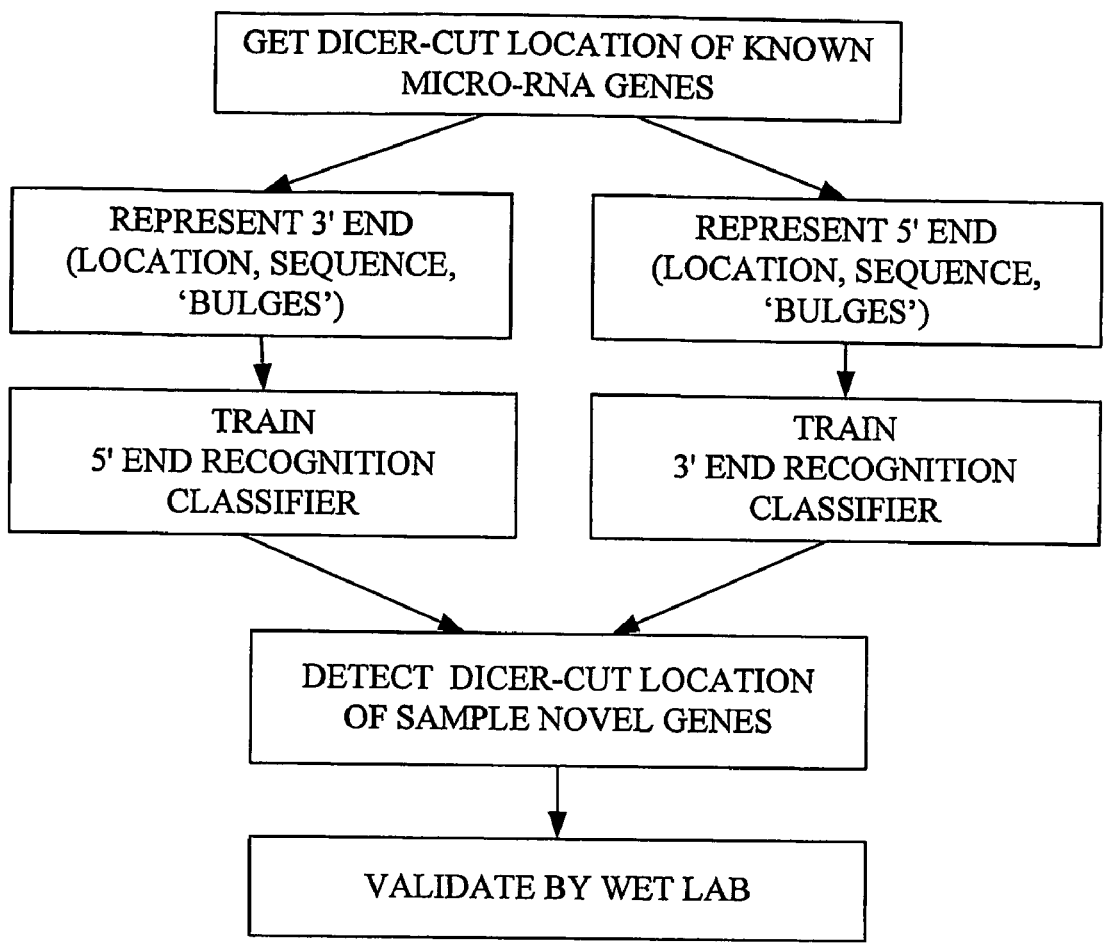
FIG. 13B is a simplified flowchart illustrating training of a dicer-cut location detector constructed and operative in accordance with a preferred embodiment of the present invention.

Reference is now made to FIG. 13B which is a simplified flowchart illustrating a preferred implementation of DICER-CUT LOCATION DETECTOR TRAINING & VALIDATION 126 of FIG. 10.

The general goal of the DICER-CUT LOCATION DETECTOR TRAINING & VALIDATION 126 is to analyze known hairpin shaped miRNA-precursors and their respective dicer-cut miRNA, in order to determine a common pattern to the dicer-cut location of known miRNA genes. Once such a common pattern is deduced, it may preferably be used by the DICER-CUT LOCATION DETECTOR 116, in detecting the predicted DICER-CUT SEQUENCES FROM HAIRPINS 140, from the respective HAIRPINS ON GENOMIC SEQUENCES 138, all of FIG. 13A.

First, the dicer-cut location of all known miRNA genes is obtained and studied, so as to train the DICER-CUT LOCATION DETECTOR 116: for each of the known miRNA, the location of the miRNA relative to its hairpin-shaped miRNA-precursor is noted.

The 5' and 3' ends of the dicer-cut location of each of the known miRNA genes is represented relative to the respective miRNA precursor hairpin, as well as to the nucleotides in each location along the hairpin. Frequency and identity of nucleotides and of nucleotide-pairing, and position of nucleotides and nucleotide pairing relative to the dicer-cut location in the known miRNA precursor hairpins is analyzed and modeled. In a preferred embodiment of the present invention, features learned from published miRNAs include: distance from hairpin's loop, nucleotide content, positional distribution of nucleotides and mismatched-nucleotides, and symmetry of mismatched-nucleotides.

Different techniques are well known in the art of machine learning for analysis of existing pattern from a given 'training set' of examples, which techniques are then capable, to a certain degree, to detect similar patterns in other, previously unseen examples. Such machine learning techniques include, but are not limited to neural networks, Bayesian networks, Support Vector Machines (SVM), Genetic Algorithms, Markovian modeling, Maximum Liklyhood modeling, Nearest Neighbor algorithms, Decision trees and other techniques, as is well known in the art.

The DICER-CUT LOCATION DETECTOR 116 preferably uses such standard machine learning techniques to predict either the 5' end or both the 5' and 3' ends of the miRNA excised, or 'diced' by the Dicer enzyme from the miRNA hairpin shaped precursor, based on known pairs of miRNA-precursors and their respective resulting miRNAs. The nucleotide sequences of 440 published miRNA and their corresponding hairpin precursors are preferably used for training and evaluation of the dicer-cut location detector module.

Using the abovementioned training set, machine learning predictors, such as a Support Vector Machine (SVM) predictor, are implemented, which predictors test every possible nucleotide on a hairpin as a candidate for being the 5' end or the 3' end of a miRNA. Other machine learning predictors include predictors based on Nearest Neighbor, Bayesian modeling, and K-nearest-neighbor algorithms. The training set of the published miRNA precursor sequences is preferably used for training multiple separate classifiers or predictors, each of which produces a model for the 5' or 3' end of a miRNA relative to its hairpin precursor. The models take into account various miRNA properties such as the distance of the respective (3' or 5') end of the miRNA from the hairpin's loop, the nucleotides at its vicinity and the local 'bulge' (i.e. base-pair mismatch) structure.

Performance of the resulting predictors, evaluated on the above-mentioned validation set of 440 published miRNAs using k-fold cross validation (Mitchell, 1997) with k=3, is found to be as follows: in 70% of known miRNAs 5'-end location is correctly determined by an SVM predictor within up to 2 nucleotides; a Nearest Neighbor (EDIT DISTANCE) predictor achieves 53% accuracy (233/440); a Two-Phased predictor that uses Baysian modeling (TWO PHASED) achieves 79% accuracy (348/440), when only the first phase is used, and 63% (277/440) when both phases are used; a K-nearest-neighbor predictor (FIRST-K) achieves 61% accuracy (268/440). The accuracies of all predictors are considerably higher on top scoring subsets of published miRNA.

Finally, in order to validate the efficacy and accuracy of the dicer-cut location detector 116, a sample of novel genes detected thereby is preferably selected, and validated by wet lab. Laboratory results validating the efficacy of the dicer-cut location detector 116 are described hereinbelow with reference to FIGS. 21 through 24C.

Figure 13C:
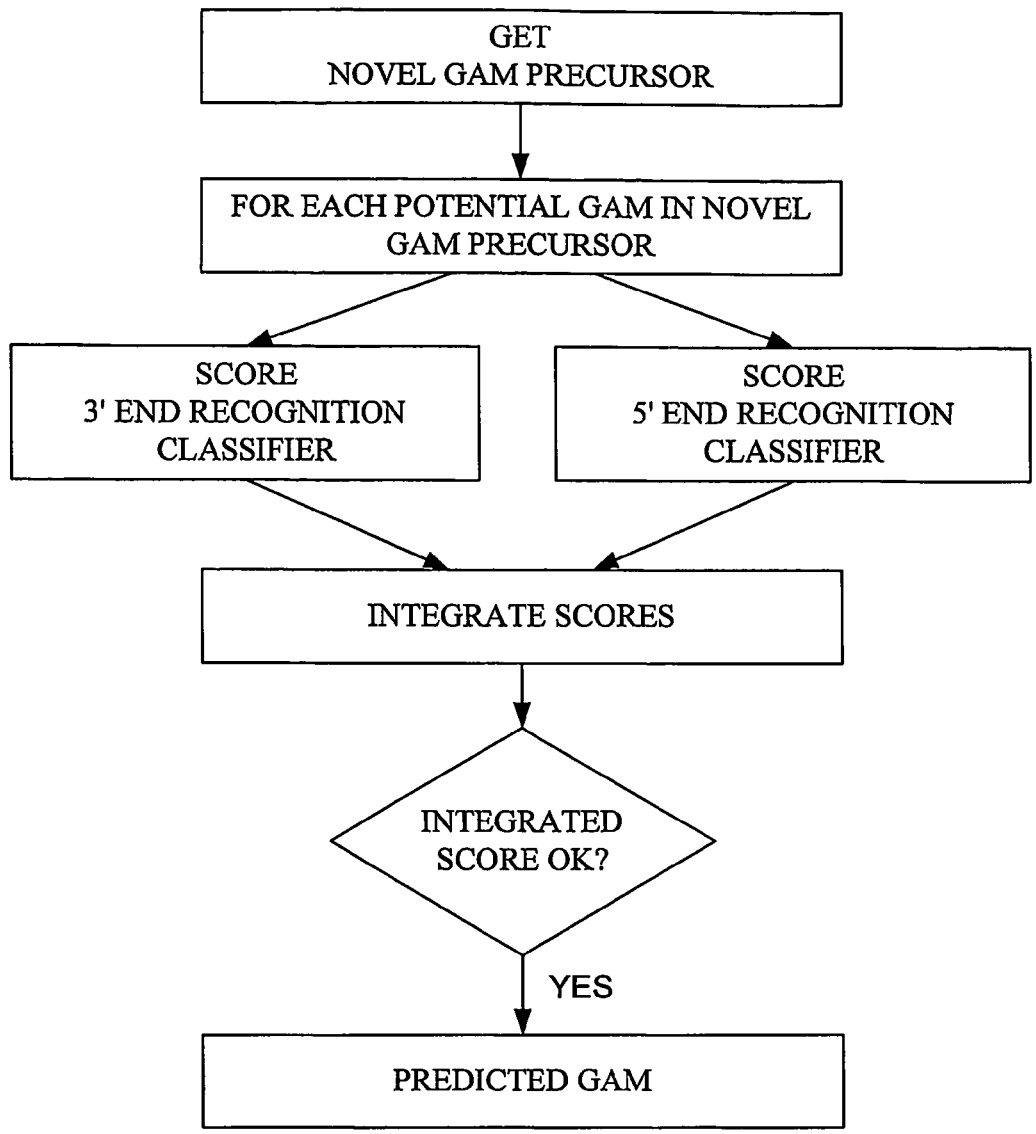
FIG. 13C is a simplified flowchart illustrating operation of a dicer-cut location detector constructed and operative in accordance with a preferred embodiment of the present invention.

Reference is now made to FIG. 13C which is a simplified flowchart illustrating operation of DICER-CUT LOCATION DETECTOR 116 of FIG. 9, constructed and operative in accordance with a preferred embodiment of the present invention.

The DICER CUT LOCATION DETECTOR 116 is a machine learning computer program module, which is trained on recognizing dicer-cut location of known miRNA genes, and based on this training, is operable to detect dicer cut location of novel GAM FOLDED PRECURSOR RNA. In a preferred embodiment of the present invention, the dicer-cut location module preferably utilizes machine learning algorithms, such as Support Vector Machine (SVM), Bayesian modeling, Nearest Neighbors, and K-nearest-neighbor, as is well known in the art.

When assessing a novel GAM precursor, all 19-24 nucleotide long segments comprised in the GAM precursor are initially considered as 'potential GAMs', since the dicer-cut location is initially unknown.

For each such potential GAM, its 5' end, or its 5' and 3' ends are scored by two or more recognition classifiers or predictors.

In a preferred embodiment of the present invention, the DICER-CUT LOCATION DETECTOR 116 preferably uses a Support Vector Machine predictor trained on features such as distance from hairpin's loop, nucleotide content, positional distribution of nucleotides and mismatched-nucleotides, and symmetry of mismatched-nucleotides.

In another preferred embodiment of the present invention, the DICER-CUT LOCATION DETECTOR 116 preferably uses an 'EDIT DISTANCE' predictor, which seeks sequences that are similar to those of published miRNAs, utilizing the Nearest Neighbor algorithm, where the similarity metric between two sequences is a variant of the edit distance algorithm (Algorithms and Strings, Dan Gusfield, Cambridge University Press, 1997). This predictor is based on the observation that miRNAs tend to form clusters (Dostie, 2003), the members of which show marked sequence similarity to each other.

In yet another preferred embodiment of the present invention, the DICER-CUT LOCATION DETECTOR 116 preferably uses a 'TWO PHASED' predictor, which predicts the dicer-cut location in two distinct phases: (a) selecting the double-stranded segment of the hairpin comprising the miRNA by naïve Bayesian modeling (Mitchell, 1997), and (b) detecting which strand contains the miRNA by either naïve or by K-nearest-neighbor modeling. The latter is a variant oft he 'FIRST-K' predictor described herein below, with parameters optimized for this specific task. The 'TWO PHASED' predictor may be operated in two modes: either utilizing only the first phase and thereby producing two alternative dicer-cut location predictions, or utilizing both phases and thereby producing only one final dicer-cut location.

In still another preferred embodiment of the present invention, the DICER-CUT LOCATION DETECTOR 116 preferably uses a 'FIRST-K' predictor, which utilizes the K-nearest-neighbor algorithm. The similarity metric between any two sequences is 1-E/L, where L is a parameter, preferably 8-10 and E is the edit distance between the two sequences, taking into account only the first L nucleotides of each sequence. If the K-nearest-neighbor scores of two or more locations on the hairpin are not significantly different, these locations are further ranked by a Bayesian model, similar to the one described hereinabove.

Scores of two or more of the abovementioned classifiers or predictors are integrated, yielding an integrated score for each 'potential GAM'. As an example, FIG. 13C illustrates integration of scores from two classifiers, a 3' end recognition classifier and a 5' end recognition classifier, the scores of which are integrated to yield an integrated score. In a preferred embodiment of the present invention, INTEGRATED SCORE of 13C preferably implements a 'best-of-breed' approach, accepting only 'potential GAMs' that score highly on one of the above mentioned EDIT DISTANCE', or 'TWO-PHASED' predictors. In this context, 'high scores' means scores which have been demonstrated to have low false positive value when scoring known miRNAs.

The INTEGRATED SCORE is then evaluated as follows: (a) the 'potential GAM' having the highest score is taken to be the most probable GAM, and (b) if the integrated score of this 'potential GAM' is higher than a pre-defined threshold, then the potential GAM is accepted as the PREDICTED GAM.

Figure 14A:
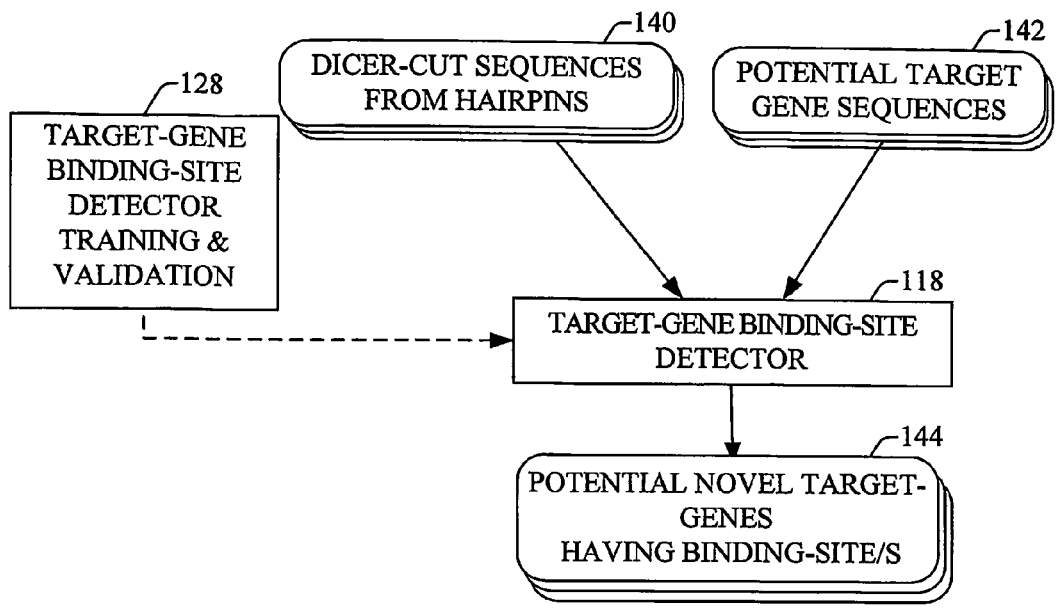
FIG. 14A is a simplified block diagram of a target-gene binding-site detector constructed and operative in accordance with a preferred embodiment of the present invention.

Reference is now made to FIG. 14A which is a simplified block diagram of a preferred implementation of the TARGET-GENE BINDING-SITE DETECTOR 118 described hereinabove with reference to FIG. 9. The goal of the TARGET-GENE BINDING-SITE DETECTOR 118 is to detect a BINDING SITE of FIG. 8, including binding sites located in untranslated regions of the RNA of a known gene, the nucleotide sequence of which BINDING SITE is a partial or accurate inversed reversed sequence to that of a GAM RNA of FIG. 8, thereby determining that the above mentioned known gene is a target gene of GAM of FIG. 8.

The TARGET-GENE BINDING-SITE DETECTOR 118 of FIG. 9 therefore receives as input a plurality of DICER-CUT SEQUENCES FROM HAIRPINS 140 of FIG. 13A which were calculated by the previous step, and a plurality of POTENTIAL TARGET GENE SEQUENCES 142 which derive from SEQUENCED DNA DATA 104 of FIG. 9, and after a phase of TARGET-GENE BINDING-SITE DETECTOR TRAINING & VALIDATION 128 is operative to detect a plurality of POTENTIAL NOVEL TARGET-GENES HAVING BINDING SITE/S 144 the nucleotide sequence of which is a partial or accurate inversed reversed sequence to that of each of the plurality of DICER-CUT SEQUENCES FROM HAIRPINS 140. Preferred operation of the TARGET-GENE BINDING-SITE DETECTOR 118 is further described hereinbelow with reference to FIG. 14B.

Figure 14B:
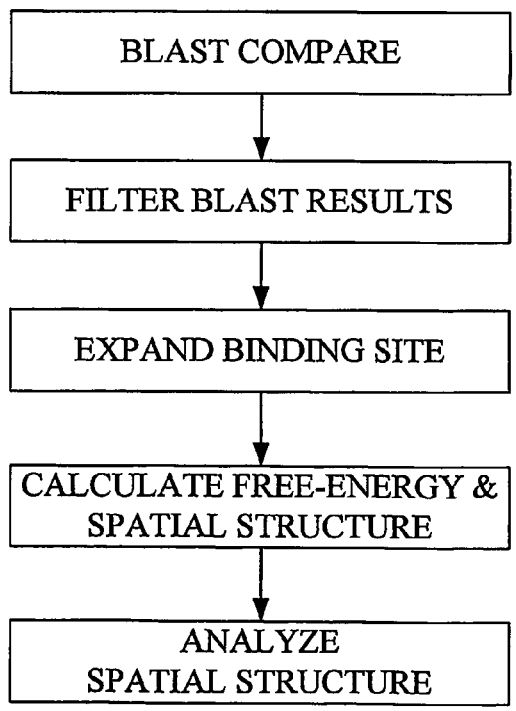
FIG. 14B is a simplified flowchart illustrating operation of a target-gene binding-site detector constructed and operative in accordance with a preferred embodiment of the present invention.

Reference is now made to FIG. 14B which is a simplified flowchart illustrating a preferred operation of the target-gene binding-site detector 118 of FIG. 9.

In a preferred embodiment of the present invention, the target-gene binding-site detector 118 first uses a sequence comparison algorithm such as BLAST in order to compare the nucleotide sequence of each of the plurality of dicer-cut sequences from hairpins 140, to the potential target gene sequences 142, such a untranslated regions of known mRNAs, in order to find crude potential matches. Alternatively, the sequence comparison may preferably be performed using a sequence match search tool that is essentially a variant of the EDIT DISTANCE algorithm described hereinabove with reference to FIG. 13C, and the Nearest Neighbor algorithm (Mitchell, 1997).

Results of the sequence comparison, performed by BLAST or other algorithms such as EDIT DISTANCE, are then filtered, preferably utilizing BLAST or EDIT DISTANCE score, to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by the sequence comparison algorithm (e.g. BLAST or EDIT DISTANCE), may improve the match. Suitable binding sites, then are computed for free-energy and spatial structure. The results are analyzed, accepting only those binding sites, which have free-energy and spatial structure similar to that of known binding sites. Since known binding sites of known miRNA genes frequently have multiple adjacent binding sites on the same target RNA, accordingly binding sites which are clustered are strongly preferred. Binding sites found in evolutionarily conserved sequences may preferably also be preferred.

For each candidate binding site a score, Binding Site Prediction Accuracy, is calculated which estimates their similarity of its binding to that of known binding sites. This score is based on GAM-binding site folding features including, but not limited to the free-energy, the total number and distribution of base pairs, the total number and distribution of unpaired nucleotides.

In another preferred embodiment of the present invention binding sites are searched by a reversed process: sequences of K (preferably 22) nucleotides of the untranslated regions of the target gene are assessed as potential binding sites. A sequence comparison algorithm, such as BLAST or EDIT DISTANCE, is then used to search for partially or accurately complementary sequences elsewhere in the genome, which complementary sequences are found in known miRNA genes or computationally predicted GAM genes. Only complementary sequences, the complementarity of which withstands the spatial structure and free energy analysis requirements described above are accepted. Clustered binding sites are strongly favored, as are potential binding sites and potential GAM genes which occur in evolutionarily conserved genomic sequences.

Target binding sites, identified by the TARGET-GENE BINDING-SITE DETECTOR 118, are divided into 3 groups: a) comprises binding sites that are exactly complementary to the predicted GAM. b) and c) comprise binding sites that are not exactly complementary to the predicted GAM: b) has binding sites with 0.9<Binding Site Prediction Accuracy<=1 and c) has binding sites with 0.8<Binding Site Prediction Accuracy<=0.9. The average number of mismatching nucleotides in the alignment of predicted GAM and target binding site is smallest in category A and largest in category C.

In a preferred embodiment of the current invention a ranking of GAM to target gene binding is performed by calculating a score, Mir Target Accuracy. This score is the dominant group identifier of all binding sites of a specific GAM to a specific target gene UTR, where 'a' dominates 'b' and 'b' dominates 'c'.

In yet another preferred embodiment of the current invention a ranking of GAM to target gene binding is performed directly from the set of Binding Site Prediction Accuracies corresponding to all the binding sites of a specific GAM to a specific target gene UTR. This set of scores is sorted in descending order. The final score is a weighted sum of these scores where the weights are exponentially decreasing as a function of the rank.

Figure 15:
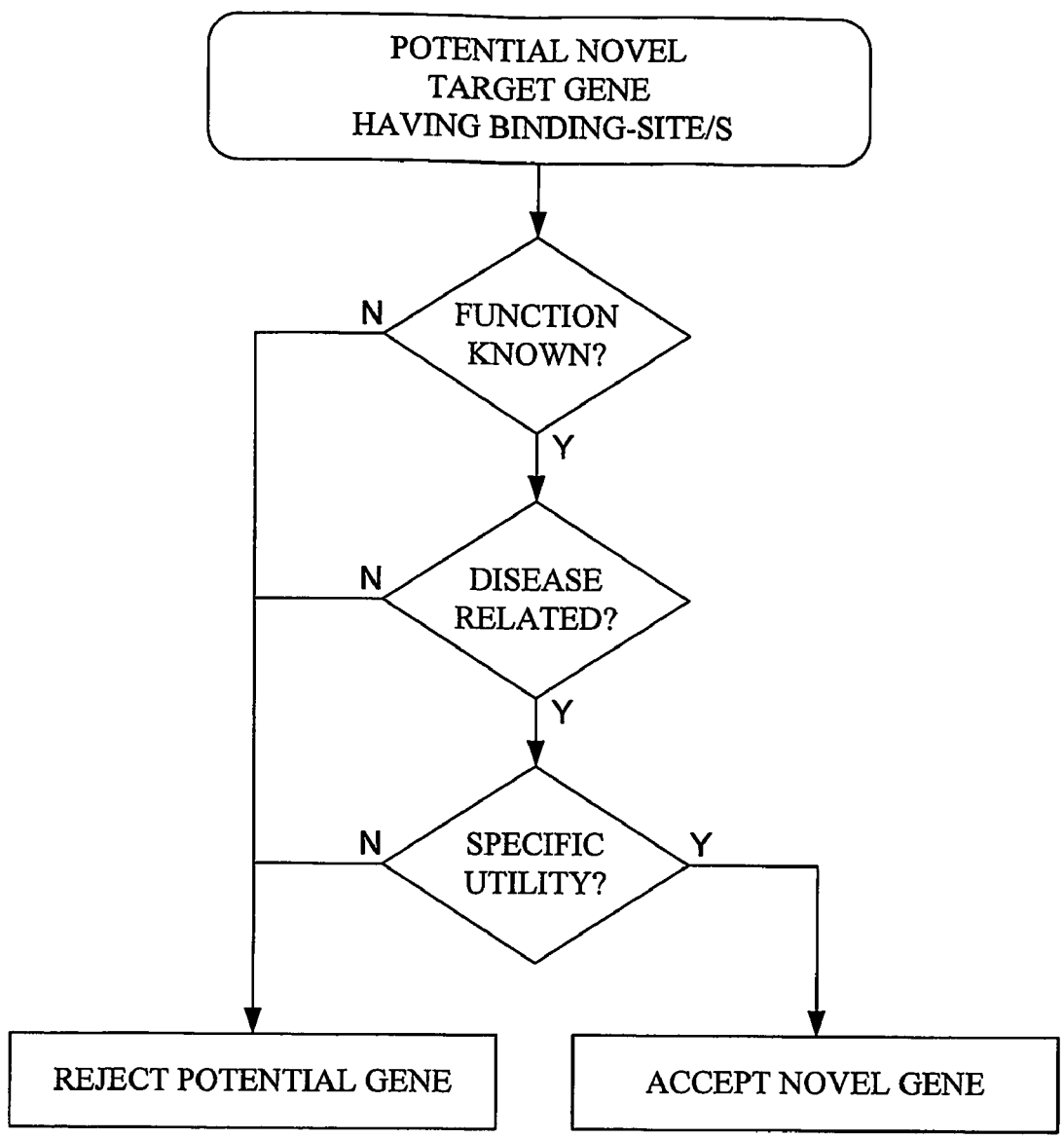
FIG. 15 is a simplified flowchart illustrating operation of a function & utility analyzer constructed and operative in accordance with a preferred embodiment of the present invention.

Reference is now made to FIG. 15 which is a simplified flowchart illustrating a preferred operation of the function & utility analyzer 120 described hereinabove with reference to FIG. 9. The goal of the function & utility analyzer 120 is to determine if a potential target gene is in fact a valid clinically useful target gene. Since a potential novel GAM gene binding a binding site in the UTR of a target gene is understood to inhibit expression of that target gene, and if that target gene is shown to have a valid clinical utility, then in such a case it follows that the potential novel gene itself also has a valid useful function—which is the opposite of that of the target gene.

The function & utility analyzer 120 preferably receives as input a plurality of potential novel target genes having binding-site/s 144, generated by the target-gene binding-site detector 118, both of FIG. 14A. Each potential gene, is evaluated as follows:

First, the system checks to see if the function of the potential target gene is scientifically well established. Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM™ database published by NCBI, which summarizes research publications relating to genes which have been shown to be associated with diseases.

Finally, the specific possible utility of the target gene is evaluated. While this process too may be facilitated by bioinformatic means, it might require manual evaluation of published scientific research regarding the target gene, in order to determine the utility of the target gene to the diagnosis and or treatment of specific disease. Only potential novel genes, the target-genes of which have passed all three examinations, are accepted as novel genes.

Figure 16:
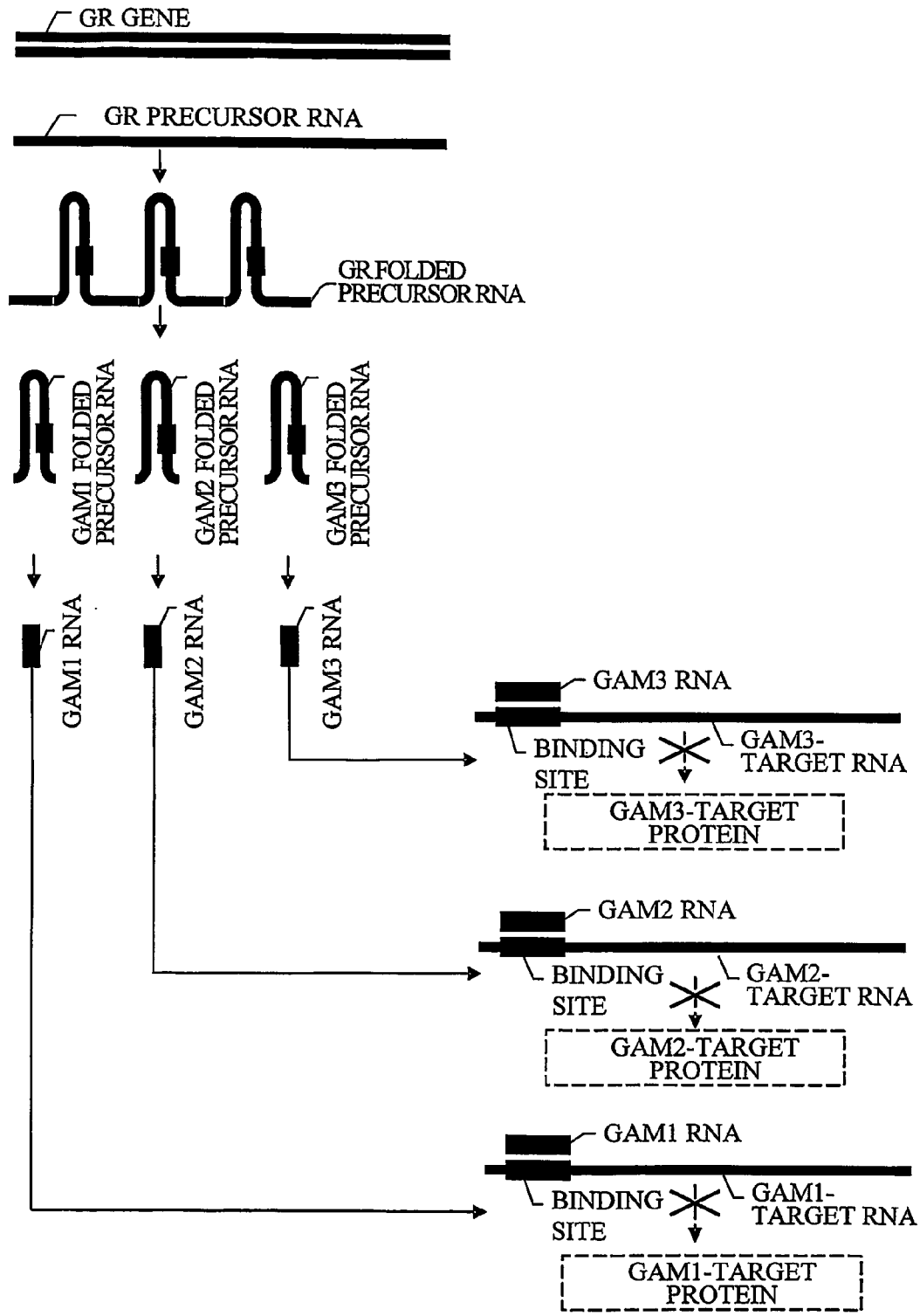
FIG. 16 is a simplified diagram describing a novel bioinformatically detected group of regulatory genes, referred to here as Genomic Record (GR) genes, each of which encodes an 'operon-like' cluster of novel miRNA-like genes, which in turn modulate expression of one or more target genes.

Reference is now made to FIG. 16, which is a simplified diagram describing each of a plurality of novel bioinformatically detected regulatory genes, referred to here as Genomic Record (GR) genes, which encodes an 'operon-like' cluster of novel micro RNA-like genes, each of which in turn modulates expression of at least one target gene, the function and utility of which at least one target gene is known in the art.

GR GENE is a novel bioinformatically detected regulatory, non protein coding, RNA gene. The method by which GR GENE was detected is described hereinabove with reference to FIGS. 9-18.

GR GENE encodes GR PRECURSOR RNA, an RNA molecule, typically several hundred nucleotides long.

GR PRECURSOR RNA folds spatially, forming GR FOLDED PRECURSOR RNA. It is appreciated that GR FOLDED PRECURSOR RNA comprises a plurality of what is known in the art as 'hairpin' structures. These 'hairpin' structures are due to the fact that the nucleotide sequence of GR PRECURSOR RNA comprises a plurality of segments, the first half of each such segment having a nucleotide sequence which is at least a partial or accurate inversed reversed sequence of the second half thereof, as is well known in the art.

GR FOLDED PRECURSOR RNA is naturally processed by cellular enzymatic activity into separate GAM precursor RNAs, herein schematically represented by GAM1 FOLDED PRECURSOR RNA through GAM3 FOLDED PRECURSOR RNA, each of which GAM precursor RNAs being a hairpin shaped RNA segment, corresponding to GAM FOLDED PRECURSOR RNA of FIG. 8.

The above mentioned GAM precursor RNAs are diced by DICER COMPLEX of FIG. 8, yielding respective short RNA segments of about 22 nucleotides in length, schematically represented by GAM1 RNA through GAM3 RNA, each of which GAM RNAs corresponding to GAM RNA of FIG. 8.

GAM1 RNA, GAM2 RNA and GAM3 RNA, each bind complementarily to binding sites located in untranslated regions of respective target genes, designated GAM1-TARGET RNA, GAM2-TARGET RNA and GAM3-TARGET RNA, respectively, which target binding site corresponds to a target binding site such as BINDING SITE I, BINDING SITE II or BINDING SITE III of FIG. 8. This binding inhibits translation of the respective target proteins designated GAM1-TARGET PROTEIN, GAM2-TARGET PROTEIN and GAM3-TARGET PROTEIN respectively.

It is appreciated that specific functions, and accordingly utilities, of each GR GENE of the present invention, correlates with, and may be deduced from, the identity of the target genes, which are inhibited by GAM RNAs comprised in the 'operon-like' cluster of said GR GENE, schematically represented by GAM1 TARGET PROTEIN through GAM3 TARGET PROTEIN.

A listing of GAM GENEs comprised in each of a plurality of GR GENEs of FIG. 16 is provided in Table 7, hereby incorporated by reference. Nucleotide sequences of each said GAM GENEs and their respective genomic source and chromosomal location are further described hereinbelow with reference to Table 1, hereby incorporated by reference. TARGET GENEs of each of said GAM GENEs are elaborated hereinbelow with reference to Table 4, hereby incorporated by reference. The functions of each of said TARGET GENEs and their association with various diseases, and accordingly the utilities of said each of GAM GENEs, and hence the functions and utilities of each of said GR GENEs of FIG. 16 is elaborated hereinbelow with reference to Table 5, hereby incorporated by reference. Studies establishing known functions of each of said TARGET GENEs, and correlation of each of said TARGET GENEs to known diseases are listed in table 6, and are hereby incorporated by reference.

The present invention discloses 1096 novel genes of the GR group of genes, which have been detected bioinformatically, as elaborated hereinbelow with reference to Table 7. Laboratory confirmation of 2 genes of the GR group of genes is described hereinbelow with reference to FIGS. 23A through 24C.

In summary, the current invention discloses a very large number of novel GR genes, each of which encodes a plurality of GAM genes, which in turn may modulate expression of a plurality of target proteins. It is appreciated therefore that the function of GR genes is in fact similar to that of the Genomic Records concept of the present invention addressing the differentiation enigma, described hereinabove with reference to FIG. 7.

Figure 17:
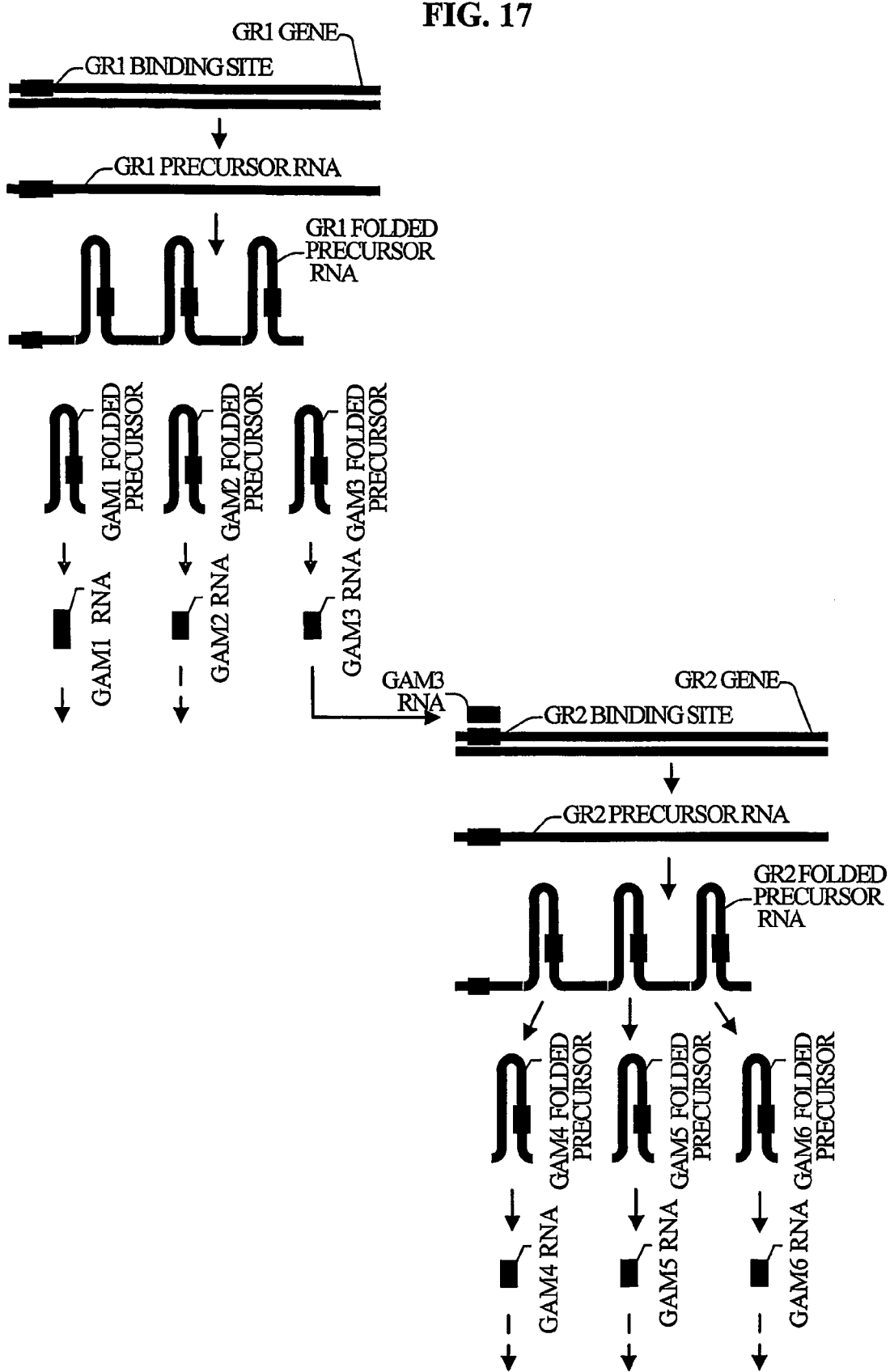
FIG. 17 is a simplified diagram illustrating a mode by which genes of a novel group of operon-like genes of the present invention, modulate expression of other such genes, in a cascading manner.

Reference is now made to FIG. 17 which is a simplified diagram illustrating a mode by which genes of a novel group of operon-like genes, described hereinabove with reference to FIG. 16 of the present invention, modulate expression of other such genes, in a cascading manner.

GR1 GENE and GR2 GENE are two genes of the novel group of operon-like genes designated GR of FIG. 16. As is typical of genes of the GR group of genes, GR1 and GR2 each encode a long RNA precursor, which in turn folds into a folded RNA precursor comprising multiple hairpin shapes, and is cut into respective separate hairpin shaped RNA segments, each of which RNA segments being diced to yield a gene of a group of genes designated GAM of FIG. 8. In this manner GR1 yields GAM1 RNA, GAM2 RNA and GAM3 RNA, and GR2 yields GAM4 RNA, GAM5 RNA and GAM6 RNA.

As FIG. 17 shows, GAM3 RNA, which derives from GR1, binds a binding site located adjacent to GR2 GENE, thus modulating expression of GR2, thereby invoking expression of GAM4 RNA, GAM5 RNA and GAM6 RNA which derive from GR2.

It is appreciated that the mode of modulation of expression presented by FIG. 17 enables an unlimited 'cascading effect' in which a GR gene comprises multiple GAM genes, each of which may modulate expression of other GR genes, each such GR gene comprising additional GAM genes, etc., whereby eventually certain GAM genes modulate expression of target proteins. This mechanism is in accord with the conceptual model of the present invention addressing the differentiation enigma, described hereinabove with specific reference to FIGS. 6 and 7.

Figure 18:
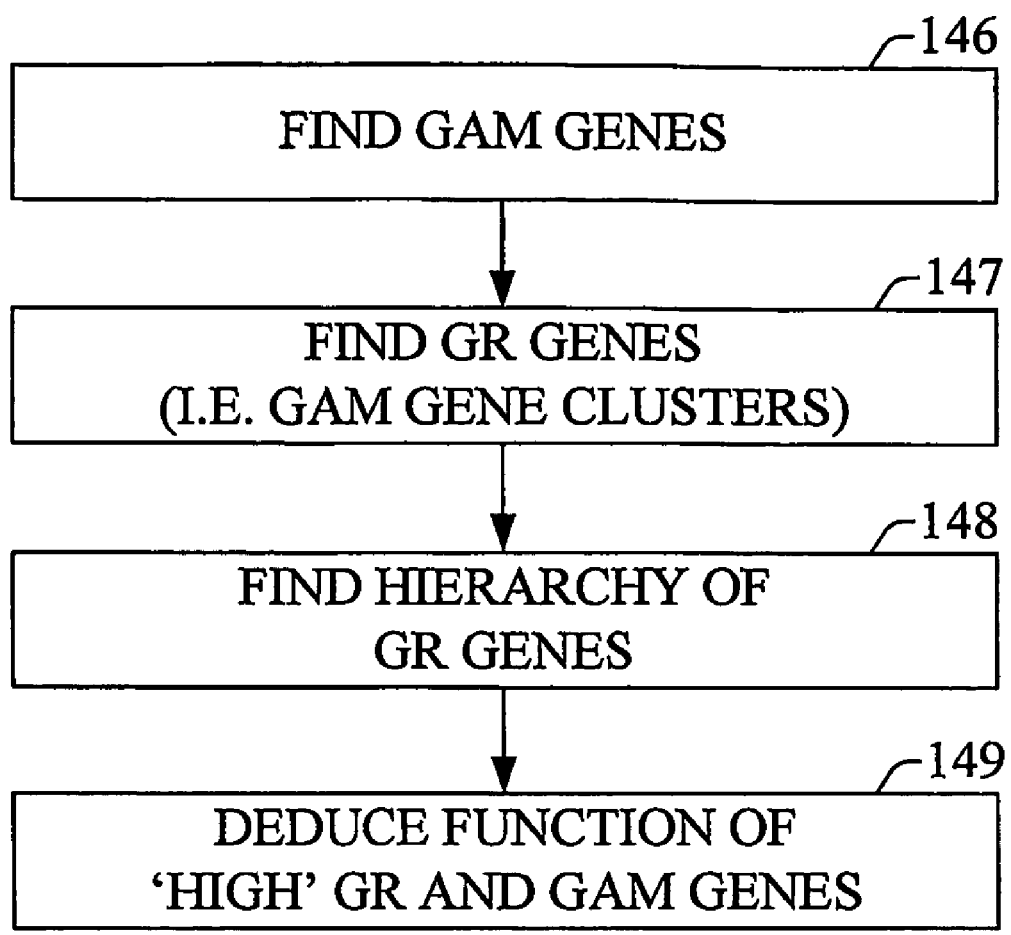
FIG. 18 is a block diagram illustrating an overview of a methodology for finding novel genes and novel operon-like genes of the present invention, and their respective functions.

Reference is now made to FIG. 18 which is a block diagram illustrating an overview of a methodology for finding novel genes and operon-like genes of the present invention, and their respective functions.

According to a preferred embodiment of the present invention, the methodology to finding novel genes of the present invention and their function comprises of the following major steps:

First, genes of the novel group of genes of the present invention, referred to here as GAM genes, as designated by reference numeral 146, are located and their function elicited by detecting target proteins they bind and the function of those target proteins, as described hereinabove with reference to FIGS. 9 through 15.

Next, genes of a novel group of operon-like genes of the present invention, referred to here as GR genes, as designated by reference numeral 147, are located, by locating clusters of proximally located GAM genes, based on the previous step.

Consequently, the hierarchy of GR and GAM genes is elicited, as designated by reference numeral 148: binding sites for non-protein-binding GAM genes comprised in each GR gene found are sought adjacent to other GR genes. When found, such a binding site indicates that the connection between the GAM and the GR the expression of which it modulates, and thus the hierarchy of the GR genes and the GAM genes they comprise.

Lastly, the function of GR genes and GAM genes which are 'high' in the hierarchy, i.e. GAM genes which modulate expression of other GR genes rather than directly modulating expression of target proteins, may be deduced. A preferred approach is as follows: The function of protein-modulating GAM genes is deducible from the protein which they modulate, provided that the function of these target proteins is known. The function of 'higher' GAM genes may be deduced by comparing the function of protein-modulating GAM genes, as designated by reference numeral 149, with the hierarchical relationships by which the 'higher' GAM genes are connected of the protein-modulating GAM genes. For example, given a group of several protein-modulating GAM genes, which collectively cause a protein expression pattern typical of a certain cell-type, then a 'higher' GAM gene is sought which modulates expression of GR genes, which perhaps modulate expression of other genes which eventually modulate expression of the given group of protein-modulating GAM genes. The 'higher' GAM gene found in this manner is taken to be responsible for differentiation of that cell-type, as per the conceptual model of the invention described hereinabove with reference to FIG. 6

Figure 19:
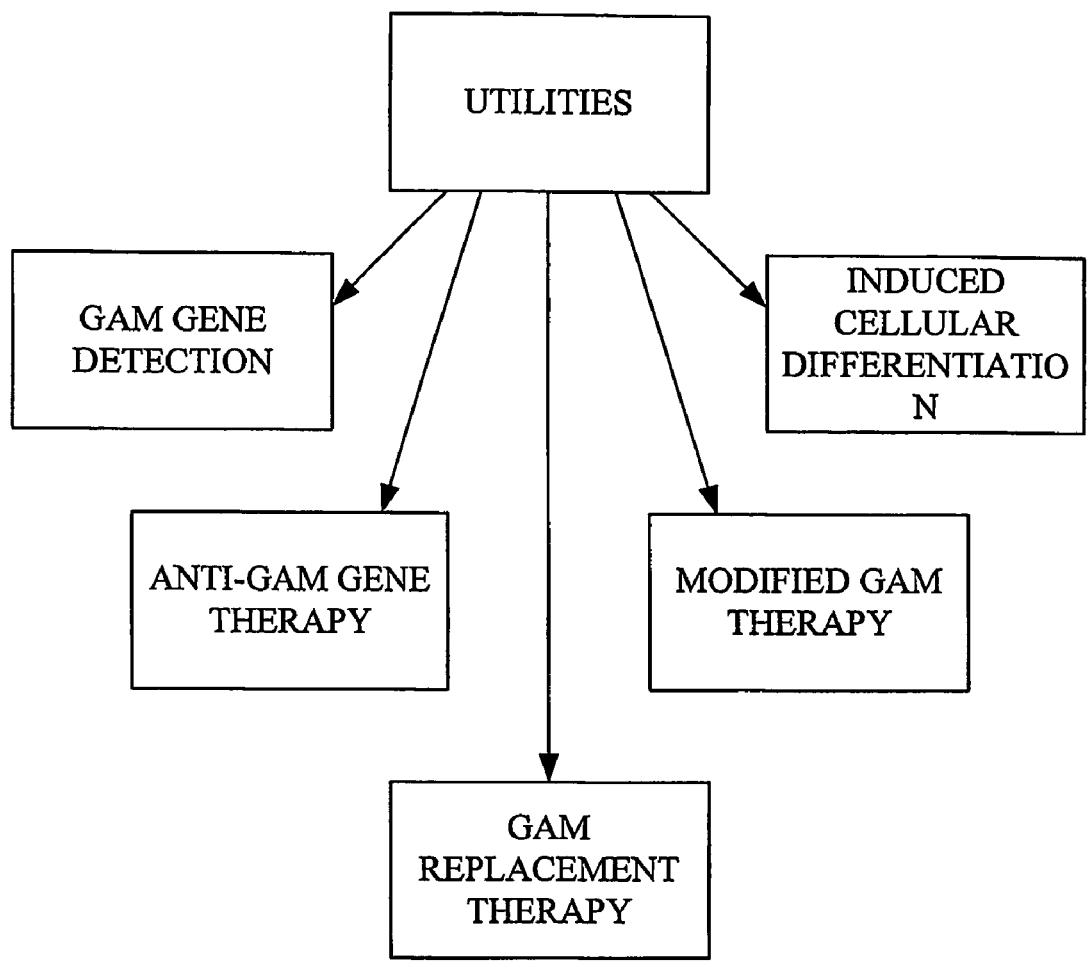
FIG. 19 is a block diagram illustrating different utilities of novel genes and novel operon-like genes, both of the present invention.

Reference is now made to FIG. 19 which is a block diagram illustrating different utilities of genes of the novel group of genes of the present invention referred to here as GAM genes and GR genes.

The present invention discloses a first plurality of novel genes referred to here as GAM genes, and a second plurality of operon-like genes referred to here as GR genes, each of the GR genes encoding a plurality of GAM genes. The present invention further discloses a very large number of known target-genes, which are bound by, and the expression of which is modulated by each of the novel genes of the present invention. Published scientific data referenced by the present invention provides specific, substantial, and credible evidence that the above mentioned target genes modulated by novel genes of the present invention, are associated with various diseases. Specific novel genes of the present invention, target genes thereof and diseases associated therewith, are described hereinbelow with reference to Tables 1 through 7. It is therefore appreciated that a function of GAM genes and GR genes of the present invention is modulation of expression of target genes related to known diseases, and that therefore utilities of novel genes of the present invention include diagnosis and treatment of the above mentioned diseases. FIG. 19 describes various types of diagnostic and therapeutic utilities of novel genes of the present invention.

A utility of novel genes of the present invention is detection of GAM genes and of GR genes. It is appreciated that since GAM genes and GR genes modulate expression of disease related target genes, that detection of expression of GAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the above mentioned related diseases, for disease diagnosis and prevention purposes, and for monitoring disease progress.

Another utility of novel genes of the present invention is anti-GAM gene therapy, a mode of therapy which allows up regulation of a disease related target-gene of a novel GAM gene of the present invention, by lowering levels of the novel GAM gene which naturally inhibits expression of that target gene. This mode of therapy is particularly useful with respect to target genes which have been shown to be under-expressed in association with a specific disease. Anti-GAM gene therapy is further discussed hereinbelow with reference to FIGS. 20A and 20B.

A further utility of novel genes of the present invention is GAM replacement therapy, a mode of therapy which achieves down regulation of a disease related target-gene of a novel GAM gene of the present invention, by raising levels of the GAM gene which naturally inhibits expression of that target gene. This mode of therapy is particularly useful with respect to target genes which have been shown to be over-expressed in association with a specific disease. GAM replacement therapy involves introduction of supplementary GAM gene products into a cell, or stimulation of a cell to produce excess GAM gene products. GAM replacement therapy may preferably be achieved by transfecting cells with an artificial DNA molecule encoding a GAM gene, which causes the cells to produce the GAM gene product, as is well known in the art. Yet a further utility of novel genes of the present invention is modified GAM therapy. Disease conditions are likely to exist, in which a mutation in a binding site of a GAM gene prevents natural GAM gene to effectively bind inhibit a disease related target-gene, causing up regulation of that target gene, and thereby contributing to the disease pathology. In such conditions, a modified GAM gene is designed which effectively binds the mutated GAM binding site, i.e. is an effective anti-sense of the mutated GAM binding site, and is introduced in disease effected cells. Modified GAM therapy is preferably achieved by transfecting cells with an artificial DNA molecule encoding the modified GAM gene, which causes the cells to produce the modified GAM gene product, as is well known in the art.

An additional utility of novel genes of the present invention is induced cellular differentiation therapy. As aspect of the present invention is finding genes which determine cellular differentiation, as described hereinabove with reference to FIG. 18. Induced cellular differentiation therapy comprises transfection of cell with such GAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining GAM gene, thus stimulating these cells to differentiate appropriately.

Figure 20A:
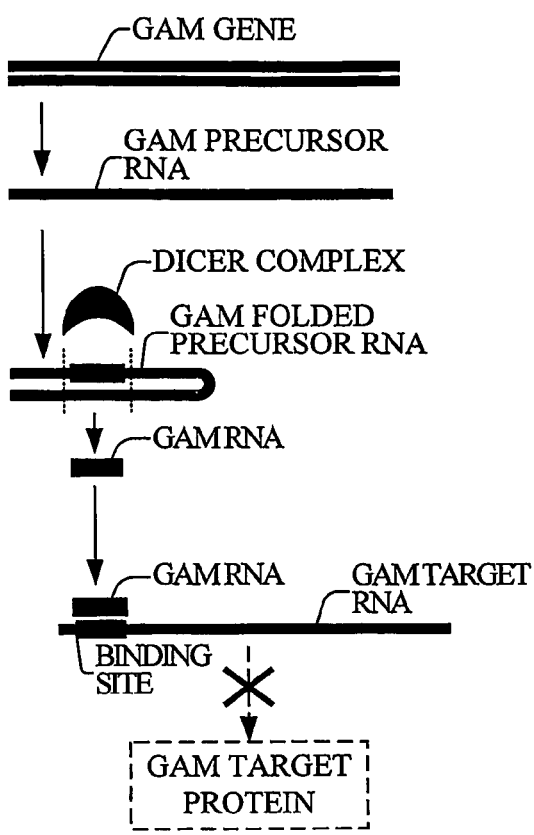
FIGS. 20A and 20B are simplified diagrams, which when taken together illustrate a mode of gene therapy applicable to novel genes of the present invention.
Figure 20B:
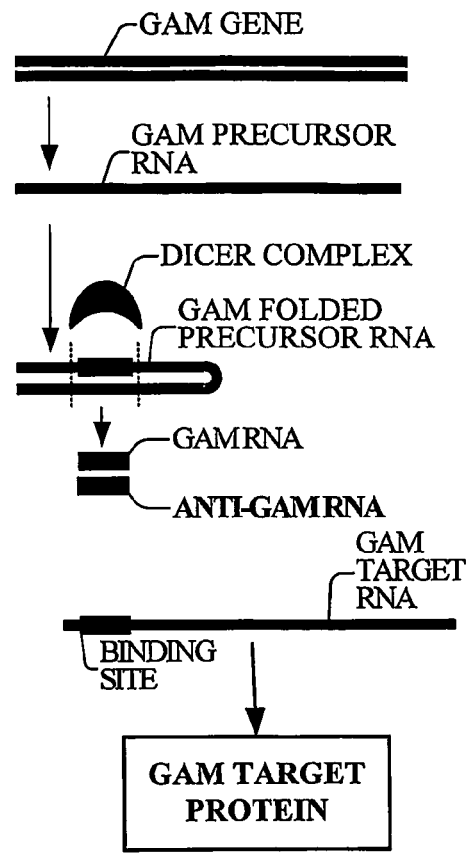

Reference is now made to FIGS. 20A and 20B, simplified diagrams which when taken together illustrate anti-GAM gene therapy mentioned hereinabove with reference to FIG. 19. A utility of novel genes of the present invention is anti-GAM gene therapy, a mode of therapy which allows up regulation of a disease related target-gene of a novel GAM gene of the present invention, by lowering levels of the novel GAM gene which naturally inhibits expression of that target gene. FIG. 20A shows a normal GAM gene, inhibiting translation of a target gene of GAM gene, by binding to a BINDING SITE found in an untranslated region of GAM TARGET RNA, as described hereinabove with reference to FIG. 8.

FIG. 20B shows an example of anti-GAM gene therapy. ANTI-GAM RNA is short artificial RNA molecule the sequence of which is an anti-sense of GAM RNA. Anti-GAM treatment comprises transfecting diseased cells with ANTI-GAM RNA, or with a DNA encoding thereof. The ANTI-GAM RNA binds the natural GAM RNA, thereby preventing binding of natural GAM RNA to its BINDING SITE. This prevents natural translation inhibition of GAM TARGET RNA by GAM RNA, thereby up regulating expression of GAM TARGET PROTEIN.

It is appreciated that anti-GAM gene therapy is particularly useful with respect to target genes which have been shown to be under-expressed in association with a specific disease.

Furthermore, anti-GAM therapy is particularly useful, since it may be used in situations in which technologies known in the art as RNAi and siRNA can not be utilized. As in known in the art, RNAi and siRNA are technologies which offer means for artificially inhibiting expression of a target protein, by artificially designed short RNA segments which bind complementarily to mRNA of said target protein. However, RNAi and siRNA can not be used to directly upregulate translation of target proteins.

Reference is now made to FIG. 21, which is a table summarizing laboratory validation results that validate efficacy of the bioinformatic gene detection engine 100 of FIG. 9. In order to assess efficacy of the bioinformatic gene detection engine 100, novel genes predicted thereby are preferably divided into 4 DETECTION ACCURACY GROUPS (first column), designated A through D, ranking GAMS from the most probable GAMs to the least probable GAMs, using the scores of HAIRPIN DETECTOR 114 and DICER-CUT LOCATION DETECTOR 116 as follows:

Group A: The score of the HAIRPIN-DETECTOR is above 0.7, the overall score of the two-phased predictor is above 0.55, and the score of the second phase of the two-phased predictor is above 0.75. Group B: The score of the EDIT-DISTANCE predictor is equal or above 17. In both groups A and B one miRNA is predicted for each hairpin. Group C: The score of the HAIRPIN-DETECTOR is between 0.6 and 0.7, and the overall score of the two-phased predictor is above 0.55. Group D: The score of the HAIRPIN-DETECTOR is between 0.3 and 0.6, and the overall score of the two-phased predictor is above 0.55. In both groups C and D, for each hairpin both sides of the double stranded window are given as output, and are examined in the lab. The groups are mutually exclusive, i.e. in groups A, C and D all hairpins score less than 17 in the EDIT-DISTANCE predictor. It is appreciated that the division into groups is not exhaustive: 344 of the 440 published hairpins, and 4747 of the 8607 novel GAMs of the present invention, belong to one of the groups.

Sample novel bioinformatically predicted genes, of each of these groups are sent to the laboratory for validation (third column), and the number (fourth column) and percent (fifth column) of successful validation of predicted genes is noted for each of the groups, as well as overall (bottom line). The number of novel genes explicitly specified by present invention belonging to each of the four groups is noted (sixth column), as is the number of novel genes found in intergenic and intronic RNA (seventh and eighth columns). Expected positives (eighth column) is deduced by multiplying the % success in the lab validation by the number of novel GAMs detected in intronic and intergenic RNA databases.

It is appreciated that the present invention comprises 4747 novel GAM genes, which fall into one of these four detection accuracy groups, and that the bioinformatic prediction is substantiated by a group of 50 novel GAM genes validated by laboratory means, out of 147 genes which were tested in the lab, resulting in validation of an overall 34% accuracy. The top group demonstrated 50% accuracy. Pictures of test-results of specific genes in the abovementioned four groups, as well as the methodology used for validating the expression of predicted genes is elaborated hereinbelow with reference to FIG. 22.

It is further appreciated that failure to detect a gene in the lab does not necessarily indicate a mistaken bioinformatic prediction. Rather, it may be due to technical sensitivity limitation of the lab test, or because the gene is not expressed in the tissue examined, or at the development phase tested.

It is still further appreciated that in general these findings are in agreement with the expected bioinformatic accuracy, as describe hereinabove with reference to FIG. 13B: assuming 80% accuracy of the hairpin detector 114 and 80% accuracy of the dicer-cut location detector 116 and 80% accuracy of the lab validation, this would result in 50% overall accuracy of the genes validated in the lab.

Figure 22:
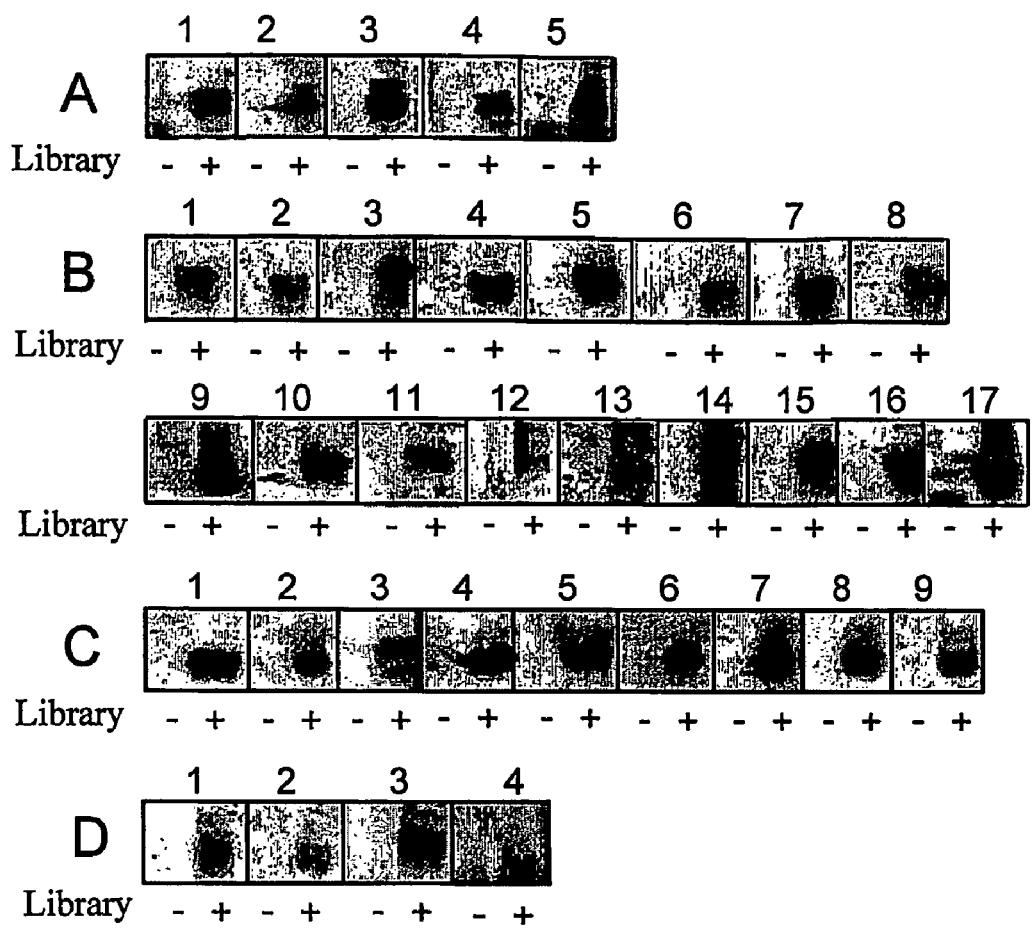
FIG. 22 is a picture of laboratory results validating the expression of 25 novel genes detected by a bioinformatic gene detection engine constructed and operative in accordance with a preferred embodiment of the present invention, thereby validating the efficacy of the gene detection engine of the present invention.

Reference is now made to FIG. 22 which is a picture of laboratory results validating the expression of 25 novel genes detected by the bioinformatic gene detection engine 100, in the four detection accuracy groups A through D described hereinabove with reference to FIG. 21.

Each row in FIG. 22, designated A through D, correlates to a corresponding one of the four detection accuracy groups A-D, described hereinabove with reference to FIG. 21. In each row, pictures of several genes validated by hybridization of PCR-product southern-blots, are provided, each corresponding to a specific GAM gene, as elaborated hereinbelow. These PCR-product hybridization pictures are designated 1 through 5 in the A group, 1 through 12 in the B group, 1 through 9 in the C group, and 1 through 4 in the D group. In each PCR hybridization picture, 2 lanes are seen: the test lane, designated '+' and the control lane, designated '−'. For convenience of viewing the results, all PCR-product hybridization pictures of FIG. 22 have been shrunk ×4 vertically. It is appreciated that for each of the tested genes, a clear hybridization band appears in the test ('+') lane, but not in the control ('−') lane.

Specifically, FIG. 22 shows pictures of PCR-product hybridization validation by southern-blot, the methodology of which is described hereinbelow, to the following novel GAM genes:

DETECTION ACCURACY GROUP A: (1) GAM8297.1; (2) GAM5346.1; (3) GAM281.1; (4) GAM8554.1; and (5) GAM2071.1.

DETECTION ACCURACY GROUP B: (1) GAM7553.1; (2) GAM5385.1; (3) GAM5227.1; (4) GAM7809.1; (5) GAM1032.1; (6) GAM3431.1; (7) GAM7933.1; (8) GAM3298.1; (9) GAM116.1; (10) GAM3418.1 (later published by other researchers as MIR23); (11) GAM3499.1; (12) GAM3027.1; (13) GAM7080.1; (14) GAM895.1; and (15) GAM2608.1, (16) GAM20, and (17) GAM21.

DETECTION ACCURACY GROUP C: (1) GAM3770.1; (2) GAM1338.1; (3) GAM7957.1; (4) GAM391.1; (5) GAM 8678.1; (6) GAM2033.1; (7) GAM7776.1; (8) GAM8145.1; and (9) GAM 633.1.

DETECTION ACCURACY GROUP D: (1) GAM19; (2) GAM8358.1; (3) GAM3229.1; and (4) GAM7052.1.

In addition to the PCR detection, the following GAMs were cloned and sequenced: GAM1338.1, GAM7809.1, GAM116.1, GAM3418.1 (later published by other researchers as MIR23), GAM3499.1, GAM3027.1, GAM7080.1, and GAM21.

The PCR-product hybridization validation methodology used is briefly described as follows. In order to validate the expression of predicted novel GAM genes, and assuming that these novel genes are probably expressed at low concentrations, a PCR product cloning approach was set up through the following strategy: two types of cDNA libraries designated "One tailed" and "Ligation" were prepared from frozen HeLa S100 extract (4c Biotech, Belgium) size fractionated RNA. Essentially, Total S100 RNA was prepared through an SDS-Proteinase K incubation followed by an acid Phenol-Chloroform purification and Isopropanol precipitation. Alternatively, total HeLa RNA was also used as starting material for these libraries.

Fractionation was done by loading up to 500 µg per YM100 Amicon Microcon column (Millipore) followed by a 500 g centrifugation for 40 minutes at 4° C. Flowthrough "YM100" RNA consisting of about ¼ of the total RNA was used for library preparation or fractionated further by loading onto a YM30 Amicon Microcon column (Millipore) followed by a 13,500 g centrifugation for 25 minutes at 4° C. Flowthrough "YM30" was used for library preparation as is and consists of less than 0.5% of total RNA. For the both the "ligation" and the "One-tailed" libraries RNA was dephosphorilated and ligated to an RNA (lowercase)-DNA (UPPERCASE) hybrid 5'-phosphorilated, 3' idT blocked 3'-adapter (5'-P-uuuAAC-CGCATTCTC-idT-3' Dharmacon # P-002045-01-05) (SEQ ID NO: 548157) (as elaborated in Elbashir et al 2001) resulting in ligation only of RNase III type cleavage products. 3'-Ligated RNA was excised and purified from a half 6%, half 13% polyacrylamide gel to remove excess adapter with a Nanosep 0.2 µM centrifugal device (Pall) according to instructions, and precipitated with glycogen and 3 volumes of Ethanol. Pellet was resuspended in a minimal volume of water. For the "ligation" library a DNA (UPPERCASE)-RNA (lowercase) hybrid 5'-adapter (5'-TACTAATACGACTCAC-Taaa-3' Dharmacon # P-002046-01-05) (SEQ ID NO: 548158) was ligated to the 3'-adapted RNA, reverse transcribed with "EcoRI-RT": (5'-GACTAGCTGGAAT-TCAAGGATGCGGTTAAA-3') (SEQ ID NO: 548159), PCR amplified with two external primers essentially as in Elbashir et al 2001 except that primers were "EcoRI-RT" and "PstI Fwd" (5'-CAGCCAACGCTGCAGATACGACTCAC-TAAA-3') (SEQ ID NO: 548160). This PCR product was used as a template for a second round of PCR with one hemispecific and one external primer or with two hemispecific primers.

For the "One tailed" library the 3'-Adapted RNA was annealed to 20 pmol primer "EcRI RT" by heating to 70° C. and cooling 0.1° C./sec to 30° C. and then reverse transcribed with Superscript II RT (According to instructions, Invitrogen) in a 20 µl volume for 10 alternating 5 minute cycles of 37° C. and 45° C. Subsequently, RNA was digested with 1 µl 2M NaOH, 2 mM EDTA at 65° C. for 10 minutes. cDNA was loaded on a polyacrylamide gel, excised and gel-purified from excess primer as above (invisible, judged by primer run alongside) and resuspended in 13 µl of water. Purified cDNA was then oligo-dC tailed with 400 U of recombinant terminal transferase (Roche molecular biochemicals), 1 µl 100 µM dCTP, 1 µl 15 mM $CoCl_2$, and 4 µl reaction buffer, to a final volume of 20 µl for 15 minutes at 37° C. Reaction was stopped with 2 µl 0.2M EDTA and 15 µl 3M NaOAc pH 5.2. Volume was adjusted to 150 µl with water, Phenol:Bromochloropropane 10:1 extracted and subsequently precipitated with glycogen and 3 volumes of Ethanol. C-tailed cDNA was used as a template for PCR with the external primers "T3-PstBsg(G/I)$_{18}$" (5'-AATTAACCCTCACTAAAGGCTGCAGGTGC AGGIGGGIIGGGIIGGGIIGN-3' [SEQ ID NO: 548161] where I stands for Inosine and N for any of the 4 possible deoxynucleotides), and with "EcoRI Nested" (5'-GGAAT-TCAAGGATGCGGTTA-3') (SEQ ID NO: 548162). This PCR product was used as a template for a second round of PCR with one hemispecific and one external primer or with two hemispecific primers.

Hemispecific primers were constructed for each predicted GAM by an in-house program designed to choose about half of the 5' or 3' sequence of the GAM corresponding to a TM° of about 30°-34° C. constrained by an optimized 3' clamp, appended to the cloning adapter sequence (for "One-tailed" libraries 5'-GGNNGGGNNG (SEQ ID NO: 548163), on the 5' end of the GAM, or TTTAACCGCATC-3' (SEQ ID NO: 548164), on the 3' end of the GAM. For "Ligation" libraries the same 3' adapter and 5'-CGACTCACTAAA (SEQ ID NO: 548165) on the 5' end). Consequently, a fully complementary primer of a TM° higher than 60° C. was created covering only one half of the GAM sequence permitting the unbiased elucidation by sequencing of the other half.

Confirmation of GAM Sequence Authenticity of PCR Products:

SOUTHERN BLOT: PCR-product sequences were confirmed by southern blot (Southern EM. Biotechnology. 1992; 24:122-39. (1975)) and hybridization with DNA oligonucleotide probes synthesized against predicted GAMs. Gels were transferred onto a Biodyne PLUS 0.45 µm, (Pall) positively charged nylon membrane and UV cross-linked. Hybridization was performed overnight with DIG-labeled probes at 42° C. in DIG Easy-Hyb buffer (Roche). Membranes were washed twice with 2×SSC and 0.1% SDS for 10 min. at 42° C. and then washed twice with 0.5×SSC and 0.1% SDS for 5 min at 42° C. The membrane was then developed by using a DIG luminescent detection kit (Roche) using anti-DIG and CSPD reaction, according to the manufacturer's protocol. All probes were prepared according to the manufacturers (Roche Molecular Biochemicals) protocols: Digoxigenin (DIG) labeled antisense transcripts was prepared from purified PCR products using a DIG RNA labeling kit with T3 RNA polymerase. DIG labeled PCR was prepared by using a DIG PCR labeling kit. 3'-DIG-tailed oligo ssDNA antisense probes, containing DIG-dUTP and dATP at an average tail length of 50 nucleotides were prepared from 100 pmole oligonucleotides with the DIG Oligonucleotide Labeling Kit.

CLONING: PCR products were inserted into pGEM-T (Promega) or pTZ57 (MBI Fermentas), transformed into competent JM109 *E. coli* (Promega) and sown on LB-Amp plates with IPTG/Xgal. White and light-blue colonies were transferred to duplicate gridded plates, one of which was blotted onto a membrane (Biodyne Plus, Pall) for hybridization with DIG tailed oligo probes (according to instructions, Roche) corresponding to the expected GAM. Plasmid DNA from positive colonies was sequenced.

Figures 23A, 23B, 23C:
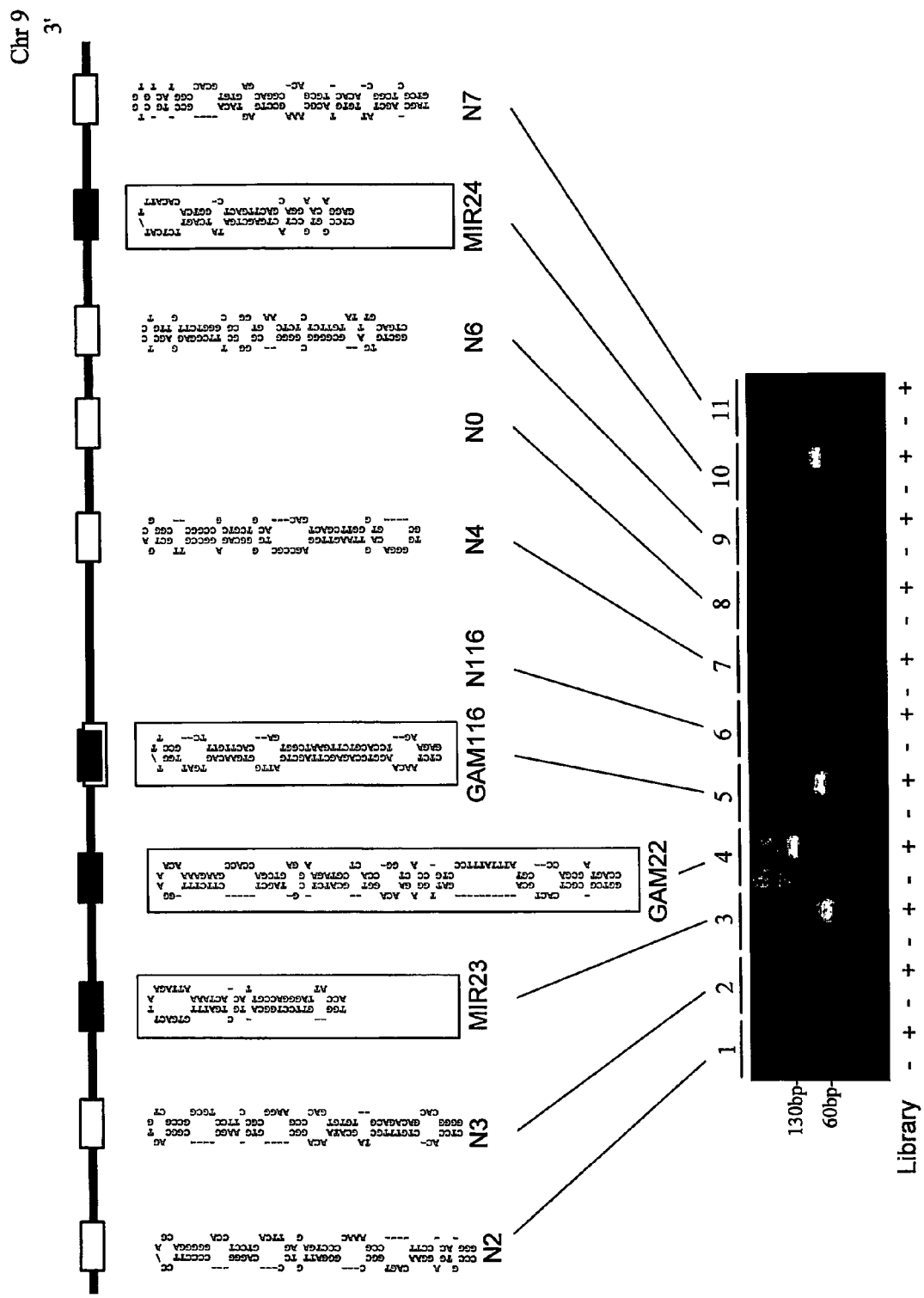
FIG. 23A is a schematic representation of an 'operon like' cluster of novel gene hairpin sequences detected bioinformatically by a bioinformatic gene detection engine constructed and operative in accordance with a preferred embodiment of the present invention, and non-GAM hairpin useful as negative controls thereto.
FIG. 23B is a schematic representation of secondary folding of hairpins of the operon-like cluster of FIG. 23A. The hairpins are associated with the following SEQ ID NOs: N2 (SEQ ID NO: 548172): N3 (SEQ ID NO: 548173): MIR23 (SEQ ID NO: 548174): GAM22 (SEQ ID NO: 548175): GAM116 (SEQ ID NO: 548176): N4 (SEQ ID NO: 548177): N6 (SEQ ID NO: 548178): MIR24 (SEQ ID NO: 548179): N7 (SEQ ID NO: 548180)
FIG. 23C is a picture of laboratory results demonstrating expression of novel genes of FIGS. 23A and 23B, and lack of expression of the negative controls, thereby validating efficacy of bioinformatic detection of GAM genes and GR genes of the present invention, by a bioinformatic gene detection engine constructed and operative in accordance with a preferred embodiment of the present invention.

Reference is now made to FIG. 23A, which is a schematic representation of a novel human GR gene, herein designated GR12731, located on chromosome 9, comprising 2 known MIR genes—MIR24 and MIR23, and 2 novel GAM genes, herein designated GAM22 and GAM116, all marked by solid black boxes. FIG. 23A also schematically illustrates 6 non-GAM hairpin sequences, and one non-hairpin sequence, all marked by white boxes, and serving as negative controls. By 'non-GAM hairpin sequences' is meant sequences of a similar length to known MIR PRECURSOR sequences, which form hairpin secondary folding pattern similar to MIR PRE-CURSOR hairpins, and yet which are assessed by the bioinformatic gene detection engine 100 not to be valid GAM PRECURSOR hairpins. It is appreciated that FIG. 23A is a simplified schematic representation, reflecting only the order in which the segments of interest appear relative to one another, and not a proportional distance between the segments.

Reference is now made to FIG. 23B, which is a schematic representation of secondary folding of each of the MIRs and GAMs of GR GR12731—MIR24, M23, GAM22 and GAM116, and of the negative control non-GAM hairpins, herein designated N2, N3, N116, N4, N6 and N7. N0 is a non-hairpin control, of a similar length to that of known MIR PRECURSOR hairpins. It is appreciated that the negative controls are situated adjacent to and in between real MIR and GAM genes, and demonstrates similar secondary folding patterns to that of known MIRs and GAMs.

Reference is now made to FIG. 23C, which is a picture of laboratory results of a PCR test upon a YM100 "ligation"-library, utilizing specific primer sets directly inside the boundaries of the hairpins. Due to the nature of the library the only PCR amplifiable products can result from RNaseRIII type enzyme cleaved RNA, as expected for legitimate hairpin precursors presumed to be produced by DROSHA (Lee et al, Nature 425 415-419, 2003). FIG. 23C demonstrates expression of hairpin precursors of known MIR genes—MIR23 and MIR4, and of novel bioinformatically detected GAM22 and GAM116 genes predicted bioinformatically by a system constructed and operative in accordance with a preferred embodiment of the present invention. FIG. 23C also shows that none of the 7 controls (6 hairpins designated N2, N3, N23, N4, N6 and N7 and 1 non-hairpin sequence designated N0) were expressed. N116 is a negative control sequence partially overlapping GAM116.

In the picture, test lanes including template are designated '+' and the control lane is designated '−'. It is appreciated that for each of the tested hairpins, a clear PCR band appears in the test ('+') lane, but not in the control ('−') lane.

FIGS. 23A through 23C, when taken together validate the efficacy of the bioinformatic gene detection engine in: (a) detecting known MIR genes; (b) detecting novel GAM genes which are found adjacent to these MIR genes, and which despite exhaustive prior biological efforts and bioinformatic detection efforts, went undetected; (c) discerning between GAM (or MIR) PRECURSOR hairpins, and non-GAM hairpins.

It is appreciated that the ability to discern GAM-hairpins from non-GAM-hairpins is very significant in detecting GAM genes, since hairpins in general are highly abundant in the genome. Other MIR prediction programs have not been able to address this challenge successfully.

Reference is now made to FIG. 24A which is an annotated sequence of an EST comprising a novel gene detected by the gene detection system of the present invention. FIG. 24A shows the nucleotide sequence of a known human non-protein coding EST (Expressed Sequence Tag), identified as EST72223. The EST72223 clone obtained from TIGR database (Kirkness and Kerlavage, 1997) was sequenced to yield the above 705 bp transcript with a polyadenyl tail. It is appreciated that the sequence of this EST comprises sequences of one known miRNA gene, identified as MIR98, and of one novel GAM gene, referred to here as GAM25, detected by the bioinformatic gene detection system of the present invention and described hereinabove with reference to FIG. 9.

The sequences of the precursors of the known MIR98 and of the predicted GAM25 are in bold, the sequences of the established miRNA 98 and of the predicted miRNA GAM25 are underlined.

Figures 24B, 24C:
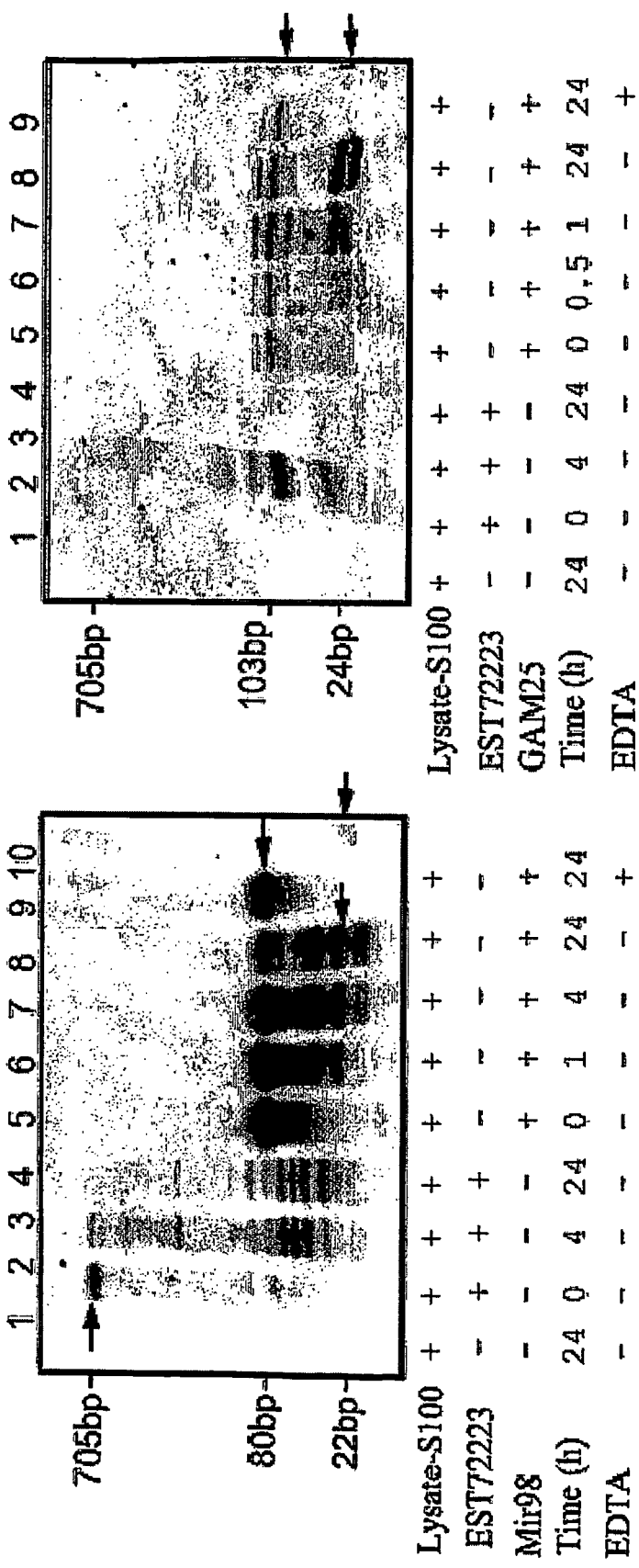
FIGS. 24B and 24C are pictures of laboratory results demonstrating laboratory confirmation of expression of known gene MIR98 and of novel bioinformatically detected gene GAM25 respectively, both of FIG. 24A, thus validating the bioinformatic gene detection system of the present invention.

Reference is now made to FIGS. 24B and 24C that are pictures of laboratory results, which when taken together demonstrate laboratory confirmation of expression of the bioinformatically detected novel gene of FIG. 24A.

In two parallel experiments, an enzymatically synthesized capped, EST72223 RNA transcript, was incubated with Hela S100 lysate for 0 minutes, 4 hours and 24 hours. RNA was subsequently harvested, run on a denaturing polyacrylamide gel, and reacted with a 102 nt and a 145 nt antisense MIR98 and GAM25 transcript probes respectively. The Northern blot results of these experiments demonstrated processing of EST72223 RNA by Hela lysate (lanes 2-4, in 24B and 24C), into ~80 bp and ~22 bp segments, which reacted with the MIR98 probe (24B), and into ~100 bp and ~24 bp segments, which reacted with the GAM25 probe (24C). These results demonstrate the processing of EST72223 by Hela lysate into MIR98 and GAM25. It is also appreciated from FIG. 24C (lane 1) that Hela lysate itself reacted with the GAM25 probe, in a number of bands, including a ~100 bp band, indicating that GAM25-precursor is endogenously expressed in Hela cells. The presence of additional bands, higher than 100 bp in lanes 5-9 probably corresponds to the presence of nucleotide sequences in Hela lysate, which contain the GAM25 sequence.

In addition, in order to demonstrate the kinetics and specificity of the processing of MIR98 and GAM25 miRNA precursors into their respective miRNA's, transcripts of MIR98 and of the bioinformatically predicted GAM25, were similarly incubated with Hela S100 lysate, for 0 minutes, 30 minutes, 1 hour and 24 hours, and for 24 hours with the addition of EDTA, added to inhibit Dicer activity, following which RNA was harvested, run on a polyacrylamide gel and reacted with MIR98 and GAM25 probes. Capped transcripts were prepared for in-vitro RNA cleavage assays with T7 RNA polymerase including a $m^7G(5')ppp(5')$ G-capping reaction using the m Message m Machine kit (Ambion). Purified PCR products were used as template for the reaction. These were amplified for each assay with specific primers containing a T7 promoter at the 5' end and a T3 RNA polymerase promoter at the 3'end. Capped RNA transcripts were incubated at 30° C. in supplemented, dialysis concentrated, Hela S100 cytoplasmic extract (4C Biotech, Seneffe, Belgium). The Hela S100 was supplemented by dialysis to a final concentration of 20 mM Hepes, 100 mM KCl, 2.5 mM $MgCl_2$, 0.5 mM DTT, 20% glycerol and protease inhibitor cocktail tablets (Complete mini Roche Molecular Biochemicals). After addition of all components, final concentrations were 100 mM capped target RNA, 2 mM ATP, 0.2 mM GTP, 500 U/ml RNasin, 25 µg/ml creatine kinase, 25 mM creatine phosphate, 2.5 mM DTT and 50% S100 extract. Proteinase K, used to enhance Dicer activity (Zhang H, Kolb F A, Brondani V, Billy E, Filipowicz W. Human Dicer preferentially cleaves dsRNAs at their termini without a requirement for ATP.EMBO J. 2002 Nov. 1; 21(21): 5875-85) was dissolved in 50 mM Tris-HCl pH 8, 5 mM $CaCl_2$, and 50% glycerol, was added to a final concentration of 0.6 mg/ml. Cleavage reactions were stopped by the addition of 8 volumes of proteinase K buffer (200 Mm Tris-Hcl, pH 7.5, 25 m M EDTA, 300 mM NaCl, and 2% SDS) and incubated at 65° C. for 15 min at different time points (0, 0.5, 1, 4, 24 h) and subjected to phenol/chloroform extraction. Pellets were dissolved in water and kept frozen. Samples were analyzed on a segmented half 6%, half 13% polyacrylamide 1×TBE-7M Urea gel.

The Northern blot results of these experiments demonstrated an accumulation of a ~22 bp segment which reacted with the MIR98 probe, and of a ~24 bp segment which reacted with the GAM25 probe, over time (lanes 5-8). Absence of these segments when incubated with EDTA (lane 9), which is known to inhibit Dicer enzyme (Zhang et al., 2002), supports the notion that the processing of MIR98 and GAM25 miRNA's from their precursors is mediated by Dicer enzyme, found in Hela lysate. The molecular sizes of EST72223, MIR-98 and GAM25 are indicated by arrows.

Transcript products were 705 nt (EST72223), 102 nt (MIR98), 125 nt (GAM25) long.EST72223 was PCR amplified with T7-EST 72223 forward primer:

5'-TAATACGACTCACTATAGGCCCTTATTA-GAGGATTCTGCT-3' (SEQ ID NO: 548166)

and T3-EST72223 reverse primer:

5'-AATTAACCCTCACTAAAG-GTTTTTTTTTCCTGAGACAGAGT-3' (SEQ ID NO: 548167).

MIR98 was PCR amplified using EST72223 as a template with T7MIR98 forward primer:

5-'TAATACGACTCACTATAGGGTGAGGTAG-TAAGTTGTATTGTT-3' (SEQ ID NO: 548168)

and T3MIR98 reverse primer:

5'-AATTAACCCTCACTAAAGGGAAAGTAG-TAAGTTGTATAGTT-3' (SEQ ID NO: 548169).

GAM25 was PCR amplified using EST72223 as a template with GAM25 forward primer: 5'-GAGGCAGGAGAAT-TGCTTGA-3' (SEQ ID NO: 548170) and T3-EST72223 reverse primer:

5'-AATTAACCCTCACTAAAGGCCTGAGACA-GAGTCTTGCTC-3' (SEQ ID NO: 548171).

To validate the identity of the band shown by the lower arrow in FIG. 24C, a RNA band parallel to a marker of 24 base was excised from the gel and cloned as in Elbashir et al (2001) and sequenced. 90 clones corresponded to the sequence of GAM25, three corresponded to GAM25* (the opposite arm of the hairpin with a 1-3 nucleotide 3' overhang) and two to the hairpin-loop.

GAM25 was also validated endogenously by sequencing from both sides from a HeLa YM100 total-RNA "ligation" libraries, utilizing hemispecific primers as detailed in FIG. 22.

Taken together, these results validate the presence and processing of a novel MIR gene product, GAM25, which was predicted bioinformatically. The processing of this novel gene product, by Hela lysate from EST72223, through its precursor, to its final form was similar to that observed for known gene, MIR98.

It is appreciated that the data presented in FIGS. 24A, 24B and 24C when taken together validate the function of the bioinformatic gene detection engine 100 of FIG. 9. FIG. 24A shows a novel GAM gene bioinformatically detected by the bioinformatic gene detection engine 100, and FIGS. 24B and 24C show laboratory confirmation of the expression of this novel gene. This is in accord with the engine training and validation methodology described hereinabove with reference to FIG. 10.

It is appreciated by persons skilled in the art that the present invention is not limited by what has been particularly shown and described hereinabove. Rather the scope of the present invention includes both combinations and subcombinations of the various features described hereinabove as well as variations and modifications which would occur to persons skilled in the art upon reading the specifications and which are not in the prior art.

DETAILED DESCRIPTION OF LARGE TABLES

Table 1 comprises data relating to the source and location of novel GAM genes of the present invention, and contains the following fields:

| | |
|---|---|
| GENE NAME | Rosetta Genomics Ltd. gene nomenclature (see below) |
| GAM SEQ-ID | GAM Seq-ID, as in the Sequence Listing |
| PRECUR SEQ-ID | GAM precursor Seq-ID, as in the Sequence Listing |
| ORGANISM | Abbreviated (hsa = *Homo sapiens*) |
| CHR | Chromosome encoding the GAM gene |
| CHROMOSOME OFFSET | Offset of GAM precursor sequence on chromosome |
| SOURCE_REF-ID | Accession number of source sequence |
| SOURCE_OFFSET | Offset of GAM precursor sequence on source sequence |
| SRC | Source-type of GAM precursor sequence (see below) |
| GAM ACC | GAM Prediction Accuracy Group (see below); |

Table 2 comprises data relating to GAM precursors of novel GAM genes of the present invention, and contains the following fields:

| | |
|---|---|
| GENE NAME | Rosetta Genomics Ltd. gene nomenclature (see below) |
| PRECUR SEQ-ID | GAM precursor Seq-ID, as in the Sequence Listing |
| PRECURSOR SEQUENCE | GAM precursor nucleotide sequence (5' to 3') |
| FOLDED-PRECURSOR | Schematic representation of the GAM folded precursor, beginning 5' end (beginning of upper row) to 3' end (beginning of lower row), where the hairpin loop is positioned at the right part of the draw. |
| SRC | Source-type of GAM precursor sequence (see below) |
| GAM ACC | GAM Prediction Accuracy Group (see below); |

Table 3 comprises data relating to GAM genes of the present invention, and contains the following fields:

TABLE 3

| Genes | |
|---|---|
| GENE NAME | Rosetta Genomics Ltd. gene nomenclature (see below) |
| GAM SEQ-ID; GENE_SEQUENCE | GAM Seq-ID, as in the Sequence Listing Sequence (5' to 3') of the mature, 'diced' GAM gene |
| PRECUR SEQ-ID | GAM precursor Seq-ID, as in the Sequence Listing |
| SOURCE_REF-ID | Accession number of the source sequence |
| SRC | Source-type of GAM precursor sequence (see below) |
| GAM ACC | GAM Prediction Accuracy Group (see below); |

Table 4 comprises data relating to target-genens and binding sites of GAM genes of the present invention, and contains the following fields:

| | |
|---|---|
| GENE NAME | Rosetta Genomics Ltd. gene nomenclature (see below) |
| GAM SEQ-ID; | GAM Seq-ID, as in the Sequence Listing |
| TARGET | GAM target protein name |
| #BS | Number of binding sites of GAM onto Target |
| TARGET SEQ-ID | Target binding site Seq-ID, as in the Sequence Listing |
| TARGET REF-ID | Target accession number (GenBank) |
| UTR | Untranslated region of binding site/s (3' or 5') |
| UTR OFFSET | Offset of GAM binding site relative to UTR |
| TAR-BINDING-SITE-SEQ | Nucleotide sequence (5' to 3') of the target binding site |
| BINDING-SITE-DRAW | Schematic representation of the binding site, upper row present 5' to 3' sequence of the GAM, lower row present 3' to 5' sequence of the target. |
| SRC | Source-type of GAM precursor sequence (see below) |
| GAM ACC | GAM Prediction Accuracy Group (see below); |
| BS ACC | Binding-Site Accuracy Group (see below) |
| TAR ACC | Target Accuracy Group (see below); |

Table 5 comprises data relating to functions and utilities of novel GAM genes of the present invention, and containing the following fields:

| | |
|---|---|
| GENE NAME | Rosetta Genomics Ltd. gene nomenclature (see below) |
| TARGET | GAM target protein name |
| GENE_SEQUENCE | Sequence (5' to 3') of the mature, 'diced' GAM gene |
| GENE-FUNCTION | Description of the GAM functions and utilities |
| SRC | Source-type of GAM precursor sequence (see below) |
| GAM ACC | GAM Prediction Accuracy Group (see below) |
| TAR ACC | Target Accuracy Group (see below) |
| TAR DIS | Target Accuracy Group (see below); |

Table 6 comprises a bibliography of references supporting the functions and utilities of novel GAM genes of the present invention, and contains the following fields:

TABLE 6

| Gene Function References - Bibliography. | |
|---|---|
| GENE NAME | Rosetta Genomics Ltd. gene nomenclature (see below) |
| TARGET | GAM target protein name |
| REFERENCES | list of references relating to the target gene, |
| SRC | Source-type of GAM precursor sequence (see below) |
| GAM ACC | GAM Prediction Accuracy Group (see below) |
| TAR ACC | Target Accuracy Group (see below); and |

Table 7 comprises data relating to novel GR genes of the present inventions, and contains the following fields:

| | |
|---|---|
| GENE NAME | Rosetta Genomics Ltd. GR gene nomenclature |
| SOURCE START_OFFSET | Start-offset of GR gene relative to source sequence |
| SOURCE END_OFFSET | End-offset of GR gene relative to source sequence |
| SOURCE_REF-ID | Accession number of the source sequence |
| GAMS_ID'S_IN_GR | List of the GAM genes in the GR cluster |
| SRC | Source-type of GAM precursor sequence (see below) |
| GR ACC | GR Prediction Accuracy Group (see below). |

The following conventions and abbreviations are used in the tables:

GENE NAME is a RosettaGenomics Ltd. gene nomenclature. All GAMs are designated by GAMx.1 or GAMx.2 where x is the unique SEQ-ID. If the GAM precursor has a single prediction for GAM, it is designated by GAMx.1. Otherwise, the higher accuracy GAM prediction is designated by GAMx.1 and the second is designated by GAMx.2.

SRC is a field indicating the type of source in which novel genes were detected, as one of the following options: (1) TIGR Intergenic, (3) EST or Unigene Intron Intergenic, (4) TIGR Intron, (6) DNA Intergenic, (7) DNA Intron, (8) DNA Exon. Sequences are based on NCBI Build33 of the human genome. TIGR source is based on "Tentative Human Consensus" (THC) The Institute for Genomic Research which are not found in mRNA Intron/Exon according to NCBI GenBank genome annotation.

GAM ACC (GAM Prediction Accuracy Group) of gene prediction system: A—very high accuracy, B—high accuracy, C— moderate accuracy, D—low accuracy, as described hereinbelow with reference to FIG. 21.

BS ACC (Binding-Site Accuracy Group) indicates accuracy of total GAM-target binding prediction, considering the number of binding sites a GAM has on the target's UTR; A—very high accuracy, B—high accuracy, C—moderate accuracy, as described hereinbelow with reference to FIG. 14B.

TAR ACC (Target Accuracy Group) indicates accuracy of target binding site prediction, A—very high accuracy, B—high accuracy, C—moderate accuracy, as described hereinbelow with reference to FIG. 14B.

TAR DIS (Target Disease Relation Group) 'A' indicates if the target gene is known to have a specific causative relation to a specific known disease, based on the OMIM database. It is appreciated that this is a partial classification emphasizing genes which are associated with 'single gene' diseases etc. All genes of the present invention ARE associated with various diseases, although not all are in 'A' status.

GR ACC (GR Prediction Accuracy Group) indicates the maximum gene prediction accuracy among GAM genes of the cluster, A—very high accuracy, B—high accuracy, C—moderate accuracy, as described hereinbelow with reference to FIG. 14B.

SEQUENCE LISTING (548185 sequences)

SEQ ID NO: 1 - RNA, 73 nt, Human
aaaaagacauuggacuaaaugcuaauauauggaauagaagauuucccaauguuaauuuaguuaacaacuuuuu

SEQ ID NO: 2 - RNA, 62 nt, Human
aaaaagguccugguucacccuggagagucaccuuuccugggccaccggauuugggccuuuuu

SEQ ID NO: 3 - RNA, 78 nt, Human
aaaaccaaaaaacauauauauaauggcuucucugucaccgcuggugacaauaggucuuaaugcaaguuuucauguuuu

SEQ ID NO: 4 - RNA, 78 nt, Human
aaaagcuggauugcugauuuuugcuaauaaacaagauguuaaagaaugcaugacuguagcagaaaucucccaguuuuu

SEQ ID NO: 5 - RNA, 85 nt, Human
aaaaucauaaggacaaaaaucugcugaugcugugagauaaaaccgaugauucugcagucaauuuguuuuguaccugugugguuuu

SEQ ID NO: 6 - RNA, 116 nt, Human
aaaaugcacaucaccaccuacuugaguguugaggauucaauuaguuaauguacuucaaauaaucauguaguaaaugcucaguaguguguguguguguguguguguguguguauuuu

SEQ ID NO: 7 - RNA, 100 nt, Human
aaacagacugggccaauguccacaaagaauuccuggucagcaccaccgauguccaaaggugcaauaucaaggaagggcaggcgugauggcuuauuuguuu

SEQ ID NO: 8 - RNA, 72 nt, Human
aaacaucauuuuaaaaugucuucagcauuuuuugaauagacguauucaaacauauucugaacauugauguuu

SEQ ID NO: 9 - RNA, 77 nt, Human
aaagagguguagaaucuggguugguccuucaaggcagcucauugcagcuacuggccuccagugaaacaggucucuuu

SEQ ID NO: 10 - RNA, 73 nt, Human
aaagccacagguaagaauucucauuugcuaaauuacaaugauuggugcaaauuaugccuaugacauuggcuuu

SEQ ID NO: 11 - RNA, 79 nt, Human
aaaggaugaaaagguggugucauguuuuggggagaaucuuacuucucaaauggaaauugcacuuuuugcugaauccuuu

SEQ ID NO: 12 - RNA, 87 nt, Human
aaaggcccuuccgguuuuggucaaggaugguagcccaacguucacauucuuaugaaccagguaaccccaaggucgggacggguuuuu

SEQ ID NO: 13 - RNA, 80 nt, Human
aaaggggagacuuaaaauuugcuccaaugucaguucucuacagaugagaaccaauacuacagcaaguaagucuugccuuu

SEQ ID NO: 14 - RNA, 108 nt, Human
aaagggugagauaauguucccacaguguaucauuagugugaugaguuuaucucuuuaaagccucacaaccugcugauaugcugugguuuuucuugguccuaucucuuu

SEQ ID NO: 15 - RNA, 80 nt, Human
aaaggugggugcagaaucuguaugggaguuccaaaucucuuuugugcuucaugccaauuaccugcaguuuuacuaccuuu

SEQ ID NO: 16 - RNA, 79 nt, Human
aaagucuugugauuuccucucaucuuuuagagauuccugccaaaaauucuaccaagcagagauggaggagcucgacuuu

SEQ ID NO: 17 - RNA, 79 nt, Human
aaagucuugugauuuccucucaucuuuuagagauuccugccaaaaauucuaccaagcagagauggaggagcuugacuuu

SEQ ID NO: 18 - RNA, 111 nt, Human
aaaguuauuuuggguguaaguggugaaugaaugugaaggccuaggacauuacuguacacuacuauagacuuuauaaacauuguacacuuagacuacacuaaacauaauuuu

SEQ ID NO: 19 - RNA, 96 nt, Human
aaaugcagguuuacaaagaugagcaggugguggugauaaaggauaaauacccaaaggcccguuaccauuggcuggucuuaccguggaccuccauuu

SEQ ID NO: 20 - RNA, 79 nt, Human
aaauguggaauacuggcaguguaaaagucuuaaacuaacuuuaaagcuaacaaaucaaaggcacaguauuaacacauuu

SEQ ID NO: 21 - RNA, 78 nt, Human
aaauuuuuccucuuauuugcaugaaaggacaagacacuguuaugcccuguccuaaaugugaagacagagguugaauuu

SEQ ID NO: 22 - RNA, 90 nt, Human
aaauuuuugggggagcgggggaaggaguuaaugaaacuguauugcacaaugcucugaucaauccuucuuuuucucuuuugcccacaauuu

SEQ ID NO: 23 - RNA, 90 nt, Human
aacaaggcaaaauaucugccuuauacaugucacaaguuauaaagauugagagcuguauuuagguaaaugcguuguauguuuugucauguu

SEQ ID NO: 24 - RNA, 65 nt, Human
aacaccccaugccaucugacagaugggaaccuaggggaccccuucgucagagaaucugggagguu

SEQ ID NO: 25 - RNA, 98 nt, Human
aacagacugggccaauguccacaaagaauuccuggucagcaccaccgauguccaaaggugcaauaucaaggaagggcaggcgugauggcuuauuuguu

SEQ ID NO: 26 - RNA, 94 nt, Human
aacagagauuuaccgcauuguuucucagaagcaaaugucagacagacgcgaaaaugacaugucuccaagcaacaaugugguuccuauucauguu

SEQ ID NO: 27 - RNA, 72 nt, Human
aacagaucucaaagaucucaucauuuuugacaaacagucaucacaaaggaugagacagaauuugaaauuguu

SEQ ID NO: 28 - RNA, 97 nt, Human
aacagggcuucucgucaucacuugcagcgugugagcuuccaaauaagccgccauuucuuuggaaaacgcacgcacuuaggcauggcgaucuccuguu

SEQ ID NO: 29 - RNA, 82 nt, Human
aacaguucuggccugagaccuggauugagccuuggcagacuucuugucuaaauguuggccauucagucucaggcccucuguu

SEQ ID NO: 30 - RNA, 103 nt, Human
aacauacagaagaagcaaggaaauuacaguuagaggucacaacugcccgaagccaguucuaaauuuuuaugaagccaauuucccugcaaaugucauggauguu

SEQ ID NO: 31 - RNA, 77 nt, Human
aacccagacgccaugaaagcugcauggccuggagaaaaagcugaaccaggcccuuuuggaucuucaugcccuggguu

SEQ ID NO: 32 - RNA, 81 nt, Human
aacccagcagcucuccauguccacagcugauuuccagaggauggaagaagucaggaaacuugggacaccgcugcugagguu

SEQ ID NO: 33 - RNA, 104 nt, Human
aaccucaucccagccaagagcuucuuaaucuuugucucauucccucaccaaccuugggagauagacugauugggaacugaaguucaaagagguugaaugggguu

SEQ ID NO: 34 - RNA, 99 nt, Human
aaccuccagcacaccaccaaugaauagcaguaauaccagcauaauugucugcaguucugcugagauacgugcucuauuuuauuggcuuggcuguagguu

SEQ ID NO: 35 - RNA, 97 nt, Human
aacgaacuccuggaugucuauguagaugucucauaauuuaggccaaugcuguacaacuucauguggcaucauccacauagaaugaauagggguuguu

SEQ ID NO: 36 - RNA, 79 nt, Human
aacgagagcagaaggcagaagccagugccauccuuacgcuccaaacagcuagaugcaggacuugcccguuccucucguu

SEQ ID NO: 37 - RNA, 71 nt, Human
aacgucaucagcuuccuaaccauguuuaagaggaauaacuucaugaacauuuugcccugaacugaagaguu

SEQ ID NO: 38 - RNA, 88 nt, Human
aacucacaacccuaccaaugcuacucucaacaaguucacagagggaacuuaaggaaguaugggagugacggacuuuggguucggaguu

SEQ ID NO: 39 - RNA, 66 nt, Human
aacucccugugggcucccuuuggggguguggcccaccugcacaucggaggccucacaucgggaguu

SEQ ID NO: 40 - RNA, 70 nt, Human
aacugaacaagaggaguauguauucccgugugccagagugccaggucaccacauacuauuauguuggguu

SEQ ID NO: 41 - RNA, 69 nt, Human
aacugaggcgcagacagguucgguuaccugcaauagaaugcagccaacccgaauuugagccccugaguu

SEQ ID NO: 42 - RNA, 94 nt, Human
aacuucagaucagacugaggauguccuggaggcuguagcugcaaagcuggaucuuccagaugacuugauuggauacuuuagucuauucuuaguu

SEQ ID NO: 43 - RNA, 106 nt, Human
aacuuccaagugggcaaguaauuccaaugauuaguuuuuucccccaaguuugacuugggaagcuggggggaaguuaauuaugaagcaagggguguaccaggggguu

SEQ ID NO: 44 - RNA, 61 nt, Human
aacuugcguaauggacccacccuugagcgaauuucauccucgcgugggucuuaacacaguu

SEQ ID NO: 45 - RNA, 77 nt, Human
aacuuuaaugauuauuuauucagacccuggaaaaccacacuauaaaauagggcacuggaucacaaguucguuugguu

SEQ ID NO: 46 - RNA, 126 nt, Human
aacuuucagcugcccccuuuucccuauaaaaguauacuuaucugcaguuucccuugucaagaguauuaaaggucugcauaaaguaaaagcuaauacuauccugagggagggcuucagugcaaaguu

SEQ ID NO: 47 - RNA, 88 nt, Human
aacuuuuguucaguugagaugauugugaaacuagguaucuuucauucugacuccuaguuuaacauuuaauuuugacucccaaugaguu

SEQ ID NO: 48 - RNA, 97 nt, Human
aagaaagaggcaguauaguauagugguuaagagcaaggucucuggaguuuugugaccuugagcaaguuaccagaucucucugugccgcaacuuucuu

SEQ ID NO: 49 - RNA, 73 nt, Human
aagaaaggacgggguuucuaguugcuaagauuuugccaaacauggcuacagaacugguaaacaaaccuuucuu

SEQ ID NO: 50 - RNA, 109 nt, Human
aagaagaaaaccaaacaagaugucuggacucuuuuaaauggaagcaaagaugacuuccucauauaugauagauguggccgucuuguauaucaucuugguuugccuuuuu

SEQ ID NO: 51 - RNA, 90 nt, Human
aagaauggcuuuuuauucauaugugauaaaaagauaagucauuugguaacaccuuugaaccuguuuucaaaauaaugaaaaguuucucuu

SEQ ID NO: 52 - RNA, 99 nt, Human
aagaccugagagaauguaagaacauauagaacauccaaaauaagacauaucuuugguuguuuuaaaaccuuuuuguuugccucauuuucuucugugcuu

SEQ ID NO: 53 - RNA, 79 nt, Human
aagacuagggauuaucuacaccuucacuuugggcaauagcuauuuccuaaaggaauggaaaaaggugauuuugcuacuu

SEQ ID NO: 54 - RNA, 64 nt, Human
aagacugagcugugaauuuguccccucaguagaggaucacccuggccaaguuccaguucaucuu

SEQ ID NO: 55 - RNA, 82 nt, Human
aagagacuguccuucccucaauguauauucuuggcacccuuguugaaaaugaguucacaauagauguauggauuuguuucuu

SEQ ID NO: 56 - RNA, 95 nt, Human
aagagacuuuguagaugugauuaaauuaaggcucuugagauugggagauuauccuggauuaucagaguaggcuugauguaaucacaagaguccuu

SEQ ID NO: 57 - RNA, 85 nt, Human
aagaggagauaccguagucuagaugucuugagguagaauauaugauggaccacauaguuuaagauuacaagguacuuucccucuu

SEQ ID NO: 58 - RNA, 91 nt, Human
aagaggguggaaccaguguaaggaaauguggaggaggcagaauuucacuuuggacucuucacuccuccuuuucuucauuauuuaucuucuu

SEQ ID NO: 59 - RNA, 110 nt, Human
aagauaccuccuuagaaggcucaucauuagcugaaaguuugagagcugcagcagaagcggcuguaucacagacuggauuuaguuaugaugaaaauacuggacuguauuuu

SEQ ID NO: 60 - RNA, 88 nt, Human
aagauccaggagcagcucugccugguccaggacuccaaucguccaugauguuccugcuaugacuaggcagacuguaucccugagucuu

SEQ ID NO: 61 - RNA, 85 nt, Human
aagauuguuucagggugucucagggucccucuguaccaucugcuguggaaugcaggacccucugugacauucuuuaucccuucuu

SEQ ID NO: 62 - RNA, 92 nt, Human
aagauuuccaggugugaggcagcuggccuuuguagagcaccucaguaaagagcuaguaucuacacucuacacugccucaugucaagauucuu

SEQ ID NO: 63 - RNA, 85 nt, Human
aagcagcuucaauucugccgggacuucucccgccuuuuuuuuccugcggcgggagaaguagaugaagccagugauuaggguguuu

SEQ ID NO: 64 - RNA, 79 nt, Human
aagccaauguuaucccuagaaaaacauuuuugucacugcuguugauaaacaagaaaaucaaggaaacucauguuggcuu

SEQ ID NO: 65 - RNA, 89 nt, Human
aagcccuugacuggggcugcugccuuucucucagagaugcccugcccagugaggaggaaucuagagaggcagucuggccacaguugcuu

SEQ ID NO: 66 - RNA, 85 nt, Human
aagccugacaaguugaugccacugcugucugagggcuccuccggcucaacagucagcucagugcuuguguaauucuuccgggcuu

SEQ ID NO: 67 - RNA, 107 nt, Human
aagccuuguuuuuucccagagcaaccauguuuuagcauaaugggaugaccuggugucccauuauaaauaaagggugguauggcuagaaggguaugagcaguaggcuu

SEQ ID NO: 68 - RNA, 87 nt, Human
aaggagcaaugagaaacaaaacuaauuuuggagcagauggucucuggaauuugcauauccuggcuagugauuuucucaucuuuccuu

SEQ ID NO: 69 - RNA, 66 nt, Human
aaggauaccaggaugguuaccaggaugacuaccgucaucaugagaguuaucaccauggauacccuu

SEQ ID NO: 70 - RNA, 74 nt, Human
aaggauuuauuaaaaaaccaguaagacacuacuacaucaugacacugucacacugggcuuuuaacacaagacuu

SEQ ID NO: 71 - RNA, 79 nt, Human
aaggcgcaaacccgccacguucuggaaacuauccgcaagugaucgagacggcggguggcacgauggcggaugugaccuu

SEQ ID NO: 72 - RNA, 96 nt, Human
aaggcguuggaaacgggauugcacaggggggcgcgggcaccccaaaacaauggcccaaccgcucuuuuaaacacaccgccuagugccaacagccuu

SEQ ID NO: 73 - RNA, 74 nt, Human
aaggcugggggugggaagauggaauacugaccuaauguauaaaacuuaaaacaauucuccaauccccucuccuu

SEQ ID NO: 74 - RNA, 101 nt, Human
aagggccagucuaacccagcugaccaagcaggccugucugagaaugugcaucauuugagcaacucaggccugcuggguuaacugcuuacaccauuuuccuu

SEQ ID NO: 75 - RNA, 88 nt, Human
aaggguuguuuuguuguuagguaaauagauauuaggcaguccauuucuaaaauaugccugaugaagcuagauaccuaaagcuacccuu

SEQ ID NO: 76 - RNA, 78 nt, Human
aaggguuugccacuuaaccuucgacacgggagggaaaauaaagaauucccuuucacuaagaacacacggcaaacuguu

SEQ ID NO: 77 - RNA, 96 nt, Human
aaguccaacaucccgggccguucuguauuuaugucgccacaguugcuuguuuguaguggcauagaugacagcaucucucauccgauggcuggucuu

SEQ ID NO: 78 - RNA, 68 nt, Human
aaguggagggggcugagcgcagggccaggaugcuggucacuggguggcccugugagcuccccucccuu

SEQ ID NO: 79 - RNA, 79 nt, Human
aaguguucuccugaggacccuuaggucagacagagaagcuuucucuuucugaugggaagggucaaaguggaaaucucuu

SEQ ID NO: 80 - RNA, 77 nt, Human
aaguuacccugugacagucauucaucugugcucuggguggcccaugggaugaguguacuacugggcagguguaacuu

SEQ ID NO: 81 - RNA, 75 nt, Human
aaguucauucuagcaguaauuuaucagaggucacucauccucuauuaaauuauuaaucuaaucaccuuugaacuu

SEQ ID NO: 82 - RNA, 72 nt, Human
aaguugugaauuugauguaagcuuaggaaauugaauuaaaauuuauaggcaucuguauuaauuguacaauuu

SEQ ID NO: 83 - RNA, 99 nt, Human
aauaacauauauauccaugaagcuagcaacugaaagucuacgacuacauuuugaauguucucuccaaaucagaacuagcguucuagaauaguuguuguu

SEQ ID NO: 84 - RNA, 102 nt, Human
aaaaccaaaaaccuuucucccacucuaauagaugagucacauaaugggaaaacaaacaaauguaucaucuauuaaagugggagaacuugguuuuguaguuuu

SEQ ID NO: 85 - RNA, 84 nt, Human
aaaagaaaaccaaagugguccacaaaacauucuccuuuccuucugaagguuuuacgaugcauuguuaucauuaaccagucuuuu

SEQ ID NO: 86 - RNA, 83 nt, Human
aaaagggcaagaauaucacggcaugggcaugaguagcuugaaacugcuuaaguauguccuguuuuucuucaacuugcucuuuu

SEQ ID NO: 87 - RNA, 85 nt, Human
aaaagguuucucuuaacaguauuuccagugacaaugcaagguaaguauaucaaaggaaaucaacaguugugcuugggggcuuuuu

SEQ ID NO: 88 - RNA, 82 nt, Human
aaaaguaaugugagucugucuaaccauauuuuccuaacucaacaguaggaucaugaugguaaggcaaaugcaaguuauuuuu

SEQ ID NO: 89 - RNA, 92 nt, Human
aaaaguuauuuuauaaauaaagggaacuuccaggcuuucagucuuuaagaaaagcuaaggcuuguuuggcuuuuuguuuauuuuuagguuuu

SEQ ID NO: 90 - RNA, 80 nt, Human
aaaauucccacuuaauugaauacuuagaaaaaaauggccaguggccgauugaaagguauauuaaaauuaagggcaguuuu

SEQ ID NO: 91 - RNA, 77 nt, Human
aaacggaugggccugggggccacuuugcacaggguucuccagagcccugcccauccugccuccaccacuuccuguuu

SEQ ID NO: 92 - RNA, 91 nt, Human
aaacgugcaaauguauuguagagacuuuaugauuagaauggcauauauuuaugaaacuuaaagaugaauguuuuauugaauuuguagguuu

SEQ ID NO: 93 - RNA, 68 nt, Human
aaacguguggugauugaugcuuucauggacucuguugccccaaguccccaagccuuguaccagcguuu

SEQ ID NO: 94 - RNA, 83 nt, Human
aaagaaaaccaaagugguccacaaaacauucuccuuuccuucugaagguuuuacgaugcauuguuaucauuaacccagucuuu

SEQ ID NO: 95 - RNA, 67 nt, Human
aaagaaaaccggguggcaaauacccgggaaauuuuuacccccgcccauauugaaccggguuuucuuu

SEQ ID NO: 96 - RNA, 76 nt, Human
aaagacaagcugucauugcaauaggauguuacaacauuauauugcauuaaaaaugauaccuaaaagcuugcucuuu

SEQ ID NO: 97 - RNA, 74 nt, Human
aaagcauuacucuuaaaaaagcaauacugagaauaaaauuccuucucuucacgcaaucaaaaugacuaagcuuu

SEQ ID NO: 98 - RNA, 77 nt, Human
aaagcuuuucuuaauguaacuuugaguacauuuuaaugccuucuauuuuuaaaacucaaaaucauuaguugggcuuu

SEQ ID NO: 99 - RNA, 73 nt, Human
aaaggacccuguucacugcugcacuuuucaaugaauuaaaauuuauuucuguucuagugggaauguguccuuu

SEQ ID NO: 100 - RNA, 63 nt, Human
aaaggaugcugcugcacagcuucuccaauguaccagucauugaggccagcgcgcagcacuuuu

SEQ ID NO: 101 - RNA, 86 nt, Human
aaaggauuauagugaugcauugucugaaguuagcaccucuuggacugaaucguuuguuuagacuacauguauuacaaagucucuuu

SEQ ID NO: 102 - RNA, 63 nt, Human
aaaggcagacggugaaugccuugagaaauuguucagauucaaggacaagcauuuguugccuuu

SEQ ID NO: 103 - RNA, 75 nt, Human
aaaggccacuucuaugacuuauuuuucuguuugguugggcugccauggaaaccggaagcauguauucaagccuuu

SEQ ID NO: 104 - RNA, 72 nt, Human
aaauacaaauuccugggucuccuggcagacuugcuaaaucagaaucuccaggggauccuggaauugguguuu

SEQ ID NO: 105 - RNA, 76 nt, Human
aaauagugauuccaaagacaagguuucccuggaacccaccagauguacaagaaacaaaucuuuagguuugccauuu

SEQ ID NO: 106 - RNA, 75 nt, Human
aaauauuaguuugaggguuuuuuccaauuuaaauuaacuaauaaaggggggagaaugacacaaaagcugcuauuu

SEQ ID NO: 107 - RNA, 74 nt, Human
aaauauugugcaccauauggaaguacugccuuauaugauaaggauaaaguuaaauugguagguguauaacauuu

SEQ ID NO: 108 - RNA, 76 nt, Human
aaaucaaacuguuuaauaggaauuuggagagacaggcuuuugucauuuuccaaugcacuugggaggcacaagauuu

SEQ ID NO: 109 - RNA, 88 nt, Human
aaaucuagccagagcccuucacugccaugauagcuggggcuucaccagucugucuacuguggugaucuguagacuucugguuguauuu

SEQ ID NO: 110 - RNA, 93 nt, Human
aaaucucucaaccacugcaagcuuuuaaaagucuggcgcaucuugacuuucuuuucaccuauaacagccagcuuggauucauuugagagauuu

SEQ ID NO: 111 - RNA, 98 nt, Human
aaauggcuuuaaagcuugguguuacuuuucuuaaguuguuuaauuauaguuaaggcaauuucaaaaaugcuccaaagaaauguggaaagggaccuuuu

SEQ ID NO: 112 - RNA, 90 nt, Human
aaauuuuugggggagcgagggaaggaguuaaugaaacuguauugcacaaugcucugaucaauccuucuuuuucucuuuugcccacaauuu

SEQ ID NO: 113 - RNA, 83 nt, Human
aacaaaauuauagaauuuccagauuucuugccagguauuuuugaaaaccuaucaaggugcuccauuggauuucuguauuuguu

SEQ ID NO: 114 - RNA, 92 nt, Human
aacagagucucacucuguugcccaggcuggaguacaguggcacgaucucagcucacugcaaccuccaccuccuggguucaagcguuucuguu

SEQ ID NO: 115 - RNA, 74 nt, Human
aacagcuacucagcugcuuaagcugggccacaaguacagaccagagacaagcaagagaagaagcagagacuguu

SEQ ID NO: 116 - RNA, 85 nt, Human
aacagucccccaaagucuuauuucagcauuaacucaaaaguccacaguccaaaguuucaucugagacaagcaagucucuucuguu

SEQ ID NO: 117 - RNA, 64 nt, Human
aacauccaauucaacugugggaaaggagcuccuucaacugaugccccaguacuuuguggguguu

SEQ ID NO: 118 - RNA, 94 nt, Human
aacaucuaccuacucaugacauggcaaauagucauuuuacaauaacaauacaguacaauaugaucgugcuacuuucauggcuaggaaugaaguu

SEQ ID NO: 119 - RNA, 73 nt, Human
aacaugaaagauuggaauacauuuuaacuuaauguaaugcauaauuaagaaacauguuccaguacuuuauguu

SEQ ID NO: 120 - RNA, 86 nt, Human
aacauggauuuuaacguugcaggauuguaaauucauaagauaguuauuaccuuucuuugaaauuguguaauguuuauauucuuguu

SEQ ID NO: 121 - RNA, 91 nt, Human
aacaugugaauacuaccaaguuucuguccccaaagucaggcaucacugcuagucuuuugggacagaugggacagauguucacuuuaauguu

SEQ ID NO: 122 - RNA, 88 nt, Human
aaccauucaaagcaaguugcugcuuaagucuugcccacaacuuuucaucugaaaaguggaguagcugaagcagccaaugcuggugguu

SEQ ID NO: 123 - RNA, 69 nt, Human
aacccaacaugccaugguuuauggagccuucauucccagguugccacuuuggccucaguguggaggguu

SEQ ID NO: 124 - RNA, 82 nt, Human
aacccgacacaguagcauuugugccaauuucugguuggaauggugacaacaugcuggagccaagugcuaacaugucuggguu

SEQ ID NO: 125 - RNA, 68 nt, Human
aaccuggggacgcauagccaaggggaagcgcgacucacaacggcgcgacuucuugaguucuccagguu

SEQ ID NO: 126 - RNA, 84 nt, Human
aaccuucuguuacucccugggagaaaggcgcugagcguggcaugcaggugucuuugcuguguuuuucuccacuucuaaaugguu

SEQ ID NO: 127 - RNA, 69 nt, Human
aacgggagugggcacagaaagccuucuccuggcaacaggacaagggcugcccgcguguccagcccuguu

SEQ ID NO: 128 - RNA, 71 nt, Human
aacucggguauuagguuggcuaaccacaagcuuagcggcggcggggauuauucaacacaaguaauugaguu

SEQ ID NO: 129 - RNA, 74 nt, Human
aacucuggugggucugauacagguagcaauguaauuugaaaucaguugaauuuccuguuuuucucucauagguu

SEQ ID NO: 130 - RNA, 84 nt, Human
aacuggucggugauuuagguaguuuccuguuguugggauccaccuuucucucgacagcacgacacugccuucauuacuucaguu

SEQ ID NO: 131 - RNA, 96 nt, Human
aagaaggcaaagacuggggcagcagggaaguuuaaaaggggaaaauaaauguguuuccccauuauaccuccuucaccccagaauauuugccgucuu

SEQ ID NO: 132 - RNA, 74 nt, Human
aagaauucuaagaacacuacuagaagcauuuguucccuccuagucaaugcuucauacuuuuucuugggauucuu

SEQ ID NO: 133 - RNA, 79 nt, Human
aagagaaaaugguacagcaguuacaagaggauguggacauggaagaugcuccuuaaaaaucucuguaaccauuucuuuu

SEQ ID NO: 134 - RNA, 80 nt, Human
aagagaaaaugguacagcaguuacaagaggauguggacauggaagaugcuccuuaaaaaucucuguaaccauuuucuuuu

SEQ ID NO: 135 - RNA, 82 nt, Human
aagaguaguuuggacccacaauauugcauuacugauuuauucacuaccuuagcagcauguaguauacagacauucugcucuu

SEQ ID NO: 136 - RNA, 107 nt, Human
aagauauucagauacucuucuaugccaggaagcacaaaagacuuguugagauugccucaguucaguagaucuuccuuggcagccaggcauaggugguuucuugucuu

SEQ ID NO: 137 - RNA, 86 nt, Human
aagaugauucugacagugaaaagcagcaacaaauucaucacaucaagaacuuguaugccuucaaccucuucugccagaagcguuuu

SEQ ID NO: 138 - RNA, 73 nt, Human
aagauugaauuaggagguuaggcaggaguaggaucaaagacuuagaaaaugcuuguuuccuccuauuauucuu

SEQ ID NO: 139 - RNA, 89 nt, Human
aagcgaacuuugugccuguccuagaagugaaaauuguucaguccaagaaacugauguuauuugauuuauuuaaaggcuaaaauuuguuu

SEQ ID NO: 140 - RNA, 77 nt, Human
aagcugaaggugcuggaggugccaagugaagugugugcauuuuugauaacuguguacuucuggugacuguacaguuu

SEQ ID NO: 141 - RNA, 91 nt, Human
aagcugggggcacuggcuucugcucuugcucuuucuucuggaaacauuauucuguuccuuuggacaugggcaaggguccugucccuaacuu

SEQ ID NO: 142 - RNA, 106 nt, Human
aaggaaaguuugguaaggcgggggcugcgcagaucugcuguucucuggaaccuaaacugggaacccuagacuugcgcagaaaauuaauaguuuuccauuuuucuuu

SEQ ID NO: 143 - RNA, 114 nt, Human
aaggaaggugaugacuugcuccauugucuguggcuuucuuauguuguaaugggagcuuaucagugugcaccaugaucagguuacagcaucaggaggagcucuacaaccuauuuu

SEQ ID NO: 144 - RNA, 74 nt, Human
aaggaggacaaaagugcuguuaaaguugcuaaaaugcuuuccuuuuccuuccacagucuuuuucucucucacuu

SEQ ID NO: 145 - RNA, 63 nt, Human
aaggauggggagcaagcuccagcucuguaacacaugguggaacuucuuuuagccccagaccuu

SEQ ID NO: 146 - RNA, 103 nt, Human
aaggcaccacggccagcccucauaccuccuuuaaaagccaaccuguuuuuugcaaaaaggcuggcuguuuuuuggaccuaagggguuuuggaauuugggccuu

SEQ ID NO: 147 - RNA, 82 nt, Human
aaggcgccagagcugaagaccagccccuagaagccacaccccugcccuucuagcagcuacggguccucuggcuccgggccuu

SEQ ID NO: 148 - RNA, 115 nt, Human
aaggcuuauuuuuccaggcaggaggagaggcugguggucuugagcuuuuggccuggaauuccagucugaauuuucaaauauucccugccuccaaccccuuugggauccuagucuu

SEQ ID NO: 149 - RNA, 62 nt, Human
aagggaacucagaguccggcagcauccuccauaugcugaacgcagguacucugggcccccuu

SEQ ID NO: 150 - RNA, 103 nt, Human
aaggggagguuuuugcaaauucccaaggaaaugucaaaaaggcaaaauggccaccauuauccauuugcuuuuuuggguuuacugggggaaaaacacuuuccuu

SEQ ID NO: 151 - RNA, 103 nt, Human
aaggggagguuuuugcaaauucccaaggaaaugucaaaaagggaaaauggccagcauuauccauuugcuuuuuuggguuuacugggggaauaacacuuuccuu

SEQ ID NO: 152 - RNA, 73 nt, Human
aagggggagaauaugugaagggggcuuccaugggaggcuucgauggcccacccacccuuccauucuuccucuu

SEQ ID NO: 153 - RNA, 87 nt, Human
aagguaaugcucauuuagacugacacagguaugaaaauuccaaucccuucuuuucacuaucauuguaucugacacacacaucaccuu

SEQ ID NO: 154 - RNA, 64 nt, Human
aagguacccagaguucucacacgcaagagcuguacuugguuguauguguguugagcuggcccuu

SEQ ID NO: 155 - RNA, 94 nt, Human
aagguauuuucugagcugugagccugccuuccagugacauguucuaaaaauugcaaguuauuugaggaggcuuuacagccaauaggaaguucuu

SEQ ID NO: 156 - RNA, 90 nt, Human
aagguguuugucaguuguuucauaaaccagauugaggaggacaaacugcucugccaauuucuggauuucuuuauuuucagcaaacacuuu

SEQ ID NO: 157 - RNA, 75 nt, Human
aaguauacgaaguuccacauugguuggcauaaguggauguuaacaagaaagcaguuuggggcucuucaguuacuu

SEQ ID NO: 158 - RNA, 72 nt, Human
aagucagaaacggccaucucacuguucacauauauacacguauguacaggaagaaccuaguguuucuagcuu

SEQ ID NO: 159 - RNA, 72 nt, Human
aagugagggagauagugaggggagggcacgcuugucuucucagguaucuuccccagcauugcucccuuacuu

SEQ ID NO: 160 - RNA, 109 nt, Human
aagugcuggauauugcuaagaauucagguagucucgggaucuccagagucuccauacuaggacaggagaucuucagaaccuggaggaauggaaauagucuagucagcuu

SEQ ID NO: 161 - RNA, 84 nt, Human
aaguugaugggugcagcaaaccaacauggcacauguauaccuauguaacaaaucugcauguugugcacguguacccuagaacuu

SEQ ID NO: 162 - RNA, 80 nt, Human
aaguuuaagaagcagccucuugucacagguugacuccuagguagugugccuagugaccaagagggcugcuaagaaagcuu

SEQ ID NO: 163 - RNA, 80 nt, Human
aauacacacauaucagaguacugugauagacucagauaaaaugauacaaauuauaguguucuaacuaugucaaauguguu

SEQ ID NO: 164 - RNA, 80 nt, Human
aauacgaagacauggauaguugcaaggucuugaaaggucgaagaaagauaccggugaugaauaaccuaugucuuugcguu

SEQ ID NO: 165 - RNA, 128 nt, Human
aauagcugggauuauaggugcccaccaccaggcugggcuaauuuuguauuuuuagcugaaacccagucucuacuaagauacgaaaauuagcugggugugguggugugugccuguggucccagcuacuu

SEQ ID NO: 166 - RNA, 65 nt, Human
aauccugaucugguccauuaaagagugugcgcggacaaaguuucugaaaggauuagagaaggauu

SEQ ID NO: 167 - RNA, 77 nt, Human
aaucuucaauauccaagaaaagaaacccccaaagaauaguacaugcuuuggacuaguggaagggauguggggagauu

SEQ ID NO: 168 - RNA, 73 nt, Human
aaugaaauguauggucuuuugugauuggcaucuuucccuuagcauguuuucaguuucauccauguauuucauu

SEQ ID NO: 169 - RNA, 71 nt, Human
aauaauauugcacuggguauauaacugguugccaccaccuauuagccaugucacucagagacaauauuauu

SEQ ID NO: 170 - RNA, 72 nt, Human
aaucacacucccuacaaguucagugugcccccaguggcacccgugggcacaucuugacaauggggaaggguu

SEQ ID NO: 171 - RNA, 71 nt, Human
aaucaccauguagugugucuucuugaguaggccaauguugcguauagagagaaaaugacuaucaggagauu

SEQ ID NO: 172 - RNA, 87 nt, Human
aaucuuuaaaauguguuguuuuucacaaguaauuuaaguauagcauuauuauuauuugguacuugagucaaagacgacauuuagauu

SEQ ID NO: 173 - RNA, 105 nt, Human
aaugaaguggaaucaagguggcaagaaaauuuagaaucguuucugauagggacuuucccuuauccuaaauguguuuugaaggcacacguuauuuccauugucauu

SEQ ID NO: 174 - RNA, 61 nt, Human
aaugacaccguugauugagcuugucagcagagcugaaagagacagucgacggaugugcauu

SEQ ID NO: 175 - RNA, 104 nt, Human
aaugacccguucuggaaucagcuucucucauuuucuuucccugcaccaacuagcagugaguugaaacucuuggaggaagcaaccauuucagucugcaggucauu

SEQ ID NO: 176 - RNA, 86 nt, Human
aaugcuaauaugauggucuuaggacaugaaccaagacaaacaacuucgaaucugggucacuuaaacaagccaucuauccaggcauu

SEQ ID NO: 177 - RNA, 105 nt, Human
aaugggcaacgugagguggagggaggcgggagaugaaauucuugguugaaacaauagucagaagaaaauaaucuucucauuuuuccucacuuuaguugauucauu

SEQ ID NO: 178 - RNA, 129 nt, Human
aauguaaaccccuuaaagcagauguguguggggccuuaugaagaccaggauucugcgggugucaggggauugccccucuugacagagacuaggguuuuagacugaggcuuccugcaggguguucgcauu

SEQ ID NO: 179 - RNA, 81 nt, Human
aauguccauucuuauuaaaugaauguaucucaaggcccuaccaaauaaguacauguaaaaaguaggaagaaaugugauauu

SEQ ID NO: 180 - RNA, 79 nt, Human
aauguggucgaagauucaaaagcauguuaccuucaaccaagugaaaggcauuuucggcuucacugacagcgacugcauu

SEQ ID NO: 181 - RNA, 104 nt, Human
aauguucuggcacauaguaauuaauuaagaaaaucgagcacccuuaauuaccuagaaugcaggguuguuaguuuuuugguugacuuuuguuuugcuggggcauu

SEQ ID NO: 182 - RNA, 99 nt, Human
aauguugcuagugcuccuuaggccuuuaagcuauaaacucagcaaggaaugucugcauuuuaucucuuuaagguaccaccagggggguaugacagcauu

SEQ ID NO: 183 - RNA, 86 nt, Human
aauuauuucacugauguuuucuucucucuucauuucuuucuuucuagaaauccauguucuaauucagaggcauuaauucauuaauu

SEQ ID NO: 184 - RNA, 85 nt, Human
aauucaaccugagaagcgagguuucugggugcaaacaauauauagugcuugcccagaauaccuguuuacucaguggaguuggguu

SEQ ID NO: 185 - RNA, 82 nt, Human
aauucgagguugccugaaaagcuggguguccuugcuccuuuuccuggaagccaauauacccaguuuuuacucaguuugaauu

SEQ ID NO: 186 - RNA, 79 nt, Human
aauucugggagauuaggaaaaaagcuucugaaaugaagguuauuucagaaguaauuuuuaugggagagcuuccagaauu

SEQ ID NO: 187 - RNA, 75 nt, Human
aauuuauguuguuuaguguuauauuccagacgugauaccaaaauuuuguugcaaauauaauggacaauauuuauu

SEQ ID NO: 188 - RNA, 74 nt, Human
acaaacuaaauacuauuugaaagucugaauucaaauaaccaugaauucuuaacuuuaaauguaaagaaguaugu

SEQ ID NO: 189 - RNA, 76 nt, Human
acaaauguagauacaauaaaauguaaacaauguagcuauuaaauaugauuacagaaaauguucuauuuauuuuugu

SEQ ID NO: 190 - RNA, 88 nt, Human
acaacaaccaguacuuugauaucuccgcccucucguguguuccuuguggagcuaaccagaggcaagaugcccgaggaacuucaugugu

SEQ ID NO: 191 - RNA, 71 nt, Human
acaagggucauucgcaggaauaacgguagaggggaacugaagcagggccgccguggcauuaugagccuugu

SEQ ID NO: 192 - RNA, 68 nt, Human
acaagguguuuuuauugaggucuuaggaauugcaauuugggagacagauucagcuagaagccacuugu

SEQ ID NO: 193 - RNA, 63 nt, Human
acaagucuugggaaguccaucugacucucugaaacaguuugucucugaccucccaggaagugu

SEQ ID NO: 194 - RNA, 118 nt, Human
acaauaauugaaauauuuucaagcugauuacaccgcagcccgaggcuagccugguugcuaagggugagcuccgcgguugcuagggggaguaaaucaucuugcauuauuugauuuuugu

SEQ ID NO: 195 - RNA, 103 nt, Human
acaauagucuaagagcuaacuaguugcacuugucuuuacccuagaggcuugcuaaauaaagcauacuuucuggagggcaagugcaggggucgcuucuguuugu

SEQ ID NO: 196 - RNA, 86 nt, Human
acaauauaauauauucuaaacacaaugaaauagggaauauaauguaugaacuuuuugcauuggcuugaagcaauauaauauauugu

SEQ ID NO: 197 - RNA, 81 nt, Human
acaauauaguuucuccugaacaccugcuuuccuucugggagucuggaauuuugguaugugccaggcagagacuaccuuugu

SEQ ID NO: 198 - RNA, 74 nt, Human
acaaugucuuuaauuccucauaugcugacuuggcaauccauaugcagccuaaaaggugguugaaagaugucugu

SEQ ID NO: 199 - RNA, 93 nt, Human
acacaaaacuaugagagugacaaaauggugacagguagcugggaccuaggcuaucuuaccaugaagguuguuuugcuuauuguauauuugugu

SEQ ID NO: 200 - RNA, 60 nt, Human
acacacagcacacagagugugggaggagagccaccacaacuccucucuauugcugugugu

SEQ ID NO: 201 - RNA, 75 nt, Human
acacauauauccuaaauaucagcuucuaauuaagucaacuuucaacucuaaagcuguuuaaaaggauuccugugu

SEQ ID NO: 202 - RNA, 88 nt, Human
acacauauuucaugucaccuaagauugccaaacguacguguucgugaaaaggcuaauggcugaugauuggauugacguggcugugugu

SEQ ID NO: 203 - RNA, 101 nt, Human
acaccacaugcagauuuuggugcuuucccaaccuucuugguauaaagguaaacaauucuauuaccagggguucgggacagccuaguuuuguuagaggcugu

SEQ ID NO: 204 - RNA, 104 nt, Human
acaccuccaaccucccugccuuugaacccuguguuaacaaugagaagcuuguuuauuugaaggcuggguucucauuggcccacagggguagguuguaauugugu

SEQ ID NO: 205 - RNA, 99 nt, Human
acaccuggaaguauuagauacauguuuaaaauaucuuuuauagguuuuauauaaaaaugucugaguaugauuaugugugaaaguucugauaccaguugu

SEQ ID NO: 206 - RNA, 95 nt, Human
acacugcuucaagguuucuuuuguauauaauucuuagaaugcucauuucuuuuaaauggguuaauuuguacagcagagggaauguuauuguaggu

SEQ ID NO: 207 - RNA, 71 nt, Human
acacuguguuucugaggguccuggaauggccagaacugaaggauccucuccagguucuucaauaucagugu

SEQ ID NO: 208 - RNA, 80 nt, Human
acagaguuccaaaaucuccuuuaucacucgacauacagaacccucuugucuugaguuugggaguuaauuuugcucuuugu

SEQ ID NO: 209 - RNA, 94 nt, Human
acagauacauuuuuuacagguuauuuucauuguguuauugacauccaugucucucguaaaacagauggcccaaaguaaugaaucauguggcugu

SEQ ID NO: 210 - RNA, 108 nt, Human
acagauguaggcagaagaccaggaguagggagagcugagacuagggauaaacaaaggggcaggaauccuggagagaagccccgugcuccacucacugacugcgucugu

SEQ ID NO: 211 - RNA, 71 nt, Human
acagaugucugcugccaaaaaguuguucugauagaaaauccaaaaucaucgaccccaaaagccaagucugu

SEQ ID NO: 212 - RNA, 80 nt, Human
acagcacaaacccuaaaguccaugugcagucuccauguacaaguauaaaagucuguuucaggacaacccuggguugcugu

SEQ ID NO: 213 - RNA, 48 nt, Human
acagcagcccauaacaguuuguggccucuacuaacuguccucugcugu

SEQ ID NO: 214 - RNA, 85 nt, Human
acagccagcgcucucagcucaugaugcgcacccggaucgccgcccaggguuucacggucgcagccaucuugcugggucuggcugu

SEQ ID NO: 215 - RNA, 98 nt, Human
acagccuggcuccuaacaggagggaagaugaagcagacugccgggagaucucugccagcaaacucuucucuucccacucauguuaggcccaguguugu

SEQ ID NO: 216 - RNA, 75 nt, Human
acagcuaugcugauugguugaagugugaauucuuggucuggaaagcaaaacuuucgcuauucuauuugugguugu

SEQ ID NO: 217 - RNA, 70 nt, Human
acaggaacuuuggagauaaacagggcucucgacauuggcaaguugcaccaucccugguuucuccaucugu

SEQ ID NO: 218 - RNA, 60 nt, Human
acaggaaggguccuagguagggggagguuccuccucccuugaaacccugggccacucugu

SEQ ID NO: 219 - RNA, 80 nt, Human
acaggcugcuauaaaugcgcuugauggccucggcuucuuccuugucaaggaugccuuucuccacauaagcaucagcuugu

SEQ ID NO: 220 - RNA, 80 nt, Human
acaggcugcuauaaaugcgcuugaugggcucggcuucuuccuugucaaggaugccuuucuccacauaagcaucagcuugu

SEQ ID NO: 221 - RNA, 60 nt, Human
acagugauucggcacauaaaacaggugcugaacuguagcaguuguuuuacuccauccugu

SEQ ID NO: 222 - RNA, 80 nt, Human
acauaccaacuuccaaucugccuaaaugugacagccucugcccaagacuggcucacugaggcgucuuggcuacuggaugu

SEQ ID NO: 223 - RNA, 79 nt, Human
acauagauggcugguacauugcugugcuggaaucacgccuaucuguauaguaaagaagccaagcccacagagacuaugu

SEQ ID NO: 224 - RNA, 85 nt, Human
acauagaugguaccuuacuuuuccucauucuuaauaggugucuaagaaugucagggcaaaaguaugggcauuuuucuugcuaugu

SEQ ID NO: 225 - RNA, 75 nt, Human
acauauuuuccuuccacaauauggauuugugucauuuaaacugaagaaguugaucuugugugaugacagguaugu

SEQ ID NO: 226 - RNA, 107 nt, Human
acaucccaaaacaacaacaugaaaaaacuggcccucaaaucuucgcucgcuauuuccaugucagaaagggggaaagaggaagcugaacaauguauagucugggaagu

SEQ ID NO: 227 - RNA, 112 nt, Human
acaugacuuacagugugcaguuuggagaucuuuggccaucaauccgugucagucuccucucagagcagaaguauggugcacuggucaauaacuuugcugccugggaucaugu

SEQ ID NO: 228 - RNA, 71 nt, Human
acaugagggugcacaugucaaguacuuagcuaaaaucaacaaagugaggacugugaagauaacuuucaugu

SEQ ID NO: 229 - RNA, 66 nt, Human
acaugcauaagucaggcucucuugaaauauacaaagcguuagcggcagaggaucuugacugcaagu

SEQ ID NO: 230 - RNA, 93 nt, Human
acaugugugcauguaugugugcauguguguguuaugcuuauguaagugcauggauguggcuguguaugcacaugaaugugcauguacacaugu

SEQ ID NO: 231 - RNA, 78 nt, Human
acauuaacaugauaauaccaacauguauuuggucaaagucuaaacacuuuuuugauaaaauacauuuuauguuaaugu

SEQ ID NO: 232 - RNA, 73 nt, Human
acauuuauagagguuauaaggaucuuggcucuagaacaaauuuuugaaauuaggaucauuuuaccauggaugu

SEQ ID NO: 233 - RNA, 104 nt, Human
accaaugugagauuccgaaucauuggucagccacagugaugccaccuuggcaucaaacuugccuguuccaucuuuaucaauguaucuggaagucugacuugagu

SEQ ID NO: 234 - RNA, 78 nt, Human
accagaggaggacaucagauccugcauuauguacacugaucguuucugcagcugcagauucugcuguucgacucuggu

SEQ ID NO: 235 - RNA, 76 nt, Human
accagcuggauaaggacaucaauaccuucucuaugcgugucagggagugguacggguaucacuuuccggagcuggu

SEQ ID NO: 236 - RNA, 65 nt, Human
accagggauaccaucugguccagugguuuuuaaacaaagcugcuuagcaccuggaauucccuggu

SEQ ID NO: 237 - RNA, 83 nt, Human
accagggugguggcggagugcgcaugcgugguucccgggcgacgggaacgcgcgcucaccgugcgcgcucgcggccggguggu

SEQ ID NO: 238 - RNA, 70 nt, Human
accagguccaguucacagacauuguggaaauauucguuuaagacuccacgaauugugaauggcuccaggu

SEQ ID NO: 239 - RNA, 67 nt, Human
accagguggccuuaguucuccagcaucacaucccuguauaagcuccucugagcagggucgacauggu

SEQ ID NO: 240 - RNA, 75 nt, Human
accaguggaucgagcaggacauggagaaguacauccugagaggggaugagacguuugcuguccugagccgcuggu

SEQ ID NO: 241 - RNA, 126 nt, Human
accaguugugauaagauugacaaguuggugacagagcauguuuugugaaccucugaacucuucugggggcauuucucauaauuuaugucuucuugucucccggcuugggugccuagcacucauggu

SEQ ID NO: 242 - RNA, 98 nt, Human
accauggcguccuccgcggccggcugcguggugaucguuggcaguggagucauugggcgaagcugggccaugcuguuugccaguggaggcuuccaggu

SEQ ID NO: 243 - RNA, 85 nt, Human
acccaaagcaguggccaacaucgcggaccccugugccuugucacagaugggugcugguccucaggcguuggggacacugcugggu

SEQ ID NO: 244 - RNA, 90 nt, Human
acccaguuugugguacuuuguuaugccagcccuagaaaauuaauaugugagagaauccaccuuucagcggcaucacuaccaaaacugggu

SEQ ID NO: 245 - RNA, 78 nt, Human
accccagaaguuccaaccugugccuuauaucuugaagaaaauuuuccaggaucgcgaggcagcagcgaccacuggggu

SEQ ID NO: 246 - RNA, 66 nt, Human
accccaugccucacuugugagauuagaguaccauguuuucuuucuuuccacauguggaaguggggu

SEQ ID NO: 247 - RNA, 60 nt, Human
acccccaaaauuccuguguggaaaucuuuacccccaaggugauaacacuaggaggguggu

SEQ ID NO: 248 - RNA, 90 nt, Human
acccccacccuccuuccgauuucucuugaaggacaggccgcucaauuugaaaggcuucuugaaagagaauuucuucuucuucuugggggu

SEQ ID NO: 249 - RNA, 76 nt, Human
accccuaacauugaccuugugcaucccugagagagugggcagagaauccaauucucaugaagcgcgaagucggggu

SEQ ID NO: 250 - RNA, 89 nt, Human
accccuccucaaauuauaagguaaaugacacaaaguugaacauagggucaguguugggcaaaaagcauuuaaaauauagauaacggggu

SEQ ID NO: 251 - RNA, 75 nt, Human
accccuugucaagcauugccugugauugcccagcccagauucaucugugccuuggacauggugauggugaugggu

SEQ ID NO: 252 - RNA, 90 nt, Human
acccgucccugauccuggccgcagcacagaugcccgcuuaccaggagcugguggaggaggcgauugccuauggccggaagcugggcgggu

SEQ ID NO: 253 - RNA, 76 nt, Human
acccgugccggccagcgcaccagguucaaggcauuuguugcuaucggggacuacaaugugccacgucggucugggu

SEQ ID NO: 254 - RNA, 96 nt, Human
aaugacuggguguauuuucucugaugaugcaauccagguggcaugccuggcauaacugguggcauuccuggcaucagaggaggaacaccuggcauu

SEQ ID NO: 255 - RNA, 71 nt, Human
aaugaguuaggcugcagaggacugguccgucuccucggcauaaacccuuugaaguuccuuuuccacucguu

SEQ ID NO: 256 - RNA, 72 nt, Human
aaugcacauacaaugccagaacuccuuaaaagcaacuaauaucauauuuguguuuugcauaaaacaugcauu

SEQ ID NO: 257 - RNA, 74 nt, Human
aaugcagccauggcgucuaguucuggagaucucauaaggguggguccaaagacgauuccaagguucucugcauu

SEQ ID NO: 258 - RNA, 78 nt, Human
aaugccccacuuuuuggaacaacgcgauccuugguucucggaggaagaauggcuuauaccccaagaggauggggaauu

SEQ ID NO: 259 - RNA, 102 nt, Human
aaugcuggacauuuaucuggagcugcaggggguaaagugucauccuugggaaauucaaagcuggccuguaccugcugagagcaccagggauauggucacauu

SEQ ID NO: 260 - RNA, 77 nt, Human
aauggaaaccaugcaauuaccugccuuaguucuuuugucauaaaaacaaucacuugguuggucguauuguagcuauu

SEQ ID NO: 261 - RNA, 73 nt, Human
aauggaauggaaucuccaggagugaggguuuccauggaagccagcacuauccuuggggacaccacugaccauu

SEQ ID NO: 262 - RNA, 104 nt, Human
aauggagggauucagcuucagguuaaaaaggaggaagaggaaaugccaaggagaagguuuuuccaaauuccuuccuuuuuaaauuuagauggaguccauuuauu

SEQ ID NO: 263 - RNA, 87 nt, Human
aauggucgugccaaaaagggccgcggccacgugcagccuauucgcugcacuaacugugcccgaugcgugcccaaggacaaggccauu

SEQ ID NO: 264 - RNA, 77 nt, Human
aauguaaugacaacaauuuaggcaucauaaaauacugaacuauugugacuuuauacuuagaauugcugucuuacauu

SEQ ID NO: 265 - RNA, 82 nt, Human
aaugugaacauuuauucauauuguuuugauuacccucguguuacuacaagauggcaauaaauacuaugggauuguuuguauu

SEQ ID NO: 266 - RNA, 114 nt, Human
aauguuuacugaguauucaccaggugcuggguggagaaagaagacuuaaagauucccuagacaucuccucuccccuagacucaggaccauggcacuuauuuucuagucaauauu

SEQ ID NO: 267 - RNA, 92 nt, Human
aauuccugccagaaugcgcacagaacauaagucagccaagugugucgugccagggauacuuugacuuugguuugcugcugcugcuagggauu

SEQ ID NO: 268 - RNA, 105 nt, Human
aauugauaaagccagaguggagacacagaaccacugguucaccuacaaugagacaaugacaguggagagugugacccaagcuguguccaaucuggcuuugcaguu

SEQ ID NO: 269 - RNA, 62 nt, Human
aauugcuacugaagagcuugccacauucaugacauuugugaggcuucucuccaguaugcauu

SEQ ID NO: 270 - RNA, 110 nt, Human
aauuggcuugagguuuuuuuggauaucagaggaaguaagucuuuuuauucuaccuagcaucuaguuuuugauagacaaguuuccuuauuauaccccucuucugguugguu

SEQ ID NO: 271 - RNA, 80 nt, Human
aauuugcaacaguucuuuccccaggccacucgcagucuugcugugacucuccuguggggucccaugaacccuuccaaguu

SEQ ID NO: 272 - RNA, 83 nt, Human
aauuuggcuaaacuuaaaagcaagcuggguuccucuggggauauaaauaagcauuggacugggaggaaacagcuggccaaauu

SEQ ID NO: 273 - RNA, 71 nt, Human
aauuuugggaugguaucuaugucucugaaaaaggaacgguucagcaggcugaugaauaagaucuaagaguu

SEQ ID NO: 274 - RNA, 81 nt, Human
acaaaauagacacuuuuggauuuucccgucuuuuccaacaccaaggaugagauuaucaaaagauguguuaaauuaauuugu

SEQ ID NO: 275 - RNA, 68 nt, Human
acaaagaucugacaugucacccagggacccauuucacccacugcucuguuuggccgccagucuuuugu

SEQ ID NO: 276 - RNA, 79 nt, Human
acaacagccagaacuguggauacacaccuggcggcuggugggaggcggaugcugugaguucccaguucuuggcuguugu

SEQ ID NO: 277 - RNA, 61 nt, Human
acaacuacggaccuuggucccggccuuuauggacuauuauuggaccaacuccgaaaguugu

SEQ ID NO: 278 - RNA, 108 nt, Human
acaagcugcugucuuugcaccuugguccuuggccaagccuccccuugccacgggggcaugggaugaccugugaacgagacagggugcaggagucacagcauagcuggu

SEQ ID NO: 279 - RNA, 70 nt, Human
acaauuuuguauggaaugcuagauggccaagccucagccuuugguccagugcaacccuugccucgcuugu

SEQ ID NO: 280 - RNA, 71 nt, Human
acacaaauguucccaguuuuucaucugcacugccaagcacugaguugguuggauuggcaagcauguugugu

SEQ ID NO: 281 - RNA, 73 nt, Human
acacagaccacuaagaacaauaacuuuaacaaaauaagcauuugcuucaaaguuauuuuuuagucgcuggugu

SEQ ID NO: 282 - RNA, 112 nt, Human
acaccggaagugggcuuauuugcgcaucagcuacuuucgcuucuacuuaaaaacggaggaucuggguaaaagaaccgaaaggcuguacgaaccuaagacuugucuccgaugu

SEQ ID NO: 283 - RNA, 93 nt, Human
acacugccucuagauuguuauuuuguccaagagagagaucauggagagagucucucucgcucacggaggcucugucuuucuaggaguaugugu

SEQ ID NO: 284 - RNA, 90 nt, Human
acacuggacagauggauguugaugagcuugugugcagcaguucuacuggaaguauguacaaggggcucagccagccaauuuggacggugu

SEQ ID NO: 285 - RNA, 71 nt, Human
acacugguauaaaacacaguuuaaacaauuagaaaaaugaaaacugauaccacuuuaugccucuauagugu

SEQ ID NO: 286 - RNA, 77 nt, Human
acagaaugcugucuuggaccaguauucaacuuguggggcaaccuaaauuugggaguauugcuuuuucuguauucugu

SEQ ID NO: 287 - RNA, 126 nt, Human
acagacaauucugaugauuaugauuucauuugguuuaacuaagcuguacuaguucauuucauaaggaaaugauacuguagacaaauguaaauaaagccugugagucaagcaucaagugguguuugu

SEQ ID NO: 288 - RNA, 107 nt, Human
acagauugcucacagaucuuauggaaaggcugccaguguuacuuccucaguguuggggagguagagcccacuaagccugagcccccuguucccugucugcacacugu

SEQ ID NO: 289 - RNA, 83 nt, Human
acagcacaucuccauuagcacuagccacaauucaggagcucaguagacacgaacuaguggcuugcauauuggagagugcaugu

SEQ ID NO: 290 - RNA, 88 nt, Human
acagcugccuguacaucaacaucuucucagaaugacccagaaguuaucaucgugggagcuggcgugcuuggcucugcuuggcagcugu

SEQ ID NO: 291 - RNA, 76 nt, Human
acagcugugguuuuaggcuuuuuccuccuaguauaagaccaaaagucuuaucuguaggccagaacaugaaguuagu

SEQ ID NO: 292 - RNA, 70 nt, Human
acaggaaggacgggcguggucugcaggaggaucuccaggccccugcagcccucccuacaguccucucugu

SEQ ID NO: 293 - RNA, 94 nt, Human
acaggagaauugcuugaacccuggagguggagguugcagugagccgagauugcaccauugcacuccacccuaggcaacaagagcaaaacucugu

SEQ ID NO: 294 - RNA, 98 nt, Human
acaggcaggagggggaugaugguacugagagaguaugugucccagagcuugucaggacacaguggcagaauugcucucauccucuucuacuucucugu

SEQ ID NO: 295 - RNA, 90 nt, Human
acagggcaaacaaccaggucggccuggcccccguggcuuaagccuaagucucuucagccaccucccaggaagaucuggccucuguccugu

SEQ ID NO: 296 - RNA, 79 nt, Human
acaguuguuccuagcuuaguguuuuguuuuccuguugcaugacagauuuaacuauucuuuccagcaguggaggugcugu

SEQ ID NO: 297 - RNA, 91 nt, Human
acauaguuccugucaaaaucccaguaagauauuugaauagauacagacaagauuauuccaaaguuuauacgggaagacaaaggaacuaagu

SEQ ID NO: 298 - RNA, 78 nt, Human
acaucaagacaauguauacuauuucaaauauauccauacauaaucaaauauagcuguaguacauguuuucauuggugu

SEQ ID NO: 299 - RNA, 77 nt, Human
acaucauugucuaucaugaacuuguacagccaucagguaaaaauuggugugaagaagacauggagaauggaggaugu

SEQ ID NO: 300 - RNA, 77 nt, Human
acaucugacaucaccugcagcuuccuuauaacaugcccacugggcagagaggaugagaggcaggagagcaccagugu

SEQ ID NO: 301 - RNA, 73 nt, Human
acauggaguucgcugauucucagagccacuucccauguccuggcauccauuguucagcuugaugucucccugu

SEQ ID NO: 302 - RNA, 95 nt, Human
acaugguggcuggguuccaagggcaaguucugagaaagagagccugguggaaaccuaucacuuuugaugaccuagcccuggaagucacauugugu

SEQ ID NO: 303 - RNA, 63 nt, Human
acauguauugaagcccuguagaaugacacgcuuuugucagaugcgcgggaugcucaugcaugu

SEQ ID NO: 304 - RNA, 72 nt, Human
acaugucauauugagccuccuacugaacucagccacauauggaaguuugaaguggguccucgaaaugcaugu

SEQ ID NO: 305 - RNA, 114 nt, Human
acauucacuugcaaccuaugcuuccaucacuauaaacuuucaagaucuugagauguucaggcaauucauuuaucuucagaagcauaaggaaagugguuaaugcacuugaaaugu

SEQ ID NO: 306 - RNA, 82 nt, Human
acauuuacaauaccucaggcuaauuacuguuauuuuuggggucgaacuuuuuuuugacagugaaggguggauuaugggaugu

SEQ ID NO: 307 - RNA, 131 nt, Human
accaacugcuuagcaccccuggccaaggucauccaugacaacuuugguaucguggaaggacucaugaccacaguccaugccaucacugacaccagaagacuguggauggccucccggaacuguggcgugau

SEQ ID NO: 308 - RNA, 67 nt, Human
accacauuagcuuggcucucugucucagaggguaucucuaagacuaggggcuugguauauauguggu

SEQ ID NO: 309 - RNA, 65 nt, Human
accacgccuggcuaauuuuugaauuuuugguagagacgggguuuuaccguguuggccaggcuggu

SEQ ID NO: 310 - RNA, 75 nt, Human
accacguuuguuucgacgccggaccgcguaagagacgaugauguugggcacggaagguggagagggauucguggu

SEQ ID NO: 311 - RNA, 130 nt, Human
accacugcccugacugucacaacuccuaaccuugccauugccugccucccccuccccuucuccuuaagagacaauuucugcagguggcaggugagcaagcccaggagaaugcugcaaucuuggggguggu

SEQ ID NO: 312 - RNA, 72 nt, Human
accagcacaccagcugcccgguggggcagaccugcugcccgagccugggugggagcugggccugcugccagu

SEQ ID NO: 313 - RNA, 73 nt, Human
accagguccaguucacagacauuguggaaauauucguuuaagaccuccacgaaguugugaauggccuccaggu

SEQ ID NO: 314 - RNA, 76 nt, Human
accaguggaucgagcaggacauggagaaguacauccugagaggggaugagacguuugcuguccugagccgccuggu

SEQ ID NO: 315 - RNA, 80 nt, Human
accaugccccugccacgugggccacuucagacuuggggcacaaauaacauggagggagccaugaaggguggggccauggu

SEQ ID NO: 316 - RNA, 64 nt, Human
accauugccauuucuacauguuauucgcuugguacccucaaguggauacaagucuggcauuggu

SEQ ID NO: 317 - RNA, 72 nt, Human
accauuuuaaaacgggcacaaauaucucuaaggcgcauagugcuuuucaccaguaggccuuugugaaguggu

SEQ ID NO: 318 - RNA, 62 nt, Human
accccaaacauuugucuuuaucuuggcaaaggccaagucaucaaggcaugggacauuggggu

SEQ ID NO: 319 - RNA, 88 nt, Human
accccgcccgggaaggcagccgcaccauggagucuuccaguucaucuaacucuuauuucuccguuggcccaaccagucccagcgcugu

SEQ ID NO: 320 - RNA, 72 nt, Human
acccuagcuaacauccuacagaauggugaaagacugaguguuuuuccccuauaauaggaaacaagcaagggu

SEQ ID NO: 321 - RNA, 78 nt, Human
acccuaugccuauuuugcucacuucccuauucuggugcuuugguugguccuuugagcaagauccccggggcuaagggu

SEQ ID NO: 322 - RNA, 71 nt, Human
accgcgagguuuuuccuagggcugucugggcuggucuacgggucgucccggcugccuuucaugccuccggu

SEQ ID NO: 323 - RNA, 75 nt, Human
accgggggcccccuuauuguuuggggcaaagggccagggccccggaaacgcuccccauauaaaauggcccccggu

SEQ ID NO: 324 - RNA, 74 nt, Human
accgugccagagagaucgugauuggugagucugguugaguccugaucaccaguaucuuuuuucugaaggcaggu

SEQ ID NO: 325 - RNA, 89 nt, Human
accuauucccuguggcuuaggugagcaugugaccaggccuggccuccugagucccacagcuuccuagccacagugauaaaagaaugggu

SEQ ID NO: 326 - RNA, 80 nt, Human
accucgauucucgucuauaacaggacuaaguucacugugaucuuaaauaagcuugguuaaaaugggacaugagugcaggu

SEQ ID NO: 327 - RNA, 73 nt, Human
accucuagcucgccguuggccgccuccaggacgcgcaccuuguccagguaggaggccaggcggucguugaggu

SEQ ID NO: 328 - RNA, 71 nt, Human
accucucauuucuccucaaugccacugcacugaugucaacugacuuagggcaggcaugagagaacugaggu

SEQ ID NO: 329 - RNA, 70 nt, Human
accugcgacugagcgaugccgucggggaccagguacuggccgugguuuaacggguccugcgguggugggu

SEQ ID NO: 330 - RNA, 63 nt, Human
accuggaacagcugccuggauuggccuggaaagguuuguugauguggguaguuauuuccgggu

SEQ ID NO: 331 - RNA, 93 nt, Human
accuggagcugcacccccccaguuauccguggucucaccguggccuccucucuuccuuggaccacgaccagcuauccggagggguuuccaggu

SEQ ID NO: 332 - RNA, 80 nt, Human
accuuaucucugugcuucgugaagcuaaucaagcaauuaaucccaaguugcuucaguuggucgaagacagagguucaggu

SEQ ID NO: 333 - RNA, 77 nt, Human
accuucaccuuccucaccaaaagcacucacuuccugguuuccagaaagaggugaagugaaguggugacuauggaggu

SEQ ID NO: 334 - RNA, 78 nt, Human
accuucggguccacugguuugaugacacccaccgcaacugucuguggcauaucacgaacagcaaagcgacccaaaggu

SEQ ID NO: 335 - RNA, 83 nt, Human
accuuggcauaauuggugauccugaagaaagaggucucucuccuaagucucugucagaauugagcuucacaauugcuaauggu

SEQ ID NO: 336 - RNA, 115 nt, Human
accuuggugguaagaacuuuagcuccagggaacuugaggcagaggcccuguuguggucuguguugacagcaaccgcaccuguccacgucaugcuccugaacuugaccaccaaggu

SEQ ID NO: 337 - RNA, 61 nt, Human
accuuguggggcucuugggaugggcgggcacccaagcccuggcuuguccuucccagaaggu

SEQ ID NO: 338 - RNA, 89 nt, Human
accuuuuggugaagagggcgugaggaaaauaauuccauuaucgaauaugcuuuuauuauuccucuuuaaugccuuuuucauuuuggggu

SEQ ID NO: 339 - RNA, 85 nt, Human
acccuagaaaagaucaccaacagccguccucccugcgucauccugugacugcacaggacucuggguuccugcucuguucuggggu

SEQ ID NO: 340 - RNA, 67 nt, Human
acccugucucccauucugagaaucuggguuagaacugcaacauacaaauuucuuuugggggaugggu

SEQ ID NO: 341 - RNA, 61 nt, Human
acccuuccuuggcaccauucuucuacacuuaaggauggaguuugggaccacauugaagggu

SEQ ID NO: 342 - RNA, 74 nt, Human
accgaagcuggcuuuggugcugacaucggaauggagaaauucuuccacaucaagugccgagcuuccggcuuggu

SEQ ID NO: 343 - RNA, 100 nt, Human
accgagcuccgucgucucguuuccggcggucgcgcgcucuuuucucgggacgggagaggccguguagcgucgccguuacuccgaggagauaccagucggu

SEQ ID NO: 344 - RNA, 61 nt, Human
accgugggugguucaaugacaugaaaaucaccguaucauuggagauugugccacccaaggu

SEQ ID NO: 345 - RNA, 74 nt, Human
accuacuuugagauggcaagaacugcuggagacacacuggauguuuuuaccaugauugacaucuuuaaguaugu

SEQ ID NO: 346 - RNA, 102 nt, Human
accugacaacuggcccuaauacuucauucaaguucgcuauaguuuuggucccucaaucccagacauaugcauaauuggauaaguagaagggaaguguaaggu

SEQ ID NO: 347 - RNA, 104 nt, Human
accugccuauauuacauucauuuugaugguuuguaucucaaaggaguacagugaacgaaacuuguuuaaagauacaccggaaagaaaaagagaagaggcagagu

SEQ ID NO: 348 - RNA, 86 nt, Human
accuucgcauucagaauuugaccaucuuggugagaaacauuaagaccuacuaccagagauggggugaugauuaugaugaagaaggu

SEQ ID NO: 349 - RNA, 74 nt, Human
acgaacgguuaagcuggcuguccugaacacuauuauaacgguggacugagaauggcaaaauuagucgccuucgu

SEQ ID NO: 350 - RNA, 63 nt, Human
acgauauuaggagagaaagaccccgagaguauugguuugggaauuucuuuuguacaagauugu

SEQ ID NO: 351 - RNA, 78 nt, Human
acgcauccuacaagcaauaguuauggggaucugauggugcaacaaagauccaauaucuacugaucuucgauggagugu

SEQ ID NO: 352 - RNA, 75 nt, Human
acggagggucaguggaaaugggaccuugguugugacaaagccugagaaugucauguugauccauccaccccucgu

SEQ ID NO: 353 - RNA, 66 nt, Human
acggcccaagggcuggagcuguaugagaacacucggaccccuaccagcuccagaccuuuguccugu

SEQ ID NO: 354 - RNA, 88 nt, Human
acgggaauggagaaaguuugccagacuggauuuaggguguucuucaugaccucggucuuguggcaaauggugaacguuccauccucgu

SEQ ID NO: 355 - RNA, 87 nt, Human
acgggggaacaacacaggagagaaauaguauauacagccacgacugcuguugccgcugacuauaaaacaaaccuguguugucucugu

SEQ ID NO: 356 - RNA, 70 nt, Human
acggucauucugguagguagggguagggccagagcaaggaguccugguuugugaaccaccagcuggccgu

SEQ ID NO: 357 - RNA, 67 nt, Human
acguaaggggcugggcugggcagcaccaggggcuugaggcucuggugaugcuccuccagcuccucgu

SEQ ID NO: 358 - RNA, 89 nt, Human
acguagacucggcguggagggugucguggacgccgccugguccgaccgcggccggguggccucagggcuccucauccaggagucugugu

SEQ ID NO: 359 - RNA, 75 nt, Human
acuacuauguuaucucagcaaauuaagcgaugguuuuaaacauaaccuucuuaaagcuauucaggauuuaguagu

SEQ ID NO: 360 - RNA, 86 nt, Human
acuacugaaguucugcagaacaguaucgagcuugaauuugggggucucgcaguaauuuaugcucuuugcuuuugccuuuucauagu

SEQ ID NO: 361 - RNA, 70 nt, Human
acuagcaaaguggauugcugacagaacggauguucauauucggguuuucagaccacccaacuacucuggu

SEQ ID NO: 362 - RNA, 75 nt, Human
acuauucaggcgcaguacaaguuggggcacugcauccuuuguggauggauuuccguugcuguguuccucacaagu

SEQ ID NO: 363 - RNA, 73 nt, Human
acuauugccagacccacuaccagugcuuguggucgugcugguaguugcagaacucuggguagcuggcgguggu

SEQ ID NO: 364 - RNA, 70 nt, Human
acuauuggccauguccaucacgagaguguuuguaguaauuaauuaccuuguacaggaccuggcacuuagu

SEQ ID NO: 365 - RNA, 84 nt, Human
acucaauaagaaucuuuuauaucaaguaaaaugaaaguugaugauagaauaucaaauagugaauuugauaugaaaucuaagagu

SEQ ID NO: 366 - RNA, 75 nt, Human
acucaccauuuuacuacuucuaucuuuuugacuuuccaagaauguccuagaguuggagugguacaguaugugggu

SEQ ID NO: 367 - RNA, 71 nt, Human
acucauugaaaauggaggcuaugcagaccagaccuaugauggaugggugacacagccccagguuagcgggu

SEQ ID NO: 368 - RNA, 77 nt, Human
acucauuuacgucuuggccuguggcucaagaauuuuguccagaaaucucuuaggcccucaggcccuugcgaaauggu

SEQ ID NO: 369 - RNA, 92 nt, Human
acuccagccuggccucugaccccaguucaauccgaccaugcccaagcccaagcgggccuuuccuccagaacugcuccggggccuggcugugu

SEQ ID NO: 370 - RNA, 72 nt, Human
acuccucgcuuacgagcuccacagcacaaagggcaucaaaagacuguugugagaggaacgcaagcgaggggu

SEQ ID NO: 371 - RNA, 78 nt, Human
acucuauuuuauucaaauggcacuaugauaugaguucaaaaaauuuuugaaacaguguccuuuguuuugagauggagu

SEQ ID NO: 372 - RNA, 105 nt, Human
acucuuagaaaaaaggcuuacaacuuuugaagguuuagcaugaugucagauguccauuugucauauauggccuuuauuggcuugagguauguauguucuauaugu

SEQ ID NO: 373 - RNA, 84 nt, Human
acucuugagcucccuccacuucugaggacguuuccugacacauucaacagcaucagcguccaaucaggagggagcucaaagagu

SEQ ID NO: 374 - RNA, 112 nt, Human
acucuuugagaugacugguauugaauggagcagucuuugaaaggcaccaacccuuccuaacugaugguggucucuugaaagaggcucuuccaaauuugucuucugaaagugu

SEQ ID NO: 375 - RNA, 61 nt, Human
acugaaacugaaagggaaaacccacaaucuugggugaaacuccuuccucagcugguucagu

SEQ ID NO: 376 - RNA, 82 nt, Human
acugacaguacccgacuguuuauuggaucuauugauuugaaaagaauuuguuaggauagaucuuaagcaguaaucugucagu

SEQ ID NO: 377 - RNA, 73 nt, Human
acugcagcacuuauaucccuccccuguugauguuucuuuuauuagcacucagggcuuccaggugugagcaagu

SEQ ID NO: 378 - RNA, 107 nt, Human
acugcaggucguauaaacgugauaaaugaaugcuacccugcuggcucuccgagagaguguaauuaguauuuauaucaaaauuuaugaaacaaauuuucggccgcagu

SEQ ID NO: 379 - RNA, 69 nt, Human
acugcucuaugagaacauuucuaccucuggaaaaggaggcuggugaaugucccuaucucaaaggguugu

SEQ ID NO: 380 - RNA, 84 nt, Human
acuggagacacaucuaauggcugugcugaugucaagggacuuucuaaucauguucaucaguugauagcagaugcuguuuccagu

SEQ ID NO: 381 - RNA, 77 nt, Human
acuggaguaaaaggacuaacugcagucagcaacaaugcagggguugacaauuuugguuuaggggcuuuugcuucggu

SEQ ID NO: 382 - RNA, 93 nt, Human
acugggacugcugagauguccucuauucuugaagagcguauucuuggagcugauaccucuguugaucuugaagaaacugggcgugucuuaagu

SEQ ID NO: 383 - RNA, 66 nt, Human
acuggugcagagaaccauugcaagacuucgccuaaagaaaauuuuuaguggugucuuuguaaaagu

SEQ ID NO: 384 - RNA, 78 nt, Human
acuguagagggaauugccgggugugccccauggauuggaggacaaguuugcgaucacaagggccggcacuucugcagu

SEQ ID NO: 385 - RNA, 87 nt, Human
acuguauuuuuacuauacuguugcuauguuuggauacauaccacuguguuuaaguugccuacaguauucagcccaguaacauacagu

SEQ ID NO: 386 - RNA, 60 nt, Human
acuguccucauggagcuuacagacuaauuacauaaaguaagagcuaaaacugaugacagu

SEQ ID NO: 387 - RNA, 86 nt, Human
acugugaucgucgugacugugguccuauugaggccagugucugaguuaugggcuuggcacguauaggauccacuauuauucacagu

SEQ ID NO: 388 - RNA, 73 nt, Human
acuguguuaguaacucuuuaugaauauugucuaaaaacuaaauaagauauucauguaaagugauuaucacagu

SEQ ID NO: 389 - RNA, 89 nt, Human
acuuacugaaccucuuuggcaaacauuuaucaagacaauuuuggacacaaaugcuuguuuagaaauuuugcucaggaaggugagucagu

SEQ ID NO: 390 - RNA, 73 nt, Human
acuuauggucaucucucccacugaaaccaaggucuuuucaaauguggcuaaauggggaugaggagacacgggu

SEQ ID NO: 391 - RNA, 84 nt, Human
acuucuucucuuauguuagcuucauuauuagauuguuucauuuuugaaaauuccugaugugagaccugaauauuuuuaagaagu

SEQ ID NO: 392 - RNA, 92 nt, Human
acuuggagaguuuggcccaggaguuccugaaccauauuuguuacuugugcucacucagguugaguucuguggccaguuuguauucucaaagu

SEQ ID NO: 393 - RNA, 95 nt, Human
acuuguacaacauugccaucugcuguugagaaugguagguacuguucugagaaccuggugcagauccuuagcauaggcagaaauguugagaaagu

SEQ ID NO: 394 - RNA, 75 nt, Human
acuuuacuggucccuuuacucuuccacauaaaugguauauacaaccacucagguccaaggaaaaagccgguuagu

SEQ ID NO: 395 - RNA, 88 nt, Human
acuuucaagcuccuggggaaauguugcugguugaccguuuuugggcaauccauuuucggccaaagauuucacccuugagguugcaggu

SEQ ID NO: 396 - RNA, 64 nt, Human
acuuucaggguaaugaugcaccuguugaacaagacauuacagugcagaaacuuacuuugaaagu

SEQ ID NO: 397 - RNA, 71 nt, Human
acuuugauuuacuuagauauguauguaacaacagugaauguacauuaagaugaagucaaguguugcaaagu

SEQ ID NO: 398 - RNA, 99 nt, Human
acuuuuggcucauuuuuugaugcaugugaccugggauuauaaaugugaaauuagguuuacgaaaggauccagugucauugugcaucaugggcaaggagu

SEQ ID NO: 399 - RNA, 96 nt, Human
acuuuuuaagaguaugaucauagcaucuacuuguagguuuguugaguauguuugacaagcccaagauagaugcucauguuagacccauuaagaagu

SEQ ID NO: 400 - RNA, 111 nt, Human
agaaaagacaacuaguauuugaggaaggugugagaaaugagccuaaagagguagaugagacucaaaggaggcugauaaagauaccacagcuacaaguuuuuguuauauucu

SEQ ID NO: 401 - RNA, 80 nt, Human
agaaagagcucacaggcuuuggggauuugugcaugaggagauacagugcugcauuccuaacugucgagugacucugcuuu

SEQ ID NO: 402 - RNA, 82 nt, Human
agaaaggaagaggcaggcgccagggggaacccacuucguguuuugugacccucccuuuuaggugaagccccuuuuucuugcu

SEQ ID NO: 403 - RNA, 82 nt, Human
agaaagggccuaaaguuggugacuaaucccauguggaaauuuaacccguuccuuucaugaaucuucaccagaugcccuugcu

SEQ ID NO: 404 - RNA, 78 nt, Human
agaaaguuuuucaauccuucauggaaauaacaucacguuucuucuacagacaugaaacauggagagagaaacauuucu

SEQ ID NO: 405 - RNA, 74 nt, Human
agaaccagcugauggccccagugccugaaagugcccuugggcaccuccucagcuggugccaggaucuggucucu

SEQ ID NO: 406 - RNA, 87 nt, Human
agaacuucagccguggcucucuagucuucgugucaauauccuuuauuguuuugaugauuauuuucuucagccauggcucauauuucu

SEQ ID NO: 407 - RNA, 71 nt, Human
agaagccaagaaacauacgaaauacaacccucuuuuuagacguuuccaauuucuaaauuuuaaaagcuuuu

SEQ ID NO: 408 - RNA, 78 nt, Human
agaagcuucugcaauucucaaaucucugggaagcuuccaucaguggucucagucuauagugggaaagcaggugcuucu

SEQ ID NO: 409 - RNA, 72 nt, Human
agaaggccaugcagaaggcaaggacugacuaggcaauuaugucagcagauccuggccuaauggggcauuuuu

SEQ ID NO: 410 - RNA, 72 nt, Human
agaagucugguggagagacucuguggacguaaagaagggaaugaacacagagaaacuuucagccagauuccu

SEQ ID NO: 411 - RNA, 105 nt, Human
agaauaucugaacauuggacuuguucuuuagaguauauggccuuuaguucuuguggaacuaaauacagugauucuaagaucaaaagucuuaguguuugggguuuu

SEQ ID NO: 412 - RNA, 84 nt, Human
agaaucgcuugaacccaggaggcugagguugcagugagccaagauugugccacuguacuccagcccgggugacagagugagacu

SEQ ID NO: 413 - RNA, 84 nt, Human
agaaucgcuugaacgcaggagguggagauugcagugagcugaggucaugccacugcacucuggccugccugacagagcgagacu

SEQ ID NO: 414 - RNA, 86 nt, Human
agaaucucccucugucacccaggcuggagugcaguggcaugaucucggcucacugcaaccuccaccucccggguucaagcgauucu

SEQ ID NO: 415 - RNA, 67 nt, Human
agaaucuugccuuucuccuucaggcucauauaaacuauuggcugacaccguggaggguaaagauucu

SEQ ID NO: 416 - RNA, 76 nt, Human
agaaugccaagaugguauuuucuuuggcaagaugcuuugguugugcagucauugaagauacuuggcacuauuuucu

SEQ ID NO: 417 - RNA, 84 nt, Human
agaauugcuugaacccaggagauggaaguugcagugagcugagauugcaccauuguacuccagccugggugacacggcaagacu

SEQ ID NO: 418 - RNA, 71 nt, Human
agacaaauugaagggagagaugauggaccuccaacauggcagccuuuuccuuagaacaccaaagauugucu

SEQ ID NO: 419 - RNA, 105 nt, Human
agacaaggccucgcucugucacccagggcuggagugcaguggguguggaucaauaccucacugcagccuccaacuccuggggcucagggcaauccuuccuugucu

SEQ ID NO: 420 - RNA, 79 nt, Human
agacacugaauuggacauugauuuccuuuucucugcgucgaaaugucaaggaaaguugcaagucugugauuuuguguuu

SEQ ID NO: 421 - RNA, 87 nt, Human
agacaucacgguggaggacaugaacgagcuagagcgacaguuucuugaauugcugcaguucagacaucaauguuccuuccagugucu

SEQ ID NO: 422 - RNA, 86 nt, Human
agacaugucaaggcaggagccaucugaucgaccuuagacuuggcaagcugguggcuaaguccagugcucacugccgacaucugucu

SEQ ID NO: 423 - RNA, 86 nt, Human
agaccaccuuauucuuuucuuauggguauguggcaugaaugccaucauuuauuuacccagcugccaguugaagaacauuuuggucu

SEQ ID NO: 424 - RNA, 78 nt, Human
agacccagugccugugacuuugaguaguuuguucuaaauguggugacaaacaagucauuucuguaagacauugggucu

SEQ ID NO: 425 - RNA, 78 nt, Human
agaccuacuugauccaauaaaagaacucuaugaggaugucagaagaaaagccuuaaugagauuggaauaugaaggucu

SEQ ID NO: 426 - RNA, 71 nt, Human
agaccuugucacauucaugacauuuguaaggcuucucuccaguaugaauucuuugauguugugaaagguuu

SEQ ID NO: 427 - RNA, 114 nt, Human
agacgaggaggugauugagcuguauggggguacccagcacaucccacuauaccagaugaguggcuucuauggcaagggucccuccauuaagcaguucauggacaucuucucgcu

SEQ ID NO: 428 - RNA, 76 nt, Human
agacucuguuaugauuuuauuucuucaauuguuccaaucacaguuucuaauacagaaauaaaacuauucagcgucu

SEQ ID NO: 429 - RNA, 75 nt, Human
agagaagauucccggagaguaaauccucuuuccaaucccgaggaacaagcauugucucucuggcaagauccaucu

SEQ ID NO: 430 - RNA, 87 nt, Human
agagaaucauacauuuguuauauugucacaucugccuugagucuuucaacuauaagugacagcuauuuccuaaucaauguguucuuu

SEQ ID NO: 431 - RNA, 74 nt, Human
agagaauccagcauccacuguucugcccaguauuuauccauugaccugugcucugucuggauccuaucuucucu

SEQ ID NO: 432 - RNA, 93 nt, Human
agagaaucugccuaagugggaauuaaaauggcuaaaguuuuaaccucaauuauuuugaaaccagaacauuuuccccacuauagacgauuuucu

SEQ ID NO: 433 - RNA, 68 nt, Human
agagacuguccuuugcaaaggaaaugaccagcauuucaacuguaugucuuccuggaaggguagauucu

SEQ ID NO: 434 - RNA, 77 nt, Human
agagagauucaccuggguaccuacaguagucgagauguaagccuuggggacugggaauuugggaagagagauucucu

SEQ ID NO: 435 - RNA, 79 nt, Human
agagaggauagauugaauguggauaaugcgaagauagagugacgucucaucgaaugggucacguauugucuaccuuuuu

SEQ ID NO: 436 - RNA, 90 nt, Human
agagaucgagcaaucaaagcguuaucugucaaagcaauucggcuccuacugauuuugccaaaaccacgcuuguagauuaguucaauuacu

SEQ ID NO: 437 - RNA, 77 nt, Human
agagcaagaugaacagaaucuguauucucaaagagcacauagccaaacccugugccgaugccugucauuuugucucu

SEQ ID NO: 438 - RNA, 70 nt, Human
agagcuuccucaucagguuacccagaagugggucccauccaccauccaggugugcuuggauguuaguucu

SEQ ID NO: 439 - RNA, 80 nt, Human
agaggaaaaagcaaguugcuccagaaaaaccuguaaagaaacaaaagacaggugagacuucgagagcccugucaucuucu

SEQ ID NO: 440 - RNA, 87 nt, Human
agaggaagcgggaggagcugagcaacguacuggccgccaugaggaaagcugcgugccaagaaagacugagccccuccccugcccucu

SEQ ID NO: 441 - RNA, 87 nt, Human
agaggaagcgggaggagcugagcaacguacuggccgccaugaggaaagcugcugccaaugaaagacugagccccuccccugcccucu

SEQ ID NO: 442 - RNA, 84 nt, Human
agaggaccucacccuaagagccgcccccugugcuacugaucucgcauacuacgcucacacucuucuuggugcucugguaccucu

SEQ ID NO: 443 - RNA, 61 nt, Human
agaggagauccaggcuaaauuuucuggcccuucaggaaggcuggcaccucuggcucucccu

SEQ ID NO: 444 - RNA, 80 nt, Human
agaggcaaagcuagggcagcucuggggucugggugggaaaggggcaucugaucucaguugcugcucaaggcacagcugcu

SEQ ID NO: 445 - RNA, 86 nt, Human
agaggcacaucuugauaacaugcugagaacugaggcaacugaugucuuuaggcucuuauagucccagcauguuuuuaagagcuacu

SEQ ID NO: 446 - RNA, 87 nt, Human
agaggcuguguggccaaccaggacccaaggugcccuucccagauuccuugggaaggacacagcaguauuggaccgguucuagccucu

SEQ ID NO: 447 - RNA, 62 nt, Human
agagggaagcagguucauaguucacaccuuguguugaagaugacaugagccuucuuucuccu

SEQ ID NO: 448 - RNA, 71 nt, Human
agagggauguagccagauucuguggaccgccgucuuuuucacccuuaagaauccgucgcuaugauuucucu

SEQ ID NO: 449 - RNA, 72 nt, Human
agaggggacccuaacaggcuggacagaguuggagcaaugguaaguucugacuagaguggccggggauccucu

SEQ ID NO: 450 - RNA, 66 nt, Human
agaggggccacggggcgcccauguacaaaacuacguguucccgccauagccccuuggauucccucu

SEQ ID NO: 451 - RNA, 115 nt, Human
agaggguugacauuagguuuggugagaugaguugcuuggcacagaucagcagaacaggacccuggugauaaggcaucuggcuuugcuaaccacuuaucaucuuccauuauucucu

SEQ ID NO: 452 - RNA, 89 nt, Human
agagguggaacuuugaagaauucacuggucguuuuguaucacagguacaacuagagcguacacuuaacuuuucaacuguucuaucaucu

SEQ ID NO: 453 - RNA, 80 nt, Human
agagguggucugcugaccugugguaucucagaggggacguuccuccuccucccugugcacaggugggcugaccuccugcu

SEQ ID NO: 454 - RNA, 107 nt, Human
agagguguuccuuaggccacacccugcccucccuggacugccugaccucgcuccaaggcucaggggaagguucugagggcaggugugaaaaugcuuggaaugucccu

SEQ ID NO: 455 - RNA, 86 nt, Human
agagucucauucuguugcccaggcaggagugcaauggugugaccucaggucacugcaaccucugcugccuggguucaagcgauucu

SEQ ID NO: 456 - RNA, 68 nt, Human
agauacacccuuuccguuuggauggugaguuccuaaguuuauccagagguaaagcccauugugugucu

SEQ ID NO: 457 - RNA, 73 nt, Human
agauagggcuuuccccauccuuuugcuuuuuuuaggcaacccuuucacaaaaccagggaaggggaaccugucu

SEQ ID NO: 458 - RNA, 114 nt, Human
agaucaacgauggcauuagauuagcauuggagcacaaacccuauugugaacuguacaugccagggaucuagguugcaugcuccuuaugagacucuaacuagugccugaugaucu

SEQ ID NO: 459 - RNA, 68 nt, Human
agaucgauggaauuucugggguauagcacauucuaaugucaccugagcuuccagguccucaaugaucu

SEQ ID NO: 460 - RNA, 72 nt, Human
agaugaaauaauguucugucacgugaaauauuuaaguauauaguauauuuauacucuagaacaugcacauuu

SEQ ID NO: 461 - RNA, 85 nt, Human
agaugacuguugggagagaagcugaggcagggcuugcaugucugcuagacuugcugguuccuugcuucuagcacuccuguuaucu

SEQ ID NO: 462 - RNA, 69 nt, Human
agauggaugggacagaaaauaaaucuaaguuuggugcgaacgccauucugggggugucccuugccgucu

SEQ ID NO: 463 - RNA, 87 nt, Human
agauggucugaugcuacaggacuugguuucagcuaagcugauuucagauuacacuguuaccgagaucccugauaccauuaaugaucu

SEQ ID NO: 464 - RNA, 76 nt, Human
agauguagcuuuuguaauacuauuuugaccucuucugcucucauuugguuaauauuugcaugcaaugucuaaaucu

SEQ ID NO: 465 - RNA, 95 nt, Human
agauucaaagcaacaccaccaccacugaaguauuuuuaguuauauaagauuggaacuaccaagcauguggcuccuggucaguguaauucuaaucu

SEQ ID NO: 466 - RNA, 88 nt, Human
agauugucggacacgcgguaauugaugaacggcaggugagggagagcucugaucagccugguguucauuguccagaguccggcuguuu

SEQ ID NO: 467 - RNA, 113 nt, Human
agauuuuuucugauacuacauauugucaguuuuuuaaauacucaguuugugcuaaaagaaaacauucggcaacugauaucugcuguucuguauguaucugucaguccagauuu

SEQ ID NO: 468 - RNA, 65 nt, Human
agcaagaguagggugcauggcuugaauaagaggaaacagccguucacccaacauuugcuuuugcu

SEQ ID NO: 469 - RNA, 107 nt, Human
agcaaggacaaguugugaccuucccaguccucucuccauuugcagaucagcaagcuucugucagcaaggagggguggacaaugaaacuggguucagcuugauuuguu

SEQ ID NO: 470 - RNA, 67 nt, Human
agcaauccucaauauuucggggagaaauauuuuggcuucccucaguuugaaguguuagguuuuuguu

SEQ ID NO: 471 - RNA, 71 nt, Human
agcacaucuaagggaauaacaugauuuaagguugaaauggcuuuagaaucauuuggguuugaggguguguu

SEQ ID NO: 472 - RNA, 70 nt, Human
agcacaucuuugagaucucccgccguccugaccuacucacuauggugguugacuacagaacccgugugcu

SEQ ID NO: 473 - RNA, 106 nt, Human
agcacaugguauuccuggguggugcaguucuagcggauaucaugaaagacaaagacaacuuuuggaugacccgacaagaguaccaagaaaaggguguccgugugcu

SEQ ID NO: 474 - RNA, 90 nt, Human
agcaccagcucuugccccuaugcuggguaccaagggaguucuccuagcuguggcuucucuagguucuaggggugcaagccucuguguguu

SEQ ID NO: 475 - RNA, 73 nt, Human
agcacgcuacaacgggcaucgcuggacuagcaacuuguccugcuaucccucaaugugacgcagugagcgugcu

SEQ ID NO: 476 - RNA, 90 nt, Human
agcagcaaggcccugguuucuaagcuguauccuuuuauucaugugggacaugagcaaauggcagaauuaggggcgagugcuuucaaugcu

SEQ ID NO: 477 - RNA, 71 nt, Human
agcagcagcccucucucuggaaccgugggauuuggaccauucuccacccugaagugcagaggguugcuguu

SEQ ID NO: 478 - RNA, 74 nt, Human
agcagccagaugguccagagacagggauuuugauacauguggucucuguccuucagaaggaagugauugcugcu

SEQ ID NO: 479 - RNA, 65 nt, Human
agcagccgagcggccauggagcugugcgggcuggggcugccccggccgcccaugcugcuggcgcu

SEQ ID NO: 480 - RNA, 77 nt, Human
agcagucaauagcauccuucucuacaacaggaggucaugaguagcuuucugccagagggaggguguuacgagcugcu

SEQ ID NO: 481 - RNA, 78 nt, Human
agcagucacucuccacccuucccuucugccugcccagcugccccggggccacgaguggaugcuggggcuguggcugcu

SEQ ID NO: 482 - RNA, 85 nt, Human
agcaguccaaaaaaugugaaugugcaaauugugaguaaaacauugcauuuaaauuugcacucauuugcaaguuacaguacuagcu

SEQ ID NO: 483 - RNA, 65 nt, Human
agcauacagcagcaagaaggggugcaggugguggugcaacagccuggcccuggguugcuguggcu

SEQ ID NO: 484 - RNA, 79 nt, Human
agcaugacugacacgucugaccccugagaagguggucucugccuuccuaaaggugucaucuguguucaaggacgaagcu

SEQ ID NO: 485 - RNA, 86 nt, Human
agcaugaucaagaagccccgcccacucgggcugaaggcagugauuuuggccaaugcaguccuggauggagccgacugcaucaugcu

SEQ ID NO: 486 - RNA, 63 nt, Human
agcauggucagcaaguucucgggguucuccagggaauucuugccagucccuuaagauuaugcu

SEQ ID NO: 487 - RNA, 82 nt, Human
agccaaaauguacaagaccacaccggaugucaucuuuguauuuggauucagaacucauuuggugguggcaagacaacuggcu

SEQ ID NO: 488 - RNA, 72 nt, Human
agccaaagcuuguuuccuuuuucuucccauccugaguucagugugaaguauagggaagaacaacaccaggcu

SEQ ID NO: 489 - RNA, 86 nt, Human
agccacaccaccagaaugugucuguccccagcaauaauguucacgcgccuuauuccagugacaaagaacacauguguacugugguu

SEQ ID NO: 490 - RNA, 77 nt, Human
agccaccuccgccaccccugccccgccgacccagcacaccuaggcagggccuguggggagugggcgccgggagugcu

SEQ ID NO: 491 - RNA, 80 nt, Human
agccagagggaucgaaauggaaaucagcugagaucaccgcaagaggaggcguuacagcgauuggucaaucucuauggacu

SEQ ID NO: 492 - RNA, 63 nt, Human
agcccagcaggcucguaccaaagucacagcaguaaugcuauguacugcagagucugaugagcu

SEQ ID NO: 493 - RNA, 90 nt, Human
agcccaguccuaaauucgaauagcagcucuuaaagagaauaggaugcucuugauaggcuuucuuuaggacugauauucaauuucugggcu

SEQ ID NO: 494 - RNA, 76 nt, Human
agcccgaaagugucuccaccaggcggcuucaauggauccaucccuaaagagguggcccccuggaggccaucuugcu

SEQ ID NO: 495 - RNA, 61 nt, Human
agccgacgggaccggcucaaacccccggggguuuucaacggggggcggcgggacccgugcu

SEQ ID NO: 496 - RNA, 76 nt, Human
agccgcagucuguauggccuggggggcuccaagaggaucuccauuggagggggcagcugugccaucaguggcggcu

SEQ ID NO: 497 - RNA, 73 nt, Human
agccggcgacacccuggagggacgggcagguguggugagccucugcccggguucucugggugagggccaggcu

SEQ ID NO: 498 - RNA, 69 nt, Human
agccucaaagcuuggccagggcugaagguaccacacgguugugggugaggcaggcuaagcgggauggcu

SEQ ID NO: 499 - RNA, 70 nt, Human
agccuccaggguccugcccgccgagcuccagcagccaguggggcgggcgcggcacagccucugugagacu

SEQ ID NO: 500 - RNA, 60 nt, Human
agccucccuaguaguugggauuacaggcaugcgcuaccaagcccagcuaauuuuuguguu

SEQ ID NO: 501 - RNA, 86 nt, Human
agccuggagccggcugauguuccgguucaucucagagaucucagucuuugugcgccgaggucauccccgugcuucccagccaggcu

SEQ ID NO: 502 - RNA, 79 nt, Human
agccuuccauuggaagaaggugccgucuaggacuuucauaacuagagagaagacaacaucugcuuugaaaggacaugcu

SEQ ID NO: 503 - RNA, 105 nt, Human
agccuuucuugucuucauaagccuguugaugucucugguccugauccugaaaucacagaugcagacagacuaacagacacaggcuuacaacuugcagggcaggcu

SEQ ID NO: 504 - RNA, 77 nt, Human
agcgagaaguacauccugacccugcagacggugcacuucacuucugaagcuguggaguugcaggauaugagcuugcu

SEQ ID NO: 505 - RNA, 78 nt, Human
agcgaucaugucgcacaaacaaauuuacuauucggacaaauacgacgacgaggaguuugaguaucgacaugucaugcu

SEQ ID NO: 506 - RNA, 68 nt, Human
agcgguggccccgagguucgagucuugcucuucaaugcuaccggggaccgggacccggcggcccugcu

SEQ ID NO: 507 - RNA, 89 nt, Human
agcguuagguaugagccucgguguuaaucggcgaggguugggcaacguguugcuagucuggucguuggugacagugaggcuucugcgcu

SEQ ID NO: 508 - RNA, 75 nt, Human
agcuaacauacacauagugaagaaugcuuuccuuuaagacugggagcaaggcauucuuauucaacaauguuagcu

SEQ ID NO: 509 - RNA, 81 nt, Human
agcuaaggaugcuggggcagaaagauggaaccuggguuacucaugacaucuugaaacugcugcagccauccuagacuggcu

SEQ ID NO: 510 - RNA, 114 nt, Human
agcuauugugacaaucuugguuaccauccauuaagugcugcugauuuuggaaagaucaugaaaaacgucuuuccaaacaugaaggcacgucguuugggcacaagaggcaaaucu

SEQ ID NO: 511 - RNA, 80 nt, Human
agcuccaucuuuuguaggggagugaguuuccaucucuggacauaucuaacagaggcuggauuccaccuacaaaagaagcu

SEQ ID NO: 512 - RNA, 67 nt, Human
agcucccaguaucgaggggcaaacuuaacauuagcuuaaugcgacuuauuugcccagauuggguccu

SEQ ID NO: 513 - RNA, 86 nt, Human
agcuccgcgccgccggcaaugagaguuuccugcaacggccaguacgccgaggccuccgcgcucuacggccgcgcgcugcgggugcu

SEQ ID NO: 514 - RNA, 61 nt, Human
agcucugcacucaugauucuguggcucucuguccaucuggccacaguucagaagccaggcu

SEQ ID NO: 515 - RNA, 84 nt, Human
agcucuuccgccuggcgcggcuugaggaccagugcacugaguacauggccaaggucauugagaagcugguggagcgggaggacu

SEQ ID NO: 516 - RNA, 85 nt, Human
agcucuuccuggaucgucucagaucugccauuccucuggauaugaaccugugggcguggcagaaauccagaaaucaguaggggcu

SEQ ID NO: 517 - RNA, 89 nt, Human
agcugaagucacacaugaaagaagccaugaucaagcuugguuuccacuugcucugcuucuucauguaucuuuauaguaugaucuuagcu

SEQ ID NO: 518 - RNA, 91 nt, Human
agcugagcucacagccgaauaagccaccaugaggcugucagugugucuccugauggucucgcuggcccuuugcugcuaccaggcccaugcu

SEQ ID NO: 519 - RNA, 75 nt, Human
agcugcgcuccccugcuagaaccuccaaacaagcucucaagguccauuuguaggagaacguaggguagucaagcu

SEQ ID NO: 520 - RNA, 87 nt, Human
agcuguaaauuauguuggagcagggacuguggaguuuauuauggacucaaaacauaauuucuguuucauggagaugaauacaaggcu

SEQ ID NO: 521 - RNA, 60 nt, Human
agcugucagggccucacuguggaaggaagguccacagaaaacauccugggguccugagcu

SEQ ID NO: 522 - RNA, 87 nt, Human
agcugugucuugcuuucuuauuugagguuucuucagaaagggaaacugauuauauuagagacaauaauguuggaagacaaaacaguu

SEQ ID NO: 523 - RNA, 104 nt, Human
agcuguguggguggaacgugccucugcugcccacccaggggcccugaugugggaaccucacccauggguaaggcagcggggacccaggugugcacccacaggcu

SEQ ID NO: 524 - RNA, 80 nt, Human
agcuuacugccagcaccaacugccucucacaggcuggggugaucaugggacugggaaggaggggugugggcgguagagcu

SEQ ID NO: 525 - RNA, 83 nt, Human
agcuuagauaccauguaguggucuguggcuacaggaagcugguucugucguguuccacagucugcuuaaaaaacugucugacu

SEQ ID NO: 526 - RNA, 68 nt, Human
agcuucaaaagcacaacuacacacuuugcccaaggucugauucuguguaucugugcaucugaggagcu

SEQ ID NO: 527 - RNA, 83 nt, Human
agcuuccauguccagaggaagccaggcgucuccuguaggaaaugucuuucuuguaggcucacucaccauugcacagggaagcu

SEQ ID NO: 528 - RNA, 89 nt, Human
agcuuccugcaggcccagcugugccaggacgugcugagcagcuuccaggagcuguguggggcccuggggcuggaacccgguggggggcu

SEQ ID NO: 529 - RNA, 78 nt, Human
agcuugcugaugcaucaguggcagcagauucaagggugguuuccagcaucuacugucaguguggcaugaggacaagcu

SEQ ID NO: 530 - RNA, 85 nt, Human
agcuuggccaacauggugaaaccccaucucuacuaaaaauacaaaaauuagcugagcaugguggugcgcgccuguaauccaagcu

SEQ ID NO: 531 - RNA, 111 nt, Human
agcuuugccacauucugcacagacguggacucugggaccguggugugcagauguuuucucauggccgaguuaucccugaaccaucuugugcagccuuuaugagggcaagcu

SEQ ID NO: 532 - RNA, 81 nt, Human
aggaaaccaaaauauugacagcaguuaucucugauagauagaaugacagaugauguuuauuuucuucuuacacuuuuuccu

SEQ ID NO: 533 - RNA, 69 nt, Human
aggaaaggaggaagaaauguuuucuuaggggaauucgcuagguuuuaacgauuuguuucuccugcuccu

SEQ ID NO: 534 - RNA, 56 nt, Human
aggaaaguugcuuuuagaaguagaauauauauucacucacaugcaagcgauuuccu

SEQ ID NO: 535 - RNA, 81 nt, Human
aggaagacacauagguggguuuauguuucaccucauuuggaacaaaagaggacagaagcagaccacucugugcaccaaccu

SEQ ID NO: 536 - RNA, 79 nt, Human
aggaaguggaugagcuguacagagaagcaccuauugauaaaacggggaaucucacuuacaucgaguucacacgcauccu

SEQ ID NO: 537 - RNA, 72 nt, Human
aggaaucuaguggccaagaguuguaguuuagaaacaacccaucugaauacugcuuuuaccacuuugauaccu

SEQ ID NO: 538 - RNA, 74 nt, Human
aggaauuccugcccagcucacaaucuaaguuucaauacucugcagcucagacagaaaguuuggccuguguuccu

SEQ ID NO: 539 - RNA, 88 nt, Human
aggacacgggguugggggaaggcagacuggcaggccagggugacccuccugaccagaggugcugcccagacccgagcccguuuguccu

SEQ ID NO: 540 - RNA, 83 nt, Human
aggaccucaaagagggagucacagccugggcucggggagcucccaggucugggcucccugaguggcugcaucucuucucuccu

SEQ ID NO: 541 - RNA, 67 nt, Human
aggacgcggccgcaagcuuauucccuuuagugaggguuaauuuuagcuuggcacuggccgucguuuu

SEQ ID NO: 542 - RNA, 90 nt, Human
aggacugcagccuaaauuccaaauaccagagacugaaauuuucagccuugcuaagggaacaucucgauguuugaaccuuuguugugucuu

SEQ ID NO: 543 - RNA, 76 nt, Human
aggacuucgucaccaugacagcuucucggaugcuaugacccaaccaucuguggagaguggagugcaccagguaccu

SEQ ID NO: 544 - RNA, 87 nt, Human
aggacuugacggagaggugaaggcuccagacgccaggauauuuauucccugugccaauacagcauucacaccugaccuccagguccu

SEQ ID NO: 545 - RNA, 79 nt, Human
aggacuuuagcagcucguuguauuuccuggucaaccucucagcgaccuggagggauucgucgagcucccgccgcagcuu

SEQ ID NO: 546 - RNA, 98 nt, Human
aggagaagaccuucaagcuuuacauuuggacuuggacgcaagaacuucaggaggauggagucacuugugguauugauguggacuuugagguuuggccu

SEQ ID NO: 547 - RNA, 85 nt, Human
aggagaaggaauuucagguggguuuaagucagagcuaguuccccaacagaaagaucauuugaaaccaguuuuuaucccuucucuu

SEQ ID NO: 548 - RNA, 117 nt, Human
aggagacccgugucauguuugagaagauagcgaaauacauuggggagaaucuucaacugcugguggaccggcccgauggcaccuacuguuuccgucugcacaacgaccggguguacu

SEQ ID NO: 549 - RNA, 82 nt, Human
aggagacguccucuacauaaaagcuccaugugaaaagcuacuccuagucuuaacauuugcaguccuugugucacugucuucu

SEQ ID NO: 550 - RNA, 68 nt, Human
aggagcaaccucuggagccaucgcgauugauuccucccaucccaagauggcuucuggguuccacuccu

SEQ ID NO: 551 - RNA, 130 nt, Human
aggagcagacuuuucucuugucacuuuggaaggagaggauugugaggcugccccuuuaaauagcauucccguaggaggcagaucacauccauccgucaccuacugccaaagcaucauuuuugguuucuau

SEQ ID NO: 552 - RNA, 70 nt, Human
aggagcccaugagauuugagucagguuguaagugaaaucacuuacacuuuuggauagaauuuauacuccu

SEQ ID NO: 553 - RNA, 77 nt, Human
aggagccucuucauguuugaugucccagaagcaagggccuguuucuguugaguuugauuauagaagagaggacuccu

SEQ ID NO: 554 - RNA, 106 nt, Human
aggaggcggagcucgggugguaacgccagcgacggggaguggcuauaaauacagaugaagcuucgcuggcuugccggccccuaaccugcugugcaccccacuuccu

SEQ ID NO: 555 - RNA, 84 nt, Human
aggaggcggaggcagcuggggagguccugagcgaugugaccaggccgccaucgcucgucucuuccuacucuccugccgccuccu

SEQ ID NO: 556 - RNA, 73 nt, Human
aggaguaaaggcauaggccccucaugaccugcagggaccccagccacugccucugggcuuggcuugagcuccu

SEQ ID NO: 557 - RNA, 66 nt, Human
aggaucauucuuccucggcggauaacaagagcgcaguggcucuucccuggggauagagugcacccu

SEQ ID NO: 558 - RNA, 75 nt, Human
aggaugaaucauauauuagaaugugaauucuaucuguuagaacuaauggauuguugcuugauaguguaucauccu

SEQ ID NO: 559 - RNA, 74 nt, Human
aggauggaacaggaagguauguccugucaguaucuuaacccuuucaacaagacauuuaccuauuugucuuuccu

SEQ ID NO: 560 - RNA, 66 nt, Human
aggcaaaagagaaauccucagacacauucugaaggauccggacauggucugggacuucuggagccu

SEQ ID NO: 561 - RNA, 87 nt, Human
aggcaacaugcuguuguuaagggcacuugggccauugguguuuugugacagcugggcucaggcaucucaacaagcagcggugugccu

SEQ ID NO: 562 - RNA, 98 nt, Human
aggcaccuggggguguagaccgggguggagccgcaugggcaccuggggguguagaccgggguggaacuauguaaacaucccacacacucaggugacuu

SEQ ID NO: 563 - RNA, 97 nt, Human
aggcaggagaaugguguuaacccaggaggcggagcuugcagugagccgagaucgcgccacugcacuccagccugggagacacagccagacuccgucu

SEQ ID NO: 564 - RNA, 65 nt, Human
aggcagggcaccugggggaugcuggggccaucggcucucagauggcaacucccagggcccagucu

SEQ ID NO: 565 - RNA, 74 nt, Human
aggcagggguauccgugcguaauucagggaaggaggaaacagcuaugggguggggauuauguguggcccuggcu

SEQ ID NO: 566 - RNA, 66 nt, Human
aggccagaggaucacuugagcccaggaguuugagaccagccugggcaacauagugagacucugucu

SEQ ID NO: 567 - RNA, 108 nt, Human
aggccaugcaauccccccacggggcauucuagaucaguccgauguggacuucgacaaggagucucuaucauaugguuucaccauccucagguugggggagugcucccu

SEQ ID NO: 568 - RNA, 60 nt, Human
aggcccuauuggacaaauuugguggggagcauaauccaccaucaauauaucuggaggccu

SEQ ID NO: 569 - RNA, 63 nt, Human
aggccuaaggagcacuagcaacauuuggcuauauugguuugcuagucaccaacuucugggucu

SEQ ID NO: 570 - RNA, 63 nt, Human
aggccugggccgcuuccugcaagaaaacaagcagcuucugcacgacgcacuggcccaggaccu

SEQ ID NO: 571 - RNA, 85 nt, Human
aggcgccauuccuuccacauucggcuauggggaggaaagccaguaggacccauuugucgacaugguggaagggguuucacugucu

SEQ ID NO: 572 - RNA, 95 nt, Human
aggcgcuggugucaaacaguuaugugaugcuuugaagcacccucacuguagaugagagugucuugcacugcaaacauagccgaucacccgugccu

SEQ ID NO: 573 - RNA, 86 nt, Human
aggcggccuccaacgcgagcgaaagacgccagccgagucagcgcggacauacucgcucccgucccgcccgcgguccccagccgccu

SEQ ID NO: 574 - RNA, 87 nt, Human
aggcgugaacaguuauccagaagaacagcacccuccaccacuggucugggcuugagguucaucaucaauaaucuguacaccucgccu

SEQ ID NO: 575 - RNA, 130 nt, Human
aggcucacacagcaagucuuugucaaagcuuaggaauggaaguagguuguccccuccuagucaugggaucucuccaacucacuagacaaucuugcuuuacgugcugaugaacaugcucugugagcagccu

SEQ ID NO: 576 - RNA, 112 nt, Human
aggcucugagcagucaggguggaugggaaguggggggccauugccuucucggaguucaggacagaagguucuggccuccugucuuagccuuccugggcugugucuggagccu

SEQ ID NO: 577 - RNA, 64 nt, Human
aggcugagagacugcuccccauugcagauuagcguauagucagaugggcuacaguuuuucuccu

SEQ ID NO: 578 - RNA, 83 nt, Human
aggcugagguaggaugauugcuagcuagaguccaggaguucaggauuaaaaugagcuaugaucauaccacugcacuccagccu

SEQ ID NO: 579 - RNA, 79 nt, Human
aggcuggaaugcagugauacuaacauggcucgcagcagccuugaccuccugggcucaagcgacccuccugcuucagccu

SEQ ID NO: 580 - RNA, 84 nt, Human
aggcuggacugagcugcucucccacaggguuucugugcagcuggauuuucucuguugcauacaugccuggcaucugucuccccu

SEQ ID NO: 581 - RNA, 73 nt, Human
aggcuggaguaccguggcacgaucugggcccauugcaaccuuugcauccggguuuaaagcgauucuccugccu

SEQ ID NO: 582 - RNA, 79 nt, Human
aggcuggagugcaauggcaagaucucggcuuacuacagguuugaccuccugugcucaagcaauccucccaccucagccu

SEQ ID NO: 583 - RNA, 87 nt, Human
aggcuguaugcuguuaaugcuaaucgugauagggguuuuugccuccaacugacuccuacauauuagcauuaacaguguaugaugccu

SEQ ID NO: 584 - RNA, 109 nt, Human
aggcuuggcuuuguuacuuuugaugaccaugauccuguggauaaaaucguauugcagaaauaccauaccaucaaauggucauaaugcagaaguaagaaaggcuuugucu

SEQ ID NO: 585 - RNA, 62 nt, Human
agggaaaggacugcccugcuccuuuugaggaaggaaaccugcaaggcaaguucucaaucccu

SEQ ID NO: 586 - RNA, 81 nt, Human
agggaaauggccuucccgccggacgaaggcuuaucugccugacaggcugugacucuucucucaaccuugggcuucuucccu

SEQ ID NO: 587 - RNA, 88 nt, Human
agggaauagaucuguucugaguguccccaaaaaaguuguccuaggaacugauguggagaaguuacagggagacugauuuccauuccuu

SEQ ID NO: 588 - RNA, 71 nt, Human
agggagagguggaggcccugcuggaucgauacuucgaggcugauccuccagggcagguggcugccuccccu

SEQ ID NO: 589 - RNA, 67 nt, Human
agggaggcuggagguuguggugggucacaguguugcugacaccucuggccuccagcccugcaucccu

SEQ ID NO: 590 - RNA, 75 nt, Human
agggauuuuguuugcuccuucugccauuugaguacacagcuagaaauggcaucuaugaagcagacaguaggcccu

SEQ ID NO: 591 - RNA, 129 nt, Human
agggcaagauccucgcuccaaccguggcccguguucucuccuuuuguccccauagugugacuccgccaggaacuuggaauggcugaagacugugaaugagagucaugggucuguggaacgcucaucccu

SEQ ID NO: 592 - RNA, 83 nt, Human
agggcaggggagagcaagggguuuuggggucgaccuccugggggaggguagcccuggggccccgcugugcccucacucgcccu

SEQ ID NO: 593 - RNA, 71 nt, Human
agggcagugggugagggacaggaacccagggagggaccauucccauaacugccccacuaagucccugcccu

SEQ ID NO: 594 - RNA, 87 nt, Human
agggccaugcagcuggagacccaugggggagcugauguuguuuugagagccgugcagcuggagauccgggggugagcugauguuccu

SEQ ID NO: 595 - RNA, 65 nt, Human
agggccgggcgugcuggagccugggaaaugccuacguguccauggggcgcccagucgcaggcccu

SEQ ID NO: 596 - RNA, 74 nt, Human
agggcggccggggagcaccugguuuuauuuccgugcagugaggggauaucauccuggugcccucgucuugguuu

SEQ ID NO: 597 - RNA, 102 nt, Human
aggggagguucuugcaaauucccaaggaaaugucaaaaaggcaaaauggccagcauuauccauuugcuuuuuuggguuuacugggugaauagcacuuuccuu

SEQ ID NO: 598 - RNA, 99 nt, Human
agggggacaacacccugauccgcaucauggucucccggagugaguuggacaugcucgacauucgggagaucuuccggaccaaguaugagaagucccucu

SEQ ID NO: 599 - RNA, 74 nt, Human
agggggcacaccacaucaaaaugagggguguguugcuguugcgaaauuaaaaccaaucguuguguuuguccccu

SEQ ID NO: 600 - RNA, 60 nt, Human
agggggccgguggaccugcuccagcagcuggugcugcaccagcaggagguccugcccccu

SEQ ID NO: 601 - RNA, 68 nt, Human
aggguaaugaguaggugagagggucuggaggaagccucccuacugcuggagccucuacuuauuacccu

SEQ ID NO: 602 - RNA, 71 nt, Human
aggguccaguuuauguugcaugucaguuuccuauuucauuacuucaagcaugcagugguaugaaugauccu

SEQ ID NO: 603 - RNA, 64 nt, Human
agggucuuuccaacuguucuggucagugaggacccugacugcaaggaggaguucuggagacccu

SEQ ID NO: 604 - RNA, 98 nt, Human
agggugagauaauguucccacaguguaucauuagugugaugaguuuaucucuuuaaagccucacaaccugcugauaugcugugguuuuucuugguccu

SEQ ID NO: 605 - RNA, 89 nt, Human
aggguuuuaaacacuaaucacaaacuggaaugacuugacuucaaaaggcaacaaccuuaaagggccgucauuuccauuagguauucccu

SEQ ID NO: 606 - RNA, 75 nt, Human
agguaccucaccuaaguggaaucauacaguauuugucuuuuugugacuagcuuauuucacuuagcauuauguccu

SEQ ID NO: 607 - RNA, 88 nt, Human
agguauaauucagagacuguccuuugcaaaggaaaugaccagcauuucaacuguaugucuuccuggaaggguagauucugcuauaucu

SEQ ID NO: 608 - RNA, 65 nt, Human
aggucaccagugacagggaaaaaguccugaaauccaggaaaaucacuuagucccugcgggugccu

SEQ ID NO: 609 - RNA, 64 nt, Human
aggucagaaagaccuccugacuccauguuacaguagacaaaacaaguuggacucuuuuggaccu

SEQ ID NO: 610 - RNA, 86 nt, Human
aggucuccuuaccuucugcuucccuuucugccugugacugaaugggcaugucaaggucuaguaggggauccaggaggaggaagccu

SEQ ID NO: 611 - RNA, 108 nt, Human
aggucuggaguugguuauggguuuugacucugaggaugacauugaguuuuaauucagcuuguccugguucugcagucaaaaauuccauguuagccuggcucgagacuu

SEQ ID NO: 612 - RNA, 82 nt, Human
aggucugguucagguguccagagucucaaggggcuggggcccagcccagcucucuucggcugagacucccgccagaaccccu

SEQ ID NO: 613 - RNA, 85 nt, Human
aggugaaaucaaaauaaucuauacuaucuagaagacuuucuugaugcgcaguccagagaugucaugguguagaacuugaacaccu

SEQ ID NO: 614 - RNA, 69 nt, Human
agguggcagagaggcaauaucaauccuucugcaucacacagugggaaaaguuugucucauugcaguucu

SEQ ID NO: 615 - RNA, 84 nt, Human
agguggggaugaaagcugagaaagcgaagaggugguucaggggaucacucuuuccuacuuguuccucucaccucaaacucaccu

SEQ ID NO: 616 - RNA, 106 nt, Human
aggugggugaggaagacuaacaaaaguaaugugagccagugucuucaaaaggggggcugaaaccaguugcaaaaaaugucagucuauagccacucccaacccaccu

SEQ ID NO: 617 - RNA, 62 nt, Human
aggugucugucccuaaagaacugguggcacuuaugagugcuauucgugauggagaaacaccu

SEQ ID NO: 618 - RNA, 127 nt, Human
agguguuuguauuuccuagagaaucuguuacugaucauguaaacuugaucacaccgcuggagaagccucuacagaacuuuaccuuguguuuucgagccuauagugaucucucucgugccuacagccu

SEQ ID NO: 619 - RNA, 119 nt, Human
agguucuggugaauucaggaugguauuuuugucuuugaauaguuucugguugcauuucuauagugggggugaagcuaggggaacuucugugaucuuccugaggucacuucaaagugccu

SEQ ID NO: 620 - RNA, 73 nt, Human
agguugaagugaccagagauugcgccauugcacuccagccugggugacaagagcaaccggucuacaacaaucu

SEQ ID NO: 621 - RNA, 91 nt, Human
agguuggugucugugaaaagcugacagagaugugagaggucccacccugaggccaacaaagacucugcagcucuggcagaaccacuaagcu

SEQ ID NO: 622 - RNA, 85 nt, Human
agguuuugcucuguuacccaggauggaaugcaguggcgugaucauagcucacuguaaccuugaacuccugggcucaagcaauccu

SEQ ID NO: 623 - RNA, 108 nt, Human
aguaacugcaaagaugcuguccgugcgcguugcugcggccgugguccgcgcccuuccucggcgggccggacuggucuccagaaaugcuuggguucaucuuucauugcu

SEQ ID NO: 624 - RNA, 69 nt, Human
aguaaggauaggccccaaauguggacagauccucuuagucacaugagccucuuggggucuauuuucucu

SEQ ID NO: 625 - RNA, 66 nt, Human
aguaaugacuuccagaaguauuuuggcaaucccaucuucuauugagggaccaagaugucuauuacu

SEQ ID NO: 626 - RNA, 75 nt, Human
aguaauuuagggagcagcccuaaaauuguccaaaggguucuaagugguucuugggcugcaucucucuggauugcu

SEQ ID NO: 627 - RNA, 96 nt, Human
gggaccucaaugccuggaccaagagugccgaggccuuuggcaagauuguggcagagcguccuggcacuaacucaacaggcccugacccaugguccc

SEQ ID NO: 628 - RNA, 69 nt, Human
gggaccugguuagucuuggggcagagaguaucuacuugggcacucucuuccaagaaagaccuugucucc

SEQ ID NO: 629 - RNA, 75 nt, Human
gggacgguugggggcugggagcccugggcguguaguguaacuggaaucuuuugccucucccagccaccuccuccc

SEQ ID NO: 630 - RNA, 89 nt, Human
gggacucagcaaugucagcccguuccucggccuccuccagcucaugcugaggcuugcggaauuuagcuagauugguguuggauuguucc

SEQ ID NO: 631 - RNA, 89 nt, Human
gggacuuaacugagaggaucugaguagcagacacccuaagagcaugucauugucuucucaccaguuacucuccaguuggcuagaguccc

SEQ ID NO: 632 - RNA, 71 nt, Human
gggagaaaggcuuaaguccuuggggugggaggagaaaccccuccccggggauccugcagcucuagucuccc

SEQ ID NO: 633 - RNA, 70 nt, Human
gggagaagggggcgagccugcgggcggaagaggaagcaaggcccucuuccuccacgucucaccccagccc

SEQ ID NO: 634 - RNA, 93 nt, Human
gggagaaucgcuugaacccuuggagguggagguugcagugagccaagauugugccauugcacuccagccuggguaacagagcaagacucucuc

SEQ ID NO: 635 - RNA, 100 nt, Human
gggagacccaggacccgggagagagguagaggggagcagagacagccaccagcuucuaucuucugcucuaagcacauucuuucacgaguuuaaguuuccu

SEQ ID NO: 636 - RNA, 66 nt, Human
gggagaggggauucacaaggugaagaacuggaaccccagcuucccuccagccucuccuccauuccc

SEQ ID NO: 637 - RNA, 89 nt, Human
gggagcaggagacccucauuugccacccagaccaaugugagccugcccccagcccccucucauuggaaguggcaaggggcuucccuccu

SEQ ID NO: 638 - RNA, 107 nt, Human
gggagccagcaagcaggaugauaucgaagagcuggagaccaaggccgugggaaugucuaacgauggccgcuuucucaaguuugacaucgaaaucggcagaggcuccu

SEQ ID NO: 639 - RNA, 74 nt, Human
gggagccaggccagggcgaggggccggaggcuggggaugccgaggucugucccacgcccgcccgccuggccacc

SEQ ID NO: 640 - RNA, 84 nt, Human
gggagccuggcaggccuggcccagcggccagggugaguguucucagaccccgggcagcuggugguucuccagggccagguaccc

SEQ ID NO: 641 - RNA, 120 nt, Human
gggagcgggaucuaaggacuuacaugaaccucgaguucugacuuugguaaagucugacccuagucugcugcugaagucugaacuugggccucugaccuggggccuuugacuuccccuucc

SEQ ID NO: 642 - RNA, 119 nt, Human
gggagcucuuugcucaggcaccaguagaacaauauccugguauugcuguggagacggugacagauucuagccgcuacuauguaauccggauccaggaugguacugggcgcagugcuuuc

SEQ ID NO: 643 - RNA, 105 nt, Human
gggaggagagaaggaaccauagauucugagaaacacaccaggaugacuaggccuggaggaguccagggugggccucagacccucacuucuugucuggcaccuccc

SEQ ID NO: 644 - RNA, 90 nt, Human
gggaggaucgcuugagccuaggaggucaaggcugcagugagcugagaucacaccacugcacuccugccuaggugacaaagugagacuguc

SEQ ID NO: 645 - RNA, 63 nt, Human
gggaggccagggaagcccgacgugguggggcgcugccucccgcuccguggccuccuuccuccc

SEQ ID NO: 646 - RNA, 73 nt, Human
gggagggcaauuuuucaucuuccaauggcggccucaaccuugaggcgaauccacuggcgaaagaugccuuucu

SEQ ID NO: 647 - RNA, 76 nt, Human
gggaggggccugugucugagccagagccugggacccaggagguucucugccagcucaagcgagaccagcccagccc

SEQ ID NO: 648 - RNA, 94 nt, Human
gggaguauagggcugugacuaguauguugaguccuguaaguaggagagugauauuugaucaggaaacgugguuacuagcccagagaguucuccc

SEQ ID NO: 649 - RNA, 74 nt, Human
gggagucguuugaggcgcgacuuccugcgccugcucagcagccugaggcgcggcgagugcccuccugcccuccu

SEQ ID NO: 650 - RNA, 68 nt, Human
gggagugaaauuuuccucucuuccccugcacauuaggaaggguaucagagggguugguguacauuccc

SEQ ID NO: 651 - RNA, 109 nt, Human
gggauagcucauuuuugaaaucaguuuagaacauuuaaaaugugggaaauucaaauaaaaaugcaaauuuucacuguuuucuaaaaagucagaucaacauugcuggccc

SEQ ID NO: 652 - RNA, 76 nt, Human
gggaucaaaugguggcuguguaaaucucuggagucauuuuauuccaucagacucuucacaacuauuccuaucuccc

SEQ ID NO: 653 - RNA, 61 nt, Human
gggaucccuaaauguaucugugauauuuggcuuucuaaauaugauacucuggggaggaacc

SEQ ID NO: 654 - RNA, 88 nt, Human
gggaucgugagacacauacagaucgagaccgggaucgugguguuauugacuaugaccgggaucgauuugacagagcaacgccgacccc

SEQ ID NO: 655 - RNA, 73 nt, Human
gggaucuuguuccacugauuacucucucugacgaguccaucaccugcaacuuaaaugaacaagcuuacauccc

SEQ ID NO: 656 - RNA, 72 nt, Human
gggaugggccaaauuaaaggaauagguugggcuaguuaacugcagcaggagcauguccuuauggcacagauc

SEQ ID NO: 657 - RNA, 102 nt, Human
gggaugggccaguuugcugagaaugacacauuacuguugccccucuaacuugacccuggguuuccuguggguaagcagcuguuucagcaaaucccagauucc

SEQ ID NO: 658 - RNA, 68 nt, Human
gggauuacaggugugagccauaucuccuggccuccuuuuuucugagacauggucucacucugacaccc

SEQ ID NO: 659 - RNA, 85 nt, Human
gggcacacacguucagccacccaccuucaagcacaaagagaaagcugaauuugcaggaugggagggcucagggugugcguucccc

SEQ ID NO: 660 - RNA, 67 nt, Human
gggcacauuggugguauuuugguauguggccacuggcccuaaacaacugaccauuucuacccugccu

SEQ ID NO: 661 - RNA, 76 nt, Human
gggcacccugcagacggcauucccguucagcugcaucccaugugcgucgaugggcaaaguauuuguagcacugccc

SEQ ID NO: 662 - RNA, 64 nt, Human
gggcaccgcaacgggcaaacaugagccccgcuggcucauacaugugcuccugcaucaggugcuc

SEQ ID NO: 663 - RNA, 63 nt, Human
gggcaccgggccggcggccgggcccgggccgugaccggaggccgcccauuuggccccgcgccc

SEQ ID NO: 664 - RNA, 102 nt, Human
gggcagcaaaaacauccauuccgcugcgcaacaguugucauuuuucuaacaucugaaaacuccagaaggagauggugauaaaugugguaccggauucugccu

SEQ ID NO: 665 - RNA, 74 nt, Human
gggcagggggccccuggaauuagggcuucucccaaacgcgggacacgggcuguggggcccccgggcgguugccc

SEQ ID NO: 666 - RNA, 88 nt, Human
gggcaucuggaucaaguucaggcacagcccuggucuccugcuccucuggacuguggcguuugcagcugagaacuuggcccuggugucu

SEQ ID NO: 667 - RNA, 93 nt, Human
gggcaugaagggcuuuaagggacagcugagccggcagguggcagaucagauguggcaggcugggaaaagacaagccuccagggccuucagcuu

SEQ ID NO: 668 - RNA, 74 nt, Human
gggcauuuagugcuauaaauuucccucuaaacacugcuucagcugugucccagagauuuugguacguugugucu

SEQ ID NO: 669 - RNA, 76 nt, Human
gggccacucaggccaugugcaccccugggcagagccccuuaaagcugcugucacuagaugcccaugguccaggccu

SEQ ID NO: 670 - RNA, 77 nt, Human
gggccagcagacuaucuaggaagcaggaguagcaugacuuuaaagugauucucugugccaaucucugcaacugguuc

SEQ ID NO: 671 - RNA, 67 nt, Human
gggccagguccggacaagacagcacuccugaagcagaugggcaggaggugaucgaggagccuggccu

SEQ ID NO: 672 - RNA, 81 nt, Human
gggcccaugcucuuaguggggaaaacucuuggagccguuuacuuugagcuuugaacacugaaaccauuguuggcaggguuc

SEQ ID NO: 673 - RNA, 86 nt, Human
gggcccccaagcuggggcccgcgacucgaaggggacugggauggggaucucguuggacugcguggcuagcuugggcaugggggccu

SEQ ID NO: 674 - RNA, 65 nt, Human
gggccccucugcggauggagccccaggugcaacagggcccauggucaucuguggagggacagccc

SEQ ID NO: 675 - RNA, 67 nt, Human
gggcccugagauggggucugaccucaguuccugcggggaacuucaccagugaccccagucagugccc

SEQ ID NO: 676 - RNA, 69 nt, Human
gggccggagccggcggcagugguggcagcgguaucgccgcccuagcucaccgcgccccuuuuccagccc

SEQ ID NO: 677 - RNA, 69 nt, Human
gggccggcauccggggccaggcuagaaacagaaucuaaugccugguagagccccacacaugccaggccc

SEQ ID NO: 678 - RNA, 71 nt, Human
gggccggugugagggcagguacagccgggucugggcuaugugcagagguuccuccuuguccuugauggccu

SEQ ID NO: 679 - RNA, 87 nt, Human
gggccgucggggccaucucccucccggagucgcuggccagucagcucccucuugaacuccagggggaaggcccucgccgacucgucc

SEQ ID NO: 680 - RNA, 96 nt, Human
gggccuggacccacaccgcgggaggacucgggcgugaccagguugccgcagggguagguccgcgcugucuuccgcgccgucugcggucgagcgucc

SEQ ID NO: 681 - RNA, 76 nt, Human
gggccuuuauuugguuuuggcuuuagcugauaauguuuuagugaugucagcuagugcaguucucaaauggcugccu

SEQ ID NO: 682 - RNA, 72 nt, Human
gggcgcuggcggaugucuugcuggcuacagaggagcgccgugguacuagagcgcaaggcuccuccggcggcc

SEQ ID NO: 683 - RNA, 79 nt, Human
gggcggccuagacccccugcugcccaggccguugaggcaacacuggguuccuggcuugacagcugugggcuggcugccc

SEQ ID NO: 684 - RNA, 72 nt, Human
gggcggcugcacgaaggaugaacgguuuguggcagaggugaccugccuggacccccugaggcgcagccgccu

SEQ ID NO: 685 - RNA, 77 nt, Human
gggcgugagugcaggaagcacauuuggcuuggcaggagcugucaggaaggggaagcggguuuccugcgauucugccu

SEQ ID NO: 686 - RNA, 67 nt, Human
gggcguuuuuuuggggggggaaaagguaagggccggguaugucuggccccuuugcaggggagcgccc

SEQ ID NO: 687 - RNA, 61 nt, Human
gggcuaaaugaucuacagccuuggccuaaucaaauggcuauagcauguggaucucgagcuc

SEQ ID NO: 688 - RNA, 73 nt, Human
gggcucaagugaucugcccacccugccugagccucccaaagugcugggauuacaggugugagccacugugccc

SEQ ID NO: 689 - RNA, 79 nt, Human
gggcucagcccccuucccccacgucacgucugcaucacuacugugggugagccuggacggacgggggcuggggcugccc

SEQ ID NO: 690 - RNA, 74 nt, Human
gggcuccagguuacagguagauuuaaaauugacugguugacaauugguuaaguuuaucuaaagaucugggacuc

SEQ ID NO: 691 - RNA, 62 nt, Human
gggcucgggcucugggcucaccaccucaucgaucagagggaggcccaguucuguccgggccc

SEQ ID NO: 692 - RNA, 81 nt, Human
gggcucgggggcgcucagcggcgagugggcaagauuggggccuuuccuguccucgaagcugcacaaagguggccccagccc

SEQ ID NO: 693 - RNA, 65 nt, Human
gggcucuguauggacuuucggcgugugcaugcacacgccgaauaacaaacugccacgccgagccu

SEQ ID NO: 694 - RNA, 70 nt, Human
gggcugaucuggaggggccggccgacggcuacgguuacccccgcggccggcacauccucucgguguuccc

SEQ ID NO: 695 - RNA, 83 nt, Human
gggcugcaaagcgagaagagagccgguggaguguacuugucccugacaggcugaccuaccugagucucugagcuuuucagucc

SEQ ID NO: 696 - RNA, 82 nt, Human
gggcugcggcagggacucggccucugggagguuuaccucgcccccacuugugcccccagcucagccccccugcacgcagccc

SEQ ID NO: 697 - RNA, 77 nt, Human
gggcugcggcugcagaaguaccgccugcggaguaacugcaaagaugcuguccgugcgcguugcugcggccguggucc

SEQ ID NO: 698 - RNA, 82 nt, Human
gggcuggaggggccgaggcaccccgcaugcuccaagguccgagguccuggguggcaucagugguggcgccugggcucagcuc

SEQ ID NO: 699 - RNA, 97 nt, Human
gggcuggauccaaauaugugggguugggauucugugaccuacuuccaauuuuaauauugaccugagcucauauuuagcucuacauguuucccagcuc

SEQ ID NO: 700 - RNA, 64 nt, Human
gggcuggcgucuggguggggugggcgcgguugggcggcguccgcccauaguuccgcgcgugccc

SEQ ID NO: 701 - RNA, 77 nt, Human
gggcugguggaagccacgaugccaccuggcgugcagcugcacugccucuauggcacuggcguccccacaccagacuc

SEQ ID NO: 702 - RNA, 63 nt, Human
gggcuguuauggggauaagcuggugagguccccaaauauugaccaacuggcaucccacagccu

SEQ ID NO: 703 - RNA, 100 nt, Human
gggcuuccaguggggggagagccccugagaggugauuggcuaucucugacuggaugacugagcgaguugauuucacagcucuccuccccuacuggagccu

SEQ ID NO: 704 - RNA, 88 nt, Human
gggcuuccgguuagggccggggauaggcucaguccucuagaagagugagccucuguucuaaauccuccggccuucccuggucgugccc

SEQ ID NO: 705 - RNA, 109 nt, Human
gggcuuguuuaacuuccgaccaucaguacgcccaguuccacuggaaguucacauucaaggcuuuccaggucaacauuacuguccucguauggcuaguaugaacaagccu

SEQ ID NO: 706 - RNA, 76 nt, Human
ggggaaacugaggugcgggugcgcgggccuggggacggccgucccauggcuuccaucugagccaccucgggacccc

SEQ ID NO: 707 - RNA, 65 nt, Human
ggggaagcgagcaggcgaguccaggaggggccggggccgggguggggcucgccugcccucacucc

SEQ ID NO: 708 - RNA, 73 nt, Human
ggggaccuccuuccagcucuacgcgccucucauucagagaggugaggucaggaaaggggaaggacgaagcccc

SEQ ID NO: 709 - RNA, 69 nt, Human
ggggacuuaguuagguagauuaauaucuggagcuccucgagggaccaaaucuccaacuuuuuuuucccc

SEQ ID NO: 710 - RNA, 73 nt, Human
ggggaguggcuauaaauacagaugaagcuucgcuggcuugccggccccuaaccugcugugcaccccacuuccu

SEQ ID NO: 711 - RNA, 71 nt, Human
ggggauaggggcagucgaaagggcuuggguucaaaaaaagcccagcugcuuuuucuccugccgcugccucc

SEQ ID NO: 712 - RNA, 62 nt, Human
ggggaucaugaaacagcccaauuagcauuaagcugcauguuaaaauugugguaaugaugccu

SEQ ID NO: 713 - RNA, 91 nt, Human
ggggaugaaugaaggugcuggguugcaggguugaaaaagucucccgcuuuuccguuccuacagucccgguucugccuuuguguggugcccc

SEQ ID NO: 714 - RNA, 89 nt, Human
ggggaugaauucuucaaauaggagccgauggaucugugguccuuugggacucaucaaagccuugguuuagcauuugucaguuuaucuuc

SEQ ID NO: 715 - RNA, 91 nt, Human
ggggaugaauucuucaaauaggagccgauggaucugugguccuuugggacucaucaaagccuugguuuagcauuuugucaguuuuaucuuc

SEQ ID NO: 716 - RNA, 76 nt, Human
ggggaugccgugaagcugagagcaugcugggccgagaugucaucggugccgcaggagcuuagcuugcugcaucguc

SEQ ID NO: 717 - RNA, 75 nt, Human
ggggauggaaggcgauggccccugcgaggacgauggcccggcccgccucgccccggcggcaucccugccgucgcc

SEQ ID NO: 718 - RNA, 95 nt, Human
ggggcagaaaguguguaagugaaguauuuuucaaagaaugcaguuauuaucugauugcauuugaccuuuugaccuuuguuacauaauucuacccc

SEQ ID NO: 719 - RNA, 63 nt, Human
ggggcagggcugccugcugcagcuugccaggggucuuguuggcguuguacuuggucuugcccc

SEQ ID NO: 720 - RNA, 65 nt, Human
ggggccguuugaucuucccaaaauuuuccaggauaaggccaugaagagggacauauugauucccc

SEQ ID NO: 721 - RNA, 85 nt, Human
ggggccucuauccacgaguucugcaucaaccugcggcagcucuacggggacagccgcaaguuccugcugcuuggucugaggcccu

SEQ ID NO: 722 - RNA, 90 nt, Human
ggggccugggcuggcaucagccggccaaugagccacugcacaaugaggagcuggcauggagcagugccggguggcccagccuggugcccc

SEQ ID NO: 723 - RNA, 97 nt, Human
ggggccuugguaauauaggaaaccuucuugccaauauaggaauauguugacauauuagcuauagcaaaaggcuuauauuagcaccgaaugaggcucu

SEQ ID NO: 724 - RNA, 73 nt, Human
ggggcgcgcccugcggcccccggagaaaggccuuuucagaaccccucuccgguguggggcgcccgcgggcccc

SEQ ID NO: 725 - RNA, 74 nt, Human
ggggcggcugguggccugagcgggaggccaucaucaaccuggccacccagcccaagaggcccaugugcaucccc

SEQ ID NO: 726 - RNA, 76 nt, Human
ggggcgggcgggagggagggugccucagcgggggcugcugcgcugccugcaggccccugccccaccucccgacccc

SEQ ID NO: 727 - RNA, 75 nt, Human
ggggcucaagugagagcaaguggucccgggccccuucaccaggggcucaggugagagcagguguucccgggcccc

SEQ ID NO: 728 - RNA, 73 nt, Human
ggggcuccuccuuccccucaaaggcaucacugccccuucccaagggcaggccagcagggaacaagaggacccc

SEQ ID NO: 729 - RNA, 82 nt, Human
ggggcuucugagcugugggucaggaaacagcucuaacgaagauauuuauuggguguuuacucugccccauuccuuaagcucc

SEQ ID NO: 730 - RNA, 75 nt, Human
ggggcuugcacugccuucucaggccagcuauacccuagcugagcaaagaacugaagaagcaaguguccacucccc

SEQ ID NO: 731 - RNA, 87 nt, Human
gggggacagagcgagacuccaucuuuucugggagacuccauugggagacugucuuuuuugggagacggagucgugccuuaguuuccc

SEQ ID NO: 732 - RNA, 88 nt, Human
gggggaggcacagcaggugugaaggcgacaggaccacguggcacggggccccuggccuaaaguccuggcgccgccacaccugcccccc

SEQ ID NO: 733 - RNA, 82 nt, Human
gggggcacggaugcggaugagggcgaguggccuggcagguaagccugcaugcucugggccaggccacaucugcggugcuucc

SEQ ID NO: 734 - RNA, 92 nt, Human
gggggccacagcagaguaaagacagagucugccaugcaggagugcuucgcaggucaggcacugcucugagugcuuuguguuaaccugccccc

SEQ ID NO: 735 - RNA, 85 nt, Human
gggggcgagaagggggccucaaaacggaguggggcgcuauuuuuggugggccaccaaccacaguguggggcuuucucucuccccu

SEQ ID NO: 736 - RNA, 81 nt, Human
gggggcggcgcacugauuccgggccccagagaacugccuaucaguggcaggggggucaaauccuucacugcugccgcuccc

SEQ ID NO: 737 - RNA, 65 nt, Human
gggggcucuaagcgccuaugagcaggccuuccugggggccgugcagagggcccgcuggggccccc

SEQ ID NO: 738 - RNA, 67 nt, Human
ggggggcaccaaugacaagggaauugggauggggaugacagucccuauuuccuuugcuguguucccc

SEQ ID NO: 739 - RNA, 77 nt, Human
gggggggacuuuggcgacccgggucagccggccgcccccugggcugcuggugggcgucgggcggcggcuccuccccc

SEQ ID NO: 740 - RNA, 66 nt, Human
ggggggugguugcuccccggccgcaggccgcgcccuggucuggccucuggggugaagcugccucuu

SEQ ID NO: 741 - RNA, 67 nt, Human
gggggugcggggcuggccguggcucugcauucggcugugagugccagugaccuggagcugcaccccc

SEQ ID NO: 742 - RNA, 63 nt, Human
ggggguuggaggguggagggguggcauuaggguaugugagccgcuccccaugcuucaccuccc

SEQ ID NO: 743 - RNA, 84 nt, Human
gggguaccaacgaguccuggccuugucuguggaggcggauuacaccuucccauugcugaaaaggucgaggccucuuggugaucc

SEQ ID NO: 744 - RNA, 80 nt, Human
gggguagacaugcacguugucaggggaagagauggcugugaauauucucuuggacugaccccgacaggcauauuaaucuu

SEQ ID NO: 745 - RNA, 78 nt, Human
ggggucaaguacauucccagucguggccucuggacaaguggcgggcccugacucaugaggguuccaaugugcugcccc

SEQ ID NO: 746 - RNA, 82 nt, Human
auagguauuacuguaucucagggaggugucugcaguauuauuaguauuuaaggaaaucauacuugcuguugacaguaccugu

SEQ ID NO: 747 - RNA, 79 nt, Human
auaguaagaagguuggcccugaugcugggcuuuuucuaauagcauagacuugaucacaucauuaaccucucuuaccugu

SEQ ID NO: 748 - RNA, 85 nt, Human
auaguauccagucacagugaauuugaaagcuggaauaguuugucucuuacaauggguucucuguucacugucagcuuaucauuau

SEQ ID NO: 749 - RNA, 97 nt, Human
auauaaaccugguugcuagcauucugugaaaucagugaagagacuggaguucucucagugcacacacugauuuuucacuuagucccuagguuucugu

SEQ ID NO: 750 - RNA, 88 nt, Human
auauaugcauuggugaauauauauguauacacauacuuacauacuuauauggguaucuguauagauaaucuguauuagaguauuauau

SEQ ID NO: 751 - RNA, 115 nt, Human
auauauguauacuagacuacuugauauuguuuaaaggccauggaggcgguuccuuuuuucucccuggucuuuuuuccucucugugcuucaguguggguaguuucuguugcugugu

SEQ ID NO: 752 - RNA, 64 nt, Human
auaucagauuugaauuacagcugaguuacccacuugggagucaguuuuagauuggagcugguau

SEQ ID NO: 753 - RNA, 107 nt, Human
auaugcugaguugggacaggagcuaaggauagaggugaggaaacccgcagacaacagcgacaugcuccucaucuuugagucccagcgaaccuuuccacugugugugu

SEQ ID NO: 754 - RNA, 97 nt, Human
auauguaugugugugcauguaugugugcauguguuuauaugugcauaugaaugugugcauugagcguguguguaugugcguguaugugcaugugugu

SEQ ID NO: 755 - RNA, 131 nt, Human
aucaacacaauaauugaaauauuuucaagcugauuacaccgcagcccgaggcuagccugguugcuaagggugagcuccgcgguugcuagggggaguaaaucaucuugcauuauuugauuuuuguuauagau

SEQ ID NO: 756 - RNA, 60 nt, Human
aucagcucuugaugccuuucuuuuaaauuaauuauagacagagagaggcauuuagcugau

SEQ ID NO: 757 - RNA, 80 nt, Human
aucauagguuccaguaaugggcaguuuggguaaauguaagcuggcaaaccuucugucuuaauucuccagaaacuugugau

SEQ ID NO: 758 - RNA, 61 nt, Human
aucaucuguaccauuggcccaugcuucccugaucaguggagacuguugaaugugagaugau

SEQ ID NO: 759 - RNA, 80 nt, Human
aucaugagggagguuguguaggaaagaaucaucaagggacuuaguugggagcuucucuaccacagcuuacuccuuauggu

SEQ ID NO: 760 - RNA, 68 nt, Human
auccaacucacaccucgcacuccugccacucacaggugagacggagcauggggagggguguggugggu

SEQ ID NO: 761 - RNA, 66 nt, Human
auccacaguugguugaauuuguggauguggaacccauggauacagagggccaacuguauuuaggau

SEQ ID NO: 762 - RNA, 71 nt, Human
auccccguucccgauuccuguaguagcggcuguauugcagccgccugccgaacugacccgggucuguggau

SEQ ID NO: 763 - RNA, 80 nt, Human
aucccuugcauuuccauaugaauuuuaacaucagcuuaauaaauuucugagaaaaagccaguuggaauuuugauagggau

SEQ ID NO: 764 - RNA, 88 nt, Human
auccgccucacagacaguugcguccagaggcuuuuggaaaucaccgaagggucagaauuccucaggcugcaaguggagggagguggau

SEQ ID NO: 765 - RNA, 71 nt, Human
auccuauagauacagcccugguaugaggccuuauaaugccagcuauaugcacaugcccuguauaaugggau

SEQ ID NO: 766 - RNA, 75 nt, Human
auccugggaaggacccuacccagucauuuuaucuaccccaaccaugguuaaaguggcuggaguggagucuuggau

SEQ ID NO: 767 - RNA, 84 nt, Human
auccuuaaacacugugcugaagacuacugugacucuguccuuuuuagacucaacauacauggucucaucaucccuauaauggau

SEQ ID NO: 768 - RNA, 61 nt, Human
aucggucaaacgggucauacgcaaguguugacacauauuguguacacucccuaggacugau

SEQ ID NO: 769 - RNA, 78 nt, Human
aucgucugagcccaggaguuugaggcugcagugagcuacaaucacaccccugcacucaagccuggguuacagagugau

SEQ ID NO: 770 - RNA, 79 nt, Human
aucucaggacucuggauaccuuuauuuuugcuucagguggcuuuuaaucagauucaaaagggaauuuaguuuucuagau

SEQ ID NO: 771 - RNA, 89 nt, Human
aucucguggguggcuguggcuugacuagguguagaacacgggaacguauuguacaaaaggagggaggaacgaaccauugaucucgaggu

SEQ ID NO: 772 - RNA, 65 nt, Human
aucuguaacuuaaauugggccaaucagaaugguuaucuuuguucaggucacaugaguugcaagau

SEQ ID NO: 773 - RNA, 60 nt, Human
aucugucaggagcaaggacuacuuuggcauuaaccaucacuguuugauuucuugacaggu

SEQ ID NO: 774 - RNA, 76 nt, Human
aucugucuuuccaagccuuccccgggaucagaguuuuuaaggauaauuugguggggagaggcuugggaaguggggu

SEQ ID NO: 775 - RNA, 75 nt, Human
aucuucauggugcugggcgccagggcgguggaucuccuucugcauccugucagcaaugcccggauacaugguggu

SEQ ID NO: 776 - RNA, 66 nt, Human
aucuucucagaaaaccaaaccaaaggcagccaugaaaacccguguucuguacgugguugagaaggu

SEQ ID NO: 777 - RNA, 66 nt, Human
aucuuggaagggaccuguucuccugccagagcagcugugagguuauggaggaagaaccccuuggau

SEQ ID NO: 778 - RNA, 87 nt, Human
aucuuguacauuuuccccacacuuggaaucagccauuccuccagggagugcagguucacaggcugggcucuaagagaauuauaaggu

SEQ ID NO: 779 - RNA, 64 nt, Human
aucuugucccuccuuuccugauugcucuuggcugaguaucuauggugguaggagaguacaggau

SEQ ID NO: 780 - RNA, 131 nt, Human
aucuuucaugccaguacuguaaauguguuaaguuaucagagaaauccuuuuguggccucuuuagugucuuuagguuccuucucucuuucuucucgaauagcagcauucaugacaguuuggcacgaauuggu

SEQ ID NO: 781 - RNA, 75 nt, Human
augaaucagucacuugcacaauuaauccucuuggcaucauacaaacuggguuuuaauggcaaaugaugacaucau

SEQ ID NO: 782 - RNA, 96 nt, Human
augacugugcugcaggaggcggcucagugugaagaacuacggguuuccugauguugaagcucagaauuagccacacugaccuucucagucaugcau

SEQ ID NO: 783 - RNA, 65 nt, Human
augagauuugggaggggccaggggcagaaugauaugguuugacuguguccucacccaaaucucau

SEQ ID NO: 784 - RNA, 63 nt, Human
augagggcagcaccugccucugaaugggaaaucaugcaacuacucagaauguguccuccucau

SEQ ID NO: 785 - RNA, 73 nt, Human
augaguaguagcccuuuugaaaaugauagaccaaccuuauuucucugacagccaacaggguuaugauacuuau

SEQ ID NO: 786 - RNA, 77 nt, Human
augauaaucuaccucacuuucccuguggcuauguucuggguuuccaaucaggccgagugguuugaggacgaugucau

SEQ ID NO: 787 - RNA, 91 nt, Human
augaugccaggacugcagcuucagggacuuguggcagaugcacagggugccucuggcucccuggagcuccacacugcagucccagcucugu

SEQ ID NO: 788 - RNA, 98 nt, Human
augauuucauuaugaaaugguaaaaaguauaugugcaauacuucugagcuacaaagaacacuuguauuuucuccuuugcauuuauaacugaaguucau

SEQ ID NO: 789 - RNA, 75 nt, Human
augcaaacacugauuaacucaaauaucuuguaaguucauucauacauggccuuauuugaggcaguguauuuguau

SEQ ID NO: 790 - RNA, 96 nt, Human
augcacaucaccaccuacuugaguguugaggauucaauuaguuaauguacuucaaauaaucauguaguaaaugcucaguagugugugugugugugu

SEQ ID NO: 791 - RNA, 62 nt, Human
augcagugucccaaauuucugucuacaagcauguguguggcagaaaacuggagaccaggcau

SEQ ID NO: 792 - RNA, 79 nt, Human
augcauccaagagaucaaggucgagcucuauuguuccaguauucucgggauccagcugcuuagauaucuugaauagcgu

SEQ ID NO: 793 - RNA, 131 nt, Human
augcccuuucugacuguguucucuguguuucaguccugucgugcaugucuaagcccugugccuugccuugggaauaagggacaaugacugagguuacgugguuuuggauuguaagguagaggaccuuuuau

SEQ ID NO: 794 - RNA, 82 nt, Human
augcgugacgccaucccgcagcucauccagcuggaccaggcgaagccccuggccgcugugcugaaggaggugugcgacgcgu

SEQ ID NO: 795 - RNA, 83 nt, Human
augcugauacguuaagcuaugcaucacuuucaguuucauucaaucucaaaguacuguaaucccagcguugcguuaccaagugu

SEQ ID NO: 796 - RNA, 74 nt, Human
augcuguauaucuuaugauuucuuaaggagaugacucauaccaaagggaaucauccaagacaugccaaaagcau

SEQ ID NO: 797 - RNA, 76 nt, Human
augcuuacaaagccaaauaaucgcagggcaaggcagauaaaggcaggcaggauagugacaguggcucggugagcau

SEQ ID NO: 798 - RNA, 79 nt, Human
auggaaaacuuuugaggaggggcuagcuaaauaagggguccagguaaugguggcccuugcaaccuuaagaccuagaaau

SEQ ID NO: 799 - RNA, 86 nt, Human
auggcaggaugacggauggcaacgaagcagcuggagaaggacuucagccugcaucgaagaaguacugccaaggucauccgugucau

SEQ ID NO: 800 - RNA, 82 nt, Human
auggccgaggagaagcgcgagggcuacgagcgucuccugaagaugcaaaaccagcguggcggcgcgcucucuuccaggacau

SEQ ID NO: 801 - RNA, 74 nt, Human
auggcggcaggcaaccaaugaggcaguuuagaccauucgguugcgcuuuuggauuggggagucugugaugccau

SEQ ID NO: 802 - RNA, 71 nt, Human
auggcugauggcaacgaggaucugcgggcugacgacuugccugggccagccuucgagagcuaugaguccau

SEQ ID NO: 803 - RNA, 69 nt, Human
auggcugucuuuuggaggucauuuuuuugagccuaucucgggucucuaagggcaaacuccagcagccau

SEQ ID NO: 804 - RNA, 94 nt, Human
augggaagaauuacuguggccuaccaggugaauauuggcuuggaaaugauaaaauuagccagcuuaccaggaugggacccacagaacuuuugau

SEQ ID NO: 805 - RNA, 60 nt, Human
augggaauggccuacaauuacaauaaacaauuaauucaguuauuuuaggggccuuaccau

SEQ ID NO: 806 - RNA, 90 nt, Human
augggcuucgacggggcuuaauagcccuugccccacugaaugcugcuacgcgcagaaucccgggcuugggagcccccaaaaauggcccau

SEQ ID NO: 807 - RNA, 66 nt, Human
auggguguuacuucuuugauaguucuuacuaccuugugggggaacuaccaaaggaaguugucucgu

SEQ ID NO: 808 - RNA, 79 nt, Human
auggguuccucacccccucccuccagaacagcuugagacagucuccaagcugagcuggaugggcuaccuuagaacccgu

SEQ ID NO: 809 - RNA, 74 nt, Human
auggucaacggcgcuacagaacaaagggcgagcucuaaagaguccagcucauccucuucccgaccucugaucgu

SEQ ID NO: 810 - RNA, 73 nt, Human
auggugaaaguagauauguuuguagcaaaauagguaugcugugguugacuagagacauuuuaagguuuauuau

SEQ ID NO: 811 - RNA, 63 nt, Human
auggugacaacaugcuggagccaagugcuaacaugccuuggucaagggauggaaagucaccgu

SEQ ID NO: 812 - RNA, 65 nt, Human
auggugacaacaugcuggagccaagugcuaacaugccuugguuccacgggauggaaagucaccgu

SEQ ID NO: 813 - RNA, 63 nt, Human
auggugacaacaugcuggagccaagugcuacauggcuugguucacaggauggcaaguccccgu

SEQ ID NO: 814 - RNA, 76 nt, Human
auggugcuauaauaaauaaacuucaacacucuuuaugauaacaacacuguguuauauucuuugaauccuagcccau

SEQ ID NO: 815 - RNA, 99 nt, Human
augguugucacuuucagauucuagcuugcuuggacuuucaguggcaacaaauggagccacugacaguacagguggcuucaucuugacuggugaccucau

SEQ ID NO: 816 - RNA, 82 nt, Human
auguagccagagcaauggugauguucuuauugcucccugaauucaggucuauugcauggacaucaggauuccucugggacau

SEQ ID NO: 817 - RNA, 90 nt, Human
auguauaaauguaaggaguauauauuuugaauacuaugaucaccccagaaugaucauucaauaagaauguaucuaauaucauuuguacau

SEQ ID NO: 818 - RNA, 78 nt, Human
auguccaaagacucaacaguuagacuacuuuucuuccacucauuuuaaagaaaaaugucuaugaaguguuuuggauau

SEQ ID NO: 819 - RNA, 67 nt, Human
augucuuuaauuccucauaugcugacuuggcaauccauaugcagccuaaaaggugguugaaagaugu

SEQ ID NO: 820 - RNA, 60 nt, Human
augugcagaggagaagaucccaccgagcacacugguugagauccaucugacugcugccau

SEQ ID NO: 821 - RNA, 85 nt, Human
auguggaauuuucagaaaaagauugucugcucugguuaaacuuccuucuggagaggauuacaauuugaaacuggaacuucuucau

SEQ ID NO: 822 - RNA, 71 nt, Human
augugguccaaccugggcauuggccuagcuaucucccugucugugguuggggcagccuggggcaucuauau

SEQ ID NO: 823 - RNA, 77 nt, Human
auguguguguguguauauacacacacauauauaaauuagaauuugcagauauuauguguauauauauacacacauau

SEQ ID NO: 824 - RNA, 130 nt, Human
auguuacaaacuagauuauucuuugcuuuagauauccaaccauucagacuccuagcugagucuuacaaguuucuagcucaggagggaguuguuggguggcaggggguggcucugugguugcugguuaugu

SEQ ID NO: 825 - RNA, 79 nt, Human
auguuaugaaaaagcaauagugugguccuggcuaugacaauccuauaaaagccagagaacacugugauuaagggaacau

SEQ ID NO: 826 - RNA, 101 nt, Human
auguuggcuaucaguucuugcuauucucagagcacucuaucauguuuuuagguguauauuguguauucaggauagcauuaaaaagaacugauggcaaaugu

SEQ ID NO: 827 - RNA, 79 nt, Human
auguuuugaagcaggccauugagcugaguccugauaaccaauacgucaagguucucuugggccugaaacugcagaagau

SEQ ID NO: 828 - RNA, 74 nt, Human
auuaggcugaaacauaugaaauugcugcauuguaguuuaaaaacugucagcaguuucauaugguuccaccuaau

SEQ ID NO: 829 - RNA, 82 nt, Human
auuaucugccaguuaagauuauucuuaaaacucuggaugccauggcuuuuaauaaguuuaauguucuucacuggcacauagu

SEQ ID NO: 830 - RNA, 77 nt, Human
auuauguauuuauuauuggcgauuauaaaguuuguuuucacagggcguaguaguuagcaacaaugaaaaugaauaau

SEQ ID NO: 831 - RNA, 86 nt, Human
auuaugugcuguaguauguauauaguauuuuuagugaaaauauucauauaaaauauuacuuaaaucauuucuacauugcacaaaau

SEQ ID NO: 832 - RNA, 89 nt, Human
auucaaggaacuuuguggcugagaacuuacaaggguucuuagugaagguguucaagcaggaaccugaggaaucagacccaaaggagagu

SEQ ID NO: 833 - RNA, 77 nt, Human
ggggucaccaccugccugcgcuucccaggcccaggcucaauugcugaccugcggaagcuggcugugaacaugguccc

SEQ ID NO: 834 - RNA, 85 nt, Human
ggggugaaaauuaaauucuaguuacagauucaugaaacuugaagccaaauuaguuuuaugagacuaucaacuccccuuucauccu

SEQ ID NO: 835 - RNA, 78 nt, Human
ggggugagggccgugccaaucccauccccacuguccucaagagggaccaggaaggacuaggcuacagaucagcacccc

SEQ ID NO: 836 - RNA, 69 nt, Human
gggguggagcaggugggcgacaugaucgaucgccuuuucgacaccucugccugagccugcugcuagccc

SEQ ID NO: 837 - RNA, 96 nt, Human
ggggugggaagaggcgggacauggcugugucuuggagucacccucuccccucgugccccagguuugcuuccucugucccugucucucucccgcccc

SEQ ID NO: 838 - RNA, 77 nt, Human
gggguguugggcuggggauuguggcuguagaggauggugagguuucucuggggcuagggccucagugcucucagccu

SEQ ID NO: 839 - RNA, 83 nt, Human
gggguugccgcucugggaacccgaccguuuggagccagggucugucccccggaggucccggaaagggcggggcggccaacccc

SEQ ID NO: 840 - RNA, 71 nt, Human
gggguugggcaaugguggugaauaaagaauuguucuaaucuacuucucuuauucucccuguucccagcccu

SEQ ID NO: 841 - RNA, 83 nt, Human
gggguuuggguccuggucacguggaacugggcaaugaagggagcucgugugcagaccucgugcagccggggccuccaggcccc

SEQ ID NO: 842 - RNA, 93 nt, Human
gggguuuuuuucucugagaaaagggggguucuauugugugguggaaagccaagaagugguuggugcucgccugaucuuaguacucaaaacucu

SEQ ID NO: 843 - RNA, 66 nt, Human
ggguaaugaguaggugagagggucuggaggaagccucccuacugcuggagccucuacuuauuaccc

SEQ ID NO: 844 - RNA, 104 nt, Human
ggguaguuaccugggaugucauccuucaaugcugcauuauuggcuuuguuucugccuguggaaaggcaaguggguggugacucccaaaucauggccacuugccc

SEQ ID NO: 845 - RNA, 104 nt, Human
gggucagcaggaaguugcggcugaugagcagcucccggagcgguggggcggggccuccucuucuccaguuccaguacgcucaucagucguccuccugcugauuu

SEQ ID NO: 846 - RNA, 82 nt, Human
ggguccacucuccugccugcugggaccuauggaaggggcuuccuggccaaggcccccucuuccagaggaggagcagggaucu

SEQ ID NO: 847 - RNA, 77 nt, Human
gggucccgguugcagacuugccauggccuccgaagcuucugugcgucuaggggugcccccuggccgucuguggaucc

SEQ ID NO: 848 - RNA, 77 nt, Human
gggucccugaucuggaagguggauuuccccuaucaggacaagcuggucggauacaucaccaacuacagcaggcgcuu

SEQ ID NO: 849 - RNA, 74 nt, Human
ggguccggugcggcuccggaaguagucgugcccuuugcuggggcauucagagacagaguuucaccgugguaccc

SEQ ID NO: 850 - RNA, 78 nt, Human
ggguccuaggagaaaaaguccuacuuuucuggguccccaggugcaagcaccucccggagacuguuucucccauggccu

SEQ ID NO: 851 - RNA, 85 nt, Human
ggguccuggcgggcgggucgagucuccccaaggcggccaucccaagcagcuccccggaugucccucagacccgcgcgcuaggcuc

SEQ ID NO: 852 - RNA, 75 nt, Human
gggucuacgugugugauccuuaucguaagaacaauucacaguaucacauuuucacagaugaggacacugaggccc

SEQ ID NO: 853 - RNA, 112 nt, Human
gggucucagauagaggugaaauucuaaccuacucagagugauuucuuuuagguucccagaccugggauccacauuuuuugcucuacugagguaggaaggugucacuagaucc

SEQ ID NO: 854 - RNA, 88 nt, Human
gggucucauucaguugcccagguuggagugcagugaugccaucuuggcucacugcaaccuacagcucaugggcucaaaugauccuccc

SEQ ID NO: 855 - RNA, 79 nt, Human
gggucucuuuuuuucaucuagguaaaccggagcaaauaaaaccuauugaagaguucuccugaugauugaaugaguuccc

SEQ ID NO: 856 - RNA, 63 nt, Human
gggucugugucacagugaccucccagagccccaagcucgggccucccacuuaaacacaggccc

SEQ ID NO: 857 - RNA, 88 nt, Human
gggucuugcucugucacccaggcuggagugcagugguguaaucuuggcucacugcaaccuccaccucccagggucaagcgaucuuccc

SEQ ID NO: 858 - RNA, 75 nt, Human
gggugaaaguguuuagcucaaguaugcagcuugucggccaaguggauaccuuugggcugagccucuacuuucccu

SEQ ID NO: 859 - RNA, 74 nt, Human
gggugacucgcguaccgugcggcuugcugacaggagcugcggcgggcccugggccgcaugguggagcggaaccu

SEQ ID NO: 860 - RNA, 115 nt, Human
gggugcauggacuaggacccuggaggcagaaauaguuaccgaggggaaguuacaggccugagugugagucccuguuugguugcugaugagcuuugagguccuuggccagacacuc

SEQ ID NO: 861 - RNA, 72 nt, Human
gggugccccucgaggacugcucugagaucaacugcaugauccgggugaagaagcaggucugggugggcagcc

SEQ ID NO: 862 - RNA, 67 nt, Human
gggugcccgccgaccugggcgccgaggccggcuugcagcagcugcucggcgcccugcgcgagcuccc

SEQ ID NO: 863 - RNA, 77 nt, Human
gggugcggaggcagcaaauguuacagguccuggugguguuccaguucaaggcaguaaauaugcagcagaccguaacc

SEQ ID NO: 864 - RNA, 60 nt, Human
gggugcuggaaucacuuuugccaaaggcaucauauccuugggcgaauuuuuccggaaucc

SEQ ID NO: 865 - RNA, 64 nt, Human
gggugcuggugcugagcuggguccaaaagucugcacagaagggagccccgcugggcccagaccu

SEQ ID NO: 866 - RNA, 99 nt, Human
ggguggaaggugaaggagcaagguaaagagagacucccgugacaaucagcaauacgccuuuaaguucauugggcuuugcuuaucuuuacuaagccaucu

SEQ ID NO: 867 - RNA, 70 nt, Human
ggguggcauggggagcagcuagaacagugcagauucauccauaaucccuuucugcuguucaccaccaccc

SEQ ID NO: 868 - RNA, 71 nt, Human
ggguggcgggugucuggcuggaaucuccccuggguacauggagggugccagccggcuggaccugcagaccc

SEQ ID NO: 869 - RNA, 71 nt, Human
ggguguaagcaauaagugaaguuacauuggcccuaacccuagggaugauucuuuacccaguuuuaaagccc

SEQ ID NO: 870 - RNA, 85 nt, Human
ggguguaauugggccuccugcugccucucagcuuggcuucaucuguaaaauggggacaguaggccaggggccugugguuacaccc

SEQ ID NO: 871 - RNA, 76 nt, Human
gggugugggaugcuucgccaggucaugugcuauauugucucauuuuuguaguacuuuuacacguuguaugacaccc

SEQ ID NO: 872 - RNA, 94 nt, Human
ggguucuuuugucuuuaaaucaauaaguaaucuaggacuagcauuauguuugcuagaccuggcauuugcucgggacauaagguucaaaguuucc

SEQ ID NO: 873 - RNA, 65 nt, Human
ggguucuuuuuccgcuuucugagcccuuuuauaccuuacguuuagaaggggaaaaucauccuccc

SEQ ID NO: 874 - RNA, 91 nt, Human
ggguugaccagaaaauguagaaugcaucagaagcauguccaugauaaggccaaucaggaugcucaugcagaagcucagugcuggcagaccc

SEQ ID NO: 875 - RNA, 112 nt, Human
ggguugcugaucagacugcgagcagcaggggggcugccacuggcagagcuggaagcauguagaucagagauggcagcagcagcugcaggcgcucggggcuguccagcagccu

SEQ ID NO: 876 - RNA, 93 nt, Human
ggguugugucuccaguccucucuggaggguauguucugggcggaggggccaucugcauggaacuucucaccaaacagggcuggagcagugccu

SEQ ID NO: 877 - RNA, 74 nt, Human
ggguuucgccauguugccucggcuggucuaggcuggucuggaccuaggcuggucucaacauggacucugaacuc

SEQ ID NO: 878 - RNA, 66 nt, Human
ggguuucugcgggugaaccaguuaaggguuuucuucugcuuuuacuucucgccuaugcucaagccu

SEQ ID NO: 879 - RNA, 75 nt, Human
ggguuugagcccacaggaccugcacacaaacuuccccaccucuuggacuuggggacaggaucugugccucaaccc

SEQ ID NO: 880 - RNA, 60 nt, Human
gguaaaguggcaacggccaauuuggguaucuggucucccaaaaguacuugccgcucuacc

SEQ ID NO: 881 - RNA, 79 nt, Human
gguaauaauuaggacagcugacauacuuguugcuaauuuugagaucugggcaacaacuguguaggcuguucuuucaacc

SEQ ID NO: 882 - RNA, 62 nt, Human
gguacaagaaucgggcuugucgggggaggguuaccucccugugaaaggcaggcucgggugcc

SEQ ID NO: 883 - RNA, 77 nt, Human
gguacaucugcauaaacaauauggcacaucuacuuauuaaccaaguuuccugugcuuucacauuguuuuuugcuacc

SEQ ID NO: 884 - RNA, 107 nt, Human
gguaccuuauuauugaaaaucagauaaacuuugguuggguggguauuuggaggaaucuuuuaagucuuuucuuaagcaaaguuuggacauucuaaaauaagguugcc

SEQ ID NO: 885 - RNA, 80 nt, Human
gguacuacggucuauuucucaaccuuaggcaguaauagacaucacaaacugccaugguuuugcacuaugauuauaauacc

SEQ ID NO: 886 - RNA, 71 nt, Human
gguacuucuacucacagcggcgauuccgaggccaacuccagcaauggcuuugcaaaucugcggaaagugcu

SEQ ID NO: 887 - RNA, 74 nt, Human
gguagagacgggguuucaccauguuggucaggauagucucaaucucuugaccuugugauccaccugccucagcc

SEQ ID NO: 888 - RNA, 86 nt, Human
gguagaguacaaaguggaggaauuacugucuagaaagcaccauuuccagcacucagcacgagguggucuuucccuccacaccugcc

SEQ ID NO: 889 - RNA, 77 nt, Human
gguagcaacccaagaaaguggguuuggacauucaaauacuugaguuuaaguccagaugugcaaacuugggcaaagcc

SEQ ID NO: 890 - RNA, 71 nt, Human
gguagcaugaugcuuccagcuuuauucuuuuugcuuaggauuaucuuggcuguauaggcucauuagguucc

SEQ ID NO: 891 - RNA, 68 nt, Human
gguagccagggaaccggcugugagggucugggaggugcuaaaccaaacggccauggaagcuggcugcc

SEQ ID NO: 892 - RNA, 75 nt, Human
gguagggagugaaaggcccggccaccuaaaggcacagcuggugccugggucaagcugaggcggcaucucucugcc

SEQ ID NO: 893 - RNA, 114 nt, Human
gguaguggugauucaaagcaagaugguagcauuggagaggaugagauauggucagaugaggauauauuuuaaaaguugagcuaacaggauuugcugaggaaucagaagugaacc

SEQ ID NO: 894 - RNA, 69 nt, Human
gguauacuuacuagcauauuauauagcucuaagaguguagaguuauaugaugugcuagugaaguguauu

SEQ ID NO: 895 - RNA, 104 nt, Human
gguauucaggagagugugucagagcccaccagauacauuggaguuuauccaccuaaacuacuaauuacuacaugggcaugaaugcuggcauauugagaaguacc

SEQ ID NO: 896 - RNA, 80 nt, Human
ggucacaaucugaugcugucaguuugaccgagcugguuuugcuuauggucaugcugcaauuuguuagaauaauagggauc

SEQ ID NO: 897 - RNA, 80 nt, Human
ggucagacagggggacagggcagagcuagcauaacucaggcuuuuggggaugugcauggcagcuguuuuccuuuggggcc

SEQ ID NO: 898 - RNA, 76 nt, Human
ggucagagugaacucuugcuuccuguauucaggcagcucagagcagaaaguaaggggcagagucauacguguggcc

SEQ ID NO: 899 - RNA, 79 nt, Human
ggucaugcccuggaagccaaugaugcaacuucccucucucuucaagaaguaugcacugggugggacgggguacuggacu

SEQ ID NO: 900 - RNA, 94 nt, Human
ggucauugugcccugccaaggcacagcguagaucuggaaagagcagaaugcuuuccuuuucauauguggcuggucauggaaggggcaguugucc

SEQ ID NO: 901 - RNA, 95 nt, Human
ggucauuguguccugccaaggcacagccguagaucuggaaagagcagaaugcuuuccuuuucagauguggcuggucauggaaggggcaguugucc

SEQ ID NO: 902 - RNA, 93 nt, Human
gguccaaggucaacguuugcggccaaaaagggcccuggacuuagcgggaauuauaccucccaagggggccuuggccgggcgggaaccugggcc

SEQ ID NO: 903 - RNA, 90 nt, Human
gguccaauugguuccaagacgcguaggcgagauggucugaaagcccccgguaucauuccucgaauuucagugcgggaaccaaugcagacu

SEQ ID NO: 904 - RNA, 91 nt, Human
gguccaauugguuccaagacgcguaggcgaguuggucugaaagcccccgguaucauuccucgaauuucaagugcgggaaccaaugcagacu

SEQ ID NO: 905 - RNA, 82 nt, Human
gguccacauucacuuucccguggaagguucaggaagcgacaccguuguuaucaggggcccuuccucggauguggagaaggcc

SEQ ID NO: 906 - RNA, 65 nt, Human
ggucccacugaagcaccucuauuuaaaucccccuguuccgaauaagggagcuguguaaauggacc

SEQ ID NO: 907 - RNA, 73 nt, Human
ggucccugagcucccuagagucggccaccacagauucagacuuggacuaugauuaucuacagaacuggggacc

SEQ ID NO: 908 - RNA, 60 nt, Human
gguccugcugugccagaaacccuuaagaaaaagcgaaggaauuucgcagagcugaagauc

SEQ ID NO: 909 - RNA, 72 nt, Human
gguccuugccaccguuccacacugcaauugguacauucauggcugucacauuguaguagggagguugggacu

SEQ ID NO: 910 - RNA, 78 nt, Human
gguccuuuaggaggugauagucaucgcuguccgaggugucauacaccagguuguuggcgaacauacuccugaggaacc

SEQ ID NO: 911 - RNA, 63 nt, Human
ggucgaaguggucuggaacuugcggggcguggagggguccggcgggaaugaccacuuccggcc

SEQ ID NO: 912 - RNA, 72 nt, Human
ggucuacaagaauugguggcuauucggguacuguuaccuguuggccgaguggcgacugauguuccucagacc

SEQ ID NO: 913 - RNA, 83 nt, Human
ggucuaguugucuuagaguugggcugaacagaagcacucuuccaagggcgcugcagcaauuuucagugagacagcagaagacu

SEQ ID NO: 914 - RNA, 64 nt, Human
ggucucacacugguuucucgugcccaccagcuuguaauggagggauacaauuggugucaugauc

SEQ ID NO: 915 - RNA, 68 nt, Human
ggucuggcaggaagggggcagccugcaacccccaagggcagguguggggcugccacagccgcuuggcc

SEQ ID NO: 916 - RNA, 130 nt, Human
ggucugugugaagcaucacuuugcagggauuacuaaugguggggcagcaggucugugaauuaaguuaucucuugaccucacccucaugucaacacaaauguaauuccuaaacaagaugcauugccagucu

SEQ ID NO: 917 - RNA, 78 nt, Human
ggucuuacagacguccaggggggucgguggcggccgcggcgagggccccggccagcccgccugagaugaugugggacu

SEQ ID NO: 918 - RNA, 69 nt, Human
ggucuuugcggauguccacgucacacuucaugauggaguugaagguaguuucguggaugccacaggacu

SEQ ID NO: 919 - RNA, 104 nt, Human
ggugaaauagauuaugaagcaaugugugaagcuuucggauggcuuaaugggagcagaucugagaaauauguucgcaauucgugcugaucaugauuuguaguacc

SEQ ID NO: 920 - RNA, 72 nt, Human
ggugaacucggcgcacacuucacagaacuccuuuagguaaagcgguugugcccuucgcgacgauuuucuacc

SEQ ID NO: 921 - RNA, 73 nt, Human
ggugaagguuuuaucagagcccagggcagacucaguggcuuccuauccagggcucuucccacagcucgucacc

SEQ ID NO: 922 - RNA, 74 nt, Human
ggugaauuucuagcucuucauggguccugaacauugauuucagucuuugcaaagaaugaagaagugaauucgcu

SEQ ID NO: 923 - RNA, 67 nt, Human
ggugacaaaccauugcugugagccaagcugcuaacaugccuugguuccaacgcgauggcaagucacc

SEQ ID NO: 924 - RNA, 60 nt, Human
ggugacaacaugcuggaaccaagugcuaacaugccuugguucaagggauggaaagucacc

SEQ ID NO: 925 - RNA, 61 nt, Human
ggugacaacaugcuggagccaagugcuaacaugccuuggcuuccaaggauggaaagucacc

SEQ ID NO: 926 - RNA, 80 nt, Human
ggugaccaacuuauacucaacuugaauaaacaucagcucugaucggauccagcugaugaacucugggauaggcugguucc

SEQ ID NO: 927 - RNA, 85 nt, Human
ggugacucagugcucaggaucuuauggcuccuuccuccagcuugggggacucuuaaaggggcugggguagagacuaagaguugcc

SEQ ID NO: 928 - RNA, 62 nt, Human
ggugagaaggggucugcggccucgucuccagccgagggcgggaggcgccucgccccuacacc

SEQ ID NO: 929 - RNA, 75 nt, Human
ggugagguggguggaucaccugaggucaggaguucaagaccagccuggccaacauggugaaaccccaucucuacu

SEQ ID NO: 930 - RNA, 109 nt, Human
ggugaugaccccacaaggaagagguacuguugcagccgcugcagcugcugccacagccaguauugccggggcuccaacccaguacccaccuggccguggggguccuccc

SEQ ID NO: 931 - RNA, 77 nt, Human
ggugaugcccaagauggaccagauaacaucacaugaaggccguuucuggaaugaagucugacuccuccaguuucacc

SEQ ID NO: 932 - RNA, 94 nt, Human
ggugcacgcauguaaucccagcuacucaggaggcugaggcaggggaaucgccugaaccugggaggcggagguugcggugaccugagauuguacc

SEQ ID NO: 933 - RNA, 102 nt, Human
ggugcaguggcacacaccuguaaucccagcuacuccgaaggcugaggcaggaggaucaccugagcccaggaaguugagacugcagugagcugagauugcacc

SEQ ID NO: 934 - RNA, 91 nt, Human
ggugccacgcucaacaccggguuccagccguguccgggccaucgaucacaguccgcaccaaaguacuaauucgguaucacgcacuggcacc

SEQ ID NO: 935 - RNA, 83 nt, Human
ggugccaugaccggaauguucguaacgauuucagugcuccaaacuauaguaucgaaggguaaccaagcugcaaucauggcacc

SEQ ID NO: 936 - RNA, 123 nt, Human
ggugccccucacccugccuauccgcauagcacgccccgccagaacuaccacaggcaauacaagcacuggugccccugaccggcagcugcgcgcacggcaggccugccuaucccucacagcacc

SEQ ID NO: 937 - RNA, 71 nt, Human
ggugcccucuccaagcacuuuaggcuggacacucagaccuugucacugugcuugcccagaagaggcgcauc

SEQ ID NO: 938 - RNA, 76 nt, Human
ggugccgaggucagagaugguggcccuagagucauaggcuugagcagggagccacgauaauucuccagacaguacc

SEQ ID NO: 939 - RNA, 71 nt, Human
ggugccuggucaaucaguccucgggauggcagccaucaacccgugggccuccuggggugaccuuacggacc

SEQ ID NO: 940 - RNA, 75 nt, Human
ggugcgucgggcggcaccaccauguacccgggcauagccgacaggaugcagaaggagaucaccgcccuggcgccc

SEQ ID NO: 941 - RNA, 72 nt, Human
ggugcucagcuucucgugcgcaucucgcugcuucugguaguggugugcuucucgauuuggcuucgaagugcu

SEQ ID NO: 942 - RNA, 89 nt, Human
ggugcucugggcacugcaggggugcuggcuggacugcgguuaccgcagcgcggaacccccuaggcgaccccgcgcuggccgggagcacu

SEQ ID NO: 943 - RNA, 67 nt, Human
ggugcugggggcucugcugggccuggccucaaccauggggagccccagcuccagugccuacugcacc

SEQ ID NO: 944 - RNA, 93 nt, Human
ggugcuuagguguuugcaggucugagaaaccucuaaccuaguguuccucuaaauuagaguccuuggaucuguaucaaaaccaccuaguguacu

SEQ ID NO: 945 - RNA, 64 nt, Human
ggugcuugcuguccgaugggucuguauucaacauuaaauacaaauugccugacggcagguaacc

SEQ ID NO: 946 - RNA, 87 nt, Human
gguggaaaagcauguacaggucaucucagugcuccaguuggguacuaguccuuccuuguacugggaguggccugcagugccauccuc

SEQ ID NO: 947 - RNA, 71 nt, Human
gguggagagaaaaugcaguauucuuaucugagacguaauagaggccagagugcugaacaacacuauccacc

SEQ ID NO: 948 - RNA, 66 nt, Human
gguggaucaccuaaggucaggaguuggugaccagccugacuaacauggugaaacucugacucuacu

SEQ ID NO: 949 - RNA, 95 nt, Human
gguggauggaaagcaagguagaguaggcuucgugggacacagcugggcaggaaggcuucugacucgccugaggccacaucuccuaaccagauacc

SEQ ID NO: 950 - RNA, 97 nt, Human
gguggcauaugcguguaaucccagcuacuugggaggcugaggcaggagaauugcuugaacccaggagguggagguuacagugagcagagauugcacc

SEQ ID NO: 951 - RNA, 82 nt, Human
gguggccacagcucaucaggaacagcuucuucuaagggauccacuggaccuaggaaaaccgagguguugagagcaggccacc

SEQ ID NO: 952 - RNA, 73 nt, Human
gguggcccccugcgcaaagaccuaggcccuggugucgggcuggcaggccugguaggcggaggcgggcaccacc

SEQ ID NO: 953 - RNA, 85 nt, Human
gguggcguagacgaguuaaguccuggucugcguggaggucgacgacuccgucgcagacuacggaccugucugggucucagccgcc

SEQ ID NO: 954 - RNA, 66 nt, Human
ggugggagggaaaguguucggcagggcagaaacccugccuggcuguauccaacugucacucccacu

SEQ ID NO: 955 - RNA, 62 nt, Human
gguggggcacacagcggggggcgccagguuuuccuugucccccagcugcucugccccuuucc

SEQ ID NO: 956 - RNA, 102 nt, Human
ggugggguugaaagcuaagaaagugaggaggugguucaggggaucacucuuuccuacuuguuccucucaccucaaacucaccuucuacugcgcagcaacacu

SEQ ID NO: 957 - RNA, 68 nt, Human
gguggugucuuccggcuucugcugcuggcuggcaaaacuguaguaguuguuggggcccaggacccacc

SEQ ID NO: 958 - RNA, 90 nt, Human
ggugguguuuuggugucuguuuuugcccuguggccuuagggugcccuuccugucccuucuuucagaaacagucauucuguaauaauagcu

SEQ ID NO: 959 - RNA, 74 nt, Human
ggugguuaguuucugcgacuugugugggacugcugauaggaagaugucuucaggaaaugcuaaaauugggcacc

SEQ ID NO: 960 - RNA, 85 nt, Human
gguguauugcuuugcccucuuuuucacugagaaccauucagaaaggauauggucuguaucaaaguuggccaacaugcaacuugcc

SEQ ID NO: 961 - RNA, 79 nt, Human
ggugucucuggaagugucuauacagaugugugcugcugcugcugcugcuuucugccuuaaaauuucuggagccaacacc

SEQ ID NO: 962 - RNA, 77 nt, Human
ggugucuguuccagugcucucgcgagggccuucuucuuuucgggguuggcaaggcgagggcacccuggccggacacu

SEQ ID NO: 963 - RNA, 109 nt, Human
ggugucuuaccauguugccuaggcugguaggcuggucucacacuccugagcugaaaugaugcuccugacucagccuccacaacuagcugggauuacauagugagucacu

SEQ ID NO: 964 - RNA, 81 nt, Human
ggugucuugguucuagcuucugggccucuuguuuucuagaauuauuugauacaagaaaguucuggcacaaccacaggcacu

SEQ ID NO: 965 - RNA, 70 nt, Human
ggugugcagaucuagaucgcagaguaguaagucucauucuaaaacauugcaacuacuguuagaguccacc

SEQ ID NO: 966 - RNA, 113 nt, Human
ggugugggcuuugucauguuuguuguguacauaugugcgugugcacacacccauacacacauguacauaucuagguacauacacauaucaggaaauaugggaaauuuugcacu

SEQ ID NO: 967 - RNA, 63 nt, Human
gguguggguuuuuggcauguagcaguuuuuaugguaagaucuauauauaaaaagucccacacc

SEQ ID NO: 968 - RNA, 90 nt, Human
gguguggucaugcauaccugcagucccagcuacuuagaugagaggaaggaucaccugagccugggagaucaagugagucaugaucacacc

SEQ ID NO: 969 - RNA, 69 nt, Human
gguguuaagugcuccaaggagguggccaccgccauccguggggccaucauccuggccaagcucuccauc

SEQ ID NO: 970 - RNA, 78 nt, Human
gguuaaguuucccuggggggccacccaaaucgggggaacccccggcaaaauaaagggcccccuugggggggaaaaacc

SEQ ID NO: 971 - RNA, 67 nt, Human
gguuacaagcgauaucuccugccucagcuucccaauuaagcuggggauuacacaggcuauuguagcc

SEQ ID NO: 972 - RNA, 84 nt, Human
gguuaccagaaaucacaguggggucuccuuguuggcaucuaauaaugaucuuccaagacaagaucuccugucacucuugguacc

SEQ ID NO: 973 - RNA, 91 nt, Human
gguucauucucuggaucagagucaguggugucagaauaucuauaaugaucagguucauugucacuaacaucugguguacagaaguugaacu

SEQ ID NO: 974 - RNA, 69 nt, Human
gguuccacuccaccauucuauauauggauaaggcuugguaaaguguaagagaaagguggcagugggauc

SEQ ID NO: 975 - RNA, 71 nt, Human
gguuccccuacuucuuggugagguucacugugauauacaacgacacagauggcaagcaagaagcgggagcu

SEQ ID NO: 976 - RNA, 110 nt, Human
gguuccgucacccccucccagggaagcaggucugagcagcuuguccuggcuguguccaugucagagcaacggcccaagucugggucugggggggaaggugucauggagcc

SEQ ID NO: 977 - RNA, 110 nt, Human
gguuccgucacccccucccagggaagcaggucugagcagcuuguccuggcuguguccaugucagagcaacggcccaagucugggucuggggggggaagugucauggagcc

SEQ ID NO: 978 - RNA, 62 nt, Human
gguucuccacauggaaucccugggccacuggagucaaggcuugaagauuucuaugcaggacc

SEQ ID NO: 979 - RNA, 81 nt, Human
gguugaaaaaccagggccuucaucuaggaaauacagcauuuuccagaagcuucuuugaaagggaauccugguuuuguugcc

SEQ ID NO: 980 - RNA, 87 nt, Human
gguugccgugauugaggaggugcuaccagcgucugcugggcagagaccagggaugcugcuccacaucccacaaugcacaggacaauc

SEQ ID NO: 981 - RNA, 77 nt, Human
gguuggagugcaggggcgcgaucucggcucacugcaaccuuugccucccggguucaagcgauucuccugccucaccc

SEQ ID NO: 982 - RNA, 61 nt, Human
gguuggggucauggcgccccgaagccuccuccugcugcucucaggggcccuggcccugacc

SEQ ID NO: 983 - RNA, 90 nt, Human
gguuuacaucaacaucugcacucgcaccucuaucccuccucaccgcagaggugaccgaaggaggagcugcgcagaugcuagaggaggacc

SEQ ID NO: 984 - RNA, 72 nt, Human
gguuucaccauaguaaaaucuuucuuuggcauuuagucaauagccuagggagauaagcacuauuuagaaacc

SEQ ID NO: 985 - RNA, 100 nt, Human
gguuucauuucuucuuggcuugccugagggguucuugcagguacaauuaacacaaaauguucugaggguaguagcuuuucaugcacugaagaaugagauc

SEQ ID NO: 986 - RNA, 69 nt, Human
gguuuccccauacugucucuuguuuuuggaggugacauuuccauccagaaggauaacgaucaggaaacu

SEQ ID NO: 987 - RNA, 82 nt, Human
gguuuccuggaacuuugggggaucauuauaaaaauacuaggguaaaaaagcaaccuuaguaaucccagcaauuugggaggcc

SEQ ID NO: 988 - RNA, 60 nt, Human
gguuucggcaguggcauucggggccggggucgcggcguggacggggccggggccgaggcc

SEQ ID NO: 989 - RNA, 97 nt, Human
gguuucuuaauuagauauagcugaaaagaacgcuagaccaaauagguucucugccuugccuuuucguuuguuuuguuuuagcuauuaucagggaacc

SEQ ID NO: 990 - RNA, 74 nt, Human
gguuugcgcugcuaugagaaucuaaggcugccacugaucugacaggaggcagaacucagguggcaaugcuuacu

SEQ ID NO: 991 - RNA, 70 nt, Human
gguuuguauguguguguauauauguaaauauguauguauguguguacguauguauauacacauacacucu

SEQ ID NO: 992 - RNA, 85 nt, Human
gguuugucugaucauugcucgugcaguuugaguacuggauacucccuuauuccaguugcuugcaccacgcccuggucuuggaacc

SEQ ID NO: 993 - RNA, 87 nt, Human
gguuuucaaggugucaugaaaagauggggauuuaaaggccagccugcuacgcauggucaaacgaaaacccacaggagaccuggagcu

SEQ ID NO: 994 - RNA, 76 nt, Human
gguuuuguugcuacaauuccaugaccaaaaaucucugaaaaguuaaagauuuuccuagcauuuuggcaacaaaacu

SEQ ID NO: 995 - RNA, 81 nt, Human
guaaaaaaacuucaacuuugagaucugacagucucaggucugccacuuacuagcugugugaucuugaacaaggaauuuugc

SEQ ID NO: 996 - RNA, 101 nt, Human
guaaacaaugcaaauagauuuccuaucuucccugggccacuguuguacuagauuacaguuuagguuucauagguccaggcuguggguucugcgauguuugc

SEQ ID NO: 997 - RNA, 72 nt, Human
guaaagccgucggacauccuuggagagaggauagauuccuuaauucuuuugccaaguaugccucggcuuggc

SEQ ID NO: 998 - RNA, 74 nt, Human
guaacagguggggcuggcuacauuggcagccacacggugcuggagcugcuggaggcuggcuacuugccuguggu

SEQ ID NO: 999 - RNA, 72 nt, Human
guaaccuagagaggggugcccccaguguggguuagaaaaucucucggaucuugauuggguccucuugguugc

SEQ ID NO: 1000 - RNA, 84 nt, Human
guaacuauaaaagggaaccuauaaauguaguuucaucugucgucaauuacugcagaaaauuauguguauccacaaccuaguuau

SEQ ID NO: 1001 - RNA, 72 nt, Human
guaagaagguuggcccugaugcugggcuuuuucuaauagcauagacuugaucacaucauuaaccucucuuac

SEQ ID NO: 1002 - RNA, 100 nt, Human
guaagacauaugaagaauuggaucagagauuucuaugacagugcgggaaagcagcacugagaaacuuuugauuguuuucaauuucuucuuuuauguucac

SEQ ID NO: 1003 - RNA, 82 nt, Human
guaagauggguaaagcaugccauuucuguuuucuugagauuuuuacuuuuuagaaacacacaugcuuccacugccaucugac

SEQ ID NO: 1004 - RNA, 94 nt, Human
guaagccuaccaggaggaaccagaacagcugcauaacuuggcaucuaccuaugugcuccugucccuuccacuuccuccuucuguggguaauuac

SEQ ID NO: 1005 - RNA, 118 nt, Human
guaagggagaauguaaaacaucaacucagccaggcuuuuguuuucugcagcaauaauaaagggccuccugcacuuagcaaaaaucugucuuaacuuuguagugcauuucuuccauuac

SEQ ID NO: 1006 - RNA, 63 nt, Human
guaagguguugcaguguggcaaaauagcaauguacggaguuuugcacaccacaacagccagac

SEQ ID NO: 1007 - RNA, 95 nt, Human
guaaguugguucuguuuugagcuucacugaggaagcacagcuguugguugaaguauuaguaugcuguguccuucauaagcacagagccaugguac

SEQ ID NO: 1008 - RNA, 78 nt, Human
guaauggcauaagaauacugacuuauucucguuuagaaagcccucuggcagaauacaagucauuucaauuuccguuac

SEQ ID NO: 1009 - RNA, 80 nt, Human
guaauucacaaaaacucacauuuacuuugaagagcaauuuggcaaugucuauaaggcuaaauguguuuauucugugauac

SEQ ID NO: 1010 - RNA, 67 nt, Human
guacacuucacucagaggcaggugcaucuuuaaauaauuucuuauaagccucuaaagugaucagugc

SEQ ID NO: 1011 - RNA, 78 nt, Human
guacagagaugaggcagaguggagagaaacaacucuggcugagccagagucuccagccacuacuucuuauuccugggc

SEQ ID NO: 1012 - RNA, 68 nt, Human
guacaggcugaggccuuugacaguguuaccaucuacuucagugacauuguuggcuucacagcauuguc

SEQ ID NO: 1013 - RNA, 74 nt, Human
guacaucaggcuuuugugauuugagacuugaugguggcucugcuccacgucaaucacaaaggcuuguccagugc

SEQ ID NO: 1014 - RNA, 71 nt, Human
guaccacacuggacguggggguccucccccagcuaugggccgaggagcacccccuccaggcaugauggugc

SEQ ID NO: 1015 - RNA, 90 nt, Human
guaccaccuugucggguagcuuaucagacugauguugacuguugaaucucauggcaacaccagucgaugggcugucugacauuuugguau

SEQ ID NO: 1016 - RNA, 72 nt, Human
guaccaggaagacuucaugaaagcagucagaaaaaguggugauucuagaaggcuggagucuaaauuggguac

SEQ ID NO: 1017 - RNA, 80 nt, Human
guacucugcccgugugggcacuguccugggccagcgauuucugcugccagcugagaacaacaagccccaaagacagguac

SEQ ID NO: 1018 - RNA, 97 nt, Human
guacugccugcccggggcuuaggaggguggcaccggugcugggacacacgggacuguguccucgccaacccccgaccugcccccugccagccagugc

SEQ ID NO: 1019 - RNA, 73 nt, Human
guagaaagaaaagccccugaugcuggaggcugucuucacgcuugaccccagaccuggggguguuguguucuac

SEQ ID NO: 1020 - RNA, 78 nt, Human
guagaaaguaaaugagauaaguacuuuguacauguuaacgcacaguaaaugguaauuauuuacauucauuucaucuac

SEQ ID NO: 1021 - RNA, 62 nt, Human
guagaagcauuuugagaacagguuggcaucaucacauaagcccuuauauucaagaacucugc

SEQ ID NO: 1022 - RNA, 69 nt, Human
guagacaaguccuccagcacagccuauauggagcucacuaggcugacaucugaggacucugcugucuau

SEQ ID NO: 1023 - RNA, 67 nt, Human
guagacgcccagcaucuucaaagacaugcucugaguuauucugccauuuagaugacggggcuuuugc

SEQ ID NO: 1024 - RNA, 80 nt, Human
guagagaggguguuucaccauguuggccagguuggucucgaauuccugaccucaagugauccgcucgcucgccucucuac

SEQ ID NO: 1025 - RNA, 74 nt, Human
guagagaugggaucucacuuuguuguccaaucuguucucaaacucuuggcuucaagugagccuccugccucugc

SEQ ID NO: 1026 - RNA, 74 nt, Human
guagagaugggguuuugccauguugccuaggcugaucucaaaucccugggcucaagcaauccacccaccucagc

SEQ ID NO: 1027 - RNA, 68 nt, Human
guagagggcaaugugguugucauggagacagcugucuucaacacaaaccauccugugcaucuaucuac

SEQ ID NO: 1028 - RNA, 74 nt, Human
guagaggugggguuucuccauguuggucaggcuggucuuuaacuccugaccucaggugauacgcccgccuuggc

SEQ ID NO: 1029 - RNA, 66 nt, Human
guagcagaauauguuacaacugcggcaaaggaaaugcuaaacugucacagcuguagaucaugcugc

SEQ ID NO: 1030 - RNA, 83 nt, Human
guagcagauugggagaaauuaccugauuguuaacucucugaaaccuuaagggguuaaccgcugucucgcuccauuccugcugc

SEQ ID NO: 1031 - RNA, 70 nt, Human
guagcaggcuuccugcagacuguauagacugcacaacaaauuucuccuguaccuaugggaagccugucac

SEQ ID NO: 1032 - RNA, 74 nt, Human
guagccuggaagaggggcuccugcagguaaucguacacuucauuuuugccuagccgaucaucuuccugagcugc

SEQ ID NO: 1033 - RNA, 74 nt, Human
guagcugcuagaggccuuugcuagcugcuacagguagguccacacugucgcaggcugcucugucucuuagcccc

SEQ ID NO: 1034 - RNA, 94 nt, Human
guaggcuugaugacagagccuggacaagaacagcgaccaggagaucgaccucaaggaguacucgguguuccugaccaugcugugcauggccuac

SEQ ID NO: 1035 - RNA, 75 nt, Human
guagggagcacccgcgugccagucacucgagacggcucuucgagcacuggccuacuggcacucggcgcuucguac

SEQ ID NO: 1036 - RNA, 69 nt, Human
guaggggcccucguccuucuucucggccgccaccagcaggcugugcuccaggucggccugggccccugc

SEQ ID NO: 1037 - RNA, 71 nt, Human
guaguaaaauaagccucacucaaacauagcugacuuccuauugguacagcuugaaaagcacuuuuuacuac

SEQ ID NO: 1038 - RNA, 74 nt, Human
guagucccagcuauucaggagcuugaggugggaggaucacuucggcccaggagucugaggcuggagugagcuau

SEQ ID NO: 1039 - RNA, 102 nt, Human
guaguccuugacucucacauuaaaacuaacuuuggcuagguacugguggcucacaccuguaaguaaucccaguacuuuaggaggcugagaguggaggauuac

SEQ ID NO: 1040 - RNA, 74 nt, Human
guagucuccacuggagaaguuaauugaugaguaguagccuacaacucaggcucuagcuucuccaggaacacuac

SEQ ID NO: 1041 - RNA, 71 nt, Human
guagugcuccuggagaagcuagagccugauguaggcuacauacucaucauuuacuucuacagggagacuac

SEQ ID NO: 1042 - RNA, 63 nt, Human
guagugcuugucacauaguaagccuuuguuguuguuagcgcuuacuguguaacaaaucacugc

SEQ ID NO: 1043 - RNA, 84 nt, Human
guagugucagagauaccggggcuguugguacuguuuuuccuauccagacaaagaccccgauaccucguguuccuaaaauacugc

SEQ ID NO: 1044 - RNA, 63 nt, Human
guaguuucuagcauaacaccagggaugugguggugaaacguuccggaagguguugagaacugc

SEQ ID NO: 1045 - RNA, 77 nt, Human
guauauaggcugagcaagagguggugagguugaucggggguggcuggaucucacuuccucugcuggggccucggugc

SEQ ID NO: 1046 - RNA, 89 nt, Human
guaucagaaagacuuguguuaaaucaguccgcccuuuaacuugcgcaaaggcauggcgcggggugacuuggccagucugaccugagugc

SEQ ID NO: 1047 - RNA, 76 nt, Human
guauccugggggugugugugugcaugcaugucugugugucugucuguccaugcacacauacacuugcccaggagac

SEQ ID NO: 1048 - RNA, 90 nt, Human
guaucuugugcugaccuccuaucucauccggugacuuagaaugccuaacucuuugggaaugcagccuaguaggucucagccuuauuuuac

SEQ ID NO: 1049 - RNA, 68 nt, Human
guaugaugucuaucaguauuuucugccugagaaugaccucacugaggagauguugcugaagcaucugc

SEQ ID NO: 1050 - RNA, 76 nt, Human
guaugcuaugcuaauuuuuaaaaaguaacauaacacuaagaucacugaauuuuaaguauuagauuuucuggugugc

SEQ ID NO: 1051 - RNA, 77 nt, Human
guaugggggguguucugcuuggcaccaugucuggcuuuuuggccagaaguccuuugcagagcugaauauccccuugc

SEQ ID NO: 1052 - RNA, 96 nt, Human
guauggugucuucacuuauuauguauguuuaucuguauguauauuccuuauuuugucauauauguagagaaaauugcaugacuugaggcaucauau

SEQ ID NO: 1053 - RNA, 75 nt, Human
guauguacaauugauaauauaaaggggcucauugaaacuugagagccuguugaguuuugguuacuuguacauugc

SEQ ID NO: 1054 - RNA, 75 nt, Human
guauucuguauguuuagccaaaagcacuaaggucauaugaucuuaaguucaaaauggcuaaacuaaccagagaac

SEQ ID NO: 1055 - RNA, 97 nt, Human
guauuugacucgaccuuggaacacuggcccugagacucagggguuuaacauuucaccucccugaauucccauccagaaaucucaggcgagcagauau

SEQ ID NO: 1056 - RNA, 83 nt, Human
guauuuugcuucugucugugaauucuguugcuucuggggcauuuccuggaagguuggaaaguuuacaaaucucaguccaaugc

SEQ ID NO: 1057 - RNA, 98 nt, Human
gucaacuacaucuaucguucagacagaguacuguggacugcugagaauguccucuauucuugaaguagcguauucuuggagcugauaccucuguugau

SEQ ID NO: 1058 - RNA, 87 nt, Human
gucaaucacccugggcuccucgaacucagccucagugcuguagcccugguggcugacccugcgcaggcgguccaggcccugguugau

SEQ ID NO: 1059 - RNA, 93 nt, Human
gucacacauggguugaaccucacugauuucugggaggcuacagcgggaccauggcauaacuauccgggaagagacuugugauccauguguggc

SEQ ID NO: 1060 - RNA, 85 nt, Human
gucacagacuguugaaacaugaccagaagcguguagcuccauccaucgugcuagagcucgcuugggucccuuugacaucuuuggc

SEQ ID NO: 1061 - RNA, 90 nt, Human
gucacagauugcggccaggggcuuaauagcgcggugaguacuaggggccaucgugaauguauugagccagugcuugcagcuuacagugac

SEQ ID NO: 1062 - RNA, 78 nt, Human
gucaccauccucugcauugacuugggcacugacaugguuccugccaucucccuggcuuaugagcaggcugagagugac

SEQ ID NO: 1063 - RNA, 71 nt, Human
gucacccauauuaaaaugcacaggggccaggcaugguggcuuaugccuguaaucccagcauuuugggaggc

SEQ ID NO: 1064 - RNA, 71 nt, Human
gucacccuggcuggaggugcaguggcgugaucucagcucacugcagucuugaccucccaggcccaggugac

SEQ ID NO: 1065 - RNA, 68 nt, Human
gucacuggaaaaugccuacaggcaguagccaccaucauguggcacaaagugggcaucauccuaguguc

SEQ ID NO: 1066 - RNA, 82 nt, Human
gucagaaaacgcucuuguuaccacucauguucuucauuucuuuauucagaaaugcugacuauaucaucaaccaguuuucugc

SEQ ID NO: 1067 - RNA, 80 nt, Human
gucagagucuucucaucugugccagcacccuucauggauuuguaaaguuuguucggcaagaagagagggcuguucuugac

SEQ ID NO: 1068 - RNA, 63 nt, Human
gucagaugccugauaacagggugcaguguuguuuauacuucauugcuccuucaggacauggac

SEQ ID NO: 1069 - RNA, 76 nt, Human
gucagcacuuacauuaagaaaauugguacaaccccgacacaguagcauuugugccaauuucugguggaauggugac

SEQ ID NO: 1070 - RNA, 72 nt, Human
gucaggcacgcucacacgcaguguccuguguuggcuccugacccagcagggggacauggugggcggauguac

SEQ ID NO: 1071 - RNA, 84 nt, Human
gucaggcagaggugacgccaggagaugauuuaaaggugaaaaugacaagguuuccaccccucaaaccuuggcuccuuuucugac

SEQ ID NO: 1072 - RNA, 76 nt, Human
gucaggccaggggguugcaaauguggguacuuuccgugagaacucauaaggguaguuggggauuuccugaucugau

SEQ ID NO: 1073 - RNA, 84 nt, Human
gucagggaaaucaugcagccaucaggacacaggcuccgggacgucgagcaucauccucuccuggcugaaaaugacaacuaugac

SEQ ID NO: 1074 - RNA, 69 nt, Human
gucagguuaaaaggcuuugcacagcuauuguucacauuuacagccuuggcucaaacccuggucucugac

SEQ ID NO: 1075 - RNA, 88 nt, Human
gucaucacaaaauacugccaaugaaucaucaaaugcauugaaaagaaaacgugaagaugaugaugaugacgaugaugaugaugaugac

SEQ ID NO: 1076 - RNA, 64 nt, Human
gucauccucguccuccucugccuguggcugcugcgguggcggcagaggaggggaugagucugac

SEQ ID NO: 1077 - RNA, 73 nt, Human
gucauuuugguuuacaauggaaacucggggaauucaaaauuaacauccugugcccggugagcuucuuauagac

SEQ ID NO: 1078 - RNA, 77 nt, Human
guccaaagccacacugaaaacagaggcagagacauguacucuggugugaucucuuguccucagugucucuucugggc

SEQ ID NO: 1079 - RNA, 75 nt, Human
guccacacugaccuucugugucauggcauaugcccaugucaggcagugcugugcuaaaggaaggauuacauggac

SEQ ID NO: 1080 - RNA, 110 nt, Human
guccacuggcccuucuugucuuagguccucacacacagcucugcucaguucaaucacccagaaugcaggcugguuggugaggcaaauuuggacagaagaagucagugucc

SEQ ID NO: 1081 - RNA, 78 nt, Human
guccagagaugaggcagaguggagagaaacaacucuggcugagccagagucuccagccacuacuucuuauuccugggc

SEQ ID NO: 1082 - RNA, 98 nt, Human
guccagauaauuccaggccaggcacgguggcucacgucuguaaucauagcacuuugggacuacaggcauaagccaucaugccuggcuuauuucuagac

SEQ ID NO: 1083 - RNA, 74 nt, Human
guccagggaaagagcaguaagggucagaagagaaagagccugguguucucacugccuccugccuuccuuaugac

SEQ ID NO: 1084 - RNA, 103 nt, Human
guccaucuucaguggcauugggccuuggcugggaugcugaguuauccacuggagcaucggcaguacaggcaggcacagaggcaguggauccaucggagguggc

SEQ ID NO: 1085 - RNA, 74 nt, Human
guccaugaccacugcaaucaccucucgcgccgagcggagcugcuggcgcagagcguccuugcagccguaggggc

SEQ ID NO: 1086 - RNA, 80 nt, Human
guccauuccauccgaggcaagucuucugaaaaccugugaacucaguucggaggaaauccugucucgugaacgaaguggac

SEQ ID NO: 1087 - RNA, 63 nt, Human
gucccauggaagcuucaugacuguaugcuguucauuuuucucuaagaugcagucacauaggau

SEQ ID NO: 1088 - RNA, 79 nt, Human
gucccccggguacuuuggggucaaaauacgguaauccauggacguaagcuggggaaggacuccggaccgcuggggggac

SEQ ID NO: 1089 - RNA, 65 nt, Human
guccccuuaacuaauccugaccuuaaccuauauaccaauggaaguucaguuguggagaaugggac

SEQ ID NO: 1090 - RNA, 90 nt, Human
gucccucccuccccugcugugaccuuguggggguugagaaaccuaggcacucauggcccccuggaggggcagggcaggcagggcuggggc

SEQ ID NO: 1091 - RNA, 86 nt, Human
guccggaaaugacuagcucucuggaaaagcuccucuugccgaugaggaagcucaugguggagcugguagaugagcccacgcuggac

SEQ ID NO: 1092 - RNA, 61 nt, Human
guccguuuucucugguuuugugaagacugcacaaaacucucaugauggagaaccaaaggac

SEQ ID NO: 1093 - RNA, 74 nt, Human
guccuacaaggcuucuggcuacaucuucacaaguuaugauauagacugggugaggcagacgccugaacagggac

SEQ ID NO: 1094 - RNA, 102 nt, Human
guccuccaucaccagagcaaguucagccaccaggccccuuaagcacagugccaagagccuuacugggccuucaggaaguucaggcuuuuguggcaggaggac

SEQ ID NO: 1095 - RNA, 69 nt, Human
guccugcagcugcagcugagacugcggcggagacugcgcgagcgugaggagaagcuggggccgcaggac

SEQ ID NO: 1096 - RNA, 88 nt, Human
guccuggacauaucggaguaggggguggucagacaucacaggagcugucaacuccugcggaaugggccaacucacucgguggcaggac

SEQ ID NO: 1097 - RNA, 110 nt, Human
guccuggcaaagaugacaugccguucacacucauucaucacgcugcgugccuucugauugucauagaguggcauaggcguugaugugaccgucuccacaucuauugggac

SEQ ID NO: 1098 - RNA, 66 nt, Human
guccuggugaagaccuaguucuugcaggagacaauuccacugcagaagcacuuuacuuaaaaggac

SEQ ID NO: 1099 - RNA, 71 nt, Human
guccuucuuucagaccaaagcuuggacgucagugccagcgaugaugagauagccaggcugaagaagcagac

SEQ ID NO: 1100 - RNA, 88 nt, Human
guccuugaacuuggaaccugacaauguugguguugucgugucuggaaaugauaaacuaauuaacggaaggagauauagugaagaggac

SEQ ID NO: 1101 - RNA, 86 nt, Human
guccuugaacuuggaaccugacaauguugguguugucguguuuggaaaugauaaacuaauuaaggaagagauauagugaagaggac

SEQ ID NO: 1102 - RNA, 87 nt, Human
guccuugaacuuggaaccugacaauguugguguugucguguuuggaaaugauaaacuaauuaaggaaggagauauagugaagaggac

SEQ ID NO: 1103 - RNA, 87 nt, Human
guccuugaacuuggaaccugacaauguugguguugucguguuuggaaaugauuaacuaauuaaggaaggagauauagugaagaggac

SEQ ID NO: 1104 - RNA, 87 nt, Human
guccuugaacuuggaaccugacaauguugguguugucguguuugggaaugauaaacuaauuaaggaaggagauauagugaagaggac

SEQ ID NO: 1105 - RNA, 86 nt, Human
guccuugaacuuggaaccugacaauguugguguugucguuuuggaaaugauaaacuaauuaaggaaggagauauagugaagaggac

SEQ ID NO: 1106 - RNA, 124 nt, Human
guccuugucauccucugccuguuguuucucauuuuagggaaaagcaguagcuuugcugugcuuuuuauuaucuaucuuucccugucuaccuuuacaaaugaaaauuauugcagagugcaaguac

SEQ ID NO: 1107 - RNA, 112 nt, Human
guccuuuagucucuauuuuugcuccuaauuguuccugcagguaguagguuaacauguaacguacuuacagaaggaagcaauugaacauggcauagauacugaaagaaagggc

SEQ ID NO: 1108 - RNA, 78 nt, Human
guccuuucucuggagaggcuuguggggccucaggacgcuacccacugcucuccgggccucuccugccgccucugggac

SEQ ID NO: 1109 - RNA, 60 nt, Human
gucgacuagggguuucagcauauugaucaugcucgucuugaauuccugaccccaggugau

SEQ ID NO: 1110 - RNA, 87 nt, Human
gucgccgcuguggggcagcgccuggcgggcggcccgcgggcgggucgccuccccuccuguagcccacacccuucuuaaagcggcggc

SEQ ID NO: 1111 - RNA, 74 nt, Human
gucgccuguugaguagacauggugggcuuuuuacaacggggugaaugaauccaugucuuaaccagcagguguac

SEQ ID NO: 1112 - RNA, 66 nt, Human
gucgcgcgcaaauuucuggugagcgccacaugacaauuuggcacacucuauccgaaauuugccgac

SEQ ID NO: 1113 - RNA, 70 nt, Human
gucgcugggauagaagccuuugaccaagcaggucaggcugaccugguucuuggucagcucaucccgggau

SEQ ID NO: 1114 - RNA, 86 nt, Human
gucguguccuacccaugcgcgucccggcggagcgggcaugcgccaccgcggcgccuggcgggacgugugggccgugaggauaggac

SEQ ID NO: 1115 - RNA, 93 nt, Human
gucuaaccagucccagugagaugaaccagguaucucagcuggaaaugcagaaaucaccugccuucucuguuggucucccugggagcugcagac

SEQ ID NO: 1116 - RNA, 82 nt, Human
gucuaauacacagauaucccaaugacuaaaguaagaauuccugucugaagcgucgucggcugggaucucgcacugguuagac

SEQ ID NO: 1117 - RNA, 78 nt, Human
gucuacaagaauaaguuuguuuuggaaaguugagcuauagcuacagcucuagcuauccagcagacuuuucauuaugac

SEQ ID NO: 1118 - RNA, 62 nt, Human
gucuacaagcauuuugaaauauucugugccuucgcagaauuucgugugugaucacugaggac

SEQ ID NO: 1119 - RNA, 68 nt, Human
gucuacauaaaugaagagcucaagaugacaucagucccauuugucuuaaguccugguguuguguggau

SEQ ID NO: 1120 - RNA, 94 nt, Human
gucuacuuuggcuacuaccaugggcuucugggggaacagggcuauggccuucucuuccagaaaccacugggugguccucaaaaccaaagugggc

SEQ ID NO: 1121 - RNA, 88 nt, Human
gucuauuaugagucugacuggcacagacaucugucaaggaagaaggauucuuugagcguauuugugucagucaacugcauauauggac

SEQ ID NO: 1122 - RNA, 71 nt, Human
gucucagcuagaacgagcggcccuagguuuucggaagggaggaucaggguauguuugcgagcggcuggaac

SEQ ID NO: 1123 - RNA, 89 nt, Human
gucuccagaacuagacugugagcuccuugaaggcaaauaguuuuuguucuauuuccuucuaauaucucauuuucuauuuucugugaggc

SEQ ID NO: 1124 - RNA, 71 nt, Human
gucuccagcugcaccuccaccauggccaccauggcaaagccggagaggagggcggagguccugcuggaggc

SEQ ID NO: 1125 - RNA, 103 nt, Human
gucucucaugaaauggaaagauucagaugaggcagacuuggugcuggcgaaagaggcaaauaugaaguguccucaaauguaaugcuuuuuaugaacgagagac

SEQ ID NO: 1126 - RNA, 73 nt, Human
gucucugcaagcucuugagucccgccaagaugauauuuuaaaacgucuguaugaguugaaagcugcaguugau

SEQ ID NO: 1127 - RNA, 76 nt, Human
gucucuguugcccaggcuggagugcaguggcgcaaucucagcucacugcaaccuccaccuccuggguucaagcgau

SEQ ID NO: 1128 - RNA, 81 nt, Human
gucugaaauccaggugugggcagggccgugcucccuccgaaggcucuaggggaggauccuugcucaacuuauuuuugagac

SEQ ID NO: 1129 - RNA, 64 nt, Human
gucugaaccugggggaucaggggaguaggggacucuccccuuguccacugauggggggucuggc

SEQ ID NO: 1130 - RNA, 85 nt, Human
gucugaauugucaaauaguucuaaagugcauucuugcagcuaauaaauagcagcauuuguuuauaaaaccuuaagaaauucagac

SEQ ID NO: 1131 - RNA, 90 nt, Human
gucugauuaacaaggugugacacauucacaguaugcgggcuauuuuaagaacccucauuuggugggcugauucaucucuggaguaaagac

SEQ ID NO: 1132 - RNA, 90 nt, Human
gucugauuucugaauguaaaguuguuguguuuuuuuaaauaguaguuuguaguauuuuaaagaaagaacagaucgaguucuaauuaugau

SEQ ID NO: 1133 - RNA, 72 nt, Human
gucugggccagaugcccugccaggaaagggacauggacccacgugcuugaggccuggcagcugggccaagac

SEQ ID NO: 1134 - RNA, 64 nt, Human
gucugguggagagacucuguggacguaaagaagggaaugaacacagagaaacuuucagccagau

SEQ ID NO: 1135 - RNA, 77 nt, Human
gucugguggccgcucaucuugugcacgguugugcugguccaggagggauagaugugcgcuugugugggucaugagac

SEQ ID NO: 1136 - RNA, 71 nt, Human
gucugucauuccugugccacgaccucagcuugcauccuaucagucuuggggaaggaaaagggaguacagac

SEQ ID NO: 1137 - RNA, 74 nt, Human
gucuguccagaucuuccaucuuaugcgccagcuugcagcagguuaaggacagcagcaggaugaagcuggaugac

SEQ ID NO: 1138 - RNA, 82 nt, Human
gucugugaccaaacagcccagaacguccggccaagcagccugcauauggccuugggagucauggcacaguacgguggcagac

SEQ ID NO: 1139 - RNA, 81 nt, Human
gucuuugaauggaaaacaacuauuuucucaucauugggucaauauugacugaucaguaguaggucuuuuaccauucuggac

SEQ ID NO: 1140 - RNA, 81 nt, Human
gugaaggaacaguuugccuggagacauuucuacugguaccuuaccaaugaggguauccaguaucuccgugauuaccuucau

SEQ ID NO: 1141 - RNA, 87 nt, Human
gugaaggaggaacugaaggguucaacugcggguaccacuuaggagacauauucugugacccguguaauccauaaguuucuaguuuac

SEQ ID NO: 1142 - RNA, 83 nt, Human
gugacccucaacuaccucagguuugaaggcccuaaaugaaacugauuaccacucauagggacaaaccgaggggguucgguuac

SEQ ID NO: 1143 - RNA, 111 nt, Human
gugaccuacaagucucuuuauuugcccuccauuauagacugagcuguuaauaacauuuaaugagcucacauggauucacuggcuaauaaagaagaauagaguugaggacau

SEQ ID NO: 1144 - RNA, 95 nt, Human
gugacucugguccaucacacuuagguccucuggccugccucugccacauccagcugcuaggggcuggccucagcccugugaggggccgcaggcac

SEQ ID NO: 1145 - RNA, 67 nt, Human
gugacuucaucuuuguccuuaaauuaaccuuugcucuugagagcagaagagggaaagacaggggaac

SEQ ID NO: 1146 - RNA, 98 nt, Human
gugacuuuccaggugucacacagugaguggcauaaucagaguacaauuugagucaugcccauacaucacauugccagugauuacccaaggaaagugac

SEQ ID NO: 1147 - RNA, 85 nt, Human
gugagaaagcacugggguccagauggggagaagauguucugccauaagaaaaucuccuggucugguccgugccuuggcuuagcac

SEQ ID NO: 1148 - RNA, 70 nt, Human
gugagaacuugguauuauugguucgagaaggaauuggugaauccaccggccgugauccauaccauuccac

SEQ ID NO: 1149 - RNA, 65 nt, Human
gugagaucaccuugccccauaauuuccaugcuuccuuugugugcaggggcaaaggcgauuaucac

SEQ ID NO: 1150 - RNA, 79 nt, Human
gugagauguguuccaggaagucgucuugagcacccauugcucagaguuuauauuggacuugcuuucuagcacauaccac

SEQ ID NO: 1151 - RNA, 108 nt, Human
gugagccuccggccugcaagaccacuuuguagucccuaccagcuguguggccagcccuguugguaaagggaccuagagaugaacacuuucuugcccuuagggguucac

SEQ ID NO: 1152 - RNA, 87 nt, Human
gugaggauggcagugcaggaugcaguagaugcccugaugcagaagugcuuucaacuccucguccuucaacuccaacaccuuccucac

SEQ ID NO: 1153 - RNA, 84 nt, Human
gugaggcucuggcaaggugugggcuagagaugcgacucaguuggaucuaucucucagaaggcuaccuuguaaguagaguuccac

SEQ ID NO: 1154 - RNA, 72 nt, Human
gugagggguuguuaacaaagaauauauauuggucauucuuacaacuacuauuuaaagucagcaacuuuucac

SEQ ID NO: 1155 - RNA, 62 nt, Human
gugaguguucuaaugauuccuaaacuacagucccuuaggaacugcguggcuaucacacugac

SEQ ID NO: 1156 - RNA, 126 nt, Human
gugauacaagugugaguuacaucauagucuauuucuugcuaaggccaaaguagaggaagucgagguaaauuugcaaaugcuauuugagccaguggccauggaaauaauuaugcucacauucuucac

SEQ ID NO: 1157 - RNA, 100 nt, Human
gugauauguuguaugaugcucucuuuucaugcugagcaguggcagcaagucgcagcucccaaucagcugugcaaucaugaggguaaacaaugcauauugu

SEQ ID NO: 1158 - RNA, 78 nt, Human
gugauccugugaucaugaucgggaaggcuuaacaugguaaagaugucaaaucuccccaaauugauguauagguauaac

SEQ ID NO: 1159 - RNA, 66 nt, Human
gugauucuggcacaggaaauggucuccaaaaucucaaaauaucagaucucuaccuugucaagucau

SEQ ID NO: 1160 - RNA, 81 nt, Human
gugcaauaaagaaaacauuaaauauuuaguuuggacuugaauaucaagucguagaaauuuauuuggaauacuugcuggcac

SEQ ID NO: 1161 - RNA, 79 nt, Human
gugcacaaccaaaaaauggagggaaacugaagcaagaauucgaauuaagagacuuuuuccauucccucacgguuugcac

SEQ ID NO: 1162 - RNA, 104 nt, Human
gugcacagccccacaaccaggucagcgaugaagguaucuucagucucccccgaaccgaugaagacaccauugacgccccaaccauuggccugggcagcuugcac

SEQ ID NO: 1163 - RNA, 102 nt, Human
gugcacuacagacuccagccucccuuugaagccagguuccagagcuuccucccuuuggccuggaaccucaacagcaggauugggaugaggauggaaguguac

SEQ ID NO: 1164 - RNA, 83 nt, Human
gugcaguacaaagacaguucagugacaaguuccauccauaccauggaagaggguuaaacuuguggcuguuuuugccacagcau

SEQ ID NO: 1165 - RNA, 75 nt, Human
gugcaguaccgcccugaggaguucacgaaggccaagggccugccuggugacagcuucuacaucagggcccuguac

SEQ ID NO: 1166 - RNA, 109 nt, Human
gugccacuaaugagcucucacucuggcuuguuaugugagaaacacaucucugugguguuuuaaucauucugcauuuuggggucuauuuguuacaggagauagugugcac

SEQ ID NO: 1167 - RNA, 87 nt, Human
gugccagcgaugaugagauagccaggcugaagaagccagaccaaggcaucaaggggcgaucagccuggucucuaugaagacuggcgc

SEQ ID NO: 1168 - RNA, 73 nt, Human
gugcccacagugccccggacacauuucacaccucaggcucgugguggugcaggggacaagaggcugugggugc

SEQ ID NO: 1169 - RNA, 95 nt, Human
gugcccgcccuggccccacggcagaaucagcuucuggguccaucggaggauccgagugugaauucccugcaagaacguggggagagugugggcgc

SEQ ID NO: 1170 - RNA, 80 nt, Human
gugccuaugcgggauccugggugugcaugacuccacucgcucagggccauggggaauguagacgccagcuguacagguac

SEQ ID NO: 1171 - RNA, 75 nt, Human
gugccucagccuccugaguagcugggauucacgggugcuugccaccuugccuggcuaauucggugguuuuaguac

SEQ ID NO: 1172 - RNA, 131 nt, Human
gugccucaucuguaggugguugagagaaugaaaggagguagcaugagcagggcacucagcucggaggcagugccuagccaacauugcuuaucuucacugugaauuuggcuuuuuuccuacucuugaaucuu

SEQ ID NO: 1173 - RNA, 90 nt, Human
gugccuuuaacucuuuuggcccuugggagucauugcaaccccaauacaaaugccagcccagggauuuccaguggccacaaguuauugcac

SEQ ID NO: 1174 - RNA, 91 nt, Human
gugcgcucggggcccuucgggcagaucuuccggccggacaacuucguuuucggucagaguggugcugggaacaacugggccaagggugcac

SEQ ID NO: 1175 - RNA, 70 nt, Human
gugcggcucagugagacucuugguggggcggguccgcuuccucuucaccaucacaggcuucuggcugcgc

SEQ ID NO: 1176 - RNA, 87 nt, Human
gugcuaaauguguucgugacaggaucaagcgugcuuuccuuaucgaggagcagaaaaucguugugaaaguguugaaggcacaagcac

SEQ ID NO: 1177 - RNA, 66 nt, Human
gugcuaggauuacaggcugaucccauaaugcauccucaaguggucaucuuaagccucauccuacau

SEQ ID NO: 1178 - RNA, 87 nt, Human
gugcuagggggucaccuaugugggagccagcucugccuccugccccgaagcuccagagacuucuccuacaacugacucucuggacac

SEQ ID NO: 1179 - RNA, 84 nt, Human
gugcucgguuuguaggcagugucauuagcugauuguacuguggugguuacaaucacuaacuccacugccaucaaaacaaggcac

SEQ ID NO: 1180 - RNA, 76 nt, Human
gugcugaccccaggaggggaggggccggccaccaucaagacguuccggacgccggagcucccacccucuucagcac

SEQ ID NO: 1181 - RNA, 62 nt, Human
gugcugcagaugcaucccaauaaucaggguggccucaaaacccugucuguccucuguagcac

SEQ ID NO: 1182 - RNA, 104 nt, Human
gugcugggucaaacagccuuuauuuuagcaguugugagacccuagagaacuccuuugguguuuuggggucuccccagcaugcacaauggggguuaugcuagcau

SEQ ID NO: 1183 - RNA, 81 nt, Human
gugcugucuuaugguugcguggcgaguuucugcuucagaugcagagcacuguccagagcuuccuccaguggacaauagcau

SEQ ID NO: 1184 - RNA, 113 nt, Human
guggaaacauacagaagaagcaaggaaauuacaguuagaggucacaacugcccgaagccaguucuaaauuuuuaugaagccaauuucccugcaaaugucauggauguuauugc

SEQ ID NO: 1185 - RNA, 78 nt, Human
guggaacggcucaccaacauccuugauggaggugcccagaacacugcacuccgcaggaaaguugagagcaucauccac

SEQ ID NO: 1186 - RNA, 93 nt, Human
guggaagaagaugaugaaauaaaucgagauugguuggauuggaccuauucagcagcuacauuuucuguuuuucucaguauccucuacuucuac

SEQ ID NO: 1187 - RNA, 104 nt, Human
guggaauucuucaucgagucguugacuucucgacggaaugcugacagguucugggugaaccugucucuguuuuucguaagaagauuucgcucgaugccuuccau

SEQ ID NO: 1188 - RNA, 86 nt, Human
guggagaagggguccaguuucaaucuucugcauauagcuagccaguuguccuugcaccauuguugaacagggaauccuuuccccau

SEQ ID NO: 1189 - RNA, 131 nt, Human
guggagauagauuuacccuuucuaaacuauuagcuguaauuuuaagguaagcauauagugugauagcuaguuugcucugcuuaaaaauacaauauuacaauuucugauaguggcaccaggguaguuuguau

SEQ ID NO: 1190 - RNA, 76 nt, Human
guggagcgagggaaggaguuaaugaaacuguauugcacaaugcucugaucaauccuucuuuuucucuuuugcccac

SEQ ID NO: 1191 - RNA, 70 nt, Human
guggagcugucggaggccaggcuccgggacgugcugcagcgcgccgggcccucucucccacuuuuuccau

SEQ ID NO: 1192 - RNA, 63 nt, Human
guggaggugcacauggaaccaaaccuccccaccaggugcugguauuccaggugcaguguccau

SEQ ID NO: 1193 - RNA, 78 nt, Human
guggaguuugugccucggcagcugggccugacggagcgccggguccacaucagccaucugcuggcccacacgcgcuac

SEQ ID NO: 1194 - RNA, 80 nt, Human
guggauggacuggaaggggauguucauggucagcugcgugguguagcuccgguagaaggccccaacccucgguccuccac

SEQ ID NO: 1195 - RNA, 82 nt, Human
guggauggacuggaaggggauguucauggucagcugcgugguguagcuccgguagaaggcccccaaccccucgguccuccac

SEQ ID NO: 1196 - RNA, 83 nt, Human
guggauuggauaugguuggaguggcacagacuggaucugggaaaacauugucuuauuugcuuccugccauuguccaacaucac

SEQ ID NO: 1197 - RNA, 71 nt, Human
guggcaagaggaacacaaggacugcccagaaaaaccggggcaagcuucugggcaaaggccccuguugccgc

SEQ ID NO: 1198 - RNA, 70 nt, Human
guggcaaguggauuauucggcugcggaagggcuuggccucccguugcugggagaaucucauuuuggccau

SEQ ID NO: 1199 - RNA, 71 nt, Human
guggcaccuucagggccaggagaggcacuggggaggggucacaggaugcuacucgggcaccuagaagccac

SEQ ID NO: 1200 - RNA, 85 nt, Human
guggcagaagaucccagcugaccacggccccuuucucuggggucagagggagaagacaggcgcagucagcaggggcagcuguugc

SEQ ID NO: 1201 - RNA, 71 nt, Human
guggcaguuccagccuuauccucagggucugacacaaucgggcuuuuacgaaaggcauguuuuacugccac

SEQ ID NO: 1202 - RNA, 71 nt, Human
guggcauauccaggcaugcugugcucuaacuggcgagggauugugccaaggacuugaauggaugaugucac

SEQ ID NO: 1203 - RNA, 65 nt, Human
guggcccacgugggcgggacggccgcaggcaugggguggcugugcugguccgacaccugggcuac

SEQ ID NO: 1204 - RNA, 72 nt, Human
guggcgaguauggugcggaggcccuggagaggauguuccuguccuuccccaccaccaagaccuacuucccgc

SEQ ID NO: 1205 - RNA, 80 nt, Human
guggcuacacagcucguuuccccuggguccucuguguaguuaacuuugcuggggacccugaugggagaagggacagccac

SEQ ID NO: 1206 - RNA, 94 nt, Human
guggcuagccauucaccagcaagucccuaaaaugaccugaaaccugaagaguguuucacccaugaaaggguuugcucucucugggcauggcuac

SEQ ID NO: 1207 - RNA, 82 nt, Human
guggcuaggaaagaacagcauaacuucagaguaaggguauagacuugggaugugaggcaguuaugcugaaagguucugucac

SEQ ID NO: 1208 - RNA, 77 nt, Human
guggcucgacucuugaccauggcugggguuccugaggaugagcuaaacccuuuccauguacuggggguugaggccac

SEQ ID NO: 1209 - RNA, 73 nt, Human
guggcucggccaucaugcccaggaucugagcccacaucuggcaccagcucuaccaagggccugguugggccac

SEQ ID NO: 1210 - RNA, 88 nt, Human
guggcucggcucagcugccuggguuguggccgcccuagcauccuguaugcccacagcuacuguaauccccgcugcugcuccgggccac

SEQ ID NO: 1211 - RNA, 66 nt, Human
guggcugugaaagaggaugcuuugguagcaagggggaucugucagacauuaauauucacauaccac

SEQ ID NO: 1212 - RNA, 87 nt, Human
guggcuuuuccagaaccagcauguucccuuuccucaguaaacgaggaauccauaaaacaaguuuuuguugguuacuaccagagucau

SEQ ID NO: 1213 - RNA, 61 nt, Human
gugggaaccccuuugccugaacgccuuacuaauggcaaguuuaaccccccgggguucccac

SEQ ID NO: 1214 - RNA, 70 nt, Human
gugggaacggguggcccggcugugugacuuuaaccccaagucuagcaagcaggccaaagaugucucccgc

SEQ ID NO: 1215 - RNA, 94 nt, Human
gugggacaaauauuaacaaagcaugauuuaaauauauauauauuuaaugugugauauguuuguauauauauuuaaacacaugcaauuguucuac

SEQ ID NO: 1216 - RNA, 83 nt, Human
gugggagcgccggucucuauauggcggcggcucugucgggccuggcuguccggcucucgcgcucggccgccgcccgcuccuau

SEQ ID NO: 1217 - RNA, 95 nt, Human
gugggagcuccaggggaggggaacagcacaggaagccucuaucagugccagucgggcacaggacacugccugccagucacccugagagguuccac

SEQ ID NO: 1218 - RNA, 62 nt, Human
gugggaggauuuugagauacuuauucuuuauuugagccagucuugcaagguuaacuucucac

SEQ ID NO: 1219 - RNA, 105 nt, Human
gugggauauuuucucuuuaaugcuuagauacuguuucuucccuaagauguguuucucaaccacaauugguggaaugaaccagagaggcaagaggaagugaauugc

SEQ ID NO: 1220 - RNA, 85 nt, Human
gugggcccacuguuccagcugcuuaaacgagggucugacuuauguguggaggcuggcaccccgucuggagggcaggaggucccac

SEQ ID NO: 1221 - RNA, 87 nt, Human
guggggugaagggucauuaagggcacgcaguagccauaaugccacacccuuugugccagccacugcgcuucuggaaaccuaccccac

SEQ ID NO: 1222 - RNA, 62 nt, Human
guggguagcaguuaaucacaugcugauagguaaucaauguggcagauacuguuagugcccac

SEQ ID NO: 1223 - RNA, 91 nt, Human
gugggucugacuugggggccauuuuagaaacugacucugaagaaguuuuuaauucucucauuguugcugaaugccccucgcagggagccac

SEQ ID NO: 1224 - RNA, 93 nt, Human
guggguggaacgugccucugcugcccacccaggggcccugaugugggaaccucacccauggguaaggcagcggggacccaggugugcacccac

SEQ ID NO: 1225 - RNA, 74 nt, Human
guggguggugcagggguggucuuaggagggcuuuccugaaggaguggccaggguucacccaucuuuccacccac

SEQ ID NO: 1226 - RNA, 80 nt, Human
gugguacuucaggaacucuuuuucaaacucacaucacaguacaucuggagauugucuaagaggcagccuccugacaccac

SEQ ID NO: 1227 - RNA, 90 nt, Human
gugguagaguacaaaguggaggaauuacugucuagaaagcaccauuuccagcacucagcacgagguggucuuucccuccacaccugccac

SEQ ID NO: 1228 - RNA, 61 nt, Human
gugguagucuccuaugguggcuggcacgggccucguggcagaagccugggagacugacugc

SEQ ID NO: 1229 - RNA, 67 nt, Human
guggucacgcccacaaucuucagcguggccucucccaggucacuguaggagaugcuguagugaccau

SEQ ID NO: 1230 - RNA, 89 nt, Human
guggucugccaccagcuguccucuucccugaaugccacuuaccguucuuugguggccagagagaaggucuucugggaccuggcggccac

SEQ ID NO: 1231 - RNA, 91 nt, Human
guggugcugaaacgaccggagauaccugacagaugagagccucagcagcuuggcagucucauguccccuuaccucacuugucucuagccgc

SEQ ID NO: 1232 - RNA, 69 nt, Human
guggugcuucgagcuggagggcagcaggugacccucaccacucaugcccccuuuggcuugggggcccau

SEQ ID NO: 1233 - RNA, 77 nt, Human
gugguggaugggccaucagaauauacacuugcuagauaauuuggcuaucugagugaaaugaguuauggaucuacuac

SEQ ID NO: 1234 - RNA, 61 nt, Human
gugguggcagaugccccugugugccuggggacgggauagcauaugggcaggugcaauccac

SEQ ID NO: 1235 - RNA, 75 nt, Human
gugguggcucagacuuauaaucccagcacuuugggaggccauggugggagaagcucaggagucugagaccagcau

SEQ ID NO: 1236 - RNA, 77 nt, Human
guguaaaauuauugcuuaugucauuucuuaagcaguuaugcucuuaaugcuuaaaagaaggcuagcauuguuugcac

SEQ ID NO: 1237 - RNA, 80 nt, Human
guguaaugugguucuagugucgcugcguguucauccucucgagcuugucugucacguaggucacacuagacucugggcac

SEQ ID NO: 1238 - RNA, 71 nt, Human
guguauauguguguguguguguguguguagcuugaagugguccauauguacacacacauauacauauauau

SEQ ID NO: 1239 - RNA, 73 nt, Human
gugucaagccagagauucggggcaguagauaaauguucauuuuacugaugcacuuuaguuuuuggucuguuac

SEQ ID NO: 1240 - RNA, 67 nt, Human
gugucccccaggcuggaaugcaguggcacgaucucggcucacugcaagcuccgccuccuggguucau

SEQ ID NO: 1241 - RNA, 64 nt, Human
gugucccugugucuccccagguaguaauaaggauguccuuuuccuccagguauacaguggguac

SEQ ID NO: 1242 - RNA, 80 nt, Human
guguccgacccaggcuaagcuugagcauggcugagcagugagcccacagccgagcagcuggccagauugcagcggagaac

SEQ ID NO: 1243 - RNA, 73 nt, Human
gugucguugcauguaacaagucuuuuuuacaauuuuauucuaugcuguaugaaauucaguuauaugaguauac

SEQ ID NO: 1244 - RNA, 80 nt, Human
gugucuagauccugccucaggagcuauguguccugaauuuaaaaaucagguauguuauaucccuggggcaugucagacau

SEQ ID NO: 1245 - RNA, 75 nt, Human
gugucugcuugugugcuggcguuucuuggagagauacgguggcugucacccucuucuccaggcacacacagacac

SEQ ID NO: 1246 - RNA, 102 nt, Human
gugucugggaggaguccccuacgccucccugguggccaccauccucugcuucuccgggguggccuuauucugcggcugugggcauguggcucucgcaggcac

SEQ ID NO: 1247 - RNA, 78 nt, Human
gugucuguguuuuaaacauuguuuauuugagacagggucucacucugucaccaggcuacagugcagaggcacagucac

SEQ ID NO: 1248 - RNA, 62 nt, Human
gugucuucggccgccggaaggggggugcguccggaucuucuucuuuuuguggcuguggacac

SEQ ID NO: 1249 - RNA, 117 nt, Human
gugucuuuauaguagaaugauuuauauuccuuuggguauauauccaggaaugguauugcugagucaaaugguauuucugguucuagauccuuggggaaucaccauacugucuuccac

SEQ ID NO: 1250 - RNA, 100 nt, Human
gugugacauggcuuauguguauaauccagcccuuuuggaggucaggauggaagaucgcuugaaccugggaguuugagguugcacugagucaugauggcau

SEQ ID NO: 1251 - RNA, 109 nt, Human
gugugaccuuggcccugugaggcuucaccucuugagccugagaagcagaggugacaguacuggcccugguucuuagcagggggguggcgggcaggguaggggguggcgc

SEQ ID NO: 1252 - RNA, 73 nt, Human
gugugaggaccgaaauuugcccuaugucuauaucccucuaagacggaccugggugcagccgcaguccaagcgc

SEQ ID NO: 1253 - RNA, 74 nt, Human
gugugcggcaguagaaauagcacaggccuuggggacacgcagggcuggguguuaacccugauacugccucaugc

SEQ ID NO: 1254 - RNA, 85 nt, Human
gugugcuacugggggaggcaugggaaagagcuccggugacagaagccaagguucaauucuccccuagauucuccagggagcacgc

SEQ ID NO: 1255 - RNA, 71 nt, Human
guguggcuucggcagggucagccuugcgggugcuuguggacguggguggcuauggcagccggagccucuac

SEQ ID NO: 1256 - RNA, 71 nt, Human
guguguagggauaaggcgugaccacagcuccuugggccuucgagaguagugauuacuaccuuccugcgugc

SEQ ID NO: 1257 - RNA, 89 nt, Human
guguguauguguacucuagacguugucccacgaugagaccccgaaccaugguuccaucaggaugcaucacgaucauuaggcaugcacau

SEQ ID NO: 1258 - RNA, 71 nt, Human
gugugucaucgauauccucauuuucuauggcaccuucagcuacgaguuuggggcagucuccucagacacac

SEQ ID NO: 1259 - RNA, 73 nt, Human
gugugugugcuaggagcuggagcgcuagcacucuucaggugacaauucucaacuccauuuccuccacaugcau

SEQ ID NO: 1260 - RNA, 76 nt, Human
guguucucuccuuuuguccccauagugugacuccgccaggaacuuggaauggcugaagacugugaaugagagucau

SEQ ID NO: 1261 - RNA, 60 nt, Human
guguuggaaaaucuacuacagggaacaaaagcaacacaucuuucucagugguuccaacac

SEQ ID NO: 1262 - RNA, 69 nt, Human
guguuuuagaagcauuugcgguggacaauggaaggcccggcuucaucguauuccuguuugcugauccac

SEQ ID NO: 1263 - RNA, 75 nt, Human
guguuuugcacuguaauaccucggucguagcaaagugccgugggaccgaaguauuauggugcagugacuugacgc

SEQ ID NO: 1264 - RNA, 87 nt, Human
guuaaagccuaggcuagcaauuuuuuuuaguugcaacuaaguaagauauacuacaaacuaaggaugcugcuagacuaaggaauaaac

SEQ ID NO: 1265 - RNA, 72 nt, Human
guuaaagcuuaccgggagaagauugagaaggagcuggagacaguuugcaaugauguccugucucugcuugac

SEQ ID NO: 1266 - RNA, 80 nt, Human
guuaagggugguguaggagaucaaauaaauuauccuuuaacauccagacuauaagauuuugacuucuaccuacccaaagc

SEQ ID NO: 1267 - RNA, 130 nt, Human
guuaauuauucaagggggugucucugccaagagaaagucaccuguggagaagaguucugugucuggacuuggagcacagccacggaugcugucaucugcuuccucuuggcacacacccuugauccaaggc

SEQ ID NO: 1268 - RNA, 64 nt, Human
auucagcggcaguggugcuuucccgaaucucagaaugccuguuaaaagaucacugaaguuggau

SEQ ID NO: 1269 - RNA, 62 nt, Human
auucaggugccucugccccacgcgguguccuggagaagcccgugggaugagaggcccuggau

SEQ ID NO: 1270 - RNA, 60 nt, Human
auucaucuguacuucaauaucuaguuuccauagcaacugagaugcaguuugcaggugggu

SEQ ID NO: 1271 - RNA, 86 nt, Human
auucauggcuagcaccuggaaaugcaguaucucguguauauagcaaaaagauccuggguaguucggaugauacuggaauccugaau

SEQ ID NO: 1272 - RNA, 81 nt, Human
auucauuugauccuucagaaaucacaaggaagaagaaguguuauaacuuauucuccaacaacuggaacuugucaaaugagu

SEQ ID NO: 1273 - RNA, 76 nt, Human
auucuaaacgagggcugguggugaguuugguguuugucucgugucacccucaccccucaccuccucaguuuaggau

SEQ ID NO: 1274 - RNA, 100 nt, Human
auugacauacauccgagaacauucugugguggauccaguggaaaagaaaauggaacuuuguucuaccaauaucacacucacaaauuuggugucaguuaau

SEQ ID NO: 1275 - RNA, 62 nt, Human
auugaugccacuaggagucaauauugguguauauauuaaugauaggcucuuggggcaucgau

SEQ ID NO: 1276 - RNA, 60 nt, Human
auugcauuccaucgcuggggggucgcgcguugugcgguuucuugggguggguagagcaau

SEQ ID NO: 1277 - RNA, 76 nt, Human
auuggaagcugugcaguauaaaauucaaguuguugcuggagcaaauuacuacauuaagguacgagcaggugauaau

SEQ ID NO: 1278 - RNA, 92 nt, Human
auugugggaagauuaucucgauccuauuaugaacaguuuugcagauguuggaaacugaaacuaagagauaucgauugacuuaacccaacaau

SEQ ID NO: 1279 - RNA, 73 nt, Human
auuuaaauuauuuuccuuucuggacuuccaaguccacuuggcaauuuuacuuaggaaaauaucaugcguaaau

SEQ ID NO: 1280 - RNA, 87 nt, Human
auuuacacuuucccauguuacagcacaauauuucaauggaauauuucuugccauaaauaauaucuugcugauuuguagaagugaaau

SEQ ID NO: 1281 - RNA, 84 nt, Human
auuuaggauucucugugugaugaccuuggaugcuguaaagugauucgucauagucucugggguacccauguaguuguagggagu

SEQ ID NO: 1282 - RNA, 71 nt, Human
auuuaucagucuguuuuuccgaugauguguacaugagagaguacaccaugugaagaguagagagaaugagu

SEQ ID NO: 1283 - RNA, 90 nt, Human
auuuauguagcaugccacuaaaagaggcagaaaauuuuuccuuuaacuuaaauuugaauuugucuugauguuuguuugcuuuuuguaggu

SEQ ID NO: 1284 - RNA, 73 nt, Human
auuucccccuccuuugggugaauuccucucuugauuagcucaggaacggaaugugauccaaucugggcaaaau

SEQ ID NO: 1285 - RNA, 73 nt, Human
auuucuaaauuagagagguuaacaagacagaugauuacuaugccucaugugcugugugcucuuugaaaggaau

SEQ ID NO: 1286 - RNA, 99 nt, Human
auuucuuccaucagccugucccuaggacuaaaaugccucauuaguguuauucuuaggaaggcaucuuccuagaucaggcugcaaggaaauggaggaagu

SEQ ID NO: 1287 - RNA, 77 nt, Human
caaaaacaguuagcuguuuacaugcuuccccuuuaaucccagaguuaguuuugcaaacggcaugauuccuguuuuug

SEQ ID NO: 1288 - RNA, 80 nt, Human
caaaagguuuauugaaaugcauguagauaaauuaucaucagcauaaaacuguuauggaguuuucaacauggggucuuuug

SEQ ID NO: 1289 - RNA, 67 nt, Human
caaaauuaacccggcauucccaguuuaauugcugcgugcacggcgggcgcugccgggucaaauuuug

SEQ ID NO: 1290 - RNA, 82 nt, Human
caaacuaguagacugaugagcuggauugcuuagauugauaacauuuacaaauaggaguccaguugacaugcuauuaauguug

SEQ ID NO: 1291 - RNA, 102 nt, Human
caaacugaucaccuggggaugagagcaauggguaacugaagcuuugggcucgggggacaggucagugcccacguuguuguauucccauuuugucucaguuug

SEQ ID NO: 1292 - RNA, 76 nt, Human
caaacuugcuguaggucugcuugaggaucugcccaguccggcggcugccgucuuccagccuccccaucagcguuug

SEQ ID NO: 1293 - RNA, 73 nt, Human
caaagcgaccagcuacauuuaccaaagccugggugauguggagugguacauagagaugaagcuggucgucaug

SEQ ID NO: 1294 - RNA, 63 nt, Human
caaauugggagcccugguuugggcauaaugggucaguuuguucaaccgccggguucccuuuug

SEQ ID NO: 1295 - RNA, 77 nt, Human
caacagaaauuuauuuucucacaguucugguacacuagaaauccagaccgaagugcaggaacauuccauuucugaug

SEQ ID NO: 1296 - RNA, 98 nt, Human
caacaggugcaaguguuaaaggguaugauccuucaguggaacaaagccuccgugucaccugagggauagcaacaugccuacaagcacugcaagaguug

SEQ ID NO: 1297 - RNA, 101 nt, Human
caacccaguaaguguccccagucaaugcuucucuccauaggagaccuguaaaugggcgguggggggaggaauuuucuggucucacacacuauuauggguug

SEQ ID NO: 1298 - RNA, 81 nt, Human
caacggucagacgagucgacacguggcagaaaucaucaucuccucguggaggugaugguugucaugugugggucaccguug

SEQ ID NO: 1299 - RNA, 82 nt, Human
caacucgacggcgcgcaacgugaccuggaagcugggcaggcgacuguacggacccagcucagugagcuucgcugaugacuug

SEQ ID NO: 1300 - RNA, 92 nt, Human
caacugccaccugggagacugcugguaaagaugggagguggccuuugccgcuuuccaucuucucacugcaguuucuucacgugggccacuug

SEQ ID NO: 1301 - RNA, 93 nt, Human
caagaaagccgaggcuggggcugggucagcaaccgaauuccaguuuagaggcggauuuggucguggacguggucagccaccucaguaaaauug

SEQ ID NO: 1302 - RNA, 114 nt, Human
caagaagaacagguucacagaaggagauaccaaaggggauagaaaaaugggaaaaauguccagaaagccauguuccuguuuccuugaguuaucaucugagugauauguuucuug

SEQ ID NO: 1303 - RNA, 65 nt, Human
caagaagguuaucuccucagccaacagagcugugguuggugugguggcuggagguggccgaauug

SEQ ID NO: 1304 - RNA, 65 nt, Human
caagaagguuaucuccucagccaucagagcugugguuggugugguggcuggagguggccgaauug

SEQ ID NO: 1305 - RNA, 63 nt, Human
caagagcugcccaagcggcugguaucugcuacaucaccagcacauuugccagcuguagccuug

SEQ ID NO: 1306 - RNA, 80 nt, Human
caagcggaggugacccugagaguguggcuggggaguaugggcggcacucccucuacaaaaugcuugguuacuucagccug

SEQ ID NO: 1307 - RNA, 77 nt, Human
caaggacaucggcuccaagucugacccacucugcauccuuuuacaggaugugggagggggcagcugggcugagcuug

SEQ ID NO: 1308 - RNA, 88 nt, Human
caaggguguaguauuucauaccgccugaaaugaucagcauuggcacaaaucaaaauucagccgccuuugaaaugcaaaaauaccuuug

SEQ ID NO: 1309 - RNA, 63 nt, Human
caaguaguucaauggcuagcuuuucucauuaucccaaugagaucaagugcuaggacuggauug

SEQ ID NO: 1310 - RNA, 92 nt, Human
caaguugugaccuucccaguccucucuccauuugcagaucagcaagcuucugucagcaaggagggguggacaaugaaacuggguucagcuug

SEQ ID NO: 1311 - RNA, 63 nt, Human
caauuauaaaaauagcgcgugucacucccgcggcgcgcacgaccgccgcgcuauuauauauug

SEQ ID NO: 1312 - RNA, 79 nt, Human
caauugguaacuugaguugugucuuggucaugggagaguauugcauucuugguugaauacauaguuaagauguuaauug

SEQ ID NO: 1313 - RNA, 111 nt, Human
caauuuuauauguucacuugacuggaucaugggguacugagauagaugggaaaacauuauuucugggugugucuguggggauguuuccggaagagauuagcauuugaauug

SEQ ID NO: 1314 - RNA, 79 nt, Human
cacaaaagaaauauuauuacaagguuucagagguagccaauugcauucuuuuggaaaucuacuguacuguuucaaugug

SEQ ID NO: 1315 - RNA, 64 nt, Human
cacaacacugccaugcaacaccuucagagucguuggagucaaguugcaggaucagcagguugug

SEQ ID NO: 1316 - RNA, 68 nt, Human
cacacggcuggguaccgggguccgggaauucuucgggaugucaaauccugguauccuuccccaaugug

SEQ ID NO: 1317 - RNA, 83 nt, Human
cacagaucuugucuugcuggucuuugaucagcugcuccagcuccgcgagcucagccuuuaagggcuccacggcacagucugug

SEQ ID NO: 1318 - RNA, 95 nt, Human
cacagcugcuaaaccaggugcugaaccgggugacagcugagaggaaccuguuugaucguguggucacccuacggcugccuggccuagagagcgug

SEQ ID NO: 1319 - RNA, 83 nt, Human
cacaggauguucccuuuguuggcaaaaacauggacggaacuucugaaacaugugagagaaaccauaaagaggaauacuaugug

SEQ ID NO: 1320 - RNA, 89 nt, Human
cacaggccagggagaaagaggagacagaggaagcaccgaggguggcuacguugucuucccuagaucaauuuucuucuggauggcucgug

SEQ ID NO: 1321 - RNA, 74 nt, Human
cacaggcgaguggagcccaaggaaccccucagcuugcgugcuggguacugguguucuccuggccucaauccgug

SEQ ID NO: 1322 - RNA, 90 nt, Human
cacauauucauacaaaugacuuaguaaucuaauaugagaagugguccuucacuuauauuaggaacuugguaaauauuuguugaaugaaug

SEQ ID NO: 1323 - RNA, 84 nt, Human
cacauccaucauggcuugugcuucuaacuaaaaucaaaggaaugaaagcagaaaaagcacugagaaaaugguaaaacgggugug

SEQ ID NO: 1324 - RNA, 74 nt, Human
cacaugugauugcauuaccuuauguguauuagagacugacuuaagcugcaacaaggugauaaaggugauaugug

SEQ ID NO: 1325 - RNA, 83 nt, Human
cacauuccuguuagcugaggucaccugacucugcuugucguuuuugcacaggcagacgugugcauucuggagagcagggagug

SEQ ID NO: 1326 - RNA, 97 nt, Human
caccaacacaguuuuugaugccaaacgucugauuggacgcagauuugaugaugcuguaguccagucugauaugaaacauuggcccuuuaugguggug

SEQ ID NO: 1327 - RNA, 62 nt, Human
caccacugggugcccgcuggcuacgcuugcaugggcgccaucuuugcuggcaccuuguggug

SEQ ID NO: 1328 - RNA, 60 nt, Human
caccagccuuccuguauagacacuaaauuguuagcaagaguguugagcuaguuccuggug

SEQ ID NO: 1329 - RNA, 68 nt, Human
caccaguaguuuuggucagggguuaauaauauuauuauuauuuuagccaccagggccaggugguggug

SEQ ID NO: 1330 - RNA, 76 nt, Human
caccaucucugaaguagcuuugcaaucuggaagggguacagugucccuucccucaaaggcugcugagcggguggug

SEQ ID NO: 1331 - RNA, 84 nt, Human
caccccguucauguaacacgggccugaggucagcaguagaggaccaguauugguuuuggccccagccucugcguggauggauug

SEQ ID NO: 1332 - RNA, 72 nt, Human
cacccucaccaagguuaaaugccucccucucgguucauccugagaaagaugaguuaauccuuuuuggaggug

SEQ ID NO: 1333 - RNA, 65 nt, Human
caccgcggcccaggacguguggaugcugcuggggggccgccuccucaccggccuggccugcggug

SEQ ID NO: 1334 - RNA, 79 nt, Human
caccuccuaauucacagagggaggaaaguucaaaaugcaggaacuuucacuucccacugugagccuccaagggagugug

SEQ ID NO: 1335 - RNA, 74 nt, Human
cacgcagggcccaugagaggacacccaguacauccugacccaaugacaucggcgugucuaaccuggacugcgug

SEQ ID NO: 1336 - RNA, 85 nt, Human
cacgccaugaccuucacugcugucucagagaaggaugaucaggauggugcuuucacaaaauggagaguggagaauucauggggug

SEQ ID NO: 1337 - RNA, 71 nt, Human
cacgccuuugguuacuugggguggaacaaguuaacaaaccaguuuuuuugugacaugguuucaaaggccug

SEQ ID NO: 1338 - RNA, 102 nt, Human
cacgcgucuuuguggucaccuggcuuaggaagcucacaagguccucaucauuuggagguguuucccugugagugcccucagcccuaggcuuucuuacgugug

SEQ ID NO: 1339 - RNA, 76 nt, Human
cacggaccaccgcgggguccccggcaagccuggaagaguugugacucuuguugaagauccugcgguaugggaugug

SEQ ID NO: 1340 - RNA, 101 nt, Human
cacguuaauccugguggcuucucuaggugucguugugugcgguccucuuguuuggcugugcgugugaacacgugugugaguucaccauguacuguacugug

SEQ ID NO: 1341 - RNA, 108 nt, Human
cacguugccuaacgucagauauguacagaaaaauaagaguuguacuaaacgacuauauugcucuuguugauccuuucuugaacuguauuugcgugucuuaggagcgug

SEQ ID NO: 1342 - RNA, 72 nt, Human
cacucccgcggcucacucugcccucgucacggugccacuggcucccuggcacagacauugcggcgggaugug

SEQ ID NO: 1343 - RNA, 84 nt, Human
cacucuguaauaaagaacuuggaaagggagguuccaagauggccaaauaugaacagcuccagucuacagcccccagcgugagug

SEQ ID NO: 1344 - RNA, 74 nt, Human
cacucuguuacccaggcuggagugcagugguguaaucucagcucacugcaaccucuaccuccuggguucaagug

SEQ ID NO: 1345 - RNA, 84 nt, Human
cacugaguguagacaaguccuccagcacagccuauauggagcucacuaggcugacaucugaggacucugcugucuauuucugug

SEQ ID NO: 1346 - RNA, 95 nt, Human
cacuggugagguggauugaugaugaaucuucugacacaccuggagcaacuccagaacacagucacgaggauaaugggaauuuaccgaaacccgug

SEQ ID NO: 1347 - RNA, 61 nt, Human
cacugugcugucagauguccaccucuauaccccgaaccauagacaucucaugguacggcug

SEQ ID NO: 1348 - RNA, 94 nt, Human
cacugugggggcggugagaacgcuguggacacugaggacgcugugggggcggugagggcgcuguggacgcggugaggacgcugugggggcggug

SEQ ID NO: 1349 - RNA, 75 nt, Human
cacuguuuccuccugcuauuagcccggguaacucagcugauccguggcuuugguaguuccuggaaaucaucagug

SEQ ID NO: 1350 - RNA, 80 nt, Human
cacuucucugagugaagcugaggagaaggcuguaaaucugccaaaacagccuugaaguauucuuuugucaugaggaagug

SEQ ID NO: 1351 - RNA, 82 nt, Human
cagaaaagaggguuugaugauaaggauggcuauaccuuggggagaacuuaguggaguugaagaucagccagaucccucucug

SEQ ID NO: 1352 - RNA, 91 nt, Human
cagaaacagauccaccuccagguacgugguggacgaaugggagcagcuggcugcuggccccacgcuuaccaaccuugaguccacauuuuug

SEQ ID NO: 1353 - RNA, 67 nt, Human
cagaaaggacaucacagguaaacugaaggacccugcgaacuuucaguauccugccgagucuguucug

SEQ ID NO: 1354 - RNA, 83 nt, Human
cagaacuggagaaugaacugaacacaaagugaaagaaaaugaggagaacacuuuguauuuaccccaaaaucuuuucaguugug

SEQ ID NO: 1355 - RNA, 69 nt, Human
cagaagacugcugguuuugagauaaugccaaacgagcauggccucgucugauccuacguucuacuucug

SEQ ID NO: 1356 - RNA, 80 nt, Human
cagaagauucagacacacuugcaauguauugcuggggauucuccagcauuggcaugauggagaggguggagaaucauuug

SEQ ID NO: 1357 - RNA, 95 nt, Human
cagaagucauuuguggaaacgggcauugugagaaggcguuaccauuaguuacaaauguuacugcuagaacggagugaacggcacaggugaaaaug

SEQ ID NO: 1358 - RNA, 81 nt, Human
cagaccccagacacccauuguccauagccuucucagggcagagugggcugguuguguugacaauaaaacaguguugguuug

SEQ ID NO: 1359 - RNA, 80 nt, Human
cagacuacaaagugacagucaccugguaaguccuguaugguaggaaguggguguggcucucggguccuaaauguggucug

SEQ ID NO: 1360 - RNA, 70 nt, Human
cagagacuguccuuugcaaaggaaaugaccagcauuucaacuguaugucuuccuggaaggguagauucug

SEQ ID NO: 1361 - RNA, 71 nt, Human
cagagaucagaauacgaagcuuccucucagcaucaugggaggagauaaaauaauucauucuauggucuuug

SEQ ID NO: 1362 - RNA, 82 nt, Human
cagagcucagagcagcuccugcauguuaucuaccagcgggucgauaaggcaguggguuuggcugaagcugcucugggucuug

SEQ ID NO: 1363 - RNA, 72 nt, Human
cagaggaggcgacuguugauuugaaauuccuaaaaaugacguaguagucccggauccuuaguuggcuuccug

SEQ ID NO: 1364 - RNA, 130 nt, Human
cagaggagucuggauuuuaaguccuugugcacggauggucucaagugaucaggauaguguggucgguacacccaaagcuugugaaugacuccauccaaagagcaucagucuguauucccaugacccccag

SEQ ID NO: 1365 - RNA, 71 nt, Human
cagaggucugucuauccugcccuggucuccuccaccccaggagaguuuucaaagguagagaggacccuuug

SEQ ID NO: 1366 - RNA, 130 nt, Human
cagaguggcacauccuacugacacuguccuauggagaguuacagugcaggaaaccugaacccagcucucaggucccucuggaacuuuggcucuucuuuguuuugucucagugagugauuugggcccucug

SEQ ID NO: 1367 - RNA, 112 nt, Human
cagaucaguagugacaugagauuuucauaggagcagaaacccuauugugaacuccaaacacaagggaucuagguuaugcacuacuuaugagaaucuaaugccugaugaucug

SEQ ID NO: 1368 - RNA, 75 nt, Human
cagaugaccaagcgagacgugccuggcuucgccaucgggggccugagcgggggugagagcaaagucgcaguucug

SEQ ID NO: 1369 - RNA, 76 nt, Human
cagaugcccccagucccuguguguucugcaagacuugcucuugaggaggaagaugcaccucacuaaggcucaucug

SEQ ID NO: 1370 - RNA, 63 nt, Human
cagaugggcucuuugggcuuugggagcuggcuucaccuggcuacucccgagucuggcccucug

SEQ ID NO: 1371 - RNA, 108 nt, Human
cagauugcacgaacauuucauuuuucacacagggucaccagaauaccaucaauuuuuugguaucacugucaaaagugauccuagcaccuucugaaauaacgugagcug

SEQ ID NO: 1372 - RNA, 80 nt, Human
cagcaaguggucaagucaccaaugauguacauauguugcuaaaucaaacagauuucccaucuuacuugaccucucagcug

SEQ ID NO: 1373 - RNA, 82 nt, Human
cagcaccucggcccagguauggccagacgaggggcuggccugcauggcuggauggccccccgugcccugggccacugugcug

SEQ ID NO: 1374 - RNA, 77 nt, Human
cagcaugaucaagaaugacaccucuggcgaguacaagaagacucugcugaagcugucugggggagaugaugaugcug

SEQ ID NO: 1375 - RNA, 112 nt, Human
cagccaggccaggacccgggcuugccaagagcagaggcccucccagcaaccaggauaccaccacuuugggggcuuuguguacagagguccgggucugagaccucauaggcug

SEQ ID NO: 1376 - RNA, 100 nt, Human
cagccccacucccuguucccuacccauauaggcccuaaauuugggaaaaaucacuauuaauuucugaauccuuugccuguggguaggaagagaauggcug

SEQ ID NO: 1377 - RNA, 112 nt, Human
cagccccgcagguuuuuggcgaugaugacguccgucacagcaucaaagacaaacuggauguuguugguguccguggcgcaggugacguggguguagaucucuuugugggcug

SEQ ID NO: 1378 - RNA, 76 nt, Human
cagccuaacuuccuagugugcaucaggcaagaugagcaggcaccaucauguaaagagcaccuugggguguaggcug

SEQ ID NO: 1379 - RNA, 78 nt, Human
cagccucuccccuucuggggucucgggaaacacgcgguaauuaccgaagaaccccgcacucugugagaggcgaggcug

SEQ ID NO: 1380 - RNA, 62 nt, Human
cagccugcaaguggaagagaagaacuugaacccagguccaacuuuugcgccacagcaggcug

SEQ ID NO: 1381 - RNA, 77 nt, Human
cagccuguuggucccgcuugcagggguguccuuccccagggccgguggggcuuucuugauggcggggcagguggcug

SEQ ID NO: 1382 - RNA, 78 nt, Human
cagcgagcgcggucguccuugguggaaggaaccaugaacuggcaucucccccucuuccucuuggccucugugacgcug

SEQ ID NO: 1383 - RNA, 77 nt, Human
cagcgcugcccagauagcagcacgguaugagcaacucaacauccaucuucguaucguuccgccugggcgggauucug

SEQ ID NO: 1384 - RNA, 67 nt, Human
cagcugggcccgggggaccacuaccaccaaaaugcggggaccgguaguggccccaaaugucuggcug

SEQ ID NO: 1385 - RNA, 64 nt, Human
cagcuguggacuuaccggcaaggcuacgaugucagcauuccugucuauaguccacugucagcug

SEQ ID NO: 1386 - RNA, 130 nt, Human
cagcuguuaucaccugcuaguugugugagccugagcaaguuacucuaccaaucuguggcucaguguccucaucuauagaauggggagaguaacaauagccaccucauagggcagcggugaagauucagug

SEQ ID NO: 1387 - RNA, 85 nt, Human
cagcuuccauguccagaggaagccaggcgucuccuguaggaaaugucuuucuuguaggcucacucaccauugcacagggaagcug

SEQ ID NO: 1388 - RNA, 73 nt, Human
cagcuucuccuuccgggacagcuccaccuguuccucguccaugguggugucgaugggccggaaguaggacaug

SEQ ID NO: 1389 - RNA, 105 nt, Human
caggaaaaagaggugcuggagagagucgagaaagagaaaauggaacgugagaaagacaacggcauccguccucccagucucgagacugccaguccucuguaccug

SEQ ID NO: 1390 - RNA, 75 nt, Human
caggaaaagcacuuguguuauuauuagaguugcaugcugaacuagcugcuuuuuuauggaauacuauuuuaccug

SEQ ID NO: 1391 - RNA, 80 nt, Human
caggaccauagaugauacaugucagugcuguggaaugugcauucucugaguguuguuuugugguaucauugucuuuccug

SEQ ID NO: 1392 - RNA, 71 nt, Human
caggagcuaguccagcaggucuugaguuuggcaacucagcuaaagaaguagaccugucugagcugccacug

SEQ ID NO: 1393 - RNA, 85 nt, Human
caggaggccaugagccaaggaaugcaagcagccucuggaaguugaaaacgacccaagugcucaguccuacagcugcauggaacug

SEQ ID NO: 1394 - RNA, 72 nt, Human
caggaggcugaaaugggaggaucacuugagccugggaggucgaggcugcaaugaguccuaauugagccacug

SEQ ID NO: 1395 - RNA, 96 nt, Human
caggaguacgacgcugugguagcuaugaucaugccacugcacuccagccugggugacagagcaagaucuagauaauuacacucuguccugcuccug

SEQ ID NO: 1396 - RNA, 60 nt, Human
caggauaauaauauggggucuuguccuucaccuuuuaaguucaggcaacaguuuguccug

SEQ ID NO: 1397 - RNA, 74 nt, Human
caggaugucucugugagagaagggagcaguucgguggcaccuugcccaggcucaguccuggcacaguuauccug

SEQ ID NO: 1398 - RNA, 76 nt, Human
caggcaaggaagaugcugccaauaacuaugcccgagggcacuacaccauuggcaaggagaucauugaccuugugug

SEQ ID NO: 1399 - RNA, 62 nt, Human
caggccuucuucucuuaaucacaagauccuuucaggcauuuacucuugagggaacaggucug

SEQ ID NO: 1400 - RNA, 68 nt, Human
caggcucgugggacuguacguggacccgcaaggccggagggcacgcgcgcaggagcucauguggccug

SEQ ID NO: 1401 - RNA, 94 nt, Human
caggcuggucuugaauuccugagcucaaaugauccaccugccucggccucccaaaguucugggauuacagguaugagccagcauguccggccug

SEQ ID NO: 1402 - RNA, 67 nt, Human
cagggacagaaggcagcucccuucccccaggaagggcaagaggagacaggugccugggcugucccug

SEQ ID NO: 1403 - RNA, 78 nt, Human
cagggacaggccagcugauauuggccauuggcacaggaucuugucugucugggaaagauaucggugagacuguuucug

SEQ ID NO: 1404 - RNA, 90 nt, Human
cagggagaagagcugugugcugugaugugguuuauaaauuaccauuuggaaggagcugcacagcacagcagccugcaacuacucuuccug

SEQ ID NO: 1405 - RNA, 91 nt, Human
cagggagaggaaaggaggggcaaagaggugagggacaggggggacaauggcuuucccucuguccccugccagcucccccagcugcacccug

SEQ ID NO: 1406 - RNA, 81 nt, Human
cagggcagaagcaugaaaggacaccaaccacgagugacacacuauacuauggcuguccugugucacaugcuauuuggccug

SEQ ID NO: 1407 - RNA, 61 nt, Human
cagggccuggaguccugggggagcucagccagcucugccuuucucagggccuggaguccug

SEQ ID NO: 1408 - RNA, 78 nt, Human
caggguacauugaagaccuuaagaaguuucuaaaaccauauacuuuagaagaacagaagaaccucacagucuguccug

SEQ ID NO: 1409 - RNA, 60 nt, Human
caggguguugccauguugcccaggcugguuucgaacucuuggcaucaagcaauccuccug

SEQ ID NO: 1410 - RNA, 72 nt, Human
caggugauugagcaggaaaccccagugagugcaaaauccucucgcucgcagcuggacuuguuugacgaugug

SEQ ID NO: 1411 - RNA, 75 nt, Human
caggugcacucuauucaagugcaaggauaucagaaguuuuugcaucaacaaauuuucgagauggaguucacucug

SEQ ID NO: 1412 - RNA, 81 nt, Human
caggugcugcugagcgagcccgaggaggcggcggcucuguaucggggccuuagucgccagucccgcgcugagcgccgccug

SEQ ID NO: 1413 - RNA, 77 nt, Human
cagguggcgguggcgcggcggcagggccuggcucuggccagggcgaugggcuuguagggccggcggcagcacgcuug

SEQ ID NO: 1414 - RNA, 101 nt, Human
caggugggucuccuguucccagugcuacccugcauaacggccuccuucccaggcucuggggcagagcacgacggguaggcuggaacgggcugccgcagcug

SEQ ID NO: 1415 - RNA, 89 nt, Human
cagguguggacuaccaugccuggcuaauuuuuguauuuuugguagaaacaggguuuuaccauguuggccaggcuggucuugaacuucug

SEQ ID NO: 1416 - RNA, 65 nt, Human
cagguguuccgggccccuucaccuggggcucaagugagagcagguguucugggccccuucaccug

SEQ ID NO: 1417 - RNA, 75 nt, Human
cagguuccacaaguuccauuaccuggccuuugugcccucagcagaggaccucuaugacugcaggguggagcacug

SEQ ID NO: 1418 - RNA, 104 nt, Human
cagguucuucugagagucuugacagagucuucuucccacgcugcucaugugaccucacuuccagugcacaccuggaaacucugcaugggucucagugggcccug

SEQ ID NO: 1419 - RNA, 63 nt, Human
caguacagcuucuggcucuaugagcucugugaugucuacuuggagugccugaaaccuguacug

SEQ ID NO: 1420 - RNA, 85 nt, Human
caguacggaugugcgggcaggcgucauagauagggaugccuggguggccuggucauggcugauccugcuuguguaugacagacug

SEQ ID NO: 1421 - RNA, 99 nt, Human
caguauauuugagugaaugauuauauguuuaaaaaguuacaugggggcuuuuuugguuguccuaaacuuacaaaacauuccacucauucuguuguacug

SEQ ID NO: 1422 - RNA, 110 nt, Human
caguaucaugauguauaugagggcuaacccauugugguuuacuuaaaaauuaguuuaaguggaguuagaaguggguuauuuuccucuggugaaaauuauggacauagcug

SEQ ID NO: 1423 - RNA, 80 nt, Human
cagucacuacuuauuugcauuauuccugcauauucagugaaugugaggucauauuugguauuguauuagaaguaguguug

SEQ ID NO: 1424 - RNA, 67 nt, Human
caguccaaaccggaagggcagaauuuauuuuugggaaacugaaggaagucccgaccuuccuggauug

SEQ ID NO: 1425 - RNA, 108 nt, Human
caguccagaguucaagaccagccugggcaacauggugaaaccccaucuauacaaaaacucggcaaggcaugguggcaugcaccuguugucccagcuacucaggggcug

SEQ ID NO: 1426 - RNA, 78 nt, Human
cagucguacaggguacagaauaauucuucguuguguggcacuaacccacacacugcaggacaucguucucccuggcug

SEQ ID NO: 1427 - RNA, 101 nt, Human
cagucuugguuacaaguaugauccuucuguagucuuuuaggggagguuggcuccucugaagucuuacuuggaagacagauucauaaagugccacugggcug

SEQ ID NO: 1428 - RNA, 63 nt, Human
cagugaagcaggauguauguggccuugaggauaaccugcacuggucuaccuucugcuucccug

SEQ ID NO: 1429 - RNA, 80 nt, Human
cagugaugucagcauucauacugccaacagucugcuggucauacauggaagacuguuaaaguguggucugugcaucauug

SEQ ID NO: 1430 - RNA, 76 nt, Human
caguucauggaggggauacaagacggaauauuugguagacaauaaaguucacgcaagaagacccuuugguauacug

SEQ ID NO: 1431 - RNA, 87 nt, Human
caguucucgcuguuuuaaaauccgucccuucguuguuggcuaggcucucuccagggaaacuagccggggcaagaggcaggggaacug

SEQ ID NO: 1432 - RNA, 81 nt, Human
caguucugauggggcuccaacagccaggcugugguccuuugacguuccucaccuguugccaaccuaucccguagugaacug

SEQ ID NO: 1433 - RNA, 82 nt, Human
caguucuucugggagaaaaauggcaggcuucuggggaaagaaagccagcugaauuuugacuccaucuccccagaagaugcug

SEQ ID NO: 1434 - RNA, 72 nt, Human
caguugauuauggcaagaaguccaagcuggaguucuccauuuaacccagcaccccagguuuguccacagcug

SEQ ID NO: 1435 - RNA, 78 nt, Human
caguuggucuuggcacucaaccagcuucgccuccgugaucuucaggaugucagggagcugcugcaggucaaccagcug

SEQ ID NO: 1436 - RNA, 73 nt, Human
caguuucuagagucuguugccaacauguuugcagcugcucagcagcucucgcagaacaucaguucagaaacug

SEQ ID NO: 1437 - RNA, 94 nt, Human
cauaaaaaucccuguguccuaaagucauggcgugcucuauuucauggucauuuguagagcacagcagcacugugccugucagggaaaaggugug

SEQ ID NO: 1438 - RNA, 102 nt, Human
cauaaggagcuuugacaaggacccacugucuggccccaucuucagagauuccaauaggucuggggugugcacaggcacuggcgucuuuaaaaucucccugug

SEQ ID NO: 1439 - RNA, 76 nt, Human
cauacacuauacaagguuuguugaauacuaguuucuuuggaaccauagggaaagcuuugcucugggucaguguaug

SEQ ID NO: 1440 - RNA, 87 nt, Human
cauauaaaaguauuacacaauucuguucagcacaugauucuugauaauaaaugacuauguuauaggguuauguauacuuuuagauug

SEQ ID NO: 1441 - RNA, 85 nt, Human
cauauagucugcacaauucaauaugaacguuuuauuuccaacaaguauguaguucacuguuccaugacuugugcauaacaauaug

SEQ ID NO: 1442 - RNA, 66 nt, Human
cauauaugucugguauucuuggggucuaguagucuaguauaauacacauagccuaggacauguaug

SEQ ID NO: 1443 - RNA, 130 nt, Human
caucaaagaauaaauaagcugcucuaauugccaagaauucacaugugguuguaugcagcauuacugggaaauugaaguguaucugcaugugauucugcugugauggacacuuguaaguuuguuccuggag

SEQ ID NO: 1444 - RNA, 130 nt, Human
cauccaggcagguguuucgacaauggcagcaucuacaacccugaagugcuuggauaucacagaggagaacucugcauucucgcuuccuggagggguguucgcaauguugccaguguucugucugcagaug

SEQ ID NO: 1445 - RNA, 75 nt, Human
cauccauggauuuugguauagaggagggguuuaagggguguccugcaaucagucccccucucauaccaaaggaug

SEQ ID NO: 1446 - RNA, 80 nt, Human
cauccccaaggagaacuucaguugcuugacucguuggaucacaacgagcuaaagcucaaauugcucuuaaacuuggugug

SEQ ID NO: 1447 - RNA, 72 nt, Human
caucccuaacacaaauccagggacuuuguuucuuaaccuuaaaauuggaaacacuucuugcuaccagggaug

SEQ ID NO: 1448 - RNA, 121 nt, Human
caucccuuuuuccuauauugaagacauucagccugagcacugaaguucaucuugcaaucaaugccacucaaauuucuagugcuuuucaucucugaacucuuuaacuguggaaauagacaug

SEQ ID NO: 1449 - RNA, 73 nt, Human
cauccuccugcagugccuccaagaccacagcccucacaggcuccugguccugcugugcaucgcccaguggaug

SEQ ID NO: 1450 - RNA, 62 nt, Human
caucgucaccaaggcacgggggaagagugacucacucuucaacuuugauguucaugacgaug

SEQ ID NO: 1451 - RNA, 61 nt, Human
caucgucaugaacaucaaaguugaagagugguccaucuucccccgugccuuggugacgaug

SEQ ID NO: 1452 - RNA, 97 nt, Human
caucuauuuaagcugaagacaacaucaugggaguuagggagauuucggagugcgauugagcuggacacccccucuaugacugcagagcaaguagcug

SEQ ID NO: 1453 - RNA, 65 nt, Human
caucucacuaagugcugaucaguuuugauucaguuggaguagagcacauagguucuuuggagaug

SEQ ID NO: 1454 - RNA, 77 nt, Human
caugaaagaagccugguuacugauuuguauaaaauguacucuuaaaguauaaaguauaagguaagguaaauuucaug

SEQ ID NO: 1455 - RNA, 63 nt, Human
caugaaucacgacuguggacgacaaugugccugugguggucaauguuccauucccgauucaug

SEQ ID NO: 1456 - RNA, 73 nt, Human
caugauccaugucuucacugcuacagucuggcucaaaauaaaugccuucuuuauagaacaggaaggacucaug

SEQ ID NO: 1457 - RNA, 65 nt, Human
caugcaagcauauuuuucagcaaguacagaaucugugcaacucugcagaaauggcuaagugcaug

SEQ ID NO: 1458 - RNA, 96 nt, Human
caugccaagcacgguucagcucccugcggccaagucgaaauguggucuucagcaucaucgagcauuucuggagggagcugcugcugucucagccug

SEQ ID NO: 1459 - RNA, 85 nt, Human
cauggcuuacuggguaaagcucagcuguacuugacagucaacccggcuccucgggacauggccugucaggugcagccccaccaug

SEQ ID NO: 1460 - RNA, 87 nt, Human
cauggcuuauguguauaauccagcccuuuuggaggucaggauggaagaucgcuugaaccugggaguuugagguugcacugagucaug

SEQ ID NO: 1461 - RNA, 70 nt, Human
caugggaaacaaccugaaaaagcaggcaggccucccggucagggagccucugcugugcuggcuucccaug

SEQ ID NO: 1462 - RNA, 62 nt, Human
caugugaugauaauggucuucucgccaucccaagauggguuggcagccaugaucuuugcaug

SEQ ID NO: 1463 - RNA, 78 nt, Human
caugugucaugggaggaauguagugggaaguaauugaaucaugggggcaguuaccccaaugcuauucucgugauagug

SEQ ID NO: 1464 - RNA, 96 nt, Human
caugugugcauguguacaugcaugcauguguguaugugugcauauggggaugugugugcguguguuggagugugugugugugcgcguguguguaug

SEQ ID NO: 1465 - RNA, 71 nt, Human
cauguugaaugcacaaaagcaacagguccaguuuaugcuaaaggaauuugaagcacgcaggcaacagcaug

SEQ ID NO: 1466 - RNA, 131 nt, Human
cauuaaaacucaccaucaaauagauguaaucuuauuaauuacacauuuuguauuuuaauuauuucaaggagugaagaaaacaggguguuuuuguuuuuguaguucugauuacucauuuaugcauuguuuug

SEQ ID NO: 1467 - RNA, 86 nt, Human
cauuagauucucauaagagcccaaacccuauugugagcugcacaugcaagggaucuagguugugcgcuccuuaugagaaucuaaug

SEQ ID NO: 1468 - RNA, 80 nt, Human
cauuauguagaauggaaugugaaacaucauccucgcuuaaaacaggauuuugccacaauuauuucacauauuauguagug

SEQ ID NO: 1469 - RNA, 70 nt, Human
cauucugagucuuucuggaugaacuuggcuauaucugaaaucugcuaucugagugaggacuccaagaaug

SEQ ID NO: 1470 - RNA, 77 nt, Human
cauucuggauuuggucgauugcuucuuuuuaguaucuuuaacuuauuagaucucaaacucagcugcacaucagaaug

SEQ ID NO: 1471 - RNA, 71 nt, Human
cauugacaagacaggguucccacugacaagaccacaauuuaccagguugcugcucaaacgaacccccaaug

SEQ ID NO: 1472 - RNA, 77 nt, Human
cauugacucagcacaccagguaugucacagcuugugcuuuugcaccuaauacccuuuuacuugcuacugggucaaug

SEQ ID NO: 1473 - RNA, 83 nt, Human
cauuggagaaaacaggaggagauguuaaaguaacccaucuugcaggacgacauugaagauuggucuucuguugaucuaagaug

SEQ ID NO: 1474 - RNA, 75 nt, Human
cauuguccccacugcauugccaucuugaagauuugucacacucugacaggagaaggcuuguuuggcaugacaaug

SEQ ID NO: 1475 - RNA, 63 nt, Human
cauuuccaacaggacauggagggaaggcuuccuaagggaagacuuccugucccaaaggaagug

SEQ ID NO: 1476 - RNA, 72 nt, Human
cauuucuggcccccugcaugccacccagaaugcaugcggcgcccaggaugcaugcuguggggccauugaaug

SEQ ID NO: 1477 - RNA, 103 nt, Human
cauuuuauuccuaggguugcuuuugcuuuaguuuguaaaacguucuuauuuuuaugauaauguaguauauacuaaauaaagaaaaaucaggaaguagaaaaug

SEQ ID NO: 1478 - RNA, 77 nt, Human
cauuuugacuuuguuggcauaaugucaguaacauacauauuccagugguuuuauggacaggcaauuuagucauuaug

SEQ ID NO: 1479 - RNA, 72 nt, Human
ccaaaaauccaucucaucaccuagagagcauguacuggcagaacugucuaaagugacuauuuggaacucugg

SEQ ID NO: 1480 - RNA, 77 nt, Human
ccaaacaccaauggcucucaguucuuccugacaugugacaagacagacuggcuggauggcaagcaugugguguuugg

SEQ ID NO: 1481 - RNA, 65 nt, Human
ccaaacugaauaaauagcaucccucuccccacgagagcuaggggagacucaugugcugaguuugg

SEQ ID NO: 1482 - RNA, 85 nt, Human
ccaaagcaaccaguaauucuuuuugaaagugcaggcauuuauuuugagcuguauuucauaggaguuucauuugguuugguuuugg

SEQ ID NO: 1483 - RNA, 72 nt, Human
ccaaauaaauuaaaaauguuuuaaagcccugaguucauagacugguuuuaggagauuuuuaugacacacggg

SEQ ID NO: 1484 - RNA, 60 nt, Human
ccaaauccagcaguucugucagcaaaggggagcucuuuuuaucaauaacuggugcugugg

SEQ ID NO: 1485 - RNA, 72 nt, Human
ccaacaggaugccacgcugggccgagcgacuauuuccugccaauguugcucacucgguguacguccuggagg

SEQ ID NO: 1486 - RNA, 78 nt, Human
ccaaccacauggcacaucgggcuauuugaacacggugacugucucucccagauggaucccucugugcuucuuggacgg

SEQ ID NO: 1487 - RNA, 83 nt, Human
ccaacgucuguucauggcugugguuuuaaaagagucccucaacagaugcucuauuuaauaaccaguuuguaccucagaugugg

SEQ ID NO: 1488 - RNA, 103 nt, Human
ccaagaagcuugagagaagaaaaauuucagaaaaauugucucaauuugacuagaauaucaaugaaccaggaaaacugaagcaccuucccuaaagaaaacuugg

SEQ ID NO: 1489 - RNA, 90 nt, Human
ccaagaccaacaggaugccacgcugggccgagcgacuauuuccugccaauguugcucacucgguguacguccuggaggacucuauugugg

SEQ ID NO: 1490 - RNA, 65 nt, Human
ccaagcacauuacaggggaccugauugcuacacguucagaaugcguuugcugucauccugcuugg

SEQ ID NO: 1491 - RNA, 91 nt, Human
ccaaggcgccuuuguuggggguccgggaauccgcggugugccaggucggaaaaggcguccgcuuuccuggagaggaggcuaaggugccggg

SEQ ID NO: 1492 - RNA, 72 nt, Human
ccaaguucauugagguaucuaaagaggcccggaagcgguuccugggcccccugcaccccuccuucaaccugg

SEQ ID NO: 1493 - RNA, 77 nt, Human
ccaaguuuaauuuauaggcuuucguggacuucuggaagucaacugacuucgaaguuaggacagcauggggggauugg

SEQ ID NO: 1494 - RNA, 74 nt, Human
ccaaugggagguuuguguacagucagugaaauugaagaacauuuaugucauuaauggacuuacauagcuauugg

SEQ ID NO: 1495 - RNA, 98 nt, Human
ccaauuccugaauucaguaagcaaguuacaauucaaaaaggaagaagaguaaaaaccuuuuauugacagugacuuugccacugaauucaagggaaugg

SEQ ID NO: 1496 - RNA, 78 nt, Human
ccacacacacuuuugccaguucccccuggugaaccauaauacacacgugggagacagcuggcaucaucugagucuugg

SEQ ID NO: 1497 - RNA, 94 nt, Human
ccacagugggggugcccgggcugggucccacuggggaagcucaaggcagcccuggccuuucccucauucuccacccagucaggccccugcgugg

SEQ ID NO: 1498 - RNA, 98 nt, Human
ccaccauggugcggccgguggccgagagcggggccaccaagaccagccgcgucuacggcuucaucggccucugcuggcugcuggccgcgcugcugggg

SEQ ID NO: 1499 - RNA, 74 nt, Human
ccaccggccuggccuugccugcagacuauaaacuauaaccauagcucgacacagucugcaguccaggcgugugg

SEQ ID NO: 1500 - RNA, 62 nt, Human
ccacgagagaacauggguugacccgaaucaccggugauucuuggaggacccauccuuugugg

SEQ ID NO: 1501 - RNA, 85 nt, Human
ccacggcggggccaagcuggccugaaaggcaccugggaagacucacuggaaggaaaggcacgcgggccgguagggcugagccggg

SEQ ID NO: 1502 - RNA, 84 nt, Human
ccacucaugaacccucacauccgcgugggccccuccugagcccccuugcuuguggcuaggcagccuaggauguggguucugugg

SEQ ID NO: 1503 - RNA, 84 nt, Human
ccacuugauguucagugaagagaaccagaaaaagucuguagagcaguaccaucugggucucaucaaaaaggagaaauaacgugg

SEQ ID NO: 1504 - RNA, 77 nt, Human
ccagaacaaccugcagcagacuccacuccacuuggcugugaucaccaaccagccagaaauugcugaggcacuucugg

SEQ ID NO: 1505 - RNA, 82 nt, Human
ccagaagacuguggauggcccuccgggaaacuguggcgugauggccgcggggcucuccagaacaucaucccugcucuacugg

SEQ ID NO: 1506 - RNA, 61 nt, Human
ccagacccauucagccccuuccgcugucuggggugggguuaaggggcacaaugggaaaugg

SEQ ID NO: 1507 - RNA, 119 nt, Human
ccagacuuccccaucuccacgccucucugaccacuuuugcagcagaaccacuauuuucuagguuagcaguucucaacugugggugaguuugccccuuggagacauuuguugaugucugg

SEQ ID NO: 1508 - RNA, 95 nt, Human
ccagagauagcaccuucugacccagugcagauuggacgguuaauugguagguuggaguugagucucacguugaaacagaaugaagugcuuccugg

SEQ ID NO: 1509 - RNA, 66 nt, Human
ccagaggaagagcgcuucgagcuucuucaaggaacuuagagaagagcggcauugugcuccuucugg

SEQ ID NO: 1510 - RNA, 106 nt, Human
ccagaggcugugaccauggcuaguagacaguggcaacauagucauccccaagaugcuaaucuucugcuggaacugucauacguuaucauggucaauguaaaccugg

SEQ ID NO: 1511 - RNA, 85 nt, Human
ccagaugaagaagaucuagaacgacuucucuuucuguuccucucaggagaagaugaugaacuugaauaagaucuuuuucgugggg

SEQ ID NO: 1512 - RNA, 60 nt, Human
ccagauugccucguuaaauccuuaaccuuggugaaaugguuugggaaaaugcaggucugg

SEQ ID NO: 1513 - RNA, 103 nt, Human
ccagccaccaagaugcaugaggggcagggucaccaucucagaaggggaagcacaggaaugugauugggaugguuaaaccucucuucuccucccuuugugcugg

SEQ ID NO: 1514 - RNA, 93 nt, Human
ccagccugacguaggugggcagcaccagcugcagggugggcuggcucucguugcucagcucgaugacugccugcuucaccggcgucaggaugg

SEQ ID NO: 1515 - RNA, 71 nt, Human
ccagccuggugaugcagcaggugucacagaaggacccugucccagcugguccugcuccacugcuaggaugg

SEQ ID NO: 1516 - RNA, 84 nt, Human
ccagcgcccaaggaaggccacuucucaacuggcagaacuucugaaguuuagaauuggaauuacuuccuuacuagugucuuuugg

SEQ ID NO: 1517 - RNA, 76 nt, Human
ccagcugugugugaggaggaccugaugcccgaggaugaccagcgggccacgcgcaaccucuucauugguaaccugg

SEQ ID NO: 1518 - RNA, 75 nt, Human
ccaggaacugaugguggagucacacaggcuacuacuucacugaaagggccugcacccacaagacucagagccugg

SEQ ID NO: 1519 - RNA, 83 nt, Human
ccaggacccucaucuuccagggcugaguguggguggaucccaggauggggcccaggcagcccaggaugggaggagacaccugg

SEQ ID NO: 1520 - RNA, 79 nt, Human
ccaggaggggaaacaggcacgcucauuucggcaacacacaacgcgcaagggauagagcgggcuuauaaacccucugugg

SEQ ID NO: 1521 - RNA, 100 nt, Human
ccaggcggagacuucaccagggagauggcacaggaggaaagagcaucuacggugagcgcuuccccgaugagaacuucaaacugaagcacuacgggccugg

SEQ ID NO: 1522 - RNA, 80 nt, Human
ccaggcucuucuggacaaguacaaugcugagaagccuaagaaugcgauucacaccuuugugcaguccggaucucacuugg

SEQ ID NO: 1523 - RNA, 73 nt, Human
ccaggcuuucugguuuuuggccguguagagcuaccacggugcuauaacgccggugaagcuucaggggguuugg

SEQ ID NO: 1524 - RNA, 81 nt, Human
ccaggguuagaugacugcgggaagccuuugaucccaacccccaaggcuuuguauauuugaucauuugugaucuaacccugg

SEQ ID NO: 1525 - RNA, 74 nt, Human
ccaggucuaucuguccaauacuuugugucuaggguagaggucccuaacccuggcugcacauuggaagcaccugg

SEQ ID NO: 1526 - RNA, 75 nt, Human
ccaggugaggaagugaucccaaaagaugaaaauggaaaaauacuauuugacacaguggaucucugugccacgugg

SEQ ID NO: 1527 - RNA, 93 nt, Human
ccaguauauuucugcagucugguauguuuuucccccuaagaaccucagcugagaaauaaagcagguuaacaaagcuguaugaaaugucacugg

SEQ ID NO: 1528 - RNA, 75 nt, Human
ccagucagggucuucacgaagaucugcaucccaccucuaagacggaggaccaggugcaggguggacucuuucugg

SEQ ID NO: 1529 - RNA, 97 nt, Human
ccagucuaugugacaguuucauuucccuuuaauguggaaaucuguaggaucaacauagaccucacagcugggggaggucagaacgucacuggccugg

SEQ ID NO: 1530 - RNA, 84 nt, Human
ccagugcaccccagcuccggggcagaagaggcagccugcagaucucugcugccgggaaagagcuccugaaguuguggggucugg

SEQ ID NO: 1531 - RNA, 81 nt, Human
ccagugccaggcagaggugggaugcaggggguuccugaaagggggugccugggaggcuugcccaugggaugcuuggacugg

SEQ ID NO: 1532 - RNA, 74 nt, Human
ccaguuauuguguaaauguccccacuaugguggauuucagguuaccacuaugauaucacagaaugcagaauugg

SEQ ID NO: 1533 - RNA, 75 nt, Human
ccaguucuccuuuaguguucaggcucaaaugaaaggccacuuucagcaaguuuuccugacauugucggagacugg

SEQ ID NO: 1534 - RNA, 93 nt, Human
ccaguugcacacuggcauuuucuugcugcaagcuuuuuuaaauuucugaacucaaggcaguggcagaagaugucagucaccucugauaacugg

SEQ ID NO: 1535 - RNA, 70 nt, Human
ccauccugucuuccucccagggucugguuggcggcuuuuuacucucaauaaaggauggauggauggaugg

SEQ ID NO: 1536 - RNA, 71 nt, Human
ccaucuauagacuuauuuugcucaaugguuucugaaugccaaacugcucacaaaaauaagucuucugaagg

SEQ ID NO: 1537 - RNA, 92 nt, Human
ccaucucucagauuacuucauugcucaccggccggcucugaaagaaaaguaucccaaaucggcgcaccuugggcgaauuguuugacaaaugg

SEQ ID NO: 1538 - RNA, 101 nt, Human
ccaucugccaauuccucaggaggacagaacaaaccagugaggcaugaagauuagauuauguaacgcucgaggauugcuguuuucaaagaggaaacaaaugg

SEQ ID NO: 1539 - RNA, 107 nt, Human
ccaucuggcagaacacugggcaaaagagguucugauucuggccuguuacuugcuguacaaacuugcacaaggccagagaggacucucuuuucccaucugcaaagugg

SEQ ID NO: 1540 - RNA, 100 nt, Human
ccaucuucaguggcauugggccuuggcugggaugcugaguuauccacuggagcaucggcaguacaggcaggcacagaggcaguggauccaucggaggugg

SEQ ID NO: 1541 - RNA, 76 nt, Human
ccaucuuucacugggaauugcgaaggggauaugccauuaugaaaacaggucccucccucauuccaaggagagaugg

SEQ ID NO: 1542 - RNA, 62 nt, Human
ccaugcucggcuaauuuuuaaaauauuuguagagauggggucuugcuauguugccgggcugg

SEQ ID NO: 1543 - RNA, 78 nt, Human
ccaugggccucaccguguccgcgcucuuuucgcggaucuucgggaagaagcagaugcggauucucaugguuggcuugg

SEQ ID NO: 1544 - RNA, 95 nt, Human
ccaugggccugggcaggccaaccaggagaugcugcgaugaugacacugaguugccaagcagaccucccuggacgcaguggcccaggccgucgugg

SEQ ID NO: 1545 - RNA, 80 nt, Human
ccauuaagucaguuucgaucuucaaacugugccuuguuuuuuaaaagauaagaugcuagaaauucaaugggauuuggugg

SEQ ID NO: 1546 - RNA, 81 nt, Human
ccauugaaaaauuugagaaggaggcugcugagaugggaaagggcuccuuucaaguauugccugggucuuggauuaaacugg

SEQ ID NO: 1547 - RNA, 62 nt, Human
ccauugcucagugacaguaucuuaaagcuuguccagagcuugaaggaccacacagguagugg

SEQ ID NO: 1548 - RNA, 70 nt, Human
ccauuuaaugaccagcagucacugagcgcugugaaaauucacucagugauaccccguguggucuugaagg

SEQ ID NO: 1549 - RNA, 118 nt, Human
ccauuuuuuuguaggucagaagugguugcaaacuggauuuuuagacucuuccuguugggggucucggacauuugcucuuuuccacagcggccaauucuucagagccacaaagaacugg

SEQ ID NO: 1550 - RNA, 86 nt, Human
cccaaagcucacaguuuggcacugaaucauauacaaucucguaguuuggauggcugugugugacugcagacugcuagacagcaggg

SEQ ID NO: 1551 - RNA, 67 nt, Human
cccaauacaucauagagggcagucagcucaauuagggcuaaauggcaaacuuucuucauguccuggg

SEQ ID NO: 1552 - RNA, 98 nt, Human
cccaauccagacccagugacaauguuacagggacaucaaggcguucaacccaaggugguugaggcgccugcuuuuccuuggccucugggaguauuggg

SEQ ID NO: 1553 - RNA, 91 nt, Human
cccaauuaacaucgaggucucagcaaacaauuaccacauuuaacauauauggaguuaaaguagauuggauuugcugaaaaucggugcuggg

SEQ ID NO: 1554 - RNA, 82 nt, Human
cccacagacgaauaccuggagggcaugaugagcgaggccccggggcccaucaacuucaccauguuccucaccauguuugggg

SEQ ID NO: 1555 - RNA, 66 nt, Human
cccacagcggagucugugucuuuuagcuacagaggagguuccuuguugcuaaagaugaccuguggg

SEQ ID NO: 1556 - RNA, 63 nt, Human
cccacagggcugggggcuuccccugggagaaaguccuucccuccccauggcccagcccugggg

SEQ ID NO: 1557 - RNA, 89 nt, Human
cccacuccacggggaugucguugggauaaaagccuuugaccaggcagguaaggcugaccugguuuuuggucaacucaucccgggauggg

SEQ ID NO: 1558 - RNA, 72 nt, Human
cccacugauggagccagcagcauugagaaaauuguagagauugaugcucacauagguugugccaugaguggg

SEQ ID NO: 1559 - RNA, 73 nt, Human
cccacugauggagcccagcagcauugagaaaauuguagagauugaugcucacauagguugugccaugaguggg

SEQ ID NO: 1560 - RNA, 77 nt, Human
cccagaaacuuucaggagaggcaagcagauucacugacccccacguguaucuuuauguguaaugaagguuuuauggg

SEQ ID NO: 1561 - RNA, 100 nt, Human
cccagaacaaagaccucuagccaacauguaagcaccuagaccaugguuucccauccuuaucauuguuaacauuuuggcuagauaguucuuuguugugugg

SEQ ID NO: 1562 - RNA, 80 nt, Human
cccagagaaagcucugccugcaauauuuuucaggucaugucacacaaagaaaaauaacaaugcuugcacagcccacuggg

SEQ ID NO: 1563 - RNA, 77 nt, Human
cccagaggaugucagucccaaggaccaguagcugccaucaguuuggauucugaaaacuaacuggcaucaacacuggg

SEQ ID NO: 1564 - RNA, 102 nt, Human
cccagcaugauucauaccuguaaucuuacccauucuugauuuagaugagauuuggauuucgaguugaugcuagaauggguuaauacuuuugaggauguuggg

SEQ ID NO: 1565 - RNA, 75 nt, Human
cccagcccugaccguucugcauaugaacaugggccuugguuuccccaucuguaugaagaagggaguagggcuggg

SEQ ID NO: 1566 - RNA, 66 nt, Human
cccagccgagauguccagauguugcuuuagaccugaagggcagcucgggagguccaguaggcuggg

SEQ ID NO: 1567 - RNA, 81 nt, Human
cccagccuggacccccgaggaggcggccuccuuuucaaaagugggagggggcagggccugaaguguugggggcagccuggg

SEQ ID NO: 1568 - RNA, 85 nt, Human
cccagggacuagucuaccaagguuauuuggcagcuaauucuagauuuggaucauugcccagaguugcacuugcuggucucuuggg

SEQ ID NO: 1569 - RNA, 74 nt, Human
cccaguacccaccuggccguggggguccuccccacaucuaugggccgaggagcacccccuccaggcaugauggg

SEQ ID NO: 1570 - RNA, 82 nt, Human
cccaucucaaacguccuugcuacucugugauuguagaauaucugaucaaccuucugggagcgagaaaguaguugugaauggg

SEQ ID NO: 1571 - RNA, 65 nt, Human
cccaucuccagcccgggcuucaaacugcugcugagggggggcugggagccaggaauggggcuggg

SEQ ID NO: 1572 - RNA, 68 nt, Human
cccaucucugugacuuccuggagacucacuuccuagaugaggacgugaaggcuaucacagaagauggg

SEQ ID NO: 1573 - RNA, 65 nt, Human
cccaucucugugacuuccuggagacucacuucuagaugaggaagugaagcuuaucagaagauggg

SEQ ID NO: 1574 - RNA, 69 nt, Human
cccaucucuugugacuuccuggagacucacuuccuagaugaggaagugaaguuuaucaagaacgauggg

SEQ ID NO: 1575 - RNA, 127 nt, Human
cccaucuguacaguccagccacugacauaagccccacucgguuaccacccccuugacccccuaccuuugaagaggcuucgugcaggacuuugaugcuugggguguuccguguugacucccagguggg

SEQ ID NO: 1576 - RNA, 64 nt, Human
cccaucuuucucuuauuugaugucucugaucagcuccucuuucagcacaaacuggagaaagggg

SEQ ID NO: 1577 - RNA, 75 nt, Human
ccccaaugugcucaaguucauuggugugcuguacaaggauaagaagcugaaccuccugacagaguacauugaggg

SEQ ID NO: 1578 - RNA, 63 nt, Human
ccccacagacgauucccuguccccugccucaugcuccggcaggguacaggcucgcaccugggg

SEQ ID NO: 1579 - RNA, 84 nt, Human
ccccaccccaguggagcucaccuuccaguaggucuaaacugguuugauugaguuccauggaaaacaacaaagugggguaagggg

SEQ ID NO: 1580 - RNA, 65 nt, Human
ccccacgcucaguccuggucaaaggcugccagaccuuucugagugcccccagggaggggcugggg

SEQ ID NO: 1581 - RNA, 68 nt, Human
ccccagcaucugauguuuugagaagugcauggaguuuccuaaacuuugcacagaagaauauccugggg

SEQ ID NO: 1582 - RNA, 77 nt, Human
ccccagccagaaucgacgugagugugaugaccgccccggucgugaagacauaccagcucaacagguucaauuugggg

SEQ ID NO: 1583 - RNA, 68 nt, Human
ccccaggcaugggcugcgagcagcugguggcagaggaggcggcugagcuguggccauccaugcugggg

SEQ ID NO: 1584 - RNA, 105 nt, Human
ccccaucgccuccaguugcuauggcaacaggccauucugggccagccacgucucugcauggcagugcccaaugguggaguugcuaggggcgacggagcuguuugg

SEQ ID NO: 1585 - RNA, 87 nt, Human
ccccauuuucuugggagaaauucaaguuugcugcagaaauucgcauaaguaaugaggagugaaauguuaaucaccaagacaaugggg

SEQ ID NO: 1586 - RNA, 72 nt, Human
cccccaaaagaguucuuacacgaggugacacaggccucucaguuccucaaaauagccuccuggaagaagggg

SEQ ID NO: 1587 - RNA, 76 nt, Human
cccccaagcugggcccgcgacucgaaggugacugggauggugaucucguuggacugcguggcuagcuugggcaugg

SEQ ID NO: 1588 - RNA, 79 nt, Human
cccccacgccgaggcuuuggagugaacagcccgcuuggcuguggcaucucaguccuauuuuugaguuuuuuuguggggg

SEQ ID NO: 1589 - RNA, 61 nt, Human
ccccccaggucgcaggugucugaggccagucaaccugcagagcacucgcggcguggguggg

SEQ ID NO: 1590 - RNA, 81 nt, Human
ccccccuugaguaucaggccauuaggacccgaggagggacaguauagccuugaguaucaggccauuagaacccgagggggg

SEQ ID NO: 1591 - RNA, 67 nt, Human
cccccucagauguuccugcagugcugaaauucauccuacagaaguaaccgcaaaacucuagaggggg

SEQ ID NO: 1592 - RNA, 63 nt, Human
cccccuucaguaaauuguccugacauccucccccacuuggagagccagucuacuagaaggggg

SEQ ID NO: 1593 - RNA, 90 nt, Human
ccccgagugagcaauuucugucccuuuuaagggcucacaacucuaagggggugugcgugagagggucgugaucgauugagcaagcagggg

SEQ ID NO: 1594 - RNA, 89 nt, Human
ccccggagccccaaggagccccucaucaguggcuggcucuucuuccgcuacauggcaaucgggggcuaugugggugcagccaccguggg

SEQ ID NO: 1595 - RNA, 63 nt, Human
ccccggcagcgguuggcgaguggggaccgaacccccgguucuccaugaucccgcuggccgggg

SEQ ID NO: 1596 - RNA, 111 nt, Human
ccccggcuggaucaggaggcgaccauauggcuuuucuuguuucacgugaagaaucuguugcgcugagagcaccaggagcagguagaagacccgggcagccauccugcgggg

SEQ ID NO: 1597 - RNA, 78 nt, Human
ccccgucguaaacgcugaggaaugauguggccaagaaugccugauguucuuuaaacaaauuccauggaguuuaagggg

SEQ ID NO: 1598 - RNA, 69 nt, Human
ccccguggaauuuuaugaggaguuaugccuaacaacuguugggcaaccucagggggauauuuauggugg

SEQ ID NO: 1599 - RNA, 71 nt, Human
ccccucauuaggaugcaucacuggccucgugcaccggcuucaccagcacugcacccuaaucaaaacagggg

SEQ ID NO: 1600 - RNA, 95 nt, Human
ccccuccacucugcuguggccuauggcuuuucauuccuaugugauugcugucccaaacucauguagggcuaaaagccaugggcuacagugagggg

SEQ ID NO: 1601 - RNA, 61 nt, Human
ccccuccagcccccaugugcucugagccagucccaacacuggcugaguuggcugcgagggg

SEQ ID NO: 1602 - RNA, 76 nt, Human
ccccucuccagcauagugagaucaagaaggaggcuucacauuuuaucuucagcuccaucaccauccuggagaaggg

SEQ ID NO: 1603 - RNA, 88 nt, Human
ccccugccugaccaagccaugucugaacaggaggcucaagccccagggggccgggggcugcccccggacaugcuggcagagcaggugg

SEQ ID NO: 1604 - RNA, 78 nt, Human
ccccugcuguauccugcaucauuagaaaaaucaaagccauuggugggaucauucugacagccagucacaacccagggg

SEQ ID NO: 1605 - RNA, 93 nt, Human
ccccuggagguccaaggggagcggcaaggcagggcaggcgguccccaggaaccugcccagugcacaggcccagcuacucaggagcugaagggg

SEQ ID NO: 1606 - RNA, 76 nt, Human
ccccuuccaggaagggccugguguugcagcugauccagucuuaccagcggaugccaggcaaugccauggugagggg

SEQ ID NO: 1607 - RNA, 61 nt, Human
ccccuuuuuggacacuuauacaaggugugggaaacccacugguaccagugcaagaaugggg

SEQ ID NO: 1608 - RNA, 80 nt, Human
cccgacaggccucccggcucucccgcccucccucccgagacacgagccgaacugggcgucaggucggggagccggucggg

SEQ ID NO: 1609 - RNA, 115 nt, Human
cccgaccacuagcagccucuuucagucacuggaaaaugcuuacaggcaguagccaccaucauguggcacaaagugggcaucauccuagugucuaacauuuaagcugugguucugg

SEQ ID NO: 1610 - RNA, 60 nt, Human
cccgacccgcgcccgggccugcgggcgacucgagcgggcccugcuggcugcggcugaggg

SEQ ID NO: 1611 - RNA, 73 nt, Human
cccgaggguugccaguuccaccuccucuuguacaggaucuugguacaggggcugguaggaguacgcaguuggg

SEQ ID NO: 1612 - RNA, 80 nt, Human
cccgauccggcagcucauuuaaauagagcucaucacaacaacaguguugguggugaagugaguagcugcaggacccuggg

SEQ ID NO: 1613 - RNA, 72 nt, Human
cccggaccagugaagcuggagccaggguguaaggcaaggaggugcugaguggcuccaaaagagcuggccagg

SEQ ID NO: 1614 - RNA, 68 nt, Human
cccggacccgcagggcugccugguuccuggaagucuucccagucuucccagccagcccgggcccuggg

SEQ ID NO: 1615 - RNA, 70 nt, Human
cccggagacccgccccggcccgguccacauucuccccaggaagccggacucuauggggcgggacccuggg

SEQ ID NO: 1616 - RNA, 61 nt, Human
cccggauccucagucgugcgggagucugggaggccuggcuuccucaggggugagguuuggg

SEQ ID NO: 1617 - RNA, 102 nt, Human
cccggcagggugggaggcagcaggggucagccugggcaggaaccucucccaacucuguccagguguucagaccucuuggcccaaccugcucaccccaccggg

SEQ ID NO: 1618 - RNA, 83 nt, Human
cccggccucaccccaccuugcccccaagaggucccacagagcuucggaccuccuugagacaaggcagggugcugaggggcggg

SEQ ID NO: 1619 - RNA, 69 nt, Human
cccggggacugagaguuaaggagaguuggaggcuuuacuagggccacaggguuccuacucgccccuggg

SEQ ID NO: 1620 - RNA, 68 nt, Human
cccggggacugagaguuaaggagaguuggaggcuuuacugggccacaggguuccuacucgccccuggg

SEQ ID NO: 1621 - RNA, 74 nt, Human
cccgguauugccaggcggcugagaauguuacgcucugacaucuguaaccucacagcaacugggggaauaucggg

SEQ ID NO: 1622 - RNA, 75 nt, Human
cccucaaguuuacugaguugguggaaaugugggcguucuagagaacugcccuaauauagacuacagcuaagaggg

SEQ ID NO: 1623 - RNA, 69 nt, Human
cccucaccuuauugggcaaaacugcaucaaucuccuuuugcaguuucugcuggacaucagggugagugg

SEQ ID NO: 1624 - RNA, 90 nt, Human
cccuccaguuugucaagaguugaaggaggcucuguggccaggugaccuggcugcuuccacuccuuguaccucagucuaaacauggagugg

SEQ ID NO: 1625 - RNA, 98 nt, Human
cccucucccggccagggagacggagcccauccacagugucagcuauggccauguggccgccugccagcuaaugggcccccacacccuggccuugaggg

SEQ ID NO: 1626 - RNA, 98 nt, Human
cccugccauccagacagucccccugcccccagggcaaccaguucuccuaugcucuaugagguugucuaugaggcaggggcccuggagaggaugcaggg

SEQ ID NO: 1627 - RNA, 72 nt, Human
cccugccugcuagcuggggaccgcuccuuggcagaugucaucauccaugagaucucccacaguugguuuggg

SEQ ID NO: 1628 - RNA, 67 nt, Human
cccuggaggagaucuaucucuucucccugcccauuaaggaaucagagaucauugauuucuuccuggg

SEQ ID NO: 1629 - RNA, 73 nt, Human
cccuggaguuuacuuccugccaggugaccuccugggggagggagccuucaagcgagccuggccagaagcgggg

SEQ ID NO: 1630 - RNA, 60 nt, Human
cccugggguuggggccucaccccucuggagggccggaggcaggagguggaaaccccaggg

SEQ ID NO: 1631 - RNA, 63 nt, Human
cccuguaucaaccuauuuaacacuucagcaggaccuggugcauguggauugauacuagcaggg

SEQ ID NO: 1632 - RNA, 72 nt, Human
cccugucuacugauagucaguuugcugugucagaaagcacuucugaaagcagauaugagucaccagacaggg

SEQ ID NO: 1633 - RNA, 110 nt, Human
cccugugccugucucuccaggguucuaccacuuggggggauugggccgguccguggugcauuggauggugucccaaccgggugguggaccuugucaucgacgucacaggg

SEQ ID NO: 1634 - RNA, 90 nt, Human
cccuguucucaguaaagaucgcaacuuucauguuuuccuggauaugaucaggaucuaaguguuaggcggaaaauacuagagauguuuggg

SEQ ID NO: 1635 - RNA, 86 nt, Human
cccuugauuugggagaggcagcagagucauguccagggcaucagaccagugacaucuuugccuuuaugccucuagucaucugaggg

SEQ ID NO: 1636 - RNA, 86 nt, Human
cccuuuacaagccagcuacuuugcaggaaaaguggggggcacuguguuuccauccaaccuugcagggcaacuggggugcaaacggg

SEQ ID NO: 1637 - RNA, 104 nt, Human
ccgacaagaaagccgaggcuggggcugggucagcaaccgaauuccaguuuagaggcggauuuggucguggacguggucagccaccucaguaaaauuggacgagg

SEQ ID NO: 1638 - RNA, 66 nt, Human
ccgaccuggcccagccuggcccguccccaauccagugggcuggccaggccaccugcaccagggagg

SEQ ID NO: 1639 - RNA, 94 nt, Human
ccgaggaccuccugaccccgcgguggcagcugggaccgcgcuacgcggcuaagcaguucgcgcguuacggcgccgccuccggggugguccccgg

SEQ ID NO: 1640 - RNA, 121 nt, Human
ccgaugaacccagggccguucccuucauacccuuucauuaguagcucuaagauguuugauuaagguguacguuuacagaggaguugguuggugaugagcauugaacauuuggguucuucgg

SEQ ID NO: 1641 - RNA, 85 nt, Human
ccgcaaagugggucucauugcugccggcggaccuggaccgucuccgggcaccaagacugugccggacacagagacuagugugagg

SEQ ID NO: 1642 - RNA, 94 nt, Human
ccgcacuuccagggccuaugcaggaugugcagguggcguucgcgcuccgccgaggugcgaaacuugccuuugcaguaggggcaacggaaggcgg

SEQ ID NO: 1643 - RNA, 63 nt, Human
ccgcagggccugccugguuccuggaagucuucccagucuucccagccagcccgggcccugggg

SEQ ID NO: 1644 - RNA, 82 nt, Human
ccgccgccgccgccgcccccugcagccacucucccgccucuaccgccgcgggagcugcaucguccacuccggucggcggugg

SEQ ID NO: 1645 - RNA, 96 nt, Human
ccgcggguggaggucgauggcagcaucauggaagggggcggccagauccugagagucucuacggccuugagcugucuccuaggccuccccuugcgg

SEQ ID NO: 1646 - RNA, 68 nt, Human
ccgcgugcaguaccaguucgagauggagagcuucgacuccauccccggccuggugcgcugcuacgugg

SEQ ID NO: 1647 - RNA, 98 nt, Human
ccgcguguggcuuccgcggagguuucggcaguggcauccggggccggggucgcuggccguggacgguggccuggggccgaggccugcggagcucgcgg

SEQ ID NO: 1648 - RNA, 86 nt, Human
ccgcucaacucuucaucuucucgccccacuccaaacgagagagcgacggaccggagaggcgagacagcggcgagagaagggagcgg

SEQ ID NO: 1649 - RNA, 65 nt, Human
ccgcucaccuauagccaauauaagcagucaccauccaggugcugcuggacaggcucguguagcgg

SEQ ID NO: 1650 - RNA, 104 nt, Human
ccgcugcggaccagugccccgcgcugugcgagugcuccgaggcagcgcgcacagucaagugcguuacccggauugaccaggugcccagggccugccgcuagugg

SEQ ID NO: 1651 - RNA, 78 nt, Human
ccgcuguccaacaaccaggaggugagugccuuuggggaagacggcgagggcgaccgaccuggaccuauggacagugcg

SEQ ID NO: 1652 - RNA, 98 nt, Human
ccgcuucaauuuccacucuucuuuccuuugccuccccuuucagauaaacaagcuggaggcacgccugaggcaggcaggguguacagauguuagagggg

SEQ ID NO: 1653 - RNA, 72 nt, Human
ccgcuucacuggcaccauggaugccuucgugaagaucgugaggcacgagggcaccaggacccucuggagcgg

SEQ ID NO: 1654 - RNA, 71 nt, Human
ccgcuucugacugccuagggcgagugggcauccugucaucaucuccacugucccaagcagucacuaggugg

SEQ ID NO: 1655 - RNA, 113 nt, Human
ccgcuuugauuggcuccgaauccucuuggguccacauacggccaucacuccugccuggagcgaaugcgauuccaaugagaucuauacugucggacacacgcuuucaaagacgg

SEQ ID NO: 1656 - RNA, 78 nt, Human
ccggaacauuggggggcaaacauaagggcaagguuauaggcugacaucuuguucuugucuugguucuuugcugucugg

SEQ ID NO: 1657 - RNA, 79 nt, Human
ccggaaccugcucaucuggaucaagaagaauuugcuaaaagagcggccagaguuguucauccaggaagacagcgugcgg

SEQ ID NO: 1658 - RNA, 78 nt, Human
ccggaaccugcucaucuggaucaagaagaauuugcuaaaagagcggccagaguuguucauccaggagacagcgugcgg

SEQ ID NO: 1659 - RNA, 79 nt, Human
ccggaaccugcucaucuggaucaagaagaauuugcuaaaagagcggccagaguuguucauccagggagacagcgugcgg

SEQ ID NO: 1660 - RNA, 60 nt, Human
ccggcccggggaggacaagucgcugccaccuuuggcugccgacgugauucccugggacgg

SEQ ID NO: 1661 - RNA, 77 nt, Human
ccggccgggugcaguguuuuggccuggagcagggcggccuguucguggaggccacgccgcagcaggauaucggccgg

SEQ ID NO: 1662 - RNA, 93 nt, Human
ccggccuugccagacggaagcuccuuguccccgacugcagcacaggcccuggcugugggacauaagcaaagauuuggugcuggaugaggaagg

SEQ ID NO: 1663 - RNA, 76 nt, Human
ccggggcggccucgcgggugacuccgggcuccguggcugucccggaccccaccucuucccugccgaccgccaccgg

SEQ ID NO: 1664 - RNA, 76 nt, Human
ccgggguuccaccccuuucuccggcccucagccucccccguacuguggcacugccggccccuggcccuagucccgg

SEQ ID NO: 1665 - RNA, 71 nt, Human
ccggguagagggauugagccaagaggugagggugcacgucuucccuccuggucccagcuccccaagccugg

SEQ ID NO: 1666 - RNA, 92 nt, Human
ccgguaaauuuuggaaaaaucgcggaaaauuuuugguaaacagucaauuuuuuacccaaagcccgaaucggaaaauccuuuuaauuaaccgg

SEQ ID NO: 1667 - RNA, 67 nt, Human
ccgguguaaauguugagccuuuuuggccuggcuuguuugcaaaggcccuggccaacgucaacauugg

SEQ ID NO: 1668 - RNA, 86 nt, Human
ccgucagcccuuggcagggggucuuggaagccagagguuuuugcucagggcagggaaagggcugcaggauccccgggggcugccgg

SEQ ID NO: 1669 - RNA, 80 nt, Human
ccguccgcgcggacuccguuucccguggugccccgggcggcccgcuuccggcgcaguuaguuacgagucggcgcacgcgg

SEQ ID NO: 1670 - RNA, 78 nt, Human
ccgugaccgccaccgccacuucccagguagcccagcagccuccagccgcugccgccccuggggaacaggccgucgcgg

SEQ ID NO: 1671 - RNA, 86 nt, Human
ccguggcuuauggaguuaaggaaggucacgugagcaaacagaaguguuccuucugcuuuuuaccuucuuucuuucuauagcccugg

SEQ ID NO: 1672 - RNA, 76 nt, Human
ccgugguuccucaccugcauuaaccagccccaguuccgggcugucuugggggaagugcaacuguggagaaagaugg

SEQ ID NO: 1673 - RNA, 80 nt, Human
ccguuggacccagagagccugaguuggagaugaacuuuggccaacuuuccucaucaccauacuuaaaauccuguccaagg

SEQ ID NO: 1674 - RNA, 67 nt, Human
ccuaagucugaagucucaucagacgaacgacauccaguucagccuggugacaagaaucggacugagg

SEQ ID NO: 1675 - RNA, 82 nt, Human
ccuacagacccucagguacugcccugugacuucucuguaugacaucacaaggcugccaagugccuguuuuucuagaacuagg

SEQ ID NO: 1676 - RNA, 63 nt, Human
ccuacccuccuuuuuuucccuaucacugaagcuuuuuagugcauuaguggggaggaggguggg

SEQ ID NO: 1677 - RNA, 94 nt, Human
ccuacuguugagguauaguauuguagcuuaauauuaauuauaauauaaaauaucuagaaaaaauaagucaagauacuguuuuucuggggguagg

SEQ ID NO: 1678 - RNA, 112 nt, Human
ccuagaugggaucugcugcaggcaagauauucccggccucagaagcugaggggagaaccuucuguucuuccccaccuucggcuugcauuccuccuucagcaucuucuuaagg

SEQ ID NO: 1679 - RNA, 77 nt, Human
ccuaucaguagauccuuccacuggguucgcaauuuugaucugcgccccagacaucugacggaucucauugauuuugg

SEQ ID NO: 1680 - RNA, 74 nt, Human
ccucagauaaaaccucaauuacugguaauuguacauuuccaucaauaucccuuuuaaagagguuuauucugagg

SEQ ID NO: 1681 - RNA, 90 nt, Human
ccucagccucccaaagugcugggauuacaggugugaaccaccaugcccggcagugauucauuucuaaacccagcuuguuaaaaggugagg

SEQ ID NO: 1682 - RNA, 107 nt, Human
ccucaguggcuguaggaacuccagauuauaucucuccugaaauccuucaagccauggaagauggaaaagggagauauggaccugaaugugacugguggucuuugggg

SEQ ID NO: 1683 - RNA, 96 nt, Human
ccucauaacuggaguagaguuccugguugcuuuucauaagagggagaguuacuuucuuuguaucucugcaagcagagauuucucuuugguuugagg

SEQ ID NO: 1684 - RNA, 65 nt, Human
ccucaugagcaagguugcagaucgguccuuccucagcuccuugauuugugaccuugaccaagggg

SEQ ID NO: 1685 - RNA, 90 nt, Human
ccucauugguucauucggcagcuguuuauuuagaaccugccgugugcuagggcagaucugggauacagcuguggacaagggaggaugagg

SEQ ID NO: 1686 - RNA, 74 nt, Human
ccucauuucuucuauuuaaaaaaaagccucuuucagugcaaguggggugccaaggauguagaauaaauaagagg

SEQ ID NO: 1687 - RNA, 98 nt, Human
ccucccagacugagcccccgaccuggcccagccuggcccguccccaauccagugggcuggccaggccaccugcaccagggaggacagcugcuggcagg

SEQ ID NO: 1688 - RNA, 82 nt, Human
ccucccauaguucucccgcgucugguuggcccguguguuccuuuuccuauaccuccccaggcagccuggggaacgugguugg

SEQ ID NO: 1689 - RNA, 91 nt, Human
ccuccccucguggagaguauaccagcugguguguagccccggugugagggcuacaaaguuauauguguagagcaucuccacuguguagagg

SEQ ID NO: 1690 - RNA, 76 nt, Human
ccuccggacuuucaaaugcuugcugaaccuuccaaaauacuuccucuagguggcagcgcaggaauaucucuggaag

SEQ ID NO: 1691 - RNA, 110 nt, Human
ccuccugcgcagccuuaagguucuccuucuucccgccccaggccuucagggcaaaggccugcagggcucggccguaggagaaggucagggcccaaggcuucagcaggggg

SEQ ID NO: 1692 - RNA, 83 nt, Human
ccuccugcugaagcuucuggauuugagaggcuuuacucuccaggagagugaagcgaguugggccagagcugagagucuggugg

SEQ ID NO: 1693 - RNA, 88 nt, Human
ccuccugugucccaaaacgaaaacacuccuauauuuuguagcgccuuccagaauggggcagcggaaacuaguguugggacaaaggagg

SEQ ID NO: 1694 - RNA, 81 nt, Human
ccuccuuguggaguaggaaaacauaagcuugaagaaggaagcuuuaaagaaagguggucguucucgcccgcaauuuagagg

SEQ ID NO: 1695 - RNA, 73 nt, Human
ccucgacuguccccaugcaguaccagcaaagaccgcccagugucccagccuagccuuguggggagcaaagagg

SEQ ID NO: 1696 - RNA, 81 nt, Human
ccucuagguaaagguuccaaggcaugccccaagagcaccuccuccucacccuucuggggacauuccuguagcaaccagagg

SEQ ID NO: 1697 - RNA, 70 nt, Human
ccucucaaagugcugggauuacaggcgugagcaagccuagcuuguauuuccuagacuuuuauauaagagg

SEQ ID NO: 1698 - RNA, 74 nt, Human
ccucucccauggcuagggaaaauggcacaguuggguccuauuucagaugcuaaagaaaacccuuaugggcgagg

SEQ ID NO: 1699 - RNA, 60 nt, Human
ccucuccuccucuucccuccccaucuaaagggguuuggggagagacacaggcaggcgagg

SEQ ID NO: 1700 - RNA, 61 nt, Human
ccucuggccaacacugccuuuuuccagggugcagcccuggaguguaguuuugggcuggagg

SEQ ID NO: 1701 - RNA, 72 nt, Human
ccucuggcuccggcuuugcuguagccuccagcagccuggcuggcuaucgacuccgaggccgggcaucagugg

SEQ ID NO: 1702 - RNA, 72 nt, Human
ccucugucuccgagcucgccugcaucuacucggcccucauucugcacgacgaugaggugacagucacggagg

SEQ ID NO: 1703 - RNA, 89 nt, Human
ccucugugauaucccugaggaccaagauaugauuauaucugacucaaagucagauagccagucuuggaaucccagcuuuacgacugagg

SEQ ID NO: 1704 - RNA, 82 nt, Human
ccucuugaauaagcucucugccuccuccucccuuucucccuuguggggaaauguuuggaggcaucacuggcauucgaugggg

SEQ ID NO: 1705 - RNA, 86 nt, Human
ccugaagccuugaagccucuucgggaugucuuccagcguaaucagcaggaugggcaauuggaggacucaccaggcuuguggccagg

SEQ ID NO: 1706 - RNA, 74 nt, Human
ccugaauauagggucuccuuaaacacaucugagcacugaccuggaugagugcacuugggagaccuggugacagg

SEQ ID NO: 1707 - RNA, 72 nt, Human
ccugacuccugggucucggcuucccguauccagcacaaggauggguucucugucgcagagccuggagucugg

SEQ ID NO: 1708 - RNA, 61 nt, Human
ccugagaaacugguggcuuugaacacuugguguggacuacuguguuauccgggauaucagg

SEQ ID NO: 1709 - RNA, 77 nt, Human
ccugaugguauacuacugcuuugcggaauugcauacaacugugcauuacaaaguuaauaugguaauuauggucuggg

SEQ ID NO: 1710 - RNA, 86 nt, Human
ccugauguggggacucuccuuucuuuuuaggucuauucaugugggugggcaggaaggaugugaggacucuaggucuccaguucagg

SEQ ID NO: 1711 - RNA, 81 nt, Human
ccugcaguaucucugagugugccuguacauauacauauaaaaaauuguaucauaaggaauuaacucaugagauuauggagg

SEQ ID NO: 1712 - RNA, 72 nt, Human
ccugcaugggguguuuguggccgagguggaggaugacaguccugccaaggguccugacggccucgugccagg

SEQ ID NO: 1713 - RNA, 81 nt, Human
ccugcccagugcugaguugucuucgagguuggcgcuccuccaggaaagcgauuggcugcguggaguuuagaaugggaaagg

SEQ ID NO: 1714 - RNA, 74 nt, Human
ccugcccaugccaggacucuggaggcuuagcuccucccuuuguaccaggcacguccagagcccuggcuaccagg

SEQ ID NO: 1715 - RNA, 77 nt, Human
ccugccccagccuggcucccucguugcugggcuuucggggcuggccaguggggacagucagggacuggagaggcagg

SEQ ID NO: 1716 - RNA, 81 nt, Human
ccugccccucugccugugcuccuggcaguguggcuucccggugcucaccugcacagcaguuaacagcagaggccgagcggg

SEQ ID NO: 1717 - RNA, 94 nt, Human
ccugcccuuggcuuccagaacagcugucagccugaguagagggugagggggccuccugcugcaggcagauuccuucugcagagcccuggccagg

SEQ ID NO: 1718 - RNA, 84 nt, Human
ccugcucaguguuuggcaucugguggcuaagcuggucuucagaguucaagacagcuucauucucaugccuggcaccuugguagg

SEQ ID NO: 1719 - RNA, 76 nt, Human
ccugcucgccuccuggagagcgcaagacacacagggcaccccccgcugugaauagugcaacgccggguaaagcagg

SEQ ID NO: 1720 - RNA, 99 nt, Human
ccugcucugccuucagacugcccucuuucuaccucucccucuagaacuacaucucuucuggcuggguuuauagcuuggggcugggggaggcccaguggg

SEQ ID NO: 1721 - RNA, 76 nt, Human
ccugcucugggacagauuccgaagugggagugucauagaucaaucccguguccugaacuugggucccaucacacgg

SEQ ID NO: 1722 - RNA, 76 nt, Human
ccugcuggguggggccaggcauaaccuggggauagcugucccuaaccucaaugacaagggcacccacccuggcugg

SEQ ID NO: 1723 - RNA, 75 nt, Human
ccugcuguaugcuaggcauugugcaagguguuagggcugaugcuugagcacaguaccuccacaucugcaguaugg

SEQ ID NO: 1724 - RNA, 85 nt, Human
ccugcuguguggcagcugaacucugccaaggugauggugaccaaugugacaucauugcuuaagacaguagaacacauacggcagg

SEQ ID NO: 1725 - RNA, 69 nt, Human
ccuggagagugcacaugccccuugguccuggcagggcgccaagucuggcaccauguuggccucuucagg

SEQ ID NO: 1726 - RNA, 64 nt, Human
ccuggaggcucucguggcccaccuuuaaaaaguaaaggugccccaagaaacgagaggcucuugg

SEQ ID NO: 1727 - RNA, 67 nt, Human
ccuggcagacaggcgggcaaacagugagcgcccacccagaccggcugcugcgcccccuccugccagg

SEQ ID NO: 1728 - RNA, 79 nt, Human
ccuggccugcaacuucagccuuucucaaaaucggggcacggucaucguggagcgcugguggaagguaccgcuggccggg

SEQ ID NO: 1729 - RNA, 75 nt, Human
ccuggcuauggaaaagugauguggguagccaauuuuauaaaauguuggcuuucuggauuuuuauccggagugagg

SEQ ID NO: 1730 - RNA, 88 nt, Human
ccugggccugccacucccacgcccuucaccaaugccguccagcugcugcugacgcugaagcuggugagccuggccagugaaguccagg

SEQ ID NO: 1731 - RNA, 79 nt, Human
ccugggucuuugcgucccgcucagggugaucggccacauuggaagcugugaccaugcccguggugccacaagacccggg

SEQ ID NO: 1732 - RNA, 71 nt, Human
ccugguuauucuaaucccaauuacauguacuuuagcaaagguguaauacugaucuggagggaaaaaccagg

SEQ ID NO: 1733 - RNA, 98 nt, Human
ccuguagaccaccuuauucuuuucuuauggguauguggcaugaaugccaucauuuauuuacccagcugccaguugaagaacauuuuggucuuuccagg

SEQ ID NO: 1734 - RNA, 75 nt, Human
ccugugaagcagaccucuccagggggaggugaguuaagccuuuccagccacuggacgaguaagucaaugcauggg

SEQ ID NO: 1735 - RNA, 66 nt, Human
ccugugucacaaugggcaaggagcucagagucucugggccucugauuuccccaucuguauuacagg

SEQ ID NO: 1736 - RNA, 75 nt, Human
ccuguugcugugggccacgcugaacgccgccuucgugcucgugggcucugugauuguggcuuucauagagguggg

SEQ ID NO: 1737 - RNA, 70 nt, Human
ccuguuggcacugaugaagaacccuuacaguucaggguccuggaacuucuaccagugccacucugacagg

SEQ ID NO: 1738 - RNA, 92 nt, Human
ccuguuucucuucaaauucuuccccucggcaauggccaucuccacccuggauaguuaggcugagagcaaauauuugugaaaauagggacagg

SEQ ID NO: 1739 - RNA, 63 nt, Human
ccuguuuucccggggugagccaguaucuccccagacacuggcaggcacgccgggcagaguagg

SEQ ID NO: 1740 - RNA, 72 nt, Human
ccuucccugcuugccugcucccucacgccccugcucugcguguuggaugugaaaaggaugucagggacuagg

SEQ ID NO: 1741 - RNA, 68 nt, Human
ccuucccuuccacagaguuuaguuuccucauuuguaaaaugaagacaaaccucgugagagagggaagg

SEQ ID NO: 1742 - RNA, 75 nt, Human
ccuucugugcauggggaacacaaggacuaaguugggagaauggagaauuggcuuccugucuuuauggauucaagg

SEQ ID NO: 1743 - RNA, 77 nt, Human
ccuugcuguccucugggcuucuccucugacccaggucacccuguggcaggccaugggcccucaggauguuucaaagg

SEQ ID NO: 1744 - RNA, 96 nt, Human
ccuuggcccugugaggcuucaccucuugagccugagaagcagaggugacaguacuggcccugguucuuagcagggggguggcgggcaggguagggg

SEQ ID NO: 1745 - RNA, 64 nt, Human
ccuugggaaccccaggucaaaaagggcccgaaugacaacuugggaaaaacuugggggcccaggg

SEQ ID NO: 1746 - RNA, 65 nt, Human
ccuuguacacucgcugcgaacacccucguggucuuacgcaucugggugucgcggcgcccacaagg

SEQ ID NO: 1747 - RNA, 105 nt, Human
ccuuguauucggggaacggggcugaugaguugaccgugguguccagggaugucaaucgccacguuccacuuuccucaccccaaauauguggaaccuuguacaagg

SEQ ID NO: 1748 - RNA, 71 nt, Human
ccuuuauguacuaucucuagaaguaaaauaguaaaaacuauauaagauagauauauaugaguagaacaagg

SEQ ID NO: 1749 - RNA, 66 nt, Human
ccuuucccaagugugacaaagauccaugaacugaacugugguggacacugugcuuacagggaacgg

SEQ ID NO: 1750 - RNA, 93 nt, Human
ccuuuccuuuucuggggggaaagggaaaauuuuugggggggauuuccccgagaaaaccccccuuuucaacuuuccuaccauaaaaaggggggg

SEQ ID NO: 1751 - RNA, 66 nt, Human
ccuuucuccguccuucauggaagcccugggagauaaccuggcuuccuggaguugauggaauaaagg

SEQ ID NO: 1752 - RNA, 78 nt, Human
ccuuucugacuucaagaugaaucuuugggacgauguuucuggugcuugguccacagugauucacuuuugaaggagagg

SEQ ID NO: 1753 - RNA, 60 nt, Human
ccuuugaacaaccugucgguuuuuaucaccauuuuauagguaagaaaauugggucagagg

SEQ ID NO: 1754 - RNA, 74 nt, Human
ccuuugaacccuguguuaacaaugagaagcuuguuuauuugaaggcuggguucucauuggcccacagggguagg

SEQ ID NO: 1755 - RNA, 99 nt, Human
ccuuuguuauaauugauaggauacaucuuggacauggaauuguuaagccaccucugagcaguguaugucaggacuuguucauuagguuggcagcagagg

SEQ ID NO: 1756 - RNA, 80 nt, Human
ccuuuugcauuucuuguuuccacucuauggguuggaauagagagaguccagauuuugaggagaagcugaaaugugugggg

SEQ ID NO: 1757 - RNA, 66 nt, Human
ccuuuuuaaugggucccaaaaucugugacaaauuuugguccaguugguucccuuuaaaaguucugg

SEQ ID NO: 1758 - RNA, 62 nt, Human
cgaaaccuguuuguucccagcccacccccaguggaugggaugcauaaugccagcaaguuuug

SEQ ID NO: 1759 - RNA, 62 nt, Human
cgaaucuggagagcuuuggauccugggugaugucuucauccgccaguacuuuaccgucuucg

SEQ ID NO: 1760 - RNA, 81 nt, Human
cgaauggaccacuggagggguucaaagauuccaguucuaauaugggaaugagccucuuugaucucuuccggggcuuuuucg

SEQ ID NO: 1761 - RNA, 81 nt, Human
cgaauggaccacuggagggguucaaagguucgcgucccaguacgggaaugagccucuuugaucucuuccggggcuuuuucg

SEQ ID NO: 1762 - RNA, 74 nt, Human
cgacuccuaacgcagccguguccggagcgcccucccgacggacccagagggcgcuacgguugcgugggcagucg

SEQ ID NO: 1763 - RNA, 84 nt, Human
cgacuuccucaugaagagacuccagaaagggguauggggcauagucucuuacccucuuucuuuggagcuaaaggagguucuucg

SEQ ID NO: 1764 - RNA, 84 nt, Human
cgacuuccucaugaagagacuccagaaagggguauggggcauagucucuuacccucuuucuuuggagcuaaaggagguuuuucg

SEQ ID NO: 1765 - RNA, 89 nt, Human
cgagauguguaaucauaagcaucugcgaauggaagcaucaaaacggaugaugaacugaaucgcagggugacuugugcuugguuauuuug

SEQ ID NO: 1766 - RNA, 86 nt, Human
cgagauugagcaauaacaggucugugaugcccuuaguuguccggcccggacaacgacaggauugacagauugauagcucuuucucg

SEQ ID NO: 1767 - RNA, 64 nt, Human
cgaggcagcgagcgacccccagcaucccgcggccuccgaaggggccgccgccgccgccgccucg

SEQ ID NO: 1768 - RNA, 90 nt, Human
cgaggcugguguugugaagauccuggugucgcaugggccgcgcccgccguguuaccgguauuguaagaacaagccguacccaaagucucg

SEQ ID NO: 1769 - RNA, 85 nt, Human
cgagggcccuccgugccgccggcgccaugggcaauugccacacgguggggcccaacgaggcgcuggugguuucagggggcuguug

SEQ ID NO: 1770 - RNA, 105 nt, Human
cgaguacuacugaucacaucuacuuaacuggcacaaugaacacaguagguacuuuuagcuuauguuggccuuuuggaguggguguccaagaucagcacuuccucg

SEQ ID NO: 1771 - RNA, 92 nt, Human
cgaguagcugcgcuccccugcuagaaccuccaaacaagcucucaagguccauuuguaggagaacguaggguagucaagcuuccaagacgucg

SEQ ID NO: 1772 - RNA, 131 nt, Human
cgagugauuuuugagguaaguauguuauuggaaaggugugaucuauauagaacccuguacaugaaaaggaggagaugccgcuaucuuggcagggaugaucauguauuugaaauaguaacucacagcauuug

SEQ ID NO: 1773 - RNA, 97 nt, Human
cgagugugccucggcaggagggcuugacuuucuucggcacagagcuagccccagugcggucaacaggagucgggccucucugcuaagaacauacuug

SEQ ID NO: 1774 - RNA, 78 nt, Human
cgagugugugcuggagaaggccuggcucgcauggaguuguuucuuuuguugugugccauuuugcagcauuuuaauuug

SEQ ID NO: 1775 - RNA, 83 nt, Human
cgaucuucccaggugggcggaagcgguggaagaaacccuucgguugguggaggguuccguuuucgaaaccccugggaaaguug

SEQ ID NO: 1776 - RNA, 78 nt, Human
cgauggucucagcuuggaggcugaagugagcuacaguugcccucuguacuccagccugggggacaaaaggagaccuug

SEQ ID NO: 1777 - RNA, 81 nt, Human
cgauugggacugacgcucauggacaggguucccauggauaaauuugucgaaggcaccagguccaaugcaguggucaagucg

SEQ ID NO: 1778 - RNA, 72 nt, Human
cgcauagccgccucuucgaccaggccuucgggcugccccugcugccggaggaguggucgcaugugguuagcg

SEQ ID NO: 1779 - RNA, 83 nt, Human
cgccaguaaucccagcguuuugagaagccauggcacgcagauuuugagcccaggaguuugagaccagucugggcaacauggcg

SEQ ID NO: 1780 - RNA, 73 nt, Human
cgccccggcccggugcagcaccaccagcguguccaggaagcccucccgggcagcgucgugcacgggucgggug

SEQ ID NO: 1781 - RNA, 106 nt, Human
cgccccugaggaccccucggaucugcuccagcacgugaaauuccaguccagcaacuuugaaaacauccugacgugggacagcgggccggagggcaccccagacacg

SEQ ID NO: 1782 - RNA, 79 nt, Human
cgccccugcgcuguccgcccuuccccuagcguuacuuccggucccucgcugaggggguucgugcggcucccaggaggcg

SEQ ID NO: 1783 - RNA, 88 nt, Human
cgccccuguugacagauggagauugggcagcagggccuugcugcauuguuaucugcuguuccgacuugguuugucuuguccaagggug

SEQ ID NO: 1784 - RNA, 92 nt, Human
cgcccucuggcccuuccugggcaucguggcugaggugcuggugcuggucaccaucaucuucaucuacgagaagcgccggaagcccgaggacg

SEQ ID NO: 1785 - RNA, 72 nt, Human
cgcccuggggucauugucagguaaagaugguaaagccuguugcuagucaaguauugagggacucagguggug

SEQ ID NO: 1786 - RNA, 81 nt, Human
cgcccuugcaaucucuaggucacuuucuccgcuuguagauuuugcgcgcaagccccagaaagacggcugggggcaggggug

SEQ ID NO: 1787 - RNA, 74 nt, Human
cgccucagccgccucgcacauuuagucuugccgggaguggugugauucccgaccaagauggcggccguggggcg

SEQ ID NO: 1788 - RNA, 67 nt, Human
cgccugggcuuccuaucccaucgggacccagauggcuggggggcagggggaaugggaguauaaggug

SEQ ID NO: 1789 - RNA, 60 nt, Human
cgccuucucugucccccagaacagaacaaacucuuguucucugugguuggggaaaaggug

SEQ ID NO: 1790 - RNA, 63 nt, Human
cgccuugggugggccccgcuguuucguugugcuuacggaaguggggccacucuuaaaagggcg

SEQ ID NO: 1791 - RNA, 95 nt, Human
guuacuggaguacggggccaggugccacccuuagucacuaccaacuuccuggugaaagaccaagggaaugcaaguccccgauacauccgauguac

SEQ ID NO: 1792 - RNA, 88 nt, Human
guuacuuggcuuucggcucugcucugauaauucuguggcucucuuaagaguuaaauccugaaaagugcagacucaagagccaugugau

SEQ ID NO: 1793 - RNA, 91 nt, Human
guuagaguugaggguacugaggcccaaggcuguccugcuccaugucacccaguuggucagggggcugcuggcugagccccaaugcucugac

SEQ ID NO: 1794 - RNA, 65 nt, Human
guuagguagguagcccgccagaagaaaagaucuagcccaguuucuggacauauugcgugccuaac

SEQ ID NO: 1795 - RNA, 82 nt, Human
guuaguaccacuuagggcuacaaggacccuggguucuucugucagaggaauuggguucagguuucaggcuuuaggguguaac

SEQ ID NO: 1796 - RNA, 64 nt, Human
guuagugugucuaaaacaaggagguuuaaggcaauauggaacuguaucccguugaugcacuaac

SEQ ID NO: 1797 - RNA, 73 nt, Human
guuaguucaguacuuauuagcugcaggagcuaacguucaugcaagaacagcaacaggggauacagcgacuaac

SEQ ID NO: 1798 - RNA, 79 nt, Human
guuauauaauguacaauauaggaccccuccaaauagguuuugcuucuggugaaucuuggucauuggguuaguauaugac

SEQ ID NO: 1799 - RNA, 78 nt, Human
guuaugauccuauaagcauggcaacagauauguggagcauuggaguguuaacauaugucaugcuuacaggaauaucac

SEQ ID NO: 1800 - RNA, 70 nt, Human
guucaacaucauuagagcccuguagaaugacagccuuuuucagguugccagucugcucauccauguaugc

SEQ ID NO: 1801 - RNA, 71 nt, Human
guucaauuguacaaaaccuaauuuguugucaaaaguaucaagcaauaaauuuuaacuauuguacagggaau

SEQ ID NO: 1802 - RNA, 84 nt, Human
guucacagaggaacuuaagaaguauggagugacgacuugugguucgaguugugugaugcuacauaugauaaagcuccaguggac

SEQ ID NO: 1803 - RNA, 67 nt, Human
guucaccaccugcuugcggacccugauauggcgcuggcggaucagcacgcgagcgugguggauggac

SEQ ID NO: 1804 - RNA, 85 nt, Human
guucaccucaacuggauucggaaugugcugauuuccauuggacucaaguugaucucacuuauauucugagugccgggaggugaau

SEQ ID NO: 1805 - RNA, 69 nt, Human
guucaggggucccaugagccuugauuuaaugggggccguugccauagggauucagggggcucccugggc

SEQ ID NO: 1806 - RNA, 97 nt, Human
guucaguucgagcgccaagaucgugaagcccaauggcgagaagccggacgaguucgaguccggcaucucccaggcucuucuggagcuggagaugaac

SEQ ID NO: 1807 - RNA, 79 nt, Human
guuccacaccuugcucaucuccuugugcccuuggaucugagaguugacgaaggcgcggaggaugugggaggugaggggc

SEQ ID NO: 1808 - RNA, 85 nt, Human
guuccagguuuauuuaauuccaaaggugagaguuggagugagaugucuuccauaucuauaccuuugugcacaguugaaugggaac

SEQ ID NO: 1809 - RNA, 92 nt, Human
guuccauuuuaaguuagaaaaauguaucugugugggaguaaaaagauuuccuuuuuaaaaucauuucagauaucaccauacuugaugggaac

SEQ ID NO: 1810 - RNA, 89 nt, Human
guucccacacuggcgguguggcugccugcucagggccuggcuccuccgacauggaggaggaaggggcggcagcuggcacagccggggac

SEQ ID NO: 1811 - RNA, 76 nt, Human
guuccuacuugcaaaagaaaagugacguggaggaucacucggugcaccugcuuuuuuucugcaaaucgcugggaac

SEQ ID NO: 1812 - RNA, 73 nt, Human
guucguuuuuguagagguaguuugggagcauggggggugccccugagcuccagccucuucuggagguacgugc

SEQ ID NO: 1813 - RNA, 94 nt, Human
guucucuugagacuaguaggcauagaagaaagcagaaggaaaauaaauagaaagaaggucuucuaccuucauggcuauucaggcucaggagggu

SEQ ID NO: 1814 - RNA, 92 nt, Human
guucugcacauguguauguucugccauuuccaggacgaaaaggagguugugcuaaagggaaaggaggaucgaugcacauguaugccaagaac

SEQ ID NO: 1815 - RNA, 74 nt, Human
guucugugccaaacaccuguguggaaugccgcaagcccaucggugcggacuccaaggaggugcacuauaagaac

SEQ ID NO: 1816 - RNA, 71 nt, Human
guucuuaagguugaagugugguucagggccagugcaauauuaguggacagcacuuaguagcuguggaggac

SEQ ID NO: 1817 - RNA, 107 nt, Human
guucuugccaccaaaaagaagcaaauaacaucuaguaccugugggcaguuggcuaagaggcugugguauuuuuuguguguauuugcuuucuaccuggggaucagagc

SEQ ID NO: 1818 - RNA, 67 nt, Human
guucuuuucccuugcugcaaccuacagaggugccauugugggaaugauaguagcugaaauuaagaac

SEQ ID NO: 1819 - RNA, 93 nt, Human
guugaaagcuaagaaagugaggaggugguucaggggaucacucuuuccuacuuguuccucucaccucaaacucaccuucuacugcgcagcaac

SEQ ID NO: 1820 - RNA, 61 nt, Human
guugaaggcacaacaguuaauggcuguauuguugcuauuccguugcugacauguuuuuaau

SEQ ID NO: 1821 - RNA, 79 nt, Human
guugacacuaaaaugcaucaaacuccuuucaugcuggcuuuaccagaagucaaaaaugaagaggcuugcuaaguguggc

SEQ ID NO: 1822 - RNA, 114 nt, Human
guugagcauccuuaauccccaaauccaaaauucuccagucagcauuuccuuugagcaucaugucauugcucaaaaaguuucagauuuuggaguuuugaauuugggauacucaac

SEQ ID NO: 1823 - RNA, 80 nt, Human
guugaggccauccagcccuugccguucuuuugacuuccucagcagagcauaccuuccaagaaacuggacuucuccucgau

SEQ ID NO: 1824 - RNA, 84 nt, Human
guugauuuguuuccaugaaccugaguugcuuugauuuaaaaaaaauuaaugcaacaaaaauacagcaucaguauacaaauccac

SEQ ID NO: 1825 - RNA, 91 nt, Human
guugcagaugcuauucuaggcaaucagauguucacacauuaugaccgggcucauauugcucaacugugugaaaaggcuggccuacugcagc

SEQ ID NO: 1826 - RNA, 80 nt, Human
guugcauacagggcacauggcuagaauugcaguuuccacuugucaucuaagcuggccaacuuggugcaguuguacacagc

SEQ ID NO: 1827 - RNA, 105 nt, Human
guugcauucuuagggagcgucuucaguguguacacggcagcagucccuuggccgcauucuuagggaaccuuuucaguucauacacaguggcggucccuuggcaac

SEQ ID NO: 1828 - RNA, 82 nt, Human
guugccugacggggauuagacuggagucacuauagcgauaaauggccugucauacuuuccuuugauuucccaggguuucaac

SEQ ID NO: 1829 - RNA, 66 nt, Human
guugccuugcuccaagucugggcaucgugacauugccgugaugcccagaagaaaguuaauggcaau

SEQ ID NO: 1830 - RNA, 110 nt, Human
guugccuuugcuccagaucuaggugagaucagauggaauggaggcuccaucuggucuucaggaagucucaaguuuucacugaucuacauaaaaucucagagcaaggcaau

SEQ ID NO: 1831 - RNA, 87 nt, Human
guugcggcccggguuuagaagggauucaugggggccgggcugccggugcggcccgggcggccggggcuucugggcgugggccccaac

SEQ ID NO: 1832 - RNA, 72 nt, Human
guugcuguucauaaguuuaguaucuauaucugaaaaaaucauagaaaauugcuggguuuagcucucagcagc

SEQ ID NO: 1833 - RNA, 90 nt, Human
guuggaagagaaaaugguacagcaguuacaagaggauguggacauggaagaugcuccuuaaaaaucucuguaaccauuucuuuuauguac

SEQ ID NO: 1834 - RNA, 72 nt, Human
guugggauucccaucggggagggugcucaugaugaagagguacucaagacaauugacgagggagaugccgau

SEQ ID NO: 1835 - RNA, 92 nt, Human
guugggcagaacacagccauauuuuucuucucgcagaaagccuauagauggaugugugaguaggagaaauauugcugaauucuuuucccagc

SEQ ID NO: 1836 - RNA, 90 nt, Human
guugggcccucucuugaagaagcgaccuugcggugccauguguuuugcucagauggugugcacccucuguuucuuguuugggcgcccagc

SEQ ID NO: 1837 - RNA, 75 nt, Human
guuggugaccucagauacacuguucagaaguacucaaaguauuccuuuuuucucacauuugagagucacucuagc

SEQ ID NO: 1838 - RNA, 82 nt, Human
guugucuguuuguggauuucauuucugccuuuuaguuuuuacuucuucuuucuuuggaggcagaaauugggcauaagacaau

SEQ ID NO: 1839 - RNA, 74 nt, Human
guuguuauuggugcaggaguaauagguguagaacuggguucaguuuggcaaagacuuggugcagaugugacagc

SEQ ID NO: 1840 - RNA, 68 nt, Human
guuguuuuuauaaugggcguuuucacaugcacauauguguaugcauguauacgcccauacagacaugc

SEQ ID NO: 1841 - RNA, 131 nt, Human
guuuaaaugguuauccgggagaauuccuguuguguggaagaugcuuugcccuuucuucaucuggaaaucauuuuuccauccuuuaggucacagcuuaaacaugauuuucccaggaauuuuucucugaccac

SEQ ID NO: 1842 - RNA, 69 nt, Human
guuuaauggccaauacgauaucauccaaugcaaagaaggggugggcugcuaucgaguggauaauugaac

SEQ ID NO: 1843 - RNA, 71 nt, Human
guuuagaaguuucuggccccacaguucuagaggcugacugacuggggcagguuguagagaaacuucuggac

SEQ ID NO: 1844 - RNA, 70 nt, Human
guuuagccagcucucccggcaguagcaaggccaccugugguuugaaucuuucuggaagaaaugguggagc

SEQ ID NO: 1845 - RNA, 82 nt, Human
guuucagauaaaguagaaguugucuguacuucuucccuagcaaacugagggagugguacugacuucugucucugucuggggc

SEQ ID NO: 1846 - RNA, 100 nt, Human
guuucccacuuuucucccaucugucauuuuucucuuuccauaaaaagcuaauggugacguuaucaaagagugaaggagucagaggcuaaggguggggaac

SEQ ID NO: 1847 - RNA, 82 nt, Human
guuucuuguaaaggcgucugacaguccugagaauuauugaugguaaggaauaaaaaauguacagaugacuucaugaagauac

SEQ ID NO: 1848 - RNA, 111 nt, Human
guuugaauucagacacugacaggugggcaagggaaaauagaugguaaucucuuaaagaguaaagaccaucucucuaaguucucuuaucccuuauagcaguggcucucaaac

SEQ ID NO: 1849 - RNA, 75 nt, Human
guuugaccuggccuggcaguacgggcccugcaccgggaucacacggcugcagcgcuggugucgggccaagcagau

SEQ ID NO: 1850 - RNA, 79 nt, Human
guuugagaagauuagaagaagaaucucuaucaggaccagucuucagccauagggguucugcuucucggcuucuauaaac

SEQ ID NO: 1851 - RNA, 96 nt, Human
guuugagcagaugagagccaacgugggcaaguugcucaaggguaucgacagguacaauccugagaaccuggccacccuggagcucuauguagagac

SEQ ID NO: 1852 - RNA, 95 nt, Human
guuugagguguuugugguauaauuuuuuugcguuuaguaugguguguaguuauauauauugaguuuaaggguuguguguauagaguauuuuggau

SEQ ID NO: 1853 - RNA, 82 nt, Human
guuugaguucaaagauggagcgaggguggauauggugggaaggggcacacggguucucacgcaacaacggaggaaggcaggc

SEQ ID NO: 1854 - RNA, 83 nt, Human
guuugcagacucugugggaauuguuuuucaucuguuucuaugguugucaaaugaauucuucacccacccuacaguuugcuaac

SEQ ID NO: 1855 - RNA, 86 nt, Human
guuugccucgaguuagucacgaaggaaucgaagagagccuuagucuucgaggcuuuucccuuccugugagccccuuugaggccagc

SEQ ID NO: 1856 - RNA, 91 nt, Human
guuuggaauugcaucagagaucauguaaggugaagagaaagaguacaaaguguuucuauggccugucucuggacuccugcacauuccgaac

SEQ ID NO: 1857 - RNA, 61 nt, Human
guuuggaggguuugguggucuccacucccgccuugacggggcugccaucugccuuccaggc

SEQ ID NO: 1858 - RNA, 82 nt, Human
guuuggaguuccacagccucugccaagcgguuuguaagccuuagcgagcucuugcgcgcaggggcaauauggagcgccgcac

SEQ ID NO: 1859 - RNA, 91 nt, Human
guuuggccguaaggugccgugcgugaauugugcuugugcccuccacacggguucgugggcacuccggacgugauuaaccagccggccagac

SEQ ID NO: 1860 - RNA, 81 nt, Human
guuuggggguuggaggguggagggguggcauuaggguaugugagccgcuccccaugcuucaccuccccucuccccucaagc

SEQ ID NO: 1861 - RNA, 106 nt, Human
guuuguaaaugucccuccugugucccaaaacgaaaacacuccuauauuuuguagcgccuuccagaauggggcagcggaaacuaguguugggacaaaggaggcgagc

SEQ ID NO: 1862 - RNA, 60 nt, Human
guuugugccuucacccugagcaaaguauuuaaacaaauuuucucgaagguguguguaaau

SEQ ID NO: 1863 - RNA, 96 nt, Human
guuugugggaggaggacuggcaaaaauaugagaguaggaguuugggcucuugagcuugggccuggccuucaaauuuccacucuuucacucacuagc

SEQ ID NO: 1864 - RNA, 81 nt, Human
guuuuauaauuccuuaaaacagcugaaaauugggacaacauacuuuacgcaaugaacaguaguuaaauagggaaauaaaac

SEQ ID NO: 1865 - RNA, 77 nt, Human
guuuuauuaaaguuauuuacauuuaauggcaauauuuacagagaaacauuguguaaaucuuaaaauuuuuuaaaaac

SEQ ID NO: 1866 - RNA, 73 nt, Human
guuuucagcuucccuaagggacuggcauaggguuuguggggucaaugccaggaaccugggggaaacuggaugc

SEQ ID NO: 1867 - RNA, 62 nt, Human
guuuucauccucuaguacugaagugcccucaaggugguaggcacuguauagcaggagaaaac

SEQ ID NO: 1868 - RNA, 78 nt, Human
guuuucaugggaagccacuuugacaggcauuacuguggcaaguguugucugacuuacugcuucaacaaaccagaagac

SEQ ID NO: 1869 - RNA, 71 nt, Human
guuuucccaauacuuuagaaaaauuacuaaucauuaauaagucgauuuuauacucaaaguaauggccuaac

SEQ ID NO: 1870 - RNA, 76 nt, Human
guuuucgcugugaacauucccuugaucucaucaaguucugagcgggucaauggggcaacacgguuagcgggagagc

SEQ ID NO: 1871 - RNA, 91 nt, Human
guuuucuggcuccaccucacccuaguuccuaaucaucauccauauccaccugauggaauagaaaauagcgugagguguguucccaggaggc

SEQ ID NO: 1872 - RNA, 73 nt, Human
guuuugaauguaaagaaaaauuguggaaaugcugucagcagcuauucacagaccaaaccagacauccauagac

SEQ ID NO: 1873 - RNA, 82 nt, Human
guuuugauagucugaggcugggccucugccuuugugaaguugaagagccaggagcuacucagcaacaauugauuuuugaaac

SEQ ID NO: 1874 - RNA, 68 nt, Human
guuuugcaauucuucugcacuuucccaccaagcugggaucugggugagucuagagauauuugugaaau

SEQ ID NO: 1875 - RNA, 77 nt, Human
guuuuggucucgcgggcuaguagggcgcacuuggcggggaggcgcuugggcgcgagacuaggcgugaagagcagagc

SEQ ID NO: 1876 - RNA, 69 nt, Human
guuuuguauaacuuuauugcaagucacauaaucuugguuuagacuugacgcaacgggagguuacagagc

SEQ ID NO: 1877 - RNA, 89 nt, Human
cgcgacuccgugagcgccuccgccggucccgggacgcgggagcgucgccguucucgcuccuugucucgcucccggcuccgcucucugcg

SEQ ID NO: 1878 - RNA, 91 nt, Human
cgcggagccucauggggguuggaguccccaagguuuccuuugugcgcaguauuggcggggccuuggacuaccacucccacaaggcaccgcg

SEQ ID NO: 1879 - RNA, 101 nt, Human
cgcggcgcuggccgacugggcgucgcccuuccacgagcgccacuuccacuacgaggagcaccuggagcgcaugaagcggcgcagcagcgccagugucagcg

SEQ ID NO: 1880 - RNA, 79 nt, Human
cgcgggaggcgugcugggcgcggggcugcggugcccagaggcugcggcauuaggggcucggcgcccccgaccuuccgcg

SEQ ID NO: 1881 - RNA, 79 nt, Human
cgcuaccaagcgguguggucccagcaugggggguccuacuacaugauaucgcgcucgcugggacccgaguuuggaggcg

SEQ ID NO: 1882 - RNA, 77 nt, Human
cgcucacauuccaggcccuuguccugcaggcugccgcgggcggacacgccagaggaggaggccggggaauggccgcg

SEQ ID NO: 1883 - RNA, 86 nt, Human
cgcuccaguugguuggguauaccgaugacuuugggccgugaguguguuucggguuucaaggucgcugggcccgagguggaccugcg

SEQ ID NO: 1884 - RNA, 90 nt, Human
cgcucgcugaccuggcgcugcugccccuggugccugacggaggaugagaaggccgucugucccggguggacucagugaggaucagcagug

SEQ ID NO: 1885 - RNA, 74 nt, Human
cgcucuuucacccaggcuggagugcaguggcaugaucucagcucacugcaaccuccaucuccuggguucaagcg

SEQ ID NO: 1886 - RNA, 76 nt, Human
cgcugccucucugcaggccgugugcuuugcucgguugaucuugcagagccuaagacacaggcccagagaggcagug

SEQ ID NO: 1887 - RNA, 68 nt, Human
cgcugcgucccagcgacucugcggggguuucgucgaggcccggcaggcuugggucgggagacgcggcg

SEQ ID NO: 1888 - RNA, 88 nt, Human
cgcugggcaggacgacaaacacgagacgccacuguggaaugagcaacuucggagcacggggugacuugcuugggaccgugcccacgug

SEQ ID NO: 1889 - RNA, 88 nt, Human
cgcugggcugugcggugcggagggugaugaggaugucuggugacagccgugcggacaccacuccucucugcagcacugccucccagcg

SEQ ID NO: 1890 - RNA, 77 nt, Human
cgcugggucuccuuucucacugccccaacgcguuugcaggggcgcuuuccccgcugggggcuguugggggcccggcg

SEQ ID NO: 1891 - RNA, 89 nt, Human
cgcugguuccugcggcuucugcucagacaccaacgccagacggcgaugccucucggguggugacuccagcgcaggaacuugaagaagcg

SEQ ID NO: 1892 - RNA, 97 nt, Human
cgcuguaagcuucugcuggggauaggaauucuggugcuccugaucaucgugauucugggggugcccuugauuaucuucaccaucaaggccaacagcg

SEQ ID NO: 1893 - RNA, 75 nt, Human
cgcugucggggccgugagacgcugucggggcggugaggacacugucggggcggugaggacgcuguggggacggug

SEQ ID NO: 1894 - RNA, 72 nt, Human
cgcugugcgugagcugcgacggcaagguggagcacuaccgcaucauguaccaugccagcaagcucagcaucg

SEQ ID NO: 1895 - RNA, 78 nt, Human
cggaaaacagcuggaagauggucguacccugucugacuacaacauccagaaagaguccaccuugcagcuggugcuccg

SEQ ID NO: 1896 - RNA, 89 nt, Human
cggaaccgcugucuuucacgccugucucacuccacacgggggccccgaccccagggucccgaaagucccaggcuguuggacguggucug

SEQ ID NO: 1897 - RNA, 81 nt, Human
cggacacaucacagguauugacugggcucccaagagcgaccgcauugucacuuguggggcagaccgcaaugccuaugucug

SEQ ID NO: 1898 - RNA, 80 nt, Human
cggacacuucggcccccugagaccaguucacggacgguggcaaauaucacaucugcuggucucugaguccuagcugucug

SEQ ID NO: 1899 - RNA, 86 nt, Human
cggacagacauuugguauggaucacuggucauuccuacgucaccuaugggccacuggccaauggugccaccagauguuuuuguuug

SEQ ID NO: 1900 - RNA, 80 nt, Human
cggacauucccugugacuccacaggccagaccucaaccuagaaagauggccacaggacuugcaacucaggguggugucug

SEQ ID NO: 1901 - RNA, 91 nt, Human
cggacccugcugugagcagcucccuauuccaugacaguguguugagcucuccauugucagaggcugguaggguguucagcuagaggugccg

SEQ ID NO: 1902 - RNA, 67 nt, Human
cggaccgcuggaucgugccgggcgggggcauggagcccgaggaggagccgggcggugcggcgguccg

SEQ ID NO: 1903 - RNA, 95 nt, Human
cggagagugcuuggguggugggugcuggaggauuuccaguucugaacacguauuuauauuggaaagagaccagaaccgaagcucggcacuccccg

SEQ ID NO: 1904 - RNA, 100 nt, Human
gacauggaggucagcgccacagaacucaugaacauucucaauaagguugugacgcgacacccugaucugaagacugaugguuugggcauugacacauguc

SEQ ID NO: 1905 - RNA, 104 nt, Human
gacauuguauagcuaagaaauaguaaagcagggauuugaacuccacaucugacccuacagccuguauucauaacaacucugcucugugucuuggcuccaaaguc

SEQ ID NO: 1906 - RNA, 67 nt, Human
uucaaguaaaaacccuuucuccuuccuggggccucggcuccuggagggcuggagggucucgucugag

SEQ ID NO: 1907 - RNA, 104 nt, Human
uucaauuaccuuuuggugaagagggcgugaggaaaauaauuccauuaucgaauaugcuuuuauuauuccucuuuaaugccuuuuucauuuugggguuuuaggaa

SEQ ID NO: 1908 - RNA, 75 nt, Human
uucaauuuccuauuccuuucaccugccccuagaaggggcaagaggcgggugagcaggagagauggggcuauugaa

SEQ ID NO: 1909 - RNA, 77 nt, Human
uucacaacuacuuuugaacaucuaaauuuaaaccuaaauuuuuuaauuaaaugccuguucaacaaagcuaauuggaa

SEQ ID NO: 1910 - RNA, 98 nt, Human
uucacaguuccggcuucccggcugcugucauauuugccgucuuugucaucacaggcaaaugccagcagaggccuuuuggggugccacgccacugugaa

SEQ ID NO: 1911 - RNA, 103 nt, Human
uucaccgcacccucggacugccccaaggccccgccgcgcuccagcgccgcuccggcggcggcggcggcggcggcggggugguggaggcggcgguggcggugga

SEQ ID NO: 1912 - RNA, 77 nt, Human
uucacucaggcgcgcuacuuggagaaagaagagaagugucucccuccucccagcauucggguaguggucacggugga

SEQ ID NO: 1913 - RNA, 116 nt, Human
uucacuggauaugguggugggugcuuguaguugcagcuuagucagaaggcugugguagaagaaucgccugaaccugaguaguugaggcugcagugagccaugaucaugccacugaa

SEQ ID NO: 1914 - RNA, 65 nt, Human
uucagaaugaugggccugugaccauagagcuggaaucgccagcucccggcacugcuaccucugaa

SEQ ID NO: 1915 - RNA, 73 nt, Human
uucagcaagguucuggcgcaggugcagcacccccugcugcugcuuaccucagcguucacaggccugugcagaa

SEQ ID NO: 1916 - RNA, 86 nt, Human
uucaggccacccugcucauggcccuuccuggccgccugccacaccgcaagcucgcuggggggacacuagaagcaccguggccuggg

SEQ ID NO: 1917 - RNA, 86 nt, Human
uucaguugcuucaggccaucuggauguauaugugcaggucacaggguuaugauggcuuagcuugggcucaggggccugacauugag

SEQ ID NO: 1918 - RNA, 63 nt, Human
uucaugcaagcauguguuuuaccuggcaagccugccgcaagacacagguaagaugcaggugaa

SEQ ID NO: 1919 - RNA, 71 nt, Human
uucauggucccugcccaguccucguggaacuacaacuuucaaugggugaucgggcaugaccccaacaugaa

SEQ ID NO: 1920 - RNA, 78 nt, Human
uucauuauuuuaugcugccucugcauaacuaauuuugauuucagggcuaggaggguggagguagggugaggaaaugaa

SEQ ID NO: 1921 - RNA, 81 nt, Human
uucauugguacaaacaucuuucauacacaauaggcuaugauaaaaugaggcauauggguguauaacuacaguauuaaugga

SEQ ID NO: 1922 - RNA, 77 nt, Human
uuccaaccagcuguauuuacuccuuggaauauggugcuuguggccuuucugaggagaaagcuguggagaaguugggg

SEQ ID NO: 1923 - RNA, 87 nt, Human
uuccaauggguguuaaucucccaccauaagaaucugugacacacggaugcaugaucuaugaagugagagaugggaacaacaauggaa

SEQ ID NO: 1924 - RNA, 91 nt, Human
uuccaggauuucacaugaauucaaugaagggggcugugucuuauuccuggaugcuuugccuccuucauggaauucaguggauuuaauggaa

SEQ ID NO: 1925 - RNA, 67 nt, Human
uuccaugggcaggggccaugacagggagauaggccacaccuuucccagguggaaccugcagauggag

SEQ ID NO: 1926 - RNA, 73 nt, Human
uucccacugaacuuuuucuccaauucgcguacuagccggacuuggauuuucuggaaagauuucaguugaggaa

SEQ ID NO: 1927 - RNA, 71 nt, Human
uuccuaagccuugggacagcugggaacuuaacuugaaauaggaaguucucacugaauccuggaggcuggaa

SEQ ID NO: 1928 - RNA, 78 nt, Human
uuccuaccacuuaagaauaaaaaaugcauuuuaauaaaaacaaaucuauacugaagucauuuuccuuugugagaggaa

SEQ ID NO: 1929 - RNA, 105 nt, Human
uuccuccaguuuucagucacucaguagaugucuguacuaucauauccaucauaugaauauaucacauaugauagguaccaacuaucugagugaaaacuggaagaa

SEQ ID NO: 1930 - RNA, 76 nt, Human
uuccucuuccagcucagcuucucuacucugggcaagguaagcagggggcugaaagguauagagaugggaaggggaa

SEQ ID NO: 1931 - RNA, 79 nt, Human
uuccugaggauucacuggguuucugggucccaaaggggaaguucucuucaagguacaaaaaccacgacuccgcagagaa

SEQ ID NO: 1932 - RNA, 92 nt, Human
uuccugccagaaugcgcacagaacauaagucagccaagugugucgugccaggggauacuuugacuuugguuugcugcugcugcugcuagggg

SEQ ID NO: 1933 - RNA, 95 nt, Human
uuccuguuggaccuucgaacaugucuucuccacgagguggaaugaagcaaaaggacaacccauuugguaaaagguggagaaugugggaacaggag

SEQ ID NO: 1934 - RNA, 94 nt, Human
uuccuuuggcagcauuacuuuugauaagaagucuccaaauaaaauacaaaauuuuggcacagacauuuuaaucuugucaagacaauguaaggaa

SEQ ID NO: 1935 - RNA, 75 nt, Human
uucgccucuuccugcuguaugcucaucccugcacugagcacagauaugacaagcaguagccaugggggagguggg

SEQ ID NO: 1936 - RNA, 67 nt, Human
uucggcuggcuagcaggacacugagacuccccucugcuuugggcaguguccgcugcagccagucgga

SEQ ID NO: 1937 - RNA, 94 nt, Human
uucggguucuagccagaagcccuggggccugucucuugccucuucuuguagcaugagacacccuuggcagguguggcugugaagauguaucgaa

SEQ ID NO: 1938 - RNA, 130 nt, Human
uucuauguuauacccuggaguccugguugaggggugggggaaucagaaaaguagguuuacauuuaacauuuuucuuaacuacauucacuucuuaaaaaggaacaagaaguguaaauaaguauguauagag

SEQ ID NO: 1939 - RNA, 88 nt, Human
uucucauguugaagccaauuguuuuccaaauaauacugaauacaacuuucaaauuccuuuggguuauaguuggaaaccaggaugggaa

SEQ ID NO: 1940 - RNA, 67 nt, Human
uucucuguguaauuggcaaggcuguaccaauguugugcugaugcaagccuuuuucaguucaagagaa

SEQ ID NO: 1941 - RNA, 124 nt, Human
uucugaacuugggccagaucuuaaccugcugguaaagcacuggcugaggguuuagacuuucaaggaauuugagguuguuuucccugccuuauugcaacccagugucuggcugcugagaccagag

SEQ ID NO: 1942 - RNA, 85 nt, Human
uucugacccaugagaaagggaaaauuuacggagugauaauuuucacauaggugugaauuuauccauuauauaggcauggucagga

SEQ ID NO: 1943 - RNA, 84 nt, Human
uucugcaauccaguccucuuagaaauugguuucucucuuugggagauucagacucagaggcagccagaggggacaggucaagag

SEQ ID NO: 1944 - RNA, 75 nt, Human
uucugggccagaucuagggaucuucccucccucccugcacucuagcugcaggagcuuccuggugucugcccagag

SEQ ID NO: 1945 - RNA, 85 nt, Human
uucugguguuuccuagagagccaauggacuguauauaaaugcugcguuuguuuggagagggugucuuucuguaaggaucacugaa

SEQ ID NO: 1946 - RNA, 65 nt, Human
uucuguaccagguuuaaauguagucuucuggagaaguauuuuugacauugagcucugggacagga

SEQ ID NO: 1947 - RNA, 94 nt, Human
uucugucuuuugaauucugucgugacuggggcuaaacaacugucacuggcaagugacaagaggcacagacagcaggggaaauaaaaagagagaa

SEQ ID NO: 1948 - RNA, 104 nt, Human
uucugugaggcuguggccaucuacggcaucaucauggcaauugucauuagcaacauggcugagccuuucagugccacagaccccaaggccaucggccaucggaa

SEQ ID NO: 1949 - RNA, 74 nt, Human
uucuuaacgauauaagcaacggcuuugagagagaaaacuacuuucaaacaaagcacaguaacaguugaaaagag

SEQ ID NO: 1950 - RNA, 101 nt, Human
uucuuagaguccaucacagaccugaacugcugaaugcuauuccucauggaaacugaggcauggacauuucggcagcucccccuuggauguggccuggagga

SEQ ID NO: 1951 - RNA, 106 nt, Human
uugaaaaaugucaagacccuauaaaacugauuuguguucagaauuuucaaaaacaucuuguucucuucccuucacuaaaugucaguauucuugacuccuuuucuaa

SEQ ID NO: 1952 - RNA, 83 nt, Human
uugaaaauggaauggaaucuccaggagugaggguuuccauggaagccagcacuauccuuggggacaccacugaccauuaacaa

SEQ ID NO: 1953 - RNA, 82 nt, Human
uugaacucauucuggcugcaaacuacuuagacaucaaagguuugcuugauguuacaugcaagacuguugccaauaugaucaa

SEQ ID NO: 1954 - RNA, 94 nt, Human
uugaacuugaaacagaaaccugugcuaaaaugcuugccucauucaaauguuccuuaaaaccagagcacagagauuuuugcuuuuuuacuaucaa

SEQ ID NO: 1955 - RNA, 78 nt, Human
uugaagggauaggcucacuuuguuaauauuugagaacauaccauccauagaaccauagcuugucaguuguucuuucaa

SEQ ID NO: 1956 - RNA, 84 nt, Human
uugaccccaucaacgcacugcagggcugccauggaagggccuaugagugaccacccuuggauggaggccuggcaggaggggcaa

SEQ ID NO: 1957 - RNA, 77 nt, Human
uugacuaguuuucuuucuuuugcuaccucaacaccaaacaauaugggauuagugagaaaugaacuucaacugguuga

SEQ ID NO: 1958 - RNA, 103 nt, Human
uugagaaggagucucgcucugucacccaggcuggagugcaauggcacgaucucggcucacugcaaccucugccuccuggguucaagcgauucucuugccucag

SEQ ID NO: 1959 - RNA, 103 nt, Human
uugagacagagucucacucugucaccuaggcuguagugcaguggugcgaucucagcucacugcaaccucugccuccuggguucaagcaauucucaugucucag

SEQ ID NO: 1960 - RNA, 103 nt, Human
uugagacagagucucacucuuuuguccaggcuggagugcaauggugcuuucuuggcucacugcaaccucugccucccagguucaagugauucuccugccucag

SEQ ID NO: 1961 - RNA, 103 nt, Human
uugagacagagucuugcucugucacccaggcuggagugcaguggcaugaucucagcucauugcaaccucugccucccggguucaagcaauucuccugccucag

SEQ ID NO: 1962 - RNA, 103 nt, Human
uugagacagggucucacuuugucacccaggcuggagugcaguggcaugaucucggcucacugcaaccucugccaccugggcucaagcaauccuccuuccucag

SEQ ID NO: 1963 - RNA, 89 nt, Human
uugagacggagucagccuggagugcaguggugcaauuucggcucguugcagccucugccucccagguuuaagugauucuccugccucag

SEQ ID NO: 1964 - RNA, 104 nt, Human
uugagagcuggagucucgcucugucacccaggcuggagugcaguggugcgaucuuggcucacugcaaccuccaccuuuguguucaagcaauucuccuuccucag

SEQ ID NO: 1965 - RNA, 103 nt, Human
uugagauggaguauugcucuguggcccaggcuggagugcaguggcacaaucucggcuuacugcaagcuccgccuccuggguucacgccauucuccuaccucag

SEQ ID NO: 1966 - RNA, 103 nt, Human
uugagauggagucucccucugucaccuaggcuggagugcaguggcaugaucucggcuuacugcaaccuccaucucuaggguccaagugauccuccugccucag

SEQ ID NO: 1967 - RNA, 103 nt, Human
uugagauggagucucgcucugucacccaggcuggagugcagugguaagaucucugcucacugcaagcucugccucccggguucacgccauucuccugccucag

SEQ ID NO: 1968 - RNA, 102 nt, Human
uugagauggagucucgcucuguugcccaggcuggagugcaguggugcgaucucagcucacugcauccucugccucccggguucaagcaauucucugccucag

SEQ ID NO: 1969 - RNA, 101 nt, Human
uugagauggaguuuugcucuuguuccccaggcuggagugcaaaggugcggucuuggcucacugcacuccagccugggauacagagcgagacccugucucaa

SEQ ID NO: 1970 - RNA, 114 nt, Human
uugagauggguucucacuauauuguccaggcuagagugcaguggcuauucacagaugcgaacauaguacacugcagccuccaacuccuagccucaagugauccuccugucucaa

SEQ ID NO: 1971 - RNA, 66 nt, Human
uugagauuacuacacuacggauugaugucaccacugauggaagacaugcugagguagaauuuacaa

SEQ ID NO: 1972 - RNA, 103 nt, Human
uugaggcagagucucacucugucacccaggcuggagcgcagugacaugaucucugcucacugcaaccuccaccuccuggguucaagagauucucgugccucag

SEQ ID NO: 1973 - RNA, 68 nt, Human
uugagggccugaagccagaaggaacugacauggaggacagucuguuccaccuggauugcaggcuccag

SEQ ID NO: 1974 - RNA, 90 nt, Human
uugaguagcgaagagguggagaaauagcccgggccguuugcaagcuuugaagguccaggcucucuuucacacuccucagugucaucucaa

SEQ ID NO: 1975 - RNA, 103 nt, Human
uugagucagagucucacucugucauccaggcuggagugcagugguacgaucucgacucacugcauccucugccuuccagguucaagcgauucuccugccucag

SEQ ID NO: 1976 - RNA, 104 nt, Human
uugagucggaguaucgcucucguugccuaggcuggagugcaguggcgugaucucggcucacugcaaccuccaccucucggguucaagcaauucuccugccucag

SEQ ID NO: 1977 - RNA, 103 nt, Human
uugauacggagucucccucugucacccaggcuggagugcaguggcaugaucucagcucacugcaaccucugccucccggguucaagcaauucuccugccucag

SEQ ID NO: 1978 - RNA, 67 nt, Human
uugauacggagucuugcucuguugcccgggcuggagugcagugggugacagagugagacccuguuga

SEQ ID NO: 1979 - RNA, 81 nt, Human
uugaucuuaaccaguuucacuuguaccaagaccaaacuuucuuaccuuuccaugcagggaaacaggcaccaucaagaucaa

SEQ ID NO: 1980 - RNA, 76 nt, Human
uugaugaugucucucacucuguuccuuuaauuacaaagucucugaagacucugaacuugacugaggauaauguuaa

SEQ ID NO: 1981 - RNA, 60 nt, Human
uugauuggcaucugggaacuuggaguucagggggcuuccaccauucccagaacugaucaa

SEQ ID NO: 1982 - RNA, 76 nt, Human
uugauuuuuagagcaccaucacuuucacauuccugauucugauuuuguuugguuuguuggguuuucugaaacuuaa

SEQ ID NO: 1983 - RNA, 81 nt, Human
uugcacuggucccuggagagagggcguccccugcaggagagcuucaugcgccugguggaggccuguggggacucggagcaa

SEQ ID NO: 1984 - RNA, 80 nt, Human
uugcagaauuuaccucaagaacucuuugcuguugacccaacuaccguuucacaaggauugaaagaugagguucucuacaa

SEQ ID NO: 1985 - RNA, 94 nt, Human
uugcauuguaguaguuuguacagucauauguaaaacaauuuaucauaaugaagacccuuauaauaacaaccauauaugcuaucuaaaaaugcaa

SEQ ID NO: 1986 - RNA, 69 nt, Human
uugccaaaugcaucaaagguauuauauggucagaggauaauugugcacuaugucgccuuuggguagcaa

SEQ ID NO: 1987 - RNA, 76 nt, Human
uugccgucugccacagcuggugccgucugagaagggggucccccuguagcagcacaucgcugacuuggcucggcaa

SEQ ID NO: 1988 - RNA, 68 nt, Human
uugccucugcuugucaugccauuaagcucccaaauaaggaagaaacucacagauaaguccauuggugg

SEQ ID NO: 1989 - RNA, 63 nt, Human
uugcuaaaguugaacaaucccgguacuguaccauaucaguccuuuguggguaguagguagcaa

SEQ ID NO: 1990 - RNA, 75 nt, Human
uugcucuauuggcaggcuggagugcaguggugcgaucucagcucacugcaacccccgccucccagauucaagcaa

SEQ ID NO: 1991 - RNA, 76 nt, Human
uugcucugucacccaggcuggagugcaguggugccaucuuggcucacugcaaccucugccucccagguucaagcaa

SEQ ID NO: 1992 - RNA, 71 nt, Human
uugcugaggacccccaaggcguacuggcaaucaccguaaagguuuggggaucacaguuacuuucucagcaa

SEQ ID NO: 1993 - RNA, 109 nt, Human
uugcugggagcccaggacuggacucagaggagaagaugaguaucaauccauagcagaaacaaagagguauauaugcaucuuccaauagagaucacugggguucccacaa

SEQ ID NO: 1994 - RNA, 111 nt, Human
uugcuguagaggaagaaggagccgucggaguccagcaugggaggcgugguguuguaguuguucuccggcugcccgcugcucucccacuccacggcgaugucgcugggguag

SEQ ID NO: 1995 - RNA, 76 nt, Human
uugcuugaacccaagaggcggagguugcagugagcuaagaucaugccacugcacuccagccugggugacagagcaa

SEQ ID NO: 1996 - RNA, 76 nt, Human
uugcuugaacccaggaggcggagauugcagugagccaagaucacuccacugcacuccagccugggcaacagagcaa

SEQ ID NO: 1997 - RNA, 96 nt, Human
uuggaaggaaagcaaguauauagaucaagcuguauuaaaaugaaagugcagagauagucuuagaaugagaauauaaagugcuuuuuuuaaauccaa

SEQ ID NO: 1998 - RNA, 72 nt, Human
uuggaagugggaaguugagucgaauuagggcuccuaaucaucugagcuaucuaauuuuuaucccccuuucag

SEQ ID NO: 1999 - RNA, 103 nt, Human
uuggacaacugccccuuccaugaccagccacaucugaaaaggaaagcauucugcucuuuccagaucuacgcugugccuuggagggcacaaugaacuugucgaa

SEQ ID NO: 2000 - RNA, 70 nt, Human
uuggacaccacaaauuguggguauugucaaauauugcuggauccuguacccauguuaugugacucuccaa

SEQ ID NO: 2001 - RNA, 80 nt, Human
uuggauauaagccagaaguagaauugcugauuaauaggguuuauguguguucagcauuaguagauucugcccauguccaa

SEQ ID NO: 2002 - RNA, 72 nt, Human
uuggauguucacugccaguugucucaugugaaaaauuaacuuuuuuguggcaauuagugugacaguuuccaa

SEQ ID NO: 2003 - RNA, 74 nt, Human
uuggccaguuggcguaauaccgaagaggccugaaccgaucgccuuuuccaacaguugcgcaaccugauagccaa

SEQ ID NO: 2004 - RNA, 61 nt, Human
uuggcccugugucuuugucauggcacaaaggugugcacugcgugacaaugacccaagccag

SEQ ID NO: 2005 - RNA, 88 nt, Human
uuggcgaugcugucggggauucugcugggcaacugggcacccugcccgccaccauccucaccagucucuucaccgacagcuuagucaa

SEQ ID NO: 2006 - RNA, 73 nt, Human
uuggcucugcguuuauagucucaaggacaaagacuuugucuuuguucucaaggacuaucagccaugagauuga

SEQ ID NO: 2007 - RNA, 106 nt, Human
uuggcuguaacacuggagcccuuggccacuuagaaggccugaguuuuuuuauauuuuccaccaagcugcugauucuaaacuguggugggguucuuucaauggccga

SEQ ID NO: 2008 - RNA, 80 nt, Human
uugggaauaugcaugggaaugaggcuguuggacgagaacugcucauuuucuuggcccaguaccuaugcaacgaauaccag

SEQ ID NO: 2009 - RNA, 85 nt, Human
uugggauuuaacuuuuuuaaugggucugaaaauucugugacaaauuuuuggucaaguuguuuccauuaaaaaguacugauuuuaa

SEQ ID NO: 2010 - RNA, 74 nt, Human
uuggggacuuuugguaguuuaaacucuuuaaccuuuuccucgccguuuaugaguaaagcuaaagcuguuaucaa

SEQ ID NO: 2011 - RNA, 69 nt, Human
uugggguugaagaguuuauuuauugcucugcccccuuggcacagcaagcccaggcucuaccagcaacga

SEQ ID NO: 2012 - RNA, 104 nt, Human
uuggucacuuuuuacgugagcguauaaucccaagaucaguguuauauuuuacuggagaagcuauugaagaugaugaugaugauuaugaugaagaaggugaagaa

SEQ ID NO: 2013 - RNA, 113 nt, Human
uuggucauuaucuugagcagugaccauuacuagaucauguuaaauuagcgaaugcuguuacugaauacgcuaacccauguguugcugaugagucaacugacaauugugaccaa

SEQ ID NO: 2014 - RNA, 62 nt, Human
uuggucugcuagccuagagguuucaguuccaaagggaggaaugcuuccggcaggagacacaa

SEQ ID NO: 2015 - RNA, 86 nt, Human
uuggugaaguauuuuguuaccucagucuuguauucaaguugcuguauuuuuucagcuuguuacauugauaauaauuauuucaccaa

SEQ ID NO: 2016 - RNA, 73 nt, Human
uuggugcauguaauaauguugaguggcagucaaaagucaugauuuuuaucuuaguucuucauuacugcauuga

SEQ ID NO: 2017 - RNA, 97 nt, Human
uuggugcccagggagaaccccuuggauaucgccaggaugauccuagcuaucguucuuuucacucugguggauauggccaggaugccuuggguaugga

SEQ ID NO: 2018 - RNA, 77 nt, Human
uugguucccuuccagucucuucccccuuucuaucccaaucaccaauagaaaugcuaacaucccugccugguagccag

SEQ ID NO: 2019 - RNA, 74 nt, Human
uugguugggucuuguucggcuuucugugcuuuuuaaucagccauuuaccagcaacuguugcacgggcccaucag

SEQ ID NO: 2020 - RNA, 70 nt, Human
uugguuugguggcccugucugugaggaccaaauauugucucuauuucacagaugaggaaacugaagccaa

SEQ ID NO: 2021 - RNA, 87 nt, Human
uugugaagaaccaucgaaaccuguuuguucccagcccacccccaguggaugggaugcauaaugccagcaaguuuuguuuaacagcaa

SEQ ID NO: 2022 - RNA, 72 nt, Human
uuguggaacaugggccuuauguugucacaaguaacaugaccuugcgugacagagacuuccccuggaccacaa

SEQ ID NO: 2023 - RNA, 66 nt, Human
uugugggaagcagggaaacuggaucuugauauuccaguacaacauuauguucccgaauucccagaa

SEQ ID NO: 2024 - RNA, 105 nt, Human
uugugguccauggcgagcccaggccucagacaauggcugugguguugcucagacaugcacacagcucucuguaccuugagccaggucuccaccauggcaccacag

SEQ ID NO: 2025 - RNA, 87 nt, Human
uuguguaccgccugcugcgcucgcccaugugcgaguaccuggugaauuucuugcacaaguugcggcagcugccugagcgauacauga

SEQ ID NO: 2026 - RNA, 83 nt, Human
uuguguucugaaagccuccgugcugcuggaucuuuggggggaaauacaggauccuucagcacugagguguuuaagauuugcaa

SEQ ID NO: 2027 - RNA, 71 nt, Human
uuguuaaccuuguaagauggauaauguguauaagaauguaggccuuaacuauuucacaugagucaaaacaa

SEQ ID NO: 2028 - RNA, 68 nt, Human
uuguucuugcuuccaggcuuugcgcugcaaauccagugcuaccagugugaagaauuccagcugaacaa

SEQ ID NO: 2029 - RNA, 74 nt, Human
uuguuggauucuuauuggcaucacucaccagagaaggaaaaauggaugaugauucaagacaguggaagagacag

SEQ ID NO: 2030 - RNA, 60 nt, Human
uuguuugguauacuucauuuccagugaugggcuggucacugaugcugaggagccaggcag

SEQ ID NO: 2031 - RNA, 73 nt, Human
uuuagccuggguugccugugguuauauaauauggcaaaauucuacugaagacacaugguauaaaaugguaaaa

SEQ ID NO: 2032 - RNA, 77 nt, Human
uuuaguucacuuguuuuuccucuuuguguuaaggcuaucauucagagggcaaacaguucccgguguugugaauugaa

SEQ ID NO: 2033 - RNA, 92 nt, Human
uuuauggucuggugagaagaucccugcucugagucacugccaagcucuagcuaugugacuuugaacagggaauuucugucccuaucuauaaa

SEQ ID NO: 2034 - RNA, 71 nt, Human
uuuaugguuuuuuccacauuguccacaaucaugccaaccauuaauguggacaauguggaaaaaacccuaaa

SEQ ID NO: 2035 - RNA, 82 nt, Human
uuuauucaucuuccaugugccugcugagucucagacucccuuucuuuccaucagcucuggcagccucaucaagaugacugaa

SEQ ID NO: 2036 - RNA, 102 nt, Human
uuuauuuaguaaacauucuuugagucuacacuauguacagaugugcugcuauguaguagcaaagauucaggaugugcccucaaggaaugucugucaaguaag

SEQ ID NO: 2037 - RNA, 72 nt, Human
uuucacagacucuaagucguaaaacucuguuacaaaggaaaugauugagaaaaugaauucgagucuuugaaa

SEQ ID NO: 2038 - RNA, 69 nt, Human
uuucagguaggugaagcagagaaagaaggcagcauacgucagcauuuucuucucugcacuuauaaggaa

SEQ ID NO: 2039 - RNA, 80 nt, Human
uuucauuauuuuaugcugccucugcauaacuaauuuugauuucagggcuaggaggguggagguagggugaggaaaugaaa

SEQ ID NO: 2040 - RNA, 61 nt, Human
uuuccugcuuguauuggcguauaucguuccuccugagcagcaacccacaguagguaggaaa

SEQ ID NO: 2041 - RNA, 94 nt, Human
uuucgaguuuuuauagguuggugcaaaagugauugugguuugcauugagaauaauggagaagacgaauauuuggacaacuguauauaaauggaa

SEQ ID NO: 2042 - RNA, 82 nt, Human
uuucguuaguuuaaauccuugagggguacagcaucacucggauucuguguccaauggccuuagcaggaagauugcuucggaa

SEQ ID NO: 2043 - RNA, 60 nt, Human
uuucuaaccaucacaauucagugaaguacaaaacacugaguuacaggcugugggaagaga

SEQ ID NO: 2044 - RNA, 107 nt, Human
uuucuagugcauuaagccugagccauauucucacaugcaagugaagucauuaaagaacuuuacauaugugagauagaaacaaugguuccuuaguuuugcacugggaa

SEQ ID NO: 2045 - RNA, 82 nt, Human
uuucuauugaagccuaagcuuugaaugaagacaugcuucugaaaauaaagcagguuuucucuagucugcuuauuaauagaaa

SEQ ID NO: 2046 - RNA, 85 nt, Human
uuucucuaugaaucucaucagacucuggcgagacuuuugaauucauaaccaagccaacaucuccagacauguaaaaauagggaaa

SEQ ID NO: 2047 - RNA, 74 nt, Human
uuucucugacgauuagugaugcugagcauauuuucacauguuugucggccacugguacgucuucuuuugagaag

SEQ ID NO: 2048 - RNA, 60 nt, Human
uuucugcauagacucacuuguuaaauagcaguucuguugagaguggaguuacugcaggga

SEQ ID NO: 2049 - RNA, 61 nt, Human
uuucugucaagaagcaguuugaagaauuaacccuuggugaauuuuugaaacuggacagaga

SEQ ID NO: 2050 - RNA, 73 nt, Human
uuucugugacagucacugcccucaggcuuggccuguccugauaggcugggugguagugcaucuuccauagggg

SEQ ID NO: 2051 - RNA, 71 nt, Human
uuucuucaguuccaacaaaaggucugucaucugauaacaaaccuaugguuaacuuggauaagcugaaggaa

SEQ ID NO: 2052 - RNA, 94 nt, Human
uuucuugccuagagaacacacaugggcuuuggagcccgacagaccugggcuugaaucccggcucguguucuugcugcaggaccugggcaagaaa

SEQ ID NO: 2053 - RNA, 101 nt, Human
uuugaacuuguccccugaauagcuacagguuuuggaagcugaaucaauguuaucagaugaguuagaauccaaaccagagcuccugguacaguuuguucaga

SEQ ID NO: 2054 - RNA, 92 nt, Human
uuugagauuuuauugaguacuacuaaucuugacauauuuugguuggcaccacauucuugguauaguggguuagugguugaauaguuugcaga

SEQ ID NO: 2055 - RNA, 61 nt, Human
uuugaggcccguuuagauaccauggcagagacaaacagcauaucuuuaaauggaccuuuga

SEQ ID NO: 2056 - RNA, 78 nt, Human
uuugauuaguugugugucugccugaaaccauuuaguagagcacuuuaauucugcaugguuuuuacaaaacucauuaaa

SEQ ID NO: 2057 - RNA, 62 nt, Human
uuugcggauguccacgucacacuucaugauggaguugaagguggucucguggaugccgcaag

SEQ ID NO: 2058 - RNA, 72 nt, Human
uuuggaaggccuuucaaaagccucaccugggaacauugggaauugguuaauuuuuugaugaggucauccgga

SEQ ID NO: 2059 - RNA, 86 nt, Human
uuuggaaggcugaagcggguagaucaccugaggccaggaguucgaaaccagccuggccaacauggugaaaccccgucccuacuaaa

SEQ ID NO: 2060 - RNA, 80 nt, Human
uuuggauugaggcugcugugcacaggaauauggguauuuccucuuauuccuuacuccacugcaccuaaucaauaaccaag

SEQ ID NO: 2061 - RNA, 70 nt, Human
uuuggcuuaacauucaagcaccuggaauaaagaucucccgggguuucguuguugcacaaaaucagccaaa

SEQ ID NO: 2062 - RNA, 61 nt, Human
uuugggggguuuggccaaacuuuuuauuuaauauucuggaguugguuaacacacacuuaaa

SEQ ID NO: 2063 - RNA, 72 nt, Human
uuuggguggaugcugcucucgaauaagucggacaucuucuacucuuuguucgaaggugcggcgcugcuugaa

SEQ ID NO: 2064 - RNA, 75 nt, Human
uuuguacaguuuaaacaacagcugaaagaacuaaagaagcaauguggucuucaagcugacagagaagcugacgga

SEQ ID NO: 2065 - RNA, 111 nt, Human
uuuguauuuuuaguagaaacggggguuucuccauguuggucaggcuggucucgaacucccgaccucaggugauccaccugccuuggccucccaaagugcugggauuacaga

SEQ ID NO: 2066 - RNA, 108 nt, Human
uuugugaagaugauugggaaaucaaauaaguaaaaacgcugggucaaaacuuuaaaaauuuuggcuacuuuaagguuuuucuuugccuuuuucagucugcuuuacaag

SEQ ID NO: 2067 - RNA, 82 nt, Human
uuuguggggacauuggucugucggugccaguacauccuccuccaugaugacuucccuauggacaaccucaucucccugcuca

SEQ ID NO: 2068 - RNA, 77 nt, Human
uuuguucauaaucccaaacaagggcccugcuggcagcaacaggacagguggggccaggacagggaagcuggagcagg

SEQ ID NO: 2069 - RNA, 84 nt, Human
uuuguuucacugcguucaauuuugaguuuccuaacauccauucuacaggucaaucaaaauacaaaggcgugcaaaugaaacaag

SEQ ID NO: 2070 - RNA, 82 nt, Human
uuuguuuucggccacaaugaguccuuuagugccauuguggacucacaaugcacauggacaucaggcugugaaugaagacaga

SEQ ID NO: 2071 - RNA, 84 nt, Human
uuuuaaagaagaagaccauuuuacuuaugauguucaggaaaucuaugauuuccuacaaccaguaagguucuuacauuuuuaaaa

SEQ ID NO: 2072 - RNA, 83 nt, Human
uuuuaauagcuuaagauuuuaagagaaaauaugaagacuuagaagaguagcaugaggaaggaaaagauaaaagguuucuaaaa

SEQ ID NO: 2073 - RNA, 86 nt, Human
uuuuagaaaagaauaugacauuuuauuuucacuuauggacauacaguacaugaauuuagaaauaaaaucgucgcaggauucugaaa

SEQ ID NO: 2074 - RNA, 89 nt, Human
uuuuagcauggcuuguaauagcaaacaguuuguaauagcaaugacguguuauuuauugcagcauuguuuguaauagcaaaauacuggaa

SEQ ID NO: 2075 - RNA, 75 nt, Human
uuuuauaauccuacucacaaaugacuagcuucuccucuuguauuuugaagcagugugggugcuggauugauaaaa

SEQ ID NO: 2076 - RNA, 73 nt, Human
uuuuaugucaccaguugguccucaucaaauaaaauuuccuuaggagugcagagggcucauugggaaaauaaaa

SEQ ID NO: 2077 - RNA, 78 nt, Human
uuuucaauugacucacuggauaucuugguaugugaaucagaggauaaagagacuauuguuccaugucagaauugaaaa

SEQ ID NO: 2078 - RNA, 61 nt, Human
uuuucaggugaagagugagguugucauggccucagcuaugcuuccuggcucucccucaaga

SEQ ID NO: 2079 - RNA, 69 nt, Human
uuuucccccaucccccuccaaagucuugauagccaagcguuauuuugggggguaggaaacgggugaaaa

SEQ ID NO: 2080 - RNA, 66 nt, Human
uuuuccuuauccaauguacucacgggauuauguuuauguucggcgguauaguguggaucaggaaaa

SEQ ID NO: 2081 - RNA, 73 nt, Human
uuuucgaaugaaugacaacuuuauuuuucuuacacuuuuaaggcugaugaaaaaccuucauuucaauugaaaa

SEQ ID NO: 2082 - RNA, 72 nt, Human
uuuucucugguuccucucugcagucuccuuucagccugcuucaggaaugagcuuguggagccccggagagaa

SEQ ID NO: 2083 - RNA, 72 nt, Human
uuuugggaagggggaccugcuguuuggccaauuuauccuacaggucuuggacggugggaccucuucagagaa

SEQ ID NO: 2084 - RNA, 65 nt, Human
uuuugggggcucuggguguggcgguugccguagcugaaauggcugcaccaugucggccuucgaga

SEQ ID NO: 2085 - RNA, 84 nt, Human
uuuugggggucggcagcaaguuuuauuugcaaagcagcauuagcaaacagaagcaauugcaccguaaaugaguaaccucuaaag

SEQ ID NO: 2086 - RNA, 103 nt, Human
uuuugguacuuucaguagagacgggguuucaccguguuagccgggauggucucgaucuccugacuucgugaucugcccgccucguccucccaaagugcuggga

SEQ ID NO: 2087 - RNA, 80 nt, Human
uuuuguuuacaagauugauuuaauaugagaggauacaaaaugucaucguuauccucucuuaugaacaacuguagucaaaa

SEQ ID NO: 2088 - RNA, 80 nt, Human
uuuuucauuuccuuaccuccuugccauaaucuuaacaaguaacaguaaaguauauggcaaggagguaaggaaaugaaaaa

SEQ ID NO: 2089 - RNA, 75 nt, Human
uuuuucgaaugaaugacaacuuuauuuuucuuacacuuuuaaggcugaugaaaaaccuucauuucaauugaaaag

SEQ ID NO: 2090 - RNA, 97 nt, Human
uuuuucuacuccaaaucuuucgucaaacacaguuucgagauuguugcuauggcuuguauuaaucuugcaucaaaaaucgaagaagcaccuagaagaa

SEQ ID NO: 2091 - RNA, 109 nt, Human
uuuuugaugagaaugagcuugagcugcugaugugugggacuggagacaucagugugucugacuucaaagcccaugcaguaguuguugguggcucauggcauuucagaga

SEQ ID NO: 2092 - RNA, 90 nt, Human
uuuuuggggaaaauuguucuguuuguuuuaauuaaaccgacugaagaagccaagacacagauggaaagagacuaagaacaagacuggaaa

SEQ ID NO: 2093 - RNA, 90 nt, Human
uuuuuucacugggacaguugcuuuuauuaucuucauuuacaaaugaaacuguggaacagaaaguaauauggccaauuauuaguggagaaa

SEQ ID NO: 2094 - RNA, 71 nt, Human
uuuuuucaugcauuacugcguuuauuucucucuaaaaccuuaugaaguaaaaacuaacuagcaaggggaaa

SEQ ID NO: 2095 - RNA, 106 nt, Human
uuuuuuccuuuuucuguaggccgccuuaagcuuucuaaauuuggaacaucuaagcaagcugaagggaaaaggggguuucgcaaaaucacucgggggaagggaaagg

SEQ ID NO: 2096 - RNA, 86 nt, Human
uuuuuucuaaaugggaaaaggguuaauaagggcuuauguucauucuuguauugcucucuaaacuuuguuccuugucacagaagaaa

SEQ ID NO: 2097 - RNA, 91 nt, Human
uuuuuugauucagcuuauacccgggcugaaaaccucaauuuauguucaugacagugggguuuucagcccggguauaagcugaaucaaaaaa

SEQ ID NO: 2098 - RNA, 73 nt, Human
uuuuuugcuuucaggaaagguuuauuguggugagugccuucuguacagucgacugcaaaugaaacgcagagga

SEQ ID NO: 2099 - RNA, 86 nt, Human
uuuuuuguagagacggggccuugccauguuacccaggcugguuuugaaccugggaaacauagggagacccugucucuauuguaaaa

SEQ ID NO: 2100 - RNA, 76 nt, Human
uuuuuuugagacggugucucacucugucgcccaggcuagagcgcaguggcaagagcgagacuccaucucaaaaaaa

SEQ ID NO: 2101 - RNA, 110 nt, Human
gaccacuguaaucccagcgcccaaggaaggccacuucucaacuggcagaacuucugaaguuuagaauuggaauuacuuccuuacuagugucuuuuggcuuaaauuuuguc

SEQ ID NO: 2102 - RNA, 68 nt, Human
gaccagacuuuuccagaagugccggacgucgggcagcgucuauaucaccuugaagaaguaugacgguc

SEQ ID NO: 2103 - RNA, 68 nt, Human
gaccagacuuuuccagaagugccggacgucgggcggcgucuauaucaccuugaagaaguaugacgguc

SEQ ID NO: 2104 - RNA, 64 nt, Human
gaccagccauccugguuuacaugggacgcaggaacugccguuuuaaagcugggcugaguugguc

SEQ ID NO: 2105 - RNA, 74 nt, Human
gacccagaaugagcguuauaaggcugccaugcggagggcauuccacauccgguugauagcucggcgccuggguu

SEQ ID NO: 2106 - RNA, 86 nt, Human
gaccgaccgcggcugccccaguugaugagcggcguguccccucugcagcgcugcaccccgugcggggcuuuggcugugacgcgguc

SEQ ID NO: 2107 - RNA, 114 nt, Human
gaccgccucuuccuugugucuccucugaucaucucccaugagaucaaccagaagagcccuuucugggagaugucucaggcucagcugcaucaggaagaguuugaaguugugguc

SEQ ID NO: 2108 - RNA, 67 nt, Human
gacgaaccuuggccgcaguccuugcgaacuguucgcaaaacagugcgggcugcggugggucagcguc

SEQ ID NO: 2109 - RNA, 71 nt, Human
gacgaauccuuaguacuguggaaaagagcagacagaaauauaaaccagcuucucucacaguggaauucguc

SEQ ID NO: 2110 - RNA, 72 nt, Human
gacgacuaauguuggcucccugccugcuaacacaacauccguucugcagcccaugggucaaagaguaauuuc

SEQ ID NO: 2111 - RNA, 82 nt, Human
gacgcugcuggccuuugccggguacucagggcuacuggcugggguggaagugagugcugggucaccccccauccgcaacguc

SEQ ID NO: 2112 - RNA, 67 nt, Human
gacggacaacccaucgugugaacuauagaguuugugaacaaauuuauauuggguucauaguggcguc

SEQ ID NO: 2113 - RNA, 88 nt, Human
gacggcaaauauucuggggugaaggaggucauaauggggaaacacuuuuuuuuccccuuuuuaacuuccugugcccaagcuugccuuc

SEQ ID NO: 2114 - RNA, 77 nt, Human
gacuauucaggcgcaguacaaguuggggcacugcauccuuuguggauggauuuccguugcuguguuccucacaaguc

SEQ ID NO: 2115 - RNA, 98 nt, Human
gacuauuugaaaagccaggaguaaauuacaagucuugacaauggugccaugucugccagucagggcaguguucugcugauggcacugauucaucaguc

SEQ ID NO: 2116 - RNA, 78 nt, Human
gacucauguuuauuagggagugagggagcacaaagggaggucuccuugcccuuguucuccuuaacacagcucagaguc

SEQ ID NO: 2117 - RNA, 70 nt, Human
gacuccccuuggugguauucgcccuccggaacccaaagacuuugguuucccggaagcugcccgggggguc

SEQ ID NO: 2118 - RNA, 66 nt, Human
gacuccggcccauuuaaacacaaaagagacccagaugggucucugaaagaccacagggccgggguc

SEQ ID NO: 2119 - RNA, 78 nt, Human
gacucucgccggccgcgcgaacccguuugagcucgguauccuagugcacacgccuugcaagcgacggcgccaugaguc

SEQ ID NO: 2120 - RNA, 82 nt, Human
gacugaaggaggaauaucagucccuuauccgguauguggagaacaacaagaaugcugacaacgauugguuccgacuggaguc

SEQ ID NO: 2121 - RNA, 77 nt, Human
gacugacaacugugagacaugcacuugcuacgaaacagaaauuucauguugcacccuuguuucuacaccuguggguu

SEQ ID NO: 2122 - RNA, 86 nt, Human
gacugacagaggaccuuguugcaccucguggcugcuuuguucacccgcagggcggccugugggcaccccgggguuccccuucaguc

SEQ ID NO: 2123 - RNA, 74 nt, Human
gacugcgggacggacgguggacgcugggacgcguuuguagcuccggccccgccguuccgacccccgccgccguc

SEQ ID NO: 2124 - RNA, 76 nt, Human
gacuguagacacaaacuguguaacuuccaugagccauuuccuuccugugcacauguauguguguuauuuuucaguc

SEQ ID NO: 2125 - RNA, 95 nt, Human
gacugugguuuuauugguaaagauauaagacauauuggcucuauuaaaaacucagguaauaaagcacuaagguugauuuuuguauugcuacaguc

SEQ ID NO: 2126 - RNA, 72 nt, Human
gacuuauuucuucuuggacacacccacggugcggccacggcggccaguggucuugucgaagaggaagugguc

SEQ ID NO: 2127 - RNA, 77 nt, Human
gacuucuccuguccauccccuuggcccccucuccucuaguccaugagauuacagcuuugcacacugacaggaggguc

SEQ ID NO: 2128 - RNA, 92 nt, Human
gacuugucguggccccggucugacuugucguggccccugucuaguuucucauggcugcgguccgacuugucauggccccuguccgacuuguc

SEQ ID NO: 2129 - RNA, 99 nt, Human
gacuuugacaguuucaucugcugcuucguuaggcuggagggcauguucagagcuuuucaugcauuugacaaggauggcagauggguaucaucaaagcuc

SEQ ID NO: 2130 - RNA, 64 nt, Human
gacuuugcuuccgguacaaacaggccaccugagcacuggugguggccugcuccggcugcuuguc

SEQ ID NO: 2131 - RNA, 93 nt, Human
gacuuuguuggaaggggaggcggggagagagugcuggaggcucuggggcgauggcuuccgcaccucuuccaaccacccucuuucccuggaguc

SEQ ID NO: 2132 - RNA, 76 nt, Human
gagaaacaaggcgaggaggaggaugcagaaaucauugucaagaucuuuguggaguuuuccauagccucugagacuc

SEQ ID NO: 2133 - RNA, 97 nt, Human
gagaaaccacacuggaguaagguaagcuguccuggagagcuggaagcuuuacuugaaucgggugcuuuguuuuuggcagucuuuauuccuguggcuc

SEQ ID NO: 2134 - RNA, 63 nt, Human
gagaaagauuguccuucaggggacaugacaucaauagguuucuggaaugagggacucuuucuc

SEQ ID NO: 2135 - RNA, 75 nt, Human
gagaaaguugucuuuuguaaugcugaauaugaaccacucccuuucuguucaggugcuccagaagccccaauucuc

SEQ ID NO: 2136 - RNA, 78 nt, Human
gagaacauaaggucuugugcaagaggaggccucgcucuucuguuccuucucggcaccaccuggaucuuugggguucuc

SEQ ID NO: 2137 - RNA, 81 nt, Human
gagaacuaggcacuuaggaaugugucuguugccugggaaaccacaccuggcacagagacaguccugagaucccuggcacuc

SEQ ID NO: 2138 - RNA, 97 nt, Human
gagaacugccagugcaggaaagccaggggacgccgugguggcaggaagcucuuugccccacacagauucugcauggccccugcaacugacggaccuc

SEQ ID NO: 2139 - RNA, 82 nt, Human
gagaagguccccuucaccaagguccaggagccauucuagaaacucugauaagucgucuucugaccggucaagggcgcuccuc

SEQ ID NO: 2140 - RNA, 89 nt, Human
gagaaucacuugaacccgggagguggagguugcagugagccaagaucgugccauugcacuccagccuggugacaaagcaagacugucuc

SEQ ID NO: 2141 - RNA, 86 nt, Human
gagaaucgcuugaacccaggagguggagguugcagugagccaagaucgcgccacugcacuccagccugggcgacagagugagauuc

SEQ ID NO: 2142 - RNA, 85 nt, Human
gagaaucgcuugaaccuggaggcggagguugcagugagcagagauugcaccauugcacuccagccugggcaacagagcgagacuc

SEQ ID NO: 2143 - RNA, 78 nt, Human
gagaaugcaaaauucacuuacauuuuaaagacagaacacacuucaugucagugguaggcugauucugauuuugcucuc

SEQ ID NO: 2144 - RNA, 86 nt, Human
gagaauugcuuaaaccuggaggcugagguugcaguaagccaagauugugccacugcacuccagccugggugacaaaagcaagacuc

SEQ ID NO: 2145 - RNA, 74 nt, Human
gagacaagguuucaccauguugcccggguugaucucaaacuccugggcucaagugaucuacccaccuuggccuc

SEQ ID NO: 2146 - RNA, 99 nt, Human
gagacagacucucacugugucgcccagguuggagugcaguggcgugaucuccacuuacugcaaccucugccucccggguucaagugauucuccugccuc

SEQ ID NO: 2147 - RNA, 89 nt, Human
gagacagggucucacucuguugcccaggcuggaggcgugaccuuggcucacugcacucuagccuaggugacagagcaagacucugucuc

SEQ ID NO: 2148 - RNA, 90 nt, Human
gagacagucucucucugucacccaggcuggugugcaguggcgugaucucggcucacugcaaccucugccuccuggguucaagcgauucuc

SEQ ID NO: 2149 - RNA, 103 nt, Human
gagacagugguagaguacaaaguggaggaauuacugucuagaaagcaccauuuccagcacucagcacgagguggucuuucccuccacaccugccaccaaccuc

SEQ ID NO: 2150 - RNA, 95 nt, Human
gagaccagcuuggccaacauggugaaaccccaucucuacuaaaaauacaaaaauuagcugagcaugguggugcgcgccuguaauccaagcuacuc

SEQ ID NO: 2151 - RNA, 69 nt, Human
gagaccuuguaucaaucagcugacuguucugaugccaaugaugccuugauaguguugauacaucuucuc

SEQ ID NO: 2152 - RNA, 66 nt, Human
gagacgggguuucaccauguuggucaggauggucucgaucuccugacuuugugaucugcccaccuc

SEQ ID NO: 2153 - RNA, 71 nt, Human
gagacucuuccaggucaaagggcuggcgugugguccgugccaccgagguaccuguguccugggagagcuuc

SEQ ID NO: 2154 - RNA, 75 nt, Human
gagacugcgggcccagcguuccauguccuuggcaaucuguugagcugucuuggucuugugcuucuccuucuucuc

SEQ ID NO: 2155 - RNA, 77 nt, Human
gagacuggauggcuuuucauugacaugguagagaggaaauggaucaaauccaccaaugaaaucaaagcuguccucuu

SEQ ID NO: 2156 - RNA, 75 nt, Human
gagagacuacuugauauaauuuugauuuucuuaaauuuauuaagaguuguuuuguguccuaucauauggucuauc

SEQ ID NO: 2157 - RNA, 79 nt, Human
gagagagagagauuggaagagagauggggagagacugacucagaucccucuccugucugcuucuuuuucugguucucuc

SEQ ID NO: 2158 - RNA, 87 nt, Human
gagagauuaagagcuguucucuggaguuccaaucccaccuuuaccguuuaauagcugugugacuuuagguaaguuacuuaaccucuc

SEQ ID NO: 2159 - RNA, 100 nt, Human
gagagccaguaccuuuacauaaagcguuguaauacacagguuagcccagcagggcauucccaugaccucagauguuuaucaggugaagccaguggcucuc

SEQ ID NO: 2160 - RNA, 106 nt, Human
gagagcuggagucucgcucugucacccaggcuggagugcaguggugcgaucuuggcucacugcaaccuccaccuuuguguucaagcaauucuccuuccucagccuc

SEQ ID NO: 2161 - RNA, 76 nt, Human
gagagguaagccaagcucucaggagggacaaagauagauuucuaucuucagugcucuugggggauguuugcuccuc

SEQ ID NO: 2162 - RNA, 82 nt, Human
gagagguuuagucaagaauaccaaagcccaugucaucaucagacuccucggauucuucuuucuuugcuuccacuugcuucuc

SEQ ID NO: 2163 - RNA, 80 nt, Human
gagauaggcuguagcccaggcuggagagcaguggcucgauuguagcucacugcacccucaaacuccugggcuccugucuc

SEQ ID NO: 2164 - RNA, 92 nt, Human
gagaucaaaggggaaugggacuaagacugcagagcccuggcucccccacugccugccaauugccugcgguuuguggucucuuccacuuucuc

SEQ ID NO: 2165 - RNA, 85 nt, Human
gagaugagggggcacauuuaaaucuguguauguccagaguccgugaggauugggaaucagucuaaagcugugcucgcuucuccuc

SEQ ID NO: 2166 - RNA, 79 nt, Human
gagaugcaguuaaaauucuagaauaauuaaaagccacaaagugaaacuguuguucuggggcccuauguuguagauucuc

SEQ ID NO: 2167 - RNA, 98 nt, Human
gagauggagucucacucugccaccaggcuagaggucaguggugugaucuuggcucacugcaaccucugccucccggguucaagcgauucuccugccuc

SEQ ID NO: 2168 - RNA, 68 nt, Human
gagauggggucucgcuguguugcccaggcuggucuugaacuccugggcucaagcaauccacccaucuc

SEQ ID NO: 2169 - RNA, 68 nt, Human
gagaugggguuucaccauguuggccaggcucgucucgaacuccugacuucaggugauccacccaucuc

SEQ ID NO: 2170 - RNA, 65 nt, Human
gagauggguuucaccauguuggucaggcuggucucgaacuccugaccucaugauccgcccaccuc

SEQ ID NO: 2171 - RNA, 76 nt, Human
gagauguccucuauucuugaagagcguauucuuggagcugauaccucugaugaucuugaagaaagcugggcguguc

SEQ ID NO: 2172 - RNA, 92 nt, Human
gagauguggccgagacugcgcuggcauccagcaggucgcugggugacuucugggcagcuggcuugccugcgaguaucucucuguuauuccuc

SEQ ID NO: 2173 - RNA, 81 nt, Human
gagauuuuguauugguacugcguucuguguuuuaaaccuuggcuuaagauuucugaauagucgguaaaauacauuuuucuc

SEQ ID NO: 2174 - RNA, 87 nt, Human
gagcaccuaggaggcaguccaggcucuuuagcaugguguuggaagcccuuaaugaucugcuacagccugggccuccagccuccucuc

SEQ ID NO: 2175 - RNA, 90 nt, Human
gagcacgggcucaugugacaccagccccgacaccgucucgcccucccugagccccggcuucgaggaccugucccaugugcagccugucuc

SEQ ID NO: 2176 - RNA, 73 nt, Human
gagcacuguaggcuuuagucccuggaauuaauaacuucuguuagugagcuccagggcuggggcucacaggcuc

SEQ ID NO: 2177 - RNA, 109 nt, Human
gagcagcgauggaccauguagugcaugggcagugugcgacauccugcucucucacauaccguaucgauagcgcaaccuucucacacuacaaauuggcgaucugcuccuc

SEQ ID NO: 2178 - RNA, 71 nt, Human
gagcaggaggauucagauucgaaacaucccuccucacgugcagugggaggugucggauggacuuuuggcuc

SEQ ID NO: 2179 - RNA, 72 nt, Human
gagcaucucaagggggccuuauucaauucuagguaacuagccaggugugaaagaaagggcccagggugucuc

SEQ ID NO: 2180 - RNA, 68 nt, Human
gagccagacucacagaguccccuggcccuggccauggcuccaguacaggguucucugaauugcugcuc

SEQ ID NO: 2181 - RNA, 72 nt, Human
gagcccagccaaucagcgccccggacugcaccagagccauggucggcagaagagcacugaucguacuggcuc

SEQ ID NO: 2182 - RNA, 73 nt, Human
gagcccgagaggaccggcgcucagcccgggucccacgcugccccgggcugcucugcgucggucccgcgcgcuc

SEQ ID NO: 2183 - RNA, 62 nt, Human
gagcccucugagaggcccagguccuagagcagcuucugccugggcugaggucuugggggcuu

SEQ ID NO: 2184 - RNA, 74 nt, Human
gagcggacauuuaggaacuggaugaacuccuuggguguuaacccucgagucaaucauuuguacagugacuuauc

SEQ ID NO: 2185 - RNA, 83 nt, Human
gagcgggcgugcauaugcgguggcgggugggguggaagggggagauccugcugcacuggccgccaaguaugaggggcgagcuc

SEQ ID NO: 2186 - RNA, 95 nt, Human
gagcuaucugagucacuagaugaggaggaggaagaugaugaugauuuaugccuuuucuuuucuucuuucuuaacuuuagauuugggaaucagcuc

SEQ ID NO: 2187 - RNA, 73 nt, Human
gagcucagugccuuaccuuugcagggccaggguccccguucuggccaguguuggcuagggacacuugcaguuc

SEQ ID NO: 2188 - RNA, 62 nt, Human
gagcuccgggccagggcugccgucgccgccgucggggagucagcccgccagcccgccagcuc

SEQ ID NO: 2189 - RNA, 89 nt, Human
gagcuccgguagcccgccgcuggaggagcuguucgcccggggcgggcccuugcggaccuuccucgagcgccaggcggggucugaagccc

SEQ ID NO: 2190 - RNA, 72 nt, Human
gagcugcugggucccucaucucccucaucuauuauagauugacuuacagcagggagagaaucucuuuagcuc

SEQ ID NO: 2191 - RNA, 71 nt, Human
gagcuggaggagcucacggugcagguggcccgggucuauaaugggcggcucaaggugcagcgccucugcuc

SEQ ID NO: 2192 - RNA, 98 nt, Human
gagcuggagucucgcucugucacccaggcuggagugcaguggugcgaucuuggcucacugcaaccuccaccuuuguguucaagcaauucuccuuccuc

SEQ ID NO: 2193 - RNA, 88 nt, Human
gagcuggcagguuggaugacacacugggaagcguauggggaaaacucugaacaauuccaaaaugcuucuaagaaccuguuugaagcuc

SEQ ID NO: 2194 - RNA, 67 nt, Human
gagcuggcuccugggcccacagcugugccugggaauaguccaggcugugcaugcagaggagcugcuc

SEQ ID NO: 2195 - RNA, 71 nt, Human
gagcuguaaauugcuuaaaucgcuuaaacuggagauuucagugagauuuuuagcaguagauuacuaagcuc

SEQ ID NO: 2196 - RNA, 123 nt, Human
gagcuguuuacaucaugagagaugugucuuuauaaauggauuaaucccauuauugcagaaaugguuuuguuaucaugggagggggucauuauaaaaagacaauuuugccaggugcaguggcuc

SEQ ID NO: 2197 - RNA, 96 nt, Human
gagcuguuugaagcuaccagucugagcccuauugacuauuuuuuucaggcucugaauagcucuagggaucucagcaggggugggaggaaacagcuc

SEQ ID NO: 2198 - RNA, 75 nt, Human
gagcuuaucauuuaaccagucccaaccccauaagugucgccuagcccagagggucggccugggggaaccgagcuc

SEQ ID NO: 2199 - RNA, 92 nt, Human
gagcuuucugggcagacuuggugaccuugccagcuccagcagccuucuuguccacuggcuuuggaugacacccaccggcaacugucuggcuc

SEQ ID NO: 2200 - RNA, 81 nt, Human
gaggaacacggccacugccaucaugagcagggcauugagguugaccacacgggcccagcucggguccucgcugauguccuc

SEQ ID NO: 2201 - RNA, 66 nt, Human
gaggaagcggaccgagcccgucgccuuggagcaugagcgcugcgccgccgcgggcucguccuccuc

SEQ ID NO: 2202 - RNA, 94 nt, Human
gaggaaggacuggagagccacuugaggucauauguuaagguauguaaaacacacuguucugaucacuuacaucuguggcucuccaguuuuccuu

SEQ ID NO: 2203 - RNA, 71 nt, Human
gaggaaugcagacucaguggagaaggaguuggaccagucaacaucucuguugucacaagcaguguuuccuc

SEQ ID NO: 2204 - RNA, 81 nt, Human
gaggaccaagacugacacagacucucuucuguuucccuuaucuccuuuccaaaguaagucugugaaucuacccugguccuu

SEQ ID NO: 2205 - RNA, 86 nt, Human
gaggaccagggugcaguuaguuccucguguuugaguucaaagauggagcgaggguggauauggugggaaggggcacacggguucuc

SEQ ID NO: 2206 - RNA, 71 nt, Human
gaggacgugggggcugcugcccaacacggaggcugggcuggccugguccgugggcucagguucucauccuc

SEQ ID NO: 2207 - RNA, 74 nt, Human
gaggacugaaccaggcaggcuggggugcagugaguccuccugccucuucucugaaaugccccugugucacccuc

SEQ ID NO: 2208 - RNA, 78 nt, Human
gaggagcggagcggcacagccucccacccucccggcugguguuagugcccggacggcgggcucugcgcuccgccccuc

SEQ ID NO: 2209 - RNA, 78 nt, Human
gaggagcggagcggcacagccucccacucucccggcugguguuagugcccggacggcgggcucugcgcuccgccccuc

SEQ ID NO: 2210 - RNA, 60 nt, Human
gaggaggcgauagacuuucuucguugcaaucccaaaaucuggaauguucauaguguccuc

SEQ ID NO: 2211 - RNA, 63 nt, Human
gaggaggcgggccgccugcucuuggagaacuacgaggaguaugcggcucgggcccgucugcuc

SEQ ID NO: 2212 - RNA, 76 nt, Human
gaggaguaugggguagagcaauggucugggccaaggaauggugagcuuagggucuuccucugacuccuuacuccuc

SEQ ID NO: 2213 - RNA, 80 nt, Human
gaggaucccuugugcuagguggaguggauggaugaucuaggcucacuacaaucuccaccucccagguucaagcgauucuc

SEQ ID NO: 2214 - RNA, 87 nt, Human
gaggcaacacagcaguuaagaauugagauaaagugccagucugccaguuagaauccugugucucacuauuuuaacacucugugccuc

SEQ ID NO: 2215 - RNA, 97 nt, Human
gaggcaggaaaaucgcuugaacccaaggcagagguugcagucagcagauauugcaccacugcacuccagccugggcaacaaagcaagacucugccuc

SEQ ID NO: 2216 - RNA, 101 nt, Human
gaggcaggagaaauugcuugaacccaggagguagagguugcagugagucaagaucaugccauugcacuccaaccugggcgacaagagcaaaacucugucuc

SEQ ID NO: 2217 - RNA, 100 nt, Human
gaggcaggagaaucucuugaacccgggaggcagagguugcagugagccgagaucaugccauugcacuccagccugggcaacaagagcgagacuccgucuc

SEQ ID NO: 2218 - RNA, 99 nt, Human
gaggcaggagaauggugugaacccaggaggcagagcuugcagugagccgagaucaagccacuguacuccauccugggugacagagcaagacuccaucuc

SEQ ID NO: 2219 - RNA, 99 nt, Human
gaggcaggagaaugguguuaacccaggaggcggagcuugcagugagccgagaucgcgccacugcacuccagccugggagacacagccagacuccgucuc

SEQ ID NO: 2220 - RNA, 100 nt, Human
gaggcaggagaauugcuugaacccaggaggcggagguugcggugaguugagaucgugccauugcacuccggccugggcaacaacagcaaaacuccgucuc

SEQ ID NO: 2221 - RNA, 100 nt, Human
gaggcaggagaauugcuugaaccugggaggcagaaguugcagugagcugagaucaugccauugcacucuagccugggcaacaagagcaaaacuccgucuc

SEQ ID NO: 2222 - RNA, 80 nt, Human
gaggcaucugcuagaaaacauucuauuguauaaaacccgaguucuuaaaaacauguuuucuuuggcacuuucauucccuc

SEQ ID NO: 2223 - RNA, 75 nt, Human
gaggcaugggggaugguccaaucauggccugcucuaguaacgcaucugccagguugagaauaucccagguggcuc

SEQ ID NO: 2224 - RNA, 104 nt, Human
gaggccacaaggacugcaugaucucgcagcugccuuccagaaacaacauuccagaaugcucuguuccccccuuccagcccaagagacugugcagaauaggccuc

SEQ ID NO: 2225 - RNA, 87 nt, Human
gaggccccugggcugguggacguaccuggugggcacccugagccucaggcccugugcccugguggcagcccccagcaccaggaccuc

SEQ ID NO: 2226 - RNA, 75 nt, Human
gaggcccuugcgccggcgaguguagggcuggcgcugccggacgcggugcuagucgccggaugaagugagggccuc

SEQ ID NO: 2227 - RNA, 70 nt, Human
gaggccgccaccggcaaggggugcgcgcuggggagcggacgcugcauccccuuucugcugcaggaaccuc

SEQ ID NO: 2228 - RNA, 77 nt, Human
gaggcggagcacgcacgcagcucaucgacgaccacauuccucuucgacaaagcccguguaccccugcugcuggccuc

SEQ ID NO: 2229 - RNA, 72 nt, Human
gaggcggagcuugcagugagccgagaucccgcacugcacuccagccugggcgacagagcgagacuccgucuc

SEQ ID NO: 2230 - RNA, 75 nt, Human
gaggcggagguuugcagugagccgagagcgugccauugcauuccagccugggcaacaagagcaaaacuccgucuc

SEQ ID NO: 2231 - RNA, 76 nt, Human
gaggcuaagucugggcagugggcuggccccuggugugagcauuagaccagccacagugccugauugguauagccuu

SEQ ID NO: 2232 - RNA, 75 nt, Human
gaggcugggaagugcaagaccaagauaugaacagauucauuaucugguacagauacccugcauauuuuuggccuc

SEQ ID NO: 2233 - RNA, 76 nt, Human
gaggcugucuucacgcugacccagaccugggggguguuuguguccuuacaggauguucaguuugcaaggaggcuuu

SEQ ID NO: 2234 - RNA, 87 nt, Human
gagggaaauaccuuggcaugcagcuccaguccgagcagccccaaaccgcugccgcccgaagcuaagccugccucuggccuuccccuc

SEQ ID NO: 2235 - RNA, 61 nt, Human
gagggaacccuaggucagaccuugguuuccuguuguucuucccaagacccaggguucccuc

SEQ ID NO: 2236 - RNA, 72 nt, Human
gagggacgcugcuucuccccugcccacgucuccaaggccugaaaggcaggguucuguggaacagcauuucuc

SEQ ID NO: 2237 - RNA, 62 nt, Human
gagggcccaggauuuuuggauccccagcccugugacaaggguuccuguccaguuucccccuc

SEQ ID NO: 2238 - RNA, 84 nt, Human
gagggcugucaccauuagcacucucggagcugggagaagucccugagcccugaaggguguuuugggcaguaugugacagugcuc

SEQ ID NO: 2239 - RNA, 71 nt, Human
gagggcuugaagacuucucagaagagacacucacuacuggaguuaaaguuauaugaagucccugagcccuu

SEQ ID NO: 2240 - RNA, 93 nt, Human
gaggggagauuaaagaaucaauguucccaggggaaaagggccuuaaauuguuuggucuuuucaauggcugacacugucuccaacucuccccuu

SEQ ID NO: 2241 - RNA, 74 nt, Human
gagggguccauacggcgucguucuggauucccgucguaacuuaaagggaaacuuucacaauguccggagcccuu

SEQ ID NO: 2242 - RNA, 78 nt, Human
gaggggugacaaguguguuugagcuggaagugccugcgcgcaggccuuuucucauggcaugaccuugacucaccuuuu

SEQ ID NO: 2243 - RNA, 76 nt, Human
gaggguacuguagaaucuuuauuaucucaacaaucuaaaaaaugauguuuauuuccuuaguuagauagugccacuu

SEQ ID NO: 2244 - RNA, 125 nt, Human
gagggucccugugguucugaugaggggagaucauccugcaugguggaggguccccgagguucugaugaggggagaccacuccauaugguggagggucucugcaguucugauaaugggagaucauc

SEQ ID NO: 2245 - RNA, 78 nt, Human
gaggguccgcauuaacagugagaggauaggguuuuuggcuggggacaguaagaccaucaucacugcgugaaaaccuuc

SEQ ID NO: 2246 - RNA, 92 nt, Human
gagggugucuauggagaggcggcggcgcggcugcugaggcggaggcugaggcaguggcgauggcgcccuuuccugaagaaguggacgucuuc

SEQ ID NO: 2247 - RNA, 87 nt, Human
gagguaaguuugaacccaggagggagagguuguggugagccaagauggcaccauugcacuccagccugggugacagagugagacuuc

SEQ ID NO: 2248 - RNA, 61 nt, Human
gagguacuagguuuugacaagcuugcaucaugcgugaguauaagcuagucguucuuggcuc

SEQ ID NO: 2249 - RNA, 85 nt, Human
gagguaggugcuuuaacugugugcacccugugagguaggugcuuuaacugugugcacauugugagguaggugcugaaacugcuuc

SEQ ID NO: 2250 - RNA, 62 nt, Human
gagguaucugcugcgccugagaugaguaaacugucguuucgggcgcgggcgcuagacgccuc

SEQ ID NO: 2251 - RNA, 68 nt, Human
gaggugccggugggccuguguugcugcgauuuuagucugugcugggaggcagggcuccgcugcgccuc

SEQ ID NO: 2252 - RNA, 88 nt, Human
gaggugccucaguggaggcgcugugucuccuacgcaacuucugagggcuggagggugccaagggcagcugcugaccgccuggugcuuc

SEQ ID NO: 2253 - RNA, 98 nt, Human
gaggugggaggauugcuuguuccccggagguugaagcuacagugagccuugauugugucacugcacuccagccugggcaacagguaagacucugucuc

SEQ ID NO: 2254 - RNA, 67 nt, Human
gagguggguggaucaccugaggucagguguucaagaccacccugaccaacauggugaaacccaucuc

SEQ ID NO: 2255 - RNA, 80 nt, Human
gagguggucuuauccagcucagcuuccccugggacccaccgugggaccugaggcagaacugggguggacuuggccuccuc

SEQ ID NO: 2256 - RNA, 80 nt, Human
gagguuggaagaaugacacgggcucaggacacagagugaggacucaugucuaaugagcaccggccaaaacuuccaucuuc

SEQ ID NO: 2257 - RNA, 81 nt, Human
gagguuggcccccugaggugugagugaaaugagcuuugcuuuauuuuccaaguuucucucucaccuucaggggcauucuuc

SEQ ID NO: 2258 - RNA, 68 nt, Human
gagguuuccaggcuagugguuucuuccucugaccacaguaagaggaaaggaagcuuugccuccaccuc

SEQ ID NO: 2259 - RNA, 82 nt, Human
gaguaaaaggaucugggcugcagucuaggcugagagaugccagcaaaggcugccuaggccagugcaguccaguaaaucccuc

SEQ ID NO: 2260 - RNA, 105 nt, Human
gaguaacaggugcuggagccagacuuccuggguucauauccugguucuaccaauuuaccagcugugugaacuuaggaaaauuccucuccgccucuuaguuuauuc

SEQ ID NO: 2261 - RNA, 104 nt, Human
gaguaaggggcagagcgcugccucucugcaggccgugugcuuugcucgguugaucuugcagagccuaagacacaggcccagagaggcagugaucgccaaagauc

SEQ ID NO: 2262 - RNA, 73 nt, Human
gaguaaugggauauccaauaaacugagaauguuucuucacaaucuccuuuauucuucguuccuccaaguacuc

SEQ ID NO: 2263 - RNA, 78 nt, Human
gagucagggauuuucugguuugagagacaaugacacacaccccuaaguucaccuucucucgaauaguaggcccugcuc

SEQ ID NO: 2264 - RNA, 84 nt, Human
gagucgcuugaaccugggagggggagguugcagugagcugagaucgugcuacugcauuccagccugggcaacagagcaagacuc

SEQ ID NO: 2265 - RNA, 76 nt, Human
gagucggugcuugguaccuggucucuccagucucaacagacucaggucaggucucucaaccaggaagcaaccacuc

SEQ ID NO: 2266 - RNA, 76 nt, Human
gagucggugcuugguaccuggucucuccagucucaacagacucaggucaggucucucacccaggaagcaaccacuc

SEQ ID NO: 2267 - RNA, 71 nt, Human
gagucuaaagguuggaguguggggguggugggggaucccccaccugggucuggacugcaugaggaagacuc

SEQ ID NO: 2268 - RNA, 83 nt, Human
gagucucacucugugguccagacuggaguauagugcuaucagagcuuacuacaacuuuaaacuucugggcucaggugauccuc

SEQ ID NO: 2269 - RNA, 76 nt, Human
gagucucuguugccuaggcuggagugcaguggugugaucuugguucacugcaacaccuccuggguucaagugauuc

SEQ ID NO: 2270 - RNA, 86 nt, Human
gagucuugccaugccggccaggcuggagugcagugcugugaucucggcucacugcaaccuccaccucccgggcuccagcaauccuc

SEQ ID NO: 2271 - RNA, 67 nt, Human
gagugaggaauguuuggguggcgucaagguugguaagcggcgcgcgccgcucgagcucucccgcauc

SEQ ID NO: 2272 - RNA, 66 nt, Human
gagugccucgcucgguaacugcuugguccugaacauucucucguuucaggaacugaugagguucuc

SEQ ID NO: 2273 - RNA, 79 nt, Human
gaguggagcggagcgggcuggugcuggggccgcggagaucgcugugcuggccccagccccaucaccgaaacacauacuc

SEQ ID NO: 2274 - RNA, 86 nt, Human
gaguggauuggauaugguuggaguggcacagacuggaucugggaaaacauugucuuauuugcuuccugccauuguccacaucacuc

SEQ ID NO: 2275 - RNA, 82 nt, Human
gagugggagcuacagccagcagccuagcuaugguggacagcagacaaagcuauggacaagcagcaaagcuauaaucccacuc

SEQ ID NO: 2276 - RNA, 76 nt, Human
gaguguccaauucuaggguauuucuccuugauaaaugauuuauuauugucacaaaagauaccaaauuuugauacuc

SEQ ID NO: 2277 - RNA, 89 nt, Human
gaguuagaguugagcuccccuguagcccaggacuaugcuguagauaucaguaugauccugggguguggcaaaaacaauuuucuuuauuc

SEQ ID NO: 2278 - RNA, 82 nt, Human
gaguuagcgguggguggaggagggggccuuggcaucuucucuuuaugucucugagcugugccuucgccaccccuucuggguc

SEQ ID NO: 2279 - RNA, 85 nt, Human
gaguugcgagggaggcugcgggggcgggcggacguauguugagacccuaugcagccuccugcucucccgagggcuccugcggcuc

SEQ ID NO: 2280 - RNA, 72 nt, Human
gaguugcugcagaggacaugacccccagcagaugucccguaggcaucaguccaguuauauccgcaguaucuc

SEQ ID NO: 2281 - RNA, 73 nt, Human
gaguuucauccuugugauaagaaauguguacuuggaacaagcuaaccugcuauuucccaccuuuaugaaacuc

SEQ ID NO: 2282 - RNA, 73 nt, Human
gaguuuuauuggguuuguugaaguaugacuugagaauaaugcauaccuggguucaaaccacaugcugaagcuc

SEQ ID NO: 2283 - RNA, 81 nt, Human
gaguuuucuucuaauguuuugugcuuaugaaaaccauuucuguguaacguguuuaaguagcuuauuuaucugaaagaacuc

SEQ ID NO: 2284 - RNA, 97 nt, Human
gauaagcugggggcacuggcuucugcucuugcucuuucuucuggaaacauuauucuguuccuuuggacaugggcaaggguccugucccuaacuuguc

SEQ ID NO: 2285 - RNA, 65 nt, Human
gauaaggaccuguuuggggcagcagggagcaaaaucuccuuuaacaaccaagcaguuccucauuc

SEQ ID NO: 2286 - RNA, 66 nt, Human
gauacaagacaggcaagaacaagugguucuuccagaaacugcgguuuuagaugcuuuguuuugauc

SEQ ID NO: 2287 - RNA, 78 nt, Human
gauacagccuugcucuguugcucaggcugaagugcacuggcgcaaucucccgucugggcgacagagcaagacucuguc

SEQ ID NO: 2288 - RNA, 67 nt, Human
gauacagccuuuucuuuaucuuauagcaggaaaaaaaaccuuuugagggaaauagaagggcugcguu

SEQ ID NO: 2289 - RNA, 66 nt, Human
gauacccucuuggccauccgggccccaucaggcaccagccuggaggugcccaucccagagggucuc

SEQ ID NO: 2290 - RNA, 93 nt, Human
gauacugcaaaagugagaaggagauaauagauacuuugcucugaauuuggcauccagaguuaacauuucuccccucacucccuugcugguguc

SEQ ID NO: 2291 - RNA, 85 nt, Human
gauagaucaguugcuauauuuucugguguagggucuuucuuauuuagugagaucuagggauaccacagaaaugguucagucuauc

SEQ ID NO: 2292 - RNA, 80 nt, Human
gauauauaaaucggggaaaauagaucauuuauugaagacauacuguacagaugaaaaugaucuguugacuccuuuguauc

SEQ ID NO: 2293 - RNA, 75 nt, Human
gauaucgaagagcuggagaccaaggccgugggaaugucuaacgauggccgcuuucucaaguuugacaucgaaauc

SEQ ID NO: 2294 - RNA, 81 nt, Human
gauauguugaaggguauuuguuaauuuuacuuuucaaagauacuuuaaaacaguagagcuagcaaugacaccuugcauuuc

SEQ ID NO: 2295 - RNA, 87 nt, Human
gauauguuucuacuagugguugauggccucuuucagcuccaucgcuauggaggcgagguucaucaauaacucagagaaacuuguguc

SEQ ID NO: 2296 - RNA, 71 nt, Human
gaucacucaggagcauguuauucaauuuucauguauuuacauuguuuugaagguuccuuuuggaguugauu

SEQ ID NO: 2297 - RNA, 63 nt, Human
gaucacucaugauguuucuuccaagaacugcaaagccaucuuggaagagcagcccaggugguc

SEQ ID NO: 2298 - RNA, 101 nt, Human
gaucagaagguugagacuccaacugggagagauguguuucugcugcucaaauauuucccaaguuugcaagacaucuccagccuuuggagugccuucugguu

SEQ ID NO: 2299 - RNA, 97 nt, Human
gaucaucagacagauggccacucaugugaaaauugauuugugcauaaauguaaggaauaugugcucucauuggguaaucucaucugcuuuggugguu

SEQ ID NO: 2300 - RNA, 75 nt, Human
gauccagcaggaagugcuggugaccccgggccgcaacgccgacgcccgugucgucaguucgucaaggugaagauc

SEQ ID NO: 2301 - RNA, 60 nt, Human
gauccucaagaugggcgaauccaacucggggcugagauguugaugcgcccacuugggcuc

SEQ ID NO: 2302 - RNA, 89 nt, Human
gauccucauguucacuacccuucaugcaugaaagacaaagcuacucagacaccuagcuguugggcagaagagggugcagaaaagagguc

SEQ ID NO: 2303 - RNA, 77 nt, Human
gauccugucacgaacacauuuagcacacauggaaccaccauaggcccugcugacauguuucuuuguuuuggacaauc

SEQ ID NO: 2304 - RNA, 91 nt, Human
gaucuaaagacaagcaccuagucuccuuguucucuguauaucuccauugcccagcuagaaggguggaaacaguugugccuguuccuggguu

SEQ ID NO: 2305 - RNA, 83 nt, Human
gaucuaacauccauuuauugagaaguuuccacuugcuguacacuuagauugcagccuuagauuuuauauuuggaucaaaguuc

SEQ ID NO: 2306 - RNA, 109 nt, Human
gaucucggcguugugcaugucgggcgacugcuccaugaucuugcgccgcucgaucugcgaccacaccaugaaggcguucaugggucgcuugaugugcccacucgggguc

SEQ ID NO: 2307 - RNA, 60 nt, Human
gaucuuucauuguuggauccccaaagccagugccuugggugagcagcaagucccaagauc

SEQ ID NO: 2308 - RNA, 115 nt, Human
gaugaagggagagagaggaggagagaggcaaguguuccaggcuagagaaauagagaccacgacccugaacuggagcauugacuuccuuucucucccuuucuccuuccuucccguc

SEQ ID NO: 2309 - RNA, 93 nt, Human
gaugaagucuugcucugucgcccaggcuggagugcaauggcgcgaucucggcucacugcaagcuccggcuugguaacagagcgagacuccauc

SEQ ID NO: 2310 - RNA, 85 nt, Human
gaugaauccuucaaauaggagccgauggaucugugguccuuugggacucaucaaagccuugguuuagcauuuugucaguuuuauc

SEQ ID NO: 2311 - RNA, 83 nt, Human
gaugacuguugggagagaagcugaggcagggcuugcaugucugcuagacuugcugguuccuugcuucuagcacuccuguuauc

SEQ ID NO: 2312 - RNA, 74 nt, Human
gaugaggggggaugcgaguaccuccaagaagaaaaaucacacucugaauggugcuugcauuuuaggguuucauu

SEQ ID NO: 2313 - RNA, 81 nt, Human
gaugaguggcuuuucgagggaccuggcacguacaucccccggaaggaaguggaggucguggagaucauucaggccaccauc

SEQ ID NO: 2314 - RNA, 79 nt, Human
gaugaucuucuacugaaaugccuaaagaagucacaggcuggcuucuguuuuauucagggauuuuuuuaaaaagucaauc

SEQ ID NO: 2315 - RNA, 78 nt, Human
gaugcacuuguccguucccauagccugcugcuaugauccccugccacagcugcacagaggggcacggaacuccaaauc

SEQ ID NO: 2316 - RNA, 61 nt, Human
gaugccuucaguuuggucagugucuaaaaguuaagucuguuuaggccaagcaugguggcuc

SEQ ID NO: 2317 - RNA, 80 nt, Human
gaugcuaugucagaacaccggaggcauuuucccaacuguccauuuuggaaaauucucuagaaacucugagguuuagcauu

SEQ ID NO: 2318 - RNA, 77 nt, Human
gaugcuggcaaagaucucacugaucccaaugagcagguacugagggaucugcaccagauggacaguggugccgcguu

SEQ ID NO: 2319 - RNA, 73 nt, Human
gauggaaaaaucagcucagaaaggccaauuacuucuuuaauagaucaguuuuuuugacauaauaacucacauc

SEQ ID NO: 2320 - RNA, 63 nt, Human
gauggaaaguucagcaagaucagcaacaaaaccaagaaaaaugauccuugcgugcugaauauc

SEQ ID NO: 2321 - RNA, 106 nt, Human
gauggauuauaagguagcaacccaagaaaguggguuuggacauucaaauacuugaguuuaaguccagaugugcaaacuugggcaaagccauuuaaccucauucauc

SEQ ID NO: 2322 - RNA, 65 nt, Human
gauggcccaggugcacccagaggccccagcccuuuggcugccuuuggguugugacuuggguuguc

SEQ ID NO: 2323 - RNA, 75 nt, Human
gauggcugucuccuucaccuaccgacaccuggcacucuucacagacacaggcuacaucuggauggggacagcauc

SEQ ID NO: 2324 - RNA, 73 nt, Human
gaugggaaugagccaccucagauguggagggcccugaagaauccauauaggagggcaggcucuucacucccuc

SEQ ID NO: 2325 - RNA, 60 nt, Human
gaugggauggaaaugaaauggccaaaagagcaaaggcuuauuucaaaaccuuugucccuc

SEQ ID NO: 2326 - RNA, 70 nt, Human
gaugggcgucccaguucccuuucccauuccugagccugaugguuguaagaguggaauuaacugcccuauc

SEQ ID NO: 2327 - RNA, 72 nt, Human
gaugggcugaagaaggagucagagcgggaucgggcaaugcuggcucucacauccacucucaacaaacucauc

SEQ ID NO: 2328 - RNA, 85 nt, Human
gauggucugaugcuacaggacuugguuucagcuaagcugauuucagauuacacuguuaccgagaucccugauaccauuaaugauc

SEQ ID NO: 2329 - RNA, 91 nt, Human
gaugguuuuagaugauaaccacaggucuacaagagcguuuuuaguaaagugccuguguucauuguggacaaaguuauuauuuugcaacauc

SEQ ID NO: 2330 - RNA, 93 nt, Human
gauguaccaacaguaccagcaacaggccggcuauggugcacagcagccgcaggcuccaccucagcagccucaacaguaugguauucaguauuc

SEQ ID NO: 2331 - RNA, 77 nt, Human
gauguaguggguuggugcaaaaguaauuggaguuuugccauuuuaaugcaauuacuuuugcaccaaucuaauauauc

SEQ ID NO: 2332 - RNA, 61 nt, Human
gaugucagucccaaggaccaguagcugccaucaguuuggauucugaaaacuaacuggcauc

SEQ ID NO: 2333 - RNA, 62 nt, Human
gauguccuuuuauaaaguugaggaacuucucuucuguuccuacuuugcugagagucuccauc

SEQ ID NO: 2334 - RNA, 82 nt, Human
gaugugaggaaaggaagugccaaaaaugccuggacagauggcuugucccaaggccaggacacacacuuuaaaauccaacauu

SEQ ID NO: 2335 - RNA, 65 nt, Human
gauguggaugguggccucacccagauugacaaguaccuguacuccucugaggacuacauuaaguc

SEQ ID NO: 2336 - RNA, 94 nt, Human
gauguguggccacccugaccgcuggcaugugcccagcgacguggccggaagccaugaucugcgucgauugccaauccgguuaauuccacgcauc

SEQ ID NO: 2337 - RNA, 77 nt, Human
gauuaaagggagacaauggugucuuggaggcaaacuacaguuugcuguaagauaacuuuccgugcaucuuuuaaauc

SEQ ID NO: 2338 - RNA, 63 nt, Human
gauuaaugcagguguuauagaagccagaagagaaacuguggcacccuaaagaagcauauaauc

SEQ ID NO: 2339 - RNA, 79 nt, Human
gauuaauuggauuugaggauaauuauuauuauuugguuuuuagauuugaaaaguagaauuuccauugagacaauugauu

SEQ ID NO: 2340 - RNA, 119 nt, Human
gauuacagaugugagccacugcacccagccuggauuuuggcucuuaaacauuaauacacacauaugaaaaggacacaggaaccagccagcaggaguuuccacuggccauaucugaaauc

SEQ ID NO: 2341 - RNA, 94 nt, Human
gauucaaagcaagaugguagcauuggagaggaugagauauggucagaugaggauauauuuuaaaaguugagcuaacaggauuugcugaggaauc

SEQ ID NO: 2342 - RNA, 90 nt, Human
gauucacaaccauuccacauuuguggggaagaucuggcucacuguucugauugucuuccggaucguccuuacagcuguaggaggagaauc

SEQ ID NO: 2343 - RNA, 107 nt, Human
gauuccuuuuaauccuauagcuuuguguguuugugugugcauguauguguguuguugugugugugugcacgugcuuuauucacaaauuuauaaggguuucuaggguc

SEQ ID NO: 2344 - RNA, 72 nt, Human
gauucgauucagcaaaugggaucaauauuucaccugaugauaaguauaucuauguugcugacauauuggauc

SEQ ID NO: 2345 - RNA, 64 nt, Human
gauugacacacagggggauggaguugguccuuguccauucucucacccuugcugugcauguauc

SEQ ID NO: 2346 - RNA, 63 nt, Human
gauuggcugcguuguuguaggccaacaugaugguggcaucuggcaaucaacuuaguagaaguc

SEQ ID NO: 2347 - RNA, 97 nt, Human
gauuguccacgccgucauucucuucaucuguauaaacuguggcugguucacuuuaacccugagcaggagcugccuaugaaagaggauggcuggaguc

SEQ ID NO: 2348 - RNA, 77 nt, Human
gauuuaguacaguuaugcucagaugaacacuggacccauguggcagggucaagcaacuagaacaugauucagaaauc

SEQ ID NO: 2349 - RNA, 61 nt, Human
gauuucaggucauuuuuagcccuagacuggaaaggggucaggggacaggugaccugggcuc

SEQ ID NO: 2350 - RNA, 78 nt, Human
gauuugguauuggacuugcaagucucuuuacagaaaauguauuggcacauccuugcauuguucuacgccgccaauguc

SEQ ID NO: 2351 - RNA, 103 nt, Human
gauuuucaguacuguaguugcccuggacauugaguacaguucagccuuacucuguuuuuaaguaguuguguugucaauuucaugcuuuuaaguccugaugauc

SEQ ID NO: 2352 - RNA, 85 nt, Human
gauuuugcucucagaaccccuucccccuucaucaugccccucugcuuuaggguuacgcuaguggaaaaauuugagcagcaaacuc

SEQ ID NO: 2353 - RNA, 86 nt, Human
gcaaaaaaagugagggagauagugaggggagggcacgcuugucuucucagguaucuuccccagcauugcucccuuacuuaguaugc

SEQ ID NO: 2354 - RNA, 72 nt, Human
gcaaaauauauuuauuucuaggauauaaugauuuagugacuagcuaaaagugguuuuaaauggacguuuugc

SEQ ID NO: 2355 - RNA, 78 nt, Human
gcaaagcaaaaggccacagagggcucccugagaauccaguacacuaagcgaggccuucacuggucaagacaacuuugc

SEQ ID NO: 2356 - RNA, 106 nt, Human
gcaaaggaaguggcuuaaugauccugaagggauuucuucugaugguagcuuuuuguauuaucacguaagauucuauuuucaguuguguguaagccaguuuuuuagu

SEQ ID NO: 2357 - RNA, 81 nt, Human
gcaaauacuuuugaccucuugugaugagucagaacuaaaacuuaauucuuugacuuucacauuuuuuaaaaaguguauugc

SEQ ID NO: 2358 - RNA, 71 nt, Human
gcaacccagcucuuuuaucaugaggagagguagccaugcugacucaugaacagguggaggaaagggguagc

SEQ ID NO: 2359 - RNA, 76 nt, Human
gcaaccucugaagauggaacagucauugcucaggcugaguauggcaguaguggauauaaggaggacagaggguugc

SEQ ID NO: 2360 - RNA, 90 nt, Human
gcaaccuucccccaacuauaggaaauggauauaauugaagcaugauuuguguugggucauguuuuucacucaccuccuuagugaagaugc

SEQ ID NO: 2361 - RNA, 85 nt, Human
gcaagaaacgugugcuaaagacugagguuccuuggaaacaugcugaaaauucuguucucaagggugucagaaccauacguacugc

SEQ ID NO: 2362 - RNA, 110 nt, Human
gcaagacgaccguuucauauuucuuucaaauaacucaagauaagugcuuagucauagucaaguuuguggauuggguuacucuuaagggaguugagaccuuacuaaauagc

SEQ ID NO: 2363 - RNA, 73 nt, Human
gcaaggaaauuacaguuagaggucacaacugcccgaagccaguucuaaauuuuuaugaagccaauuucccugc

SEQ ID NO: 2364 - RNA, 74 nt, Human
gcaagguuugggaaauaagcugauaguaaagucauguaacacuuucugugcagguuaacauuucuggaccuugc

SEQ ID NO: 2365 - RNA, 61 nt, Human
gcaaguaguuauacucaggaagaacuucgacacuuacggguuucuucuguuugauacuggc

SEQ ID NO: 2366 - RNA, 65 nt, Human
gcaagugaaugucuugcugaaugugucuagggguucaucuucaguaaucgacauuccacuagugc

SEQ ID NO: 2367 - RNA, 100 nt, Human
gcaagugacuaaguguucauuaccuuuugguuagcguugcuaucacuguagcugugcugccuuaacaucgagaguugaguuguggacuuagucauugagu

SEQ ID NO: 2368 - RNA, 109 nt, Human
gcaaguuccuuuauuuuugaaugggaaugccuuacagaauuuaaaagaaacuuuaaacguggauguuuugguacaacuuauagaaaagguaaaggaaaccccaacaugc

SEQ ID NO: 2369 - RNA, 89 nt, Human
gcaaugaggacucucuacaggacccgauauggcuaucccguggaucuauuugugaugacuauauggcaacucuuggcuguccucauugu

SEQ ID NO: 2370 - RNA, 61 nt, Human
gcaaugccguagcuauggaauagaagcauuuguugaacucuuuuugugagccaggcccugu

SEQ ID NO: 2371 - RNA, 65 nt, Human
gcacaaaggcggcgcggugcacgucggaguuguaguacuucagcugcaucugcgccaccugcugc

SEQ ID NO: 2372 - RNA, 90 nt, Human
gcacaaccugccacugccacaguagcucaaccaagcaguugugcugagaauggcaccuggugagagccugcugugugccaggcuuugugc

SEQ ID NO: 2373 - RNA, 60 nt, Human
gcacaauugaaccaacuuccaucgugaaucuuuauaaugauugacuuugguguauagugc

SEQ ID NO: 2374 - RNA, 72 nt, Human
gcacagagauccagaaaguggguagugcaggcuguagugcugauaacuacuguacuacuuggaucuuugugc

SEQ ID NO: 2375 - RNA, 71 nt, Human
gcacagaguuagguaacaaaaauuccuaucagaguaaaaugacaaagcacagaaaaaccagauucuaaugc

SEQ ID NO: 2376 - RNA, 80 nt, Human
gcacauuugugucuuggguuaucuguggggugagaaaccuccucacuuccaaucccagcuaucuggguacaaucuggugu

SEQ ID NO: 2377 - RNA, 75 nt, Human
gcaccacagcaaggauuaucaugugcccuccagagacauacucucagguggaugcgagaaauauccagcuguugc

SEQ ID NO: 2378 - RNA, 77 nt, Human
gcaccauggccagcuuccugaagggggcccaugugaccaucaacgcacgggccgaggaggauguggagccugagugc

SEQ ID NO: 2379 - RNA, 92 nt, Human
gcaccccggagcggauggccgaggcuggcuucauccacugccccacugagaacgagccagacuuggccaguguuucuucugcuucaaggagc

SEQ ID NO: 2380 - RNA, 68 nt, Human
gcaccccuccccucuuggcagccagugggcaagaaccuuacccuacgcugccagguggaggguggggc

SEQ ID NO: 2381 - RNA, 76 nt, Human
gcacccgccucuuccagguccgcgccaacagcgcuggagccacccgggcuguugagguauugccuaaggcuggugc

SEQ ID NO: 2382 - RNA, 65 nt, Human
gcaccgggugcuccugcucgaggccacugugacguucaugcaggcccugugggagcccacggugu

SEQ ID NO: 2383 - RNA, 65 nt, Human
gcaccuccccuguuguguagccagcacaggcacaauuuguggguuugguggcagguagguggugc

SEQ ID NO: 2384 - RNA, 61 nt, Human
gcacgaggacugguccauuaucaucuucaccaacacgugcaagaccugccagauucugugc

SEQ ID NO: 2385 - RNA, 71 nt, Human
gcacgcuccugcuccugacucaccgcuguucgcucucgccgaggaacaagucggucaggaagcccgcgcgc

SEQ ID NO: 2386 - RNA, 77 nt, Human
gcacggcgaggcauggacgcuuucaugggugguuacgcgacaguugccaggaccgagggcgaaaccggcugcaaggc

SEQ ID NO: 2387 - RNA, 77 nt, Human
gcacucuccgagucgcugaagccgcugcugucgcugacacugggcgcugcugcggccuuucaugcgcuccagggugc

SEQ ID NO: 2388 - RNA, 73 nt, Human
gcacugcgagaccugcauaucuggcuucuacggugaucccaccaauggagggaaaugucagccaugcaagugc

SEQ ID NO: 2389 - RNA, 62 nt, Human
gcacugcugcugaaccggccccgggcggccacugucguggcccgggggccccucaagugugu

SEQ ID NO: 2390 - RNA, 91 nt, Human
gcacuggcuugccaguucuucagcucuaggacuuguagcuuuaagcaaacgguguggcauggguugaguguggccaacuggcaggaugugc

SEQ ID NO: 2391 - RNA, 97 nt, Human
gcacuuugugccgcaccagcuccagccgguccuuguccucagccgccgccagguaugcgcuggacgcccgcuucuccugcugggcggccuccagugc

SEQ ID NO: 2392 - RNA, 90 nt, Human
gcagaaaucuggauggccugaguuugaugacuccggggcaugggcccccauguucgagucccuccgcucuuggcaaaccgguucuucugu

SEQ ID NO: 2393 - RNA, 76 nt, Human
gcagacaaaaugaaagaaaaugagagcagaaaguaagcauuuccagccuaucuaauuucuuuaguuuucuauuugc

SEQ ID NO: 2394 - RNA, 62 nt, Human
gcagagccagagaauaagcuuuuuccuguuuguguugaaacauggaaguccccuggcugugc

SEQ ID NO: 2395 - RNA, 84 nt, Human
gcagagcuggggcugcgcggggccgggcgagcgggaccaggcgggagccauggaccgcuagggcccggccuagccccgcgaugc

SEQ ID NO: 2396 - RNA, 72 nt, Human
gcagagguacugagccauaacagagaggcgacuacgcuguuugcuuccuguauuggcugcaagucucucugc

SEQ ID NO: 2397 - RNA, 79 nt, Human
gcagauggggcacucgcugcccucagcgcagagcucacacagcgcagcguguuggcacggcagcacugcccgcuucugu

SEQ ID NO: 2398 - RNA, 80 nt, Human
gcagauuuguguuuuguuuucuuguuaucacugucacacagcuuauaacauguaugcuuuucagaauacaguugucuagc

SEQ ID NO: 2399 - RNA, 68 nt, Human
gcagcacaaaggcggcgcggugcacaucggaguuguaguacuuuaacugcauuugcgccaccugcugc

SEQ ID NO: 2400 - RNA, 68 nt, Human
gcagcacaaaggcggcgcggugcacgucggaguuguaguacuucagcugcaucugcgccaccugcugc

SEQ ID NO: 2401 - RNA, 93 nt, Human
gcagcacuggagcucagcccagguuccagcucaauugaagaaucuccuccuuccacuggaaaccuccuuggcuggguuccaaauugaaaaggc

SEQ ID NO: 2402 - RNA, 89 nt, Human
gcagcaggcagggccaggcagggccgggccuggggccugguguccgaccgcagcccagccccccucaucgccugacacucugccucugc

SEQ ID NO: 2403 - RNA, 76 nt, Human
gcagcaguaucugcaguccauagaagagcgugagaaacuggacgggcucuacgagugcauucucugugccugcugu

SEQ ID NO: 2404 - RNA, 81 nt, Human
gcagccucaucuguuugcggaucagaacccgagcugugcuuguggcugcggcugcuaacuggcugcgcacagggaagcugu

SEQ ID NO: 2405 - RNA, 85 nt, Human
gcagcugaaggcuaggcgccacugggccuggaauucgccacaggacggaucuuacagaggcaaguggucccuggaccucucuugc

SEQ ID NO: 2406 - RNA, 71 nt, Human
gcagcugacuggucuuaaugcuguacuugcgauaggcucguuaagcagcauggaaaagauggguugauugc

SEQ ID NO: 2407 - RNA, 87 nt, Human
gcagcuucccuugcccauguguguccaugugacuaaguucuggccaauggaaugugagugauaaugauacauacagagggaggcugc

SEQ ID NO: 2408 - RNA, 88 nt, Human
gcagcuugaguguuagauuaugacuggagagaaaggcaguccaacaugucaaacaugucuguuuucucacacacuaacacuuugcugu

SEQ ID NO: 2409 - RNA, 75 nt, Human
gcagcuugcucugugguuuucccaacacaaauccgugcuagugcuggggacggaaccgucagagcagucaguugc

SEQ ID NO: 2410 - RNA, 68 nt, Human
gcaggaauugaagcuuuuacagcuggagacugagaaguaggcaucuguacuguaaaccuuugaccugu

SEQ ID NO: 2411 - RNA, 93 nt, Human
gcaggacaucaucuaugaaaauuaucugugaguacgaaaacgagcaucgugguuuaagguguuccagaugacuucaaagguaugaaugccugc

SEQ ID NO: 2412 - RNA, 73 nt, Human
gcaggaggcucaugggugguugcugaaugaagaacagaaucuuggugcuuuguggcucaccacagccaucugu

SEQ ID NO: 2413 - RNA, 60 nt, Human
gcaggaugauugaggaugcaauucgaagucacagcgaaucagccucaccuucagcccugu

SEQ ID NO: 2414 - RNA, 86 nt, Human
gcaggcaggcaaggugacgggacuggaagcccuuuucagagccuuggaggagcugguccguccacaagcaaugagugccacucugc

SEQ ID NO: 2415 - RNA, 94 nt, Human
gcaggcauguguuggcaaaggcuguuaauaguaguuaaguguuaagacugcuuuucuuuaacguuuucaugguaaugcauauuuagagcacugu

SEQ ID NO: 2416 - RNA, 96 nt, Human
gcaggcccaaccgccgccagcaccauggccagcaccauuuccgccuacaaggagaagaugaaggagcugucggugcugucgcucaucugcuccugc

SEQ ID NO: 2417 - RNA, 68 nt, Human
gcaggcggcgcgaauucacuagugauugugagcugagaucgcacccaaacaauccuagugaagccugu

SEQ ID NO: 2418 - RNA, 66 nt, Human
gcaggggcucacggaggaagugcugccugggccagggggaccagcuuuccuccguagagaccaugu

SEQ ID NO: 2419 - RNA, 95 nt, Human
gcaggggcucgaaccagcucuugaggcgggccuggaacgucggccugcgaggcguagucugcugggccugcuccuccagcuuggcgagcaccugc

SEQ ID NO: 2420 - RNA, 105 nt, Human
gcagguagggaucucuggcuuugguaauucuuuaugagaggauccuagccuuugaagcugggagcaggagucaucaucuaaagaauuccauugcucaccuccugc

SEQ ID NO: 2421 - RNA, 92 nt, Human
gcagguauguuacgaaguuuagggggaauuugcuaagccgggagcauauggcuuggcgugcaagugcuggaugaaacuuauaacaugccugc

SEQ ID NO: 2422 - RNA, 111 nt, Human
gcagguccaucuucaguggcauugggccuuggcugggaugcugaguuauccacuggagcaucggcaguacaggcaggcacagaggcaguggauccaucggagguggcaggu

SEQ ID NO: 2423 - RNA, 90 nt, Human
gcaggucccgcuggugcuguggucgagugaccgggacuugugggcuccgugcggccgacacucaugaaggccacaucaccagcgacuugc

SEQ ID NO: 2424 - RNA, 62 nt, Human
gcaggugccagcacggugguuaaaggggagaaguccucuuccuguuuugugguggccccugu

SEQ ID NO: 2425 - RNA, 82 nt, Human
gcagguucacaaggcaggcggucugcguggcacugaagucagggacagucaccaacagcacugucugguccucaggaccugc

SEQ ID NO: 2426 - RNA, 100 nt, Human
gcagguugguacuacuucugauuaggcagaaaacaccaggauuccuuaagugauccuugaaaugguuauuguuuucugccuugucacauuugccaccugu

SEQ ID NO: 2427 - RNA, 79 nt, Human
gcaguauguggagacaggcaagcuugcagcaguugcaguaguguggaaaucuuuuugccugucuuauaauuucguuugu

SEQ ID NO: 2428 - RNA, 111 nt, Human
gcagucccugacaaaugccuucagcuucucugaguccuccuucuuccggucuucagccaaugaggaugaagccaaagcagagaccauccggagcuugaggaaguccuuugc

SEQ ID NO: 2429 - RNA, 85 nt, Human
gcagucuggauucguguuuauugaagccaguaauuagagacaucuuuuuuucccaggacuagaaagcaagguuccacaugacugc

SEQ ID NO: 2430 - RNA, 78 nt, Human
gcagugcacacagguccccggggaccccaccauguggagcggaugguggcuguggccccuuguggccgucugcacugc

SEQ ID NO: 2431 - RNA, 80 nt, Human
gcagugcuugucuaacagcuucugggugcagauuuucuucggcauccuuuugcacucagcuuauuacagguagguagugc

SEQ ID NO: 2432 - RNA, 73 nt, Human
gcaguggagggggcaggaccuccugcuggugcagcaccagcucguggagcagguccaccggccccuacauugc

SEQ ID NO: 2433 - RNA, 74 nt, Human
gcaguggagggggcaggaccuccugcuggugcagcaccagcucgugugagcagguccaccggccccuacauugc

SEQ ID NO: 2434 - RNA, 74 nt, Human
gcaguggagggggcaggaccuccugcuggugcagcaccagcugcugguagcagguccaccggccccuacauugc

SEQ ID NO: 2435 - RNA, 110 nt, Human
gcaguggcgugaucucgguucacuguaaccuccaccucuuggguucaagcgauucuucugccucagccucccgaguagcugggauuacagugccugccaccaugcccggc

SEQ ID NO: 2436 - RNA, 72 nt, Human
gcaguugucaaauaccaggagggcaucagccgcaaacuccucugagcugguguaccuggacagggcaggggc

SEQ ID NO: 2437 - RNA, 82 nt, Human
gcaguugucacaaaaacucacucaucaacuucuuagugaauuugacaggcaagaagaugacauucacuuagugacauuaugu

SEQ ID NO: 2438 - RNA, 72 nt, Human
gcauaagagaacaguacaauuugcaguuaggaucaucuuucuagauuucuguaucuuucaaaauuucugugc

SEQ ID NO: 2439 - RNA, 69 nt, Human
gcauacuggcuacccagguggauuuagacaaguaacagcugcucagcuucaccugagggauccaguggc

SEQ ID NO: 2440 - RNA, 79 nt, Human
gcauaguuaaaaaaaugaagcgagauggcaguuugugcaguaauaucugcccuucgaaguucaugcaaccaacuaaugc

SEQ ID NO: 2441 - RNA, 131 nt, Human
gcauauauuuaagagagagcgcauuuguauaagagauuaguguguguggguuuguaugugagagagaaacacacacaugcacccaguuacacucuccagcagaguaccccuguucuugccugaguaucugc

SEQ ID NO: 2442 - RNA, 73 nt, Human
gcauccagcaugaugcccugcucguccagcucuucuccaacgcggccggacaugugcuucagaaccuggaugc

SEQ ID NO: 2443 - RNA, 73 nt, Human
gcauccugcagcuucgagccaauggugagcuccuucuggaucagcuccuucagcuccuucuugcucagggugu

SEQ ID NO: 2444 - RNA, 68 nt, Human
gcaucgauuaaauccacagucagccauaauaacuccucagacauguuaugcuggggccgugucgaugu

SEQ ID NO: 2445 - RNA, 63 nt, Human
gcaucugcaggggaagccaguuuguucuuuugauccagaaggguuaauuuucgcugcaggugu

SEQ ID NO: 2446 - RNA, 70 nt, Human
gcaugagaucuuugcgcguucgagguguuaccauaugcccguaagauuuuagaccgugcaauuauuaagc

SEQ ID NO: 2447 - RNA, 76 nt, Human
gcaugaucccaggguggaguuuucagcccucugacauuaaaaggugaagcagaggacaugaaaacucgcucugugc

SEQ ID NO: 2448 - RNA, 82 nt, Human
gcaugcgauuuguuaaucaugauggagucucagagcuuuugaagagcugaaccgauaugagaaagucuuaaccaguuguugc

SEQ ID NO: 2449 - RNA, 70 nt, Human
gcauggccagggagggcaaauggaaaggcaaccacucucugccgguccugggcuuaucccugcaaugugc

SEQ ID NO: 2450 - RNA, 77 nt, Human
gcauguaggggguccggcaugggcguccuggcacuugacgcuuaccucguccguagucuggugggccucuguagugc

SEQ ID NO: 2451 - RNA, 73 nt, Human
gcauguccuucacaucacaaaaaccuguccagccgcccaaggccaugguguccaccgaugugcacacacaugc

SEQ ID NO: 2452 - RNA, 78 nt, Human
gcaugucuuaucccgcugaugauuaugagucugaggcggcuuaugaccccuacgcuuaucccagcgacuaugauaugc

SEQ ID NO: 2453 - RNA, 72 nt, Human
gcauuaaaggauaauuuucucugugaauaagagcaaaauggucuucagagaaacagacuguucauuugaagc

SEQ ID NO: 2454 - RNA, 64 nt, Human
gcauugaucuuauccuccgugacugucaccucaucgucgugcagaaugagggccgaguauaugc

SEQ ID NO: 2455 - RNA, 108 nt, Human
gcauuguuuuaccccuuuucucgugggugugguguucagguggccggagcauguggcagcugugggcauucaauuaaacacccuccgaggaagcguggaccucggugu

SEQ ID NO: 2456 - RNA, 72 nt, Human
gcauuucuaaagcccuuugaaaaugugugucaugcuuauggguggccacauuccagagggcugaauaugugc

SEQ ID NO: 2457 - RNA, 81 nt, Human
gcauuugcugaguggaaagccagcccccucccaggcaccuucauuaggugcacguggccccaggccucccuccgaagaugc

SEQ ID NO: 2458 - RNA, 81 nt, Human
gccaaaaugggaaaggaaaagacucauaucaacauugucgucauuggacacguagauucgggcaaguccaccacuacuggc

SEQ ID NO: 2459 - RNA, 95 nt, Human
gccaacaaaaaagacuuggaggaggcagaggggagacuugcagcuccucugcugaaacguuuaagccucuccacauccaaauugaacagccuggc

SEQ ID NO: 2460 - RNA, 110 nt, Human
gccaagaacuugugguugucuugaauccacaaucuuuucucuggcauuggguuccccaaccugaucaauugaguugggagcaauggauucaagucaacagucauucuuac

SEQ ID NO: 2461 - RNA, 73 nt, Human
gccaagagccaucugaagccaccucucugccuguuccucccaagaggccaggguggccacggguggugagggc

SEQ ID NO: 2462 - RNA, 83 nt, Human
gccaagauccauuaauuauuugggguugcaaaauggugguauucucauucugucguuugcuugccuuuauuagcuggaauggu

SEQ ID NO: 2463 - RNA, 87 nt, Human
gccaaggaaacaggaugcugauagucuccagcgggccuggacugugggcugguguguggaacugcugcaagcuuucuuccugguggc

SEQ ID NO: 2464 - RNA, 75 nt, Human
gccaaggcaacacuugcugaugagcaacuuuaaggcuaagccaaguuuucucaaaauaaucagcaguaagcuggc

SEQ ID NO: 2465 - RNA, 66 nt, Human
gccaauaagcgccgguaugccccuguauugggauggccacaagggucacauuggaugcgaguuggu

SEQ ID NO: 2466 - RNA, 94 nt, Human
gccaauuagcugcugccaguggcauaggagggauuaaaagcuggacccaagguuuggaucaccugcuaucuaauuggcuuaagcugcauacggc

SEQ ID NO: 2467 - RNA, 82 nt, Human
gccacaugaaagccguagaauuugaccuugcgaagacucgaguagucguaaagggcaaggguccaaauggcucgcaaauugc

SEQ ID NO: 2468 - RNA, 107 nt, Human
gccaccaccugaacaucagucuagcagaccuuuuaccuuauuaugcagaaagcacacuuggcaugaaaagaaaggguauccucggcuagauuugcuucugucauggc

SEQ ID NO: 2469 - RNA, 84 nt, Human
gccaccaggccaaccugcauauaagaucgaaguaaguuaaauacucaccuaacuaauacgagagguaaucagauggucuagggc

SEQ ID NO: 2470 - RNA, 91 nt, Human
gccaccaggcgguggucugugaugaaggucagggccacgcagggguagguucacagaggccaggagucgcagacggcaacuucuggugggc

SEQ ID NO: 2471 - RNA, 63 nt, Human
gccaccaggucaugaaggaggcguuugggcccgaagauggguuacagaggcucaccugguggu

SEQ ID NO: 2472 - RNA, 74 nt, Human
gccacccgggcagcgcccugagccugaguccucgcguguccgcugagccagagcagggcgcccccgagcguggu

SEQ ID NO: 2473 - RNA, 70 nt, Human
gccaccggggucugcgauggcacgccagugcuggagccgcagccaggcgaggccacucgacucccggggc

SEQ ID NO: 2474 - RNA, 92 nt, Human
gccacuucuucuuauuggagugugagcacuaggagcagggaccuuuccauggugcuugcuguguuauacccugcacccagaacuuaguaggc

SEQ ID NO: 2475 - RNA, 76 nt, Human
gccagaaacucauaauccagaggaacuguguccagcaagcgggcguaguugccauugaucugggcgaugaucuggu

SEQ ID NO: 2476 - RNA, 65 nt, Human
gccagaacagacuguucucugcagugaaucugagccuucaagauucauguaggacaugauuuggc

SEQ ID NO: 2477 - RNA, 62 nt, Human
gccagaggagccugcuguuuuucagaacugaacuggaagggcagaaucaggcuaucucuggc

SEQ ID NO: 2478 - RNA, 76 nt, Human
gccagaucauccugucacaccauuaacgagcuguugugauuggcccucucacgguagaacuguggcagugacuggc

SEQ ID NO: 2479 - RNA, 72 nt, Human
gccagcacgccaaguacacuugcucuuucuguggcaaaaccaagaugaagagacgagcuguggggaucuggc

SEQ ID NO: 2480 - RNA, 130 nt, Human
gccagcagaguucuggagagagagaauucugagacugccacagggcaucugguaccaguucaaauucgcaaagugguacaaugagugaaccugaggcccagauaaagacucccucagaacaguaaguaac

SEQ ID NO: 2481 - RNA, 66 nt, Human
gccagccagcccagcagcgcuccgugcuccaucggagagcggugugcggagaaggcaugagcuggc

SEQ ID NO: 2482 - RNA, 70 nt, Human
gccagccccugggguuuccaccuccugccuccggcccuccagaggggugaggccccaaccccagggcagc

SEQ ID NO: 2483 - RNA, 86 nt, Human
gccagcgccugagcauccccgucaugguggucacccugggaccccacgcgggaccagugcuucggggaccgcuuucagccgccugc

SEQ ID NO: 2484 - RNA, 81 nt, Human
gccaggaccaagagacaggcagcucaccaggguggacaaaucgccagagauguggugcauuguccuguuuucacuuuuggc

SEQ ID NO: 2485 - RNA, 79 nt, Human
gccaggccuccucauccaaguacauccuggauccucuuucucucugguuuccagguacucaggaacuaggccauuuggc

SEQ ID NO: 2486 - RNA, 61 nt, Human
gccagucucaccugcaccuuacgcagcggcaucaauguuaguauguacaggauguacuggu

SEQ ID NO: 2487 - RNA, 87 nt, Human
gccagucugcccagcugcaguacucacgccccaugggggaucuuggucuguuuuucuugugggagccuaguggagagcagacguggc

SEQ ID NO: 2488 - RNA, 61 nt, Human
gccagugucuuuggggggcuguggcagggccgccugccugggguucccuuacucaucuggu

SEQ ID NO: 2489 - RNA, 78 nt, Human
gccaguucaggguccacacugccucgccguuuuggagcagacaccugcuaaccaaugcgguggagcuccugagccggc

SEQ ID NO: 2490 - RNA, 61 nt, Human
gccaguuuaacugucuagcaaaaugcauuucauuuuaaaauuggauauugggagacuuggc

SEQ ID NO: 2491 - RNA, 60 nt, Human
gccaucacgccacaguuucccggaggggccauccacagucuucuggguggcagugauggc

SEQ ID NO: 2492 - RNA, 61 nt, Human
gccaucacugccaccagaagacuguggauggccccuccggggaaaacuguggcgugauggc

SEQ ID NO: 2493 - RNA, 60 nt, Human
gccaucccacaguuguuacugguuugucaagcauaagccaugcccuaacgacaggcuggc

SEQ ID NO: 2494 - RNA, 76 nt, Human
gccaucccgggcagugggcaccgucaaaguauaccugcccaacaagcaacgcacgguggugacuguccgggauggc

SEQ ID NO: 2495 - RNA, 75 nt, Human
gccaugagcacaggcggguccacacacaggcggcgaaccuccacucgcuggcagacggcucgcuuuucguauggc

SEQ ID NO: 2496 - RNA, 82 nt, Human
gccaugccaucgucagugaccccgaggcagguaacgcuguugacgugccaucgaggacugcugcacggucgcccuucauggc

SEQ ID NO: 2497 - RNA, 61 nt, Human
gccauucccacccuccuagguucacauccagggcugugucuuccuugggggaggagauggu

SEQ ID NO: 2498 - RNA, 64 nt, Human
gccauuuuaagcaauaaaaauuggcaugugggugcaugccuguaaucccugcuacuuaggaggc

SEQ ID NO: 2499 - RNA, 76 nt, Human
gcccacugugacgaugucaccgaucuggacgucccugaagcagggggacagguguacagacauguucuuguggcgc

SEQ ID NO: 2500 - RNA, 71 nt, Human
gcccagagucagcaugugcggcgggccaggaccacaaggcuccuaaucccagauguaccgcgacccuaggc

SEQ ID NO: 2501 - RNA, 90 nt, Human
gcccaggcuagaauucaguggcaggaucauagcucacugcagccucgaacuccuaggcucaagcaauccuccugcuucugccuccugggu

SEQ ID NO: 2502 - RNA, 81 nt, Human
gcccaggcuggaguguaguggcaugaucucggcucacugcaagcucugccucccggguucacgcccuucuccugccucagc

SEQ ID NO: 2503 - RNA, 92 nt, Human
gcccauuuaauugaaaguauauaguaaugaaaagccuuauaacgucgggccucuagcaaugcgauuauauagcaaugauuauaaagcugggc

SEQ ID NO: 2504 - RNA, 88 nt, Human
gccccaccgcgcaugaaaccgaaaaaaggggcccuuccccauuugcaaagcgaacaugaacgggccuugacauuuuaaugcguugggc

SEQ ID NO: 2505 - RNA, 60 nt, Human
gccccagccaccauauaccccugcaguuugcacuuuaauugaugguaguucaguuggggu

SEQ ID NO: 2506 - RNA, 92 nt, Human
gccccaucagggauggucacaguccacgccacaggggcugacucugcccaaucaugucccccugguggcagcgaccagauccuggcuggggc

SEQ ID NO: 2507 - RNA, 66 nt, Human
gccccaucccuuguccaguguccucucuaaggcagauuuaaaggacacaaaaggaagcuguguggc

SEQ ID NO: 2508 - RNA, 69 nt, Human
gcccccaaaccauguucagccacacgccuaccaguucaccuaccguguuacugaauguggcaucagggc

SEQ ID NO: 2509 - RNA, 68 nt, Human
gccccccagagcuaauuacauccacacccauccccugaagugguggacauaagggagcccuggggagc

SEQ ID NO: 2510 - RNA, 74 nt, Human
gccccgccccugccgccggaauccugaagcccaaggucugcccgggggcgguccggcggcgccggcgauggggc

SEQ ID NO: 2511 - RNA, 73 nt, Human
gccccggagacagaagcaugaacgugucaaaagaaccaagugaaugcgcgugcguggaagaauacaccggggc

SEQ ID NO: 2512 - RNA, 66 nt, Human
gccccguggcccggggaagggggcugggauugcgccagccccggauaccuggacugcuuagugggc

SEQ ID NO: 2513 - RNA, 71 nt, Human
gccccucgguugggaccguuucucggcacgagcccuacccuugaaucuggggcgcggucuggauugugggc

SEQ ID NO: 2514 - RNA, 86 nt, Human
gccccucuccuuccucuccuccccgggccagcgggcagugcugcuggccgaagcugcccgcacccuggagaaggugggcgaccggc

SEQ ID NO: 2515 - RNA, 80 nt, Human
gccccuugaccccagcuagggccucagggacuuucgggccuuuuccaaaauuuccucccugaucuugggguagucggggu

SEQ ID NO: 2516 - RNA, 85 nt, Human
gcccgccagcucuggcugggaggacuugcucuugggucugcagccugcaucaggagccuccacuuuccccagugcuggauuaugc

SEQ ID NO: 2517 - RNA, 86 nt, Human
gcccgccccuucccuccccuuucuuuacauauaggagaugggauacucauucccgcugcuauugauaaggucggaggcggccgggc

SEQ ID NO: 2518 - RNA, 78 nt, Human
gcccgccgcucuuccuggcgugucaucuccagcauugagcagaaaacagagaggaaugagaagaagcagcagaugggc

SEQ ID NO: 2519 - RNA, 77 nt, Human
gcccgcguggccuucuccucguaggacucccaaacucguucacucugcguuuauccacaggauaaagccacgcuggu

SEQ ID NO: 2520 - RNA, 71 nt, Human
gcccgcucauaaggggauggccauggcgagguuuauagauaguugggguggugaguguaaaugagugaggc

SEQ ID NO: 2521 - RNA, 78 nt, Human
gcccggaaaccacacuacgacaucuggggcaauacagucaauguagccagcaggauggaguccacgggggucaugggc

SEQ ID NO: 2522 - RNA, 84 nt, Human
gcccggcuccucaggaagaaaaccgcuggcccuucccgagugugccggccgagggccgaggggccgugcaaauggggagagggc

SEQ ID NO: 2523 - RNA, 92 nt, Human
gcccguuaauuuuuuacccuauguuuacaucuugaggcagcagagucugucugcagcuauguggugagcuauguaaggaaaaaaaucugggc

SEQ ID NO: 2524 - RNA, 77 nt, Human
gcccuacauggaugacugugguggcaugagauucagcgguucaucacccucgugcccuccaaccugccccaugaagc

SEQ ID NO: 2525 - RNA, 88 nt, Human
gcccuacccaagaagggagacaggcccuggggucacuuguuuccagcccuucaugaccccaagaccuguuccccacaggggccagggc

SEQ ID NO: 2526 - RNA, 68 nt, Human
gcccucccggcaggcacuacucaucgagagguacuaugccuuugaugaggccuuuguucgggaggugc

SEQ ID NO: 2527 - RNA, 71 nt, Human
gcccucccugagccucagucucucauccuccaugggaggauguaauuuuccugaaaaagacagggccgggc

SEQ ID NO: 2528 - RNA, 71 nt, Human
gcccucgaggcccccgcagucccaucauucaguuccguagggucaccggcgcggcaguggccucgcagggc

SEQ ID NO: 2529 - RNA, 86 nt, Human
gcccucgcccggccugucagcgcugcucuccgccgcagcuucagcaccucggcccagaacaaugcuaaaguagcugugcuaggggc

SEQ ID NO: 2530 - RNA, 65 nt, Human
gcccugaguugggagccuccgcgaacagugguccuguacaagugcgugguuuccggcucuggggc

SEQ ID NO: 2531 - RNA, 76 nt, Human
gcccugggaugaaaacauggaccucuuggaagguauaacugggcuuugaagacucugguccgaaaguuuaucuggc

SEQ ID NO: 2532 - RNA, 72 nt, Human
gcccuugauguccugcaaaugaaggaggaggauguccuuaaguuccuugcagcaggaacccacuuagguggc

SEQ ID NO: 2533 - RNA, 108 nt, Human
gcccuuuaagcagcuucauaaccgaagauugcuguggcacggguccaggaccaccaacuuugcugggauccugucccagggaucuucggauagccccgccugaagcgc

SEQ ID NO: 2534 - RNA, 80 nt, Human
gccgacaaggagcgccuggccauccugggcauccacaaugagguguccaagauuguccagaccuaccacgucaauauggc

SEQ ID NO: 2535 - RNA, 80 nt, Human
gccgacccccaagaggccauuaacuguuugaugcgagcaaucgagaucuacacagacaugggccgauucacgauugcggc

SEQ ID NO: 2536 - RNA, 61 nt, Human
gccgaugugucuacucgaagauucugugaucucacucucaggagaccauugcaucauuggc

SEQ ID NO: 2537 - RNA, 76 nt, Human
gccgcccucgccgccgccgucgccgccgcggagcagaucaauaggcgaacgcggagcacagcgcagcgcgggcggc

SEQ ID NO: 2538 - RNA, 63 nt, Human
gccgccgccaggguagcgguguagcugcgcagcgucgcgcgcgcuaccgcacccagguucggc

SEQ ID NO: 2539 - RNA, 68 nt, Human
gccgccucuucgaccaggccuucggguugccccggcugccggaggaguggucgcagugguuaggcggc

SEQ ID NO: 2540 - RNA, 83 nt, Human
gccgcgcccccuuggcgccggguguccugccgcugcuugcgcagcggcccuuguuucuucuuacccguuguuaggggcgcagc

SEQ ID NO: 2541 - RNA, 63 nt, Human
gccgcuccgcucugggugguucaaucccaaccagggguugggauguccugccugcggaggggc

SEQ ID NO: 2542 - RNA, 64 nt, Human
gccgcucgccccaggccugggcccgcuccuguagcggcuggccggccagggagcccacaguggc

SEQ ID NO: 2543 - RNA, 111 nt, Human
gccgcucgccuccuccugccguccgcucggcucaggcgcgggcccuggcuaucuggcgguccucggucuccgcccugcccccggccggcggcagguaagggaggcggcggc

SEQ ID NO: 2544 - RNA, 65 nt, Human
gccggagaugggcccggcggauacuccucuuuuggggaagagguucaagcuggcccauggccggu

SEQ ID NO: 2545 - RNA, 67 nt, Human
gccggcuuuuucgcggggggaaagaaacaaaggccugcauuccccccuucuaaaagggaaagccggc

SEQ ID NO: 2546 - RNA, 85 nt, Human
gccgggcuuggaagccuuugaccuggauccugcacaguuggggagucaauguccagcccuacuccggguccccagccaaccuggc

SEQ ID NO: 2547 - RNA, 74 nt, Human
gccgggggucuggcaggaaugggaggcauccagaacgagaaggagaccaugcaaagccugaacgaccgccuggc

SEQ ID NO: 2548 - RNA, 73 nt, Human
gccguccgcaagcaggagaacgcggccccgcugggcgauccugcccgaaggcgcccgaacugcggcgcgcggc

SEQ ID NO: 2549 - RNA, 73 nt, Human
gccgugggacugucccgggagcgggcccuggacuacuacgggcuguacgacgaccgugggcgccccuaugugc

SEQ ID NO: 2550 - RNA, 78 nt, Human
gccguugagcugguacaccguccggaaggcauuggccauacccgacagccggccgcugauguuggccagcgagagggc

SEQ ID NO: 2551 - RNA, 83 nt, Human
gccuaccccaucugcuccucaucugugcugggggaggccccuccccucaccggccccgaagcugaguuguuuggggugauggc

SEQ ID NO: 2552 - RNA, 98 nt, Human
gccuacuugaccucaaagucacaacccucauauguuaaaucauggccggcagcucaugguacagauuuggcgaaggguuguggggagagucaugaggc

SEQ ID NO: 2553 - RNA, 61 nt, Human
gccuagaauucagaauguacccgauguccacuaacaguagacuggauacaugaacuguggc

SEQ ID NO: 2554 - RNA, 71 nt, Human
gccuaguucuuaccuauguagcacggccggaaagugagaccgccuuagcugcugauuguacuagagcaggc

SEQ ID NO: 2555 - RNA, 87 nt, Human
gccucaaagcugcauguugagugccgucugcuuucggucccgucauuaucucuguauagacccaguuggcaaucaugcauuuggggc

SEQ ID NO: 2556 - RNA, 79 nt, Human
gccucacagaagacuucgugucccaccuggagaccgagcuggagcagucgaggcugcgggagacggagacacugggggc

SEQ ID NO: 2557 - RNA, 80 nt, Human
gccucagauuucugcucaugaucuacauagauuuggaaacuguuuuccucuguuuuggucucuugggcaacauuuuuggc

SEQ ID NO: 2558 - RNA, 109 nt, Human
gccucagccucuccucaguacagucucauggguggaaaagaccaggcuuccggacugcucugggcuacuacccaggagaggcugggcaguggggaaggggggcuggggc

SEQ ID NO: 2559 - RNA, 82 nt, Human
gccucagucucccgaguagcugggacuacaggugcgugccaccacacccagcuaauuuuuguauuuuugguagagacggggu

SEQ ID NO: 2560 - RNA, 83 nt, Human
gccucagucuccugaguagcugggguuacaggugccugccaccaaguccagcuaauuuuuguauuuuuagguagagauggggu

SEQ ID NO: 2561 - RNA, 81 nt, Human
gccucauccucccaaguagcugggauuacaggcuuuugccauuaugccugguaauuuugguauuuuuaguagagauggggu

SEQ ID NO: 2562 - RNA, 60 nt, Human
gccuccaucugggccucucuggucaaaaccacuuuuuugagucaggggcccagccuaggc

SEQ ID NO: 2563 - RNA, 77 nt, Human
gccucggcacgugcacucauggccuuggaauuguuggccugcaucuucuuuaggcccuuuuuguugugcuucuuggc

SEQ ID NO: 2564 - RNA, 61 nt, Human
gccucuggguccugggcagauacagccuuugcugugggagggaugugggggaccuugaggc

SEQ ID NO: 2565 - RNA, 84 nt, Human
gccugaccgaggcgaacgcguggacaaagugaagcugaucaaggaaaucaagaacuacauccaaggcaucaaccucguccaggc

SEQ ID NO: 2566 - RNA, 79 nt, Human
gccugagcgagcagaaggcccgcgagacgcucaagaacucggcucugagcgcgcagcugcgcgaggccgcuacucaggc

SEQ ID NO: 2567 - RNA, 61 nt, Human
gccugaugacaugcucacgugacaugguuaugcccuguuuggcuuuauaugugauaaaggc

SEQ ID NO: 2568 - RNA, 67 nt, Human
gccugccgggggugguggcacugagagccugggggaacaggcgccaggccaguggcccaaggacggc

SEQ ID NO: 2569 - RNA, 88 nt, Human
gccugcgggguauuguagaaacgcugcgcugccuaucacagcuugugaugugacacguucauucugcaaguuuaaacuucgccuaggu

SEQ ID NO: 2570 - RNA, 99 nt, Human
gccugcugcuguacuucaucagaaaacaccuucagcugcugcaggaagggcucuuugugguaguuggggugcacauuaucauaguugggcacuacaggc

SEQ ID NO: 2571 - RNA, 107 nt, Human
gccuggaacucugugguccugcaccucccccuacaccccccaacaaaaauuagccuccaaucagcuccuggagacaauguuggugggaaccacaaggguuccugggc

SEQ ID NO: 2572 - RNA, 86 nt, Human
gccuggccuccugcaugcccaacaagccugcucccguggggccugcuauccaccuguuggggaccugcuuguugggaggacccggu

SEQ ID NO: 2573 - RNA, 108 nt, Human
gccuggccuuccauauaucaagcagaguuuuaucaccuuaugcaggggcagcccugccaccugccauaaaguugauaggcuaaugacauuuuguggauauugccaugu

SEQ ID NO: 2574 - RNA, 95 nt, Human
gccuggcuccagcagccugggcauggcggcgacucccccaaaaacaccccagcugggugggugccugggggccuaggugaggcugguguuggagc

SEQ ID NO: 2575 - RNA, 70 nt, Human
gccugggacuuggagaaaugggauuugaaauuccuccuggagaaagcucagaaucuguuuuuucccaagc

SEQ ID NO: 2576 - RNA, 63 nt, Human
gccugggagucucccugccucacuccucuaggcaggggagugaugcuucaggacgugacaggc

SEQ ID NO: 2577 - RNA, 103 nt, Human
gccugggcugugguaaguaauggagcugugaguuccuggauggugacacgguccaggaucuugaaacucguguccaguuucaggggcuggcugcagcgcuggc

SEQ ID NO: 2578 - RNA, 82 nt, Human
gccugucaccuaaaucuuaugcaacuuaucaaagaaaugcuucuacauucuuacaaagaccacuaggaagagguggcaaggu

SEQ ID NO: 2579 - RNA, 65 nt, Human
gccuucguucaagggucaggaauggaccagaacagauggguucuggaggccccugaacagagggc

SEQ ID NO: 2580 - RNA, 110 nt, Human
gccuucuuguccacugcuuugaugacacccaccgcaacugucugucuuauaucacgaacagcaaagcgaccccaaaguggauagucugagaagcuccaacacacaugggc

SEQ ID NO: 2581 - RNA, 72 nt, Human
gccuugagcuaagguauccgcuucaaggccuccuauccauggcccuuggaagcggauaccuuagcucaaggu

SEQ ID NO: 2582 - RNA, 71 nt, Human
gccuugggacgugcccauuuuuacuguaaauuaugauuccguaacugacuuguaguaagcagguuucuggc

SEQ ID NO: 2583 - RNA, 67 nt, Human
gccuugucaccuccaguugggugccucuggguucccacuggcucugcccaggugggggugggugggc

SEQ ID NO: 2584 - RNA, 71 nt, Human
gcgaccgggagagcuuuucuuuaacgauaucaacuuuguggugccaaaaggaaaagcggccuccccccagc

SEQ ID NO: 2585 - RNA, 72 nt, Human
gcgaccuucagcuccuuuggcuuauguccuuaugcccccugggacuucacgugcuccguuggaucaggucgc

SEQ ID NO: 2586 - RNA, 76 nt, Human
gcgacgcggagcccagcgggcgcgcgugcgguugucuaccccgugacgcggcccagcggggcucgggaccgcgcgc

SEQ ID NO: 2587 - RNA, 88 nt, Human
gcgacguccuguuucuggcugugaagccacauaucauccccuucauccuggaugagauuggggccgacgugcaagccagacacaucgu

SEQ ID NO: 2588 - RNA, 77 nt, Human
gcgagcgggaaaucgugcgcgacauccagagaagcugugcuacgucgccuggaauucgagcagagauggcacgccgc

SEQ ID NO: 2589 - RNA, 60 nt, Human
gcgaggaccugcgggcacgcucccagggguccccugaggacucggccccccaggccucgc

SEQ ID NO: 2590 - RNA, 80 nt, Human
gcgagugccagcaugccuggcuaauuuuuuguauuuuuaguagagacuggguuucaccauguuggccaggcuggucucgu

SEQ ID NO: 2591 - RNA, 84 nt, Human
gcgccagguuucaauuucuaucgccuauacuuuauuggguaaaugguuccgguaagguugucagguaguaagguggacgugggu

SEQ ID NO: 2592 - RNA, 92 nt, Human
gcgcccuccgggcccagccucccgagccuucggagcgggcgccgucccagcccagcuccggggaaacgcgagccgcgaugccuggggggugc

SEQ ID NO: 2593 - RNA, 80 nt, Human
gcgccuaccucacagacggccaggagccagggagccccaggaugcuccgacugacaacccugcugcugggaccacggcgc

SEQ ID NO: 2594 - RNA, 83 nt, Human
gcgccugagaacccaauugacuacgcgcgacgauccaggacacgccuggccccguuggucccuauccaauucuucccagacgu

SEQ ID NO: 2595 - RNA, 63 nt, Human
gcgccugggcgugcucaagaacgugcuggcugccagcgccgggggcaugcucaccuacggcgu

SEQ ID NO: 2596 - RNA, 102 nt, Human
gcgcgcucguucgggaucgccgagggggcugagauagugaauuccuaagaagaaaauaauggaugcauauuaguuguucucuaaguggacucaacagugugc

SEQ ID NO: 2597 - RNA, 72 nt, Human
gcgcggcgaggaugccaacugauggcucguacggacuuguucguugaucacucacaucgugcucgcugcagc

SEQ ID NO: 2598 - RNA, 73 nt, Human
gcgcguuccccgguuuucuuuguuccaaggggggccccuauauauagggggggccggauuuuuauuagcgcgc

SEQ ID NO: 2599 - RNA, 79 nt, Human
gcgcuccaaauugaauuuacuuuuaaaaugggcaaaauaccacaauugaccauuuuagagcuaaguuaaauuggacugc

SEQ ID NO: 2600 - RNA, 68 nt, Human
gcgcuggccgccgccgccuccuccaaagggggccggguccuggaggugggcuuuggcauggccaucgc

SEQ ID NO: 2601 - RNA, 73 nt, Human
gcgcuuuguggcuccuccuggccaggucauacuucgaaguuguccccucgccaaagggacgggucaguagcgu

SEQ ID NO: 2602 - RNA, 63 nt, Human
gcggaaacgugccggagauugcuguguaccuggcuuugaagcaacuccucaguacguuuuggc

SEQ ID NO: 2603 - RNA, 83 nt, Human
gcggaaguguccucggccggcgcagcccgcgcuccgcccgcgcuccgaccccggcccggcuggcacccccucgacgccuccgc

SEQ ID NO: 2604 - RNA, 75 nt, Human
gcggagagguaucugcugcgccugagaugaguaaacugucguuucgggcgcgggcgcuagacgccucgaagccgc

SEQ ID NO: 2605 - RNA, 83 nt, Human
gcggaggcucguaacugucgguucuuuccccuucggucuuaggaugaggugggcgcaccgggcauagugguuggaguuucugu

SEQ ID NO: 2606 - RNA, 98 nt, Human
gcggaggugggggucuggcuucagggucucaguccuucccuuuagaauaucugagaggggaaggucaggaagguccaagcguugagucaccccucugc

SEQ ID NO: 2607 - RNA, 84 nt, Human
gcggcacgcccgggaggcuuucucuggcugguaaccgcuacucccggacaccagaccaccgccuuccguacacagggugcccgc

SEQ ID NO: 2608 - RNA, 72 nt, Human
gcggccaccgucaacaggagcacucggugccggagaacaugguagaggcaccucugucgggcagguggccgu

SEQ ID NO: 2609 - RNA, 60 nt, Human
gcggccgagggggagggccgggggagcggacgucgccucugcuggucucccaccucccgc

SEQ ID NO: 2610 - RNA, 93 nt, Human
gcggccggaggaccagcaggaggaggaggcggcggccgccgccgcguaccuggacgagcugcccgagccgcugcugcugcgcgugcuggccgc

SEQ ID NO: 2611 - RNA, 81 nt, Human
gcggccggggcgggagagacucagcaacgacccauaccucagacccgacggcccggagcggagcgcgcccugcccuggcgc

SEQ ID NO: 2612 - RNA, 64 nt, Human
gcggccucggugauguggaugugaaugacuggagacagcauucuauuuacaagaacgguacugc

SEQ ID NO: 2613 - RNA, 79 nt, Human
gcggcgacucgccggcgcgcugcucggagcagcgccuccgcgacgaacgcuccuccgccagcuugcucgcgggucgugc

SEQ ID NO: 2614 - RNA, 84 nt, Human
gcggcgcagcgaaaauggcggguuccaggugggcgcgcaaggccgugguccugcuuugugccucugaccugcugcugcugcugc

SEQ ID NO: 2615 - RNA, 60 nt, Human
gcggcgggagagcggcggggccuagagcgugacucggccgcuacgcgcugcuucccccgc

SEQ ID NO: 2616 - RNA, 66 nt, Human
gcggcugcagaaguaccgccugcggaguaacugcaaagaugcuguccgugcgcgugcugcggccgu

SEQ ID NO: 2617 - RNA, 67 nt, Human
gcggcugcagaaguaccgccugcggaguaacugcaaagaugcuguccgugcgcguugcugcggccgu

SEQ ID NO: 2618 - RNA, 66 nt, Human
gcggcugcagaauaccgccugcggaguaacugcaaagaugcuguccgugcgcguugcugcggccgu

SEQ ID NO: 2619 - RNA, 67 nt, Human
gcggcugcaggaguaccgccugcggaguaacugcaaagaugcuguccgugcgcguugcugcggccgu

SEQ ID NO: 2620 - RNA, 63 nt, Human
gcgggacggacgguggacgcugggacgcguuuguagcuccggccccgccguuccgacccccgc

SEQ ID NO: 2621 - RNA, 76 nt, Human
gcgggacggacgguggacgcugggacgcguuuguagcuccggccccgccguuccgagcccccgccgccgucgccgc

SEQ ID NO: 2622 - RNA, 61 nt, Human
gcgggagagucuguguguaugugucuuccccggaauccacaacacagcacccuccuccugu

SEQ ID NO: 2623 - RNA, 80 nt, Human
gcgggagcugggggugugccuccaggagcugcugauggcugacgggcggcccgggacugguggaucucccggcugaccgu

SEQ ID NO: 2624 - RNA, 97 nt, Human
gcggggcggaggcacucgcgcggggggucauucggggucuggguucuggugccugcgcagcuuuccccgauggcccacugcgugaccuugguucagc

SEQ ID NO: 2625 - RNA, 88 nt, Human
gcgggggguuucacacgcgguuuugggugcgugucgccgccaagcgucugccgcgcgacacauucuccuaugccgcgcaucccuucgc

SEQ ID NO: 2626 - RNA, 68 nt, Human
gcggucccaagggcuggagcuguuugagaacaccucggcccccuaccagcuccagaccuuuguccugc

SEQ ID NO: 2627 - RNA, 73 nt, Human
gcggucucccgccuggcccacgcccaccaugcgcauccaccccuguggcggccgggccggguuggggggcugu

SEQ ID NO: 2628 - RNA, 89 nt, Human
gcgguggcugguucugcuacuuaauggcggcaagacugguuggcccugacuacgucugugaagcccgagaugcaggaagguguggccgc

SEQ ID NO: 2629 - RNA, 65 nt, Human
gcggugggagcagcagccaaguccgcgggaaaccgagcugcucgggccugcccugcaccccccgc

SEQ ID NO: 2630 - RNA, 84 nt, Human
gcguccggcugcggcugcagaaguaccgccugcggaguaacugcaaagaugcuguccgugcgcguugcugcggccgugguccgc

SEQ ID NO: 2631 - RNA, 88 nt, Human
gcgucgccgcgaugguguuguuggagagcgagcaguuccugacggagcugaccagacuuuuccagaagugccggacgucgggcagcgu

SEQ ID NO: 2632 - RNA, 85 nt, Human
gcgucucgcgacccaggcgcggguuuccggaggacagccaacaagcgaugcugccgccgccguuuccugauugguuguggguggc

SEQ ID NO: 2633 - RNA, 71 nt, Human
gcgugggcggaaucacuugagcccaggaguuugagaucagccugggcaauauagugagaccucgucuaugu

SEQ ID NO: 2634 - RNA, 82 nt, Human
gcguggugggaggcuggggcuggugccugcggacagcuccagauggaaucccaggccacggugcuucuaguauccccccagc

SEQ ID NO: 2635 - RNA, 80 nt, Human
gcguggugggaggcuggggcuggugcugcggacaguccagauggaaucccaggccacggugcuucuaguguccccccagc

SEQ ID NO: 2636 - RNA, 76 nt, Human
gcguguuggcuuggcuguugacauggaugaaauugaaaaguaccaagaaguggaagaagaccaagacccaucaugc

SEQ ID NO: 2637 - RNA, 60 nt, Human
gcuaaauggccggaccauggagauugagucuaccuuucacauguauguccagccuguagu

SEQ ID NO: 2638 - RNA, 86 nt, Human
gcuaacuagcagggaccccugcaaguguuaggucggggggaccucgagcugccugagcugacacgaggcggaggggucuguguagc

SEQ ID NO: 2639 - RNA, 85 nt, Human
gcuaaugagguggaacaacuuguugcggaagaggaauuuuuacaagaagcuagaguugcaucuucccaaguucuccauuucuggc

SEQ ID NO: 2640 - RNA, 73 nt, Human
gcuacagaaacagucauuauauaaauuagcaucuauauucagaaucugcuaucucauugauaucuuuugcagc

SEQ ID NO: 2641 - RNA, 85 nt, Human
gcuacgaggcugggaauccuggagaacccccaagaaccaagcgccuccagggucucuacacgaaagaccaggacccagcaaaagc

SEQ ID NO: 2642 - RNA, 79 nt, Human
gcuacuccaauggcugugggagacuuaauuccaauuccaggugauacagccgucagucucccacuagcuguaggauggu

SEQ ID NO: 2643 - RNA, 67 nt, Human
gcuagcauaaguuugagggugaugcacaggggcucacaccuguaaucccaaccuuugagauagcagc

SEQ ID NO: 2644 - RNA, 93 nt, Human
gcuagccacagggaaguugagaaaagagggaaacggggauaacagaagcuaaaaauguccugaguggccuggaagaagaccccugaggugggc

SEQ ID NO: 2645 - RNA, 65 nt, Human
gcuaggagcugccaaggccucuugagugugacaucacagguuagaggcccugcugagcugcuagc

SEQ ID NO: 2646 - RNA, 70 nt, Human
gcuaggcagccagaaaccugcggaaaaugguagcgauggcggcugggccgagugggugucuggugccggc

SEQ ID NO: 2647 - RNA, 85 nt, Human
gcuaggcugagaccuauggugguggcagggguggcuguugagccugaacuuccaguacuccugcccuuccuucuguuuaccuggc

SEQ ID NO: 2648 - RNA, 131 nt, Human
gcuagucacuggggcaaagaugacuaaaacacuuuuccugcccucgaggagcucacagucuaguaugucucauccccuacuagacugaagcuccuugaggacagggauggucauacucaccucgguguugc

SEQ ID NO: 2649 - RNA, 89 nt, Human
gcuaucaguucuugcuauucucagagcacucuaucauguuuuuagguguauauuguguauucaggauagcauuaaaaagaacugauggc

SEQ ID NO: 2650 - RNA, 85 nt, Human
gcuaucuggauuuuaaagugacugaagggagcuuugucuauaaggguggaaaaaucuacaagguuccuuccacugaagcagaagc

SEQ ID NO: 2651 - RNA, 107 nt, Human
gcuauugugacaaucuugguuaccauccauuaagugcugcugauuuuggaaagaucaugaaaaacgucuuuccaaacaugaaggcacgucguuugggcacaagaggc

SEQ ID NO: 2652 - RNA, 83 nt, Human
gcuauuuuugcuguuuggcagauggugaggggucacucuggcuguccucuggcuccuccuccugcagcggcagcuuggguggc

SEQ ID NO: 2653 - RNA, 81 nt, Human
gcucaaguauuuuuuuggugugcauucuagcuaauccacauagcuaaagugaaaaaacacugaaaagaucaaugccugagu

SEQ ID NO: 2654 - RNA, 110 nt, Human
gcucacaaaaccuagguggggaugaaagcugagaaagcgaagaggugguucaggggaucacucuuuccuacuuguuccucucaccucaaacucaccuucuacugcacagc

SEQ ID NO: 2655 - RNA, 73 nt, Human
gcucacaaucucugucaucggcugauccaaccguuccuugagcuuggcagcuggcaugaagaaggaauagagc

SEQ ID NO: 2656 - RNA, 100 nt, Human
gcucacugggcacaugcaccagguacaugcacuggguacccgugagacagaggcuacuugggggauacagggucaauguggcugaguagugccuuugggc

SEQ ID NO: 2657 - RNA, 71 nt, Human
gcucagaacuuguucacgaacgugacagagcuuacguuaagcagaggucaccgggcaacuaaguuccaugc

SEQ ID NO: 2658 - RNA, 61 nt, Human
gcucagagagauuaccuggacuuccuggacugacgaggaagaccagggaauuuaucagagc

SEQ ID NO: 2659 - RNA, 80 nt, Human
gcucagccuguaauucuggaauuucgggaggccgaggcaggaagauuccuugagcacaggaguuccagaccagccugggc

SEQ ID NO: 2660 - RNA, 87 nt, Human
gcucagcgcauggcucagcggauggggcacgacagcuagcaacaguuauugucuccagucuugucugcuguuucuaggcgcuugagu

SEQ ID NO: 2661 - RNA, 74 nt, Human
gcucagcuacacagggcgugaugaccggcacuuuguacccaugggccucuacaucgucaggcagugauaugagc

SEQ ID NO: 2662 - RNA, 108 nt, Human
gcucauccuuaguggaguuguuugacgauuuggagaagagcaagauuugaucuuaugaacauuaucacggaaucuuuuccagaguucugaacuuucauuaaugauggc

SEQ ID NO: 2663 - RNA, 71 nt, Human
gcucaucgccagggaccaauuggccauccuaggcagcgacuucgccuucagccagguccuccgccuugagc

SEQ ID NO: 2664 - RNA, 84 nt, Human
gcucauucaguucaaugcuguggaaaccgagccuguaggugacagcaucagcuacuggccugguaucagcagcugagccugagc

SEQ ID NO: 2665 - RNA, 60 nt, Human
gcucauugcucaaagguauuuauuacaguaucaggagccaauaccuugugagcaguuggu

SEQ ID NO: 2666 - RNA, 80 nt, Human
gcuccaaacagcgcaacaccacaaguaccccaccaucaugaaacaggaagacagaaccugugguuugcaaccccgggggc

SEQ ID NO: 2667 - RNA, 77 nt, Human
gcuccaacccgggaaagaggguaacucccggcggaggggucccacccggcugguaaacccaucaacccggagggagc

SEQ ID NO: 2668 - RNA, 75 nt, Human
gcuccagugaacuggcgaguguggaaccuccugacaccuucugaggaccuccugccugccauguugcuguggagc

SEQ ID NO: 2669 - RNA, 60 nt, Human
gcuccgccccucucuggguucaggcgauucucuugccucagccuuccgaguagcuggagc

SEQ ID NO: 2670 - RNA, 61 nt, Human
gcuccgcgugaauggggcuggaucuuaugccggcguacaagauuaggccucucaaaagagc

SEQ ID NO: 2671 - RNA, 100 nt, Human
gcuccggcaugugcaaagcugguuuugcuggggacgacgcuccccgagccguguuuccuuccaucgucgggcgccccagacaccaggcgucauggugggc

SEQ ID NO: 2672 - RNA, 75 nt, Human
gcuccugaaaaguacaucaagucuaaagugaaccagcuaacucauuaagacuggaaucaugagcaacaauggagc

SEQ ID NO: 2673 - RNA, 86 nt, Human
gcuccuggccuaggccaugucgagccguauggugccccggugucccgucgccgggacccggcaacccgcggcccuugggccagggc

SEQ ID NO: 2674 - RNA, 84 nt, Human
gcuccugggcugaagcgaucuuccugucuugaccuccuaaaguucugagauuacaggcaugagccacugcacccagcccacugc

SEQ ID NO: 2675 - RNA, 96 nt, Human
gcucgccaagucgcugggguuagguggggcaagaguuucgccggcgcaucagcgcugcuucggacuguuugcaacguguuccagcgagcugggagc

SEQ ID NO: 2676 - RNA, 86 nt, Human
gcucuccuuucugaucuaaaaacucaucuuugggguaaagaguuaaguguccaaagguugucacaguucaugaggucagagggagc

SEQ ID NO: 2677 - RNA, 60 nt, Human
gcucucgggggcaccuuccgggguuccuaagccgcggggccccucgcugccccucgaggc

SEQ ID NO: 2678 - RNA, 69 nt, Human
gcucugccaguagguuccaacuacuacaugguaauguggugaugguaccaaguuacuggaauccagagu

SEQ ID NO: 2679 - RNA, 61 nt, Human
gcucuggauuaccuugcaccuuaugccaaguauaaaguuuggauaaagccuggugcagagc

SEQ ID NO: 2680 - RNA, 84 nt, Human
gcugaaacggcugugggaggcugggcccugggacgcccucucauagcguccagcgauccagacaaauaggagagccgugacggc

SEQ ID NO: 2681 - RNA, 82 nt, Human
gcugaagccauuggugucugcuccgcugaucguccugaugcccgaggaccuguggaccguggaaaaugacaugauggucagc

SEQ ID NO: 2682 - RNA, 74 nt, Human
gcugaaggagagcaguuuguugaagaagccuuggaaaagucuccuugccaaacagauguccuccgcagugcagc

SEQ ID NO: 2683 - RNA, 86 nt, Human
gcugacacgauggagaagguaugugcaggggacuccuggagggggacgagguuuucagcacagccuucauguuccccgugcucagc

SEQ ID NO: 2684 - RNA, 82 nt, Human
gcugacaugugguuacuggguugccauagggaugagguagcagccagguuccugacaggugacagagacugccaaggugagc

SEQ ID NO: 2685 - RNA, 87 nt, Human
gcugacgagcgggucuggcucagagcagcguccacccucggcccucacaggccccgcugcccugccgccagggcuugagcuugcagu

SEQ ID NO: 2686 - RNA, 73 nt, Human
gcugagauguccucuauucuugaagagcguauucuuggagcugauaccucuguugaucuugaagaaacugggc

SEQ ID NO: 2687 - RNA, 65 nt, Human
gcugagcaggacgugcccuccacccugggacccaucucccagggucaccagcaugaaugcucggc

SEQ ID NO: 2688 - RNA, 70 nt, Human
gcugagccuuaaugggggcagaaaggggucauaaagaacccucuucagcuccacauucacggggcucugc

SEQ ID NO: 2689 - RNA, 77 nt, Human
gcugagcgacuucgaggggaagaagcccggguaacucagcugauccguggcuuugguaguuccuggaaaucaucagu

SEQ ID NO: 2690 - RNA, 76 nt, Human
gcugaguaucagugaacucaugagcgggacagguccauucacccugaaauuccuccuuggucacugccuucucagc

SEQ ID NO: 2691 - RNA, 74 nt, Human
gcugcaauccauggugaugucgcgucaugcaugcacugacuaugagugcccugcacuacugacaauggagcagc

SEQ ID NO: 2692 - RNA, 74 nt, Human
gcugcacuggugcaugaaggugaaguaaggaggcagcuacucccuccacaaauaagaauucgugcagcagcagu

SEQ ID NO: 2693 - RNA, 67 nt, Human
gcugcagagggagaaggacaggcagugucguggccuggagcucauugccucagagaacuucugcagc

SEQ ID NO: 2694 - RNA, 73 nt, Human
gcugccacacagagggcuugcuuccaguugccacaugugagaaaggcugagagagcuuucucgugggcaccgc

SEQ ID NO: 2695 - RNA, 79 nt, Human
gcugcccugucuugcguuccaguguuccagcuucugcgagaugacccucaaggcgagcgagggcgagagugggggcagc

SEQ ID NO: 2696 - RNA, 95 nt, Human
gcugccggacgcggugcuagucgccggaugaagugagggccucacccccacgcagccuuagcuuucucgggaggaccgagcaccuuggcggcagc

SEQ ID NO: 2697 - RNA, 83 nt, Human
gcugccucacggacacacuggagcagguauugggcccccuaagacugagguaaccgacugccuguugcuuugcugugugcagc

SEQ ID NO: 2698 - RNA, 78 nt, Human
gcugccuguaaucccagcuacucgggaagcugaggcaggagaauugcuugaaccugggagguggggauugcagucagc

SEQ ID NO: 2699 - RNA, 97 nt, Human
gcugccuuccuugagcuccccaggagucgguuuccacaucugugagguggagggcugguguggaggugcucauggggugcggugcuugggagacagc

SEQ ID NO: 2700 - RNA, 63 nt, Human
gcugcgcgccggcgccgugguggccguccccaccgauacgcuguacggccuggccugcgcggc

SEQ ID NO: 2701 - RNA, 74 nt, Human
gcugcggcgggagcucgacgaaucccuccaggucgcugagagguugaccaggaaauacaacgagcugcuaaagu

SEQ ID NO: 2702 - RNA, 72 nt, Human
gcugcggcugagaaguaccgccugcggaguaacugcaaagaugcuguccgugcgcguugcugcggccguggu

SEQ ID NO: 2703 - RNA, 91 nt, Human
gcugcuaucucaugagguaaaugcgugaucacauagccaagagaugccuuuuuguucuaaugaucacuguaagaccuucuugagagacagu

SEQ ID NO: 2704 - RNA, 74 nt, Human
gcugcugcugaagucaccugaaaacucaacuaagcuaaagagccuagauggguuacucagaugacuggcagugc

SEQ ID NO: 2705 - RNA, 82 nt, Human
gcugcugcugcuccccagcccaccagugccuggccagccugcccccuucccuggacagggcuguggagauggcuccggcggc

SEQ ID NO: 2706 - RNA, 61 nt, Human
gcugcugcugcugcuggccggggccgggcugucagccgccucgcccccagcagcgccgcgc

SEQ ID NO: 2707 - RNA, 68 nt, Human
gcugcuggggagcagagagggacccucuaucgcuggcuucagggggugccuugggucccuucaguagc

SEQ ID NO: 2708 - RNA, 80 nt, Human
gcugcugugaucccgacugcagcuccguggauuucagugucuuuucugccugcucaguuccaguugucacgggcgacagc

SEQ ID NO: 2709 - RNA, 76 nt, Human
gcugcuuccggagcaccugucuucauugccucucccuucugcagccugaaaggagggauguucaggacucugcagc

SEQ ID NO: 2710 - RNA, 81 nt, Human
gcugcuugagucaugcugaagagauaggcuucauagauuauauuuaagaaguugucaucauucugaaugagguacagcagu

SEQ ID NO: 2711 - RNA, 60 nt, Human
gcuggagauaaggagugggcccuggaagaugcucauucaggcccugcucaagauuccagu

SEQ ID NO: 2712 - RNA, 61 nt, Human
gcuggagaugcgcuuggggccgcgcuggaagggcgaggcccuggagcaggccaucaucagc

SEQ ID NO: 2713 - RNA, 71 nt, Human
gcuggaggaagaggagucgcagagaaacccaguccucugacugguuucuggugaggucucuauucaucagu

SEQ ID NO: 2714 - RNA, 76 nt, Human
gcuggaggacggccugaaccgggugcugggccugggccugggcugccugcgccucaccgaggccgacuaccugagc

SEQ ID NO: 2715 - RNA, 121 nt, Human
gcuggaggacugcuucaccuuccugggcaaucuuccuggccaucauccucuuccccuuuggguucauuugcuguuuugccuugaggaagcgacgaugccccaacuguggagccaccuucgc

SEQ ID NO: 2716 - RNA, 81 nt, Human
gcuggaguacaggaguucugggcuguagugcgcuauggcacaaucauagcucacugcagccucuaccuccugggcuccagc

SEQ ID NO: 2717 - RNA, 65 nt, Human
gcuggagugugaucuagcucacuguagccucaacguccauggcucaggugauucucacacucagc

SEQ ID NO: 2718 - RNA, 99 nt, Human
gcuggauauugcuaagaauucagguagucucgggaucuccagagucuccauacuaggacaggagaucuucagaaccuggaggaauggaaauagucuagu

SEQ ID NO: 2719 - RNA, 87 nt, Human
gcuggcccucacucccgcuaggaugaucacuuuucaugguuauugcuccauuuagggucucuagaaggcagguaguguggugccggc

SEQ ID NO: 2720 - RNA, 103 nt, Human
gcuggcggccuuggacggggcaguggcucccccggccugaggagugccgccccuuguggccacgcugcccagcaggccggcuccuucccucucgggcgccagc

SEQ ID NO: 2721 - RNA, 86 nt, Human
gcuggcgugccugggcagcacccucggggguagcagcuacuccagcugcuacagcuuuggcucuggugguggcuauggcacgcagc

SEQ ID NO: 2722 - RNA, 80 nt, Human
gcugggaccugcugagacucccccuggagcgggagcagaauggagacagccaccauucaggggacuggcgggggcccagc

SEQ ID NO: 2723 - RNA, 83 nt, Human
gcugggccuguuggucaggcauggaggagcuguguggucacuggccacuggcucucuucugcaccaccgccggcucugacagu

SEQ ID NO: 2724 - RNA, 85 nt, Human
gcugggcuugcgcuugcggccgguguacugggugucaggucugacuucccugcccuggcgccugugccgcuccuucuucuccagc

SEQ ID NO: 2725 - RNA, 62 nt, Human
gcuggggagagcccccucggggggcaucggucaagcugcugaacccccugcucaccgccagc

SEQ ID NO: 2726 - RNA, 60 nt, Human
gcuggggcaccaugcagagucagagaagggauuacacucugcaaauuuugugcucacagc

SEQ ID NO: 2727 - RNA, 88 nt, Human
gcugggugccaggggcaggggauccucaguauagccggugaacccugauaccaggagccugggccucccugaaccccuggcuuccagc

SEQ ID NO: 2728 - RNA, 84 nt, Human
gcuggucccaggaagauguccgucagccccuggagagcuggcucacggccgcugcuuccugcccagacuggauaccgggaccgc

SEQ ID NO: 2729 - RNA, 70 nt, Human
gcugguggggccaggaguggaacugcucuugacaccccgagagccagcccugcccuuggaaccagacagc

SEQ ID NO: 2730 - RNA, 60 nt, Human
gcugguguguaucggcccagggugacucaagacgucaaccugcugcugagccacgccggc

SEQ ID NO: 2731 - RNA, 72 nt, Human
gcugguuuccuggccgaggcggagcugcugaaccugaggaagaucagcuccgacuuuggacgggcacccggu

SEQ ID NO: 2732 - RNA, 82 nt, Human
gcugucgcccccaagcucgccccuggacacgcccuuccucccugccucacgggacucgccgcuggcgcagcuggcggacagc

SEQ ID NO: 2733 - RNA, 67 nt, Human
gcugucgcgccgcgcugcggggccaugauccggaacgggcgcggggcugcaggcggcgcagagcagc

SEQ ID NO: 2734 - RNA, 71 nt, Human
gcugucguuuuuuccuugacacuuguaggcuccucuucauguuuacauaaccucagugggaaaacgccagc

SEQ ID NO: 2735 - RNA, 104 nt, Human
gcugucuauuaugagucugacuggcacagacaucugucaaggaagaaggauucuuugagcguauuugugucagucaacugcauauauggaccacaacagaaagc

SEQ ID NO: 2736 - RNA, 79 nt, Human
gcugucugcuuguggauuucauuucugccuuuuagauuuuacuucuuucuuuggaggcagaaauugggcauaagacagu

SEQ ID NO: 2737 - RNA, 72 nt, Human
gcugucuuggaagacauggcucguccggacagacauggauugucuggacgauguggcuuuucuauggcaugu

SEQ ID NO: 2738 - RNA, 107 nt, Human
gcugugccagcgccgggccuuggaagccuuugaccuggauccugcacaguggggagucaauguccagcccuacuccggguccccagccaaccuggcgucuacacagc

SEQ ID NO: 2739 - RNA, 67 nt, Human
gcugugcggcucaaggagaagaagcuggugaaggaggucaucgccgucagcugugggccugcacagu

SEQ ID NO: 2740 - RNA, 82 nt, Human
gcuguggcuggauucaaguaauccaggauaggcuguuuccaucugugaggccuauucuugauuacuuguuucuggaggcagc

SEQ ID NO: 2741 - RNA, 87 nt, Human
gcugugguugcuguaagggguccucccugcgccacacggccgucgccauggugaagcugagcaaagaggccaagcagagacuacagc

SEQ ID NO: 2742 - RNA, 83 nt, Human
gcuguguugcccaggccggucacaaaaagaggggcuuuaucuaauguccucuguuuguauguauuugaagugggcgauaaagc

SEQ ID NO: 2743 - RNA, 106 nt, Human
gcuguuauaccgugugugucuguguuuuaaacauuguuuauuugagacagggucucacucugucaccaggcuacagugcagaggcacagucacagcucauugcagc

SEQ ID NO: 2744 - RNA, 80 nt, Human
gcuguuggcaagaaacggcuuuacuuacaaaacagacucuuuaccuucugcuguguuugaaguauguuuagucagcaugc

SEQ ID NO: 2745 - RNA, 85 nt, Human
gcuguuggugaguauggagaucucugcccuugucagaggaaggcuuccucaucacaaggcagggcaggugucugugcccaagagc

SEQ ID NO: 2746 - RNA, 71 nt, Human
gcuuaaaaugccagauguuguucgggggacaacuuguaucuuucuagcagcagaucuguaguuuguauagc

SEQ ID NO: 2747 - RNA, 81 nt, Human
gcuuaauuauuacgggcacugccuuggagcgauguuaaaaaacauugaugaugcaguucuuucaacagguauuuauugagc

SEQ ID NO: 2748 - RNA, 75 nt, Human
gcuuaauugcugauacauaugaaugaaaccuuggcugguauuaccuggcauucacugugcuaucggcaaugaugc

SEQ ID NO: 2749 - RNA, 72 nt, Human
gcuuaccaggaagcauuugaaauuaguaagaacagaaaugcagccuacacacccaauucgucuuggucuggc

SEQ ID NO: 2750 - RNA, 68 nt, Human
gcuuagauaagucuggguucuacucccaaagccucuaggcuaggcauggagcagcccaauuaucuagc

SEQ ID NO: 2751 - RNA, 83 nt, Human
gcuuauccccuguguccccgcuccuggccccuccagacccccgccuugccucgcgcugggaggggagauccagaaugaaaggc

SEQ ID NO: 2752 - RNA, 72 nt, Human
gcuuaucucuuuugguuccuuguuggaaaguugauuuugaaggcauccagcuugggaacccgggacaauagc

SEQ ID NO: 2753 - RNA, 75 nt, Human
gcuuauuuaaguguccacuuucuuuaucccauccuauucuuugugauaaaccagagggaucaggcuuaaccaagu

SEQ ID NO: 2754 - RNA, 73 nt, Human
gcuucauucauggcuguguuugagauaacuaaaguaaauuuuuuuucagguauuuggugucauguuuuggagu

SEQ ID NO: 2755 - RNA, 82 nt, Human
gcuuccccaaacagcuaggaugaaggcaacauauuccucacaggucauuugaucuugagguccuucaaggcugacuccaagc

SEQ ID NO: 2756 - RNA, 75 nt, Human
gcuuccccaugccucaguuugcucuggguuagcucagcagcagcacucaauauuccacagaagcaagggggaagc

SEQ ID NO: 2757 - RNA, 77 nt, Human
gcuucccugggagaaaguccuucccuccccauggcccagcccuggggaaagaaagcagagacuaacucagggacugc

SEQ ID NO: 2758 - RNA, 67 nt, Human
gcuuccuucgucuaccacucugugccagcuccaacagaccuggcaacuaauaggacuagaaggaggc

SEQ ID NO: 2759 - RNA, 87 nt, Human
gcuuccuugucuuuugccucauaucgucagguagcuaguuucgguucagcugcuccucccagacaguuugaugcaucucaauucagc

SEQ ID NO: 2760 - RNA, 81 nt, Human
gcuucgagucggccaccuuccuaggcuacuucaagucuggccugaaguacaagaaaggagguguggcaucaggauucaagc

SEQ ID NO: 2761 - RNA, 83 nt, Human
gcuucgccacugauuguccaaacgcaauucuuguacgagucugcggccaaccgagaauuguggcuggacaucuguggcugagc

SEQ ID NO: 2762 - RNA, 113 nt, Human
gcuucucugcuccccugggugaugggugggcccagaagguggcagucccacaccuuguccucccaccucccugaaacuguccauugcuuuuauagggugagguaagugacagc

SEQ ID NO: 2763 - RNA, 62 nt, Human
gcuucuguuugugcacaaguaacacgacgacugaaaucugcaacuacugcaaagacgcgggc

SEQ ID NO: 2764 - RNA, 89 nt, Human
gcuucuugcugaucagagcuugguuggcacagccgggguccucgcccucggcccugcuguucucccggaucgcucugauccagcccagc

SEQ ID NO: 2765 - RNA, 72 nt, Human
gcuugaacccaggagguggagguugcagugagcugagauccugccacugcacuccagucugggugacagagc

SEQ ID NO: 2766 - RNA, 72 nt, Human
gcuugaacccgggaaguggagguugcagugagcugagaucaugccacugcacuccagccugggugacagagu

SEQ ID NO: 2767 - RNA, 73 nt, Human
gcuugacuuuagacacagguuucaaaaguagaaaguuuuauucucuuauguuucuauggcuuugaaguuuugc

SEQ ID NO: 2768 - RNA, 71 nt, Human
gcuugauuugcuuggugaccgaauuacuaggugacuaguuuacuaacuaggucauucacggcaagucaagu

SEQ ID NO: 2769 - RNA, 71 nt, Human
gcuugcucaugauguacgcgcaguccaaaggcaucuacuacgugcaguggaggaugacaucgugggcaagc

SEQ ID NO: 2770 - RNA, 104 nt, Human
gcuugcuccacuggaggaggugcugggcagcguucuucugaggccagugcuggcuggguucaggucguaugccaggugccccugcagcucccccagggagaagu

SEQ ID NO: 2771 - RNA, 76 nt, Human
gcuuggaaaagaucaggaaugucccgcagggcuuugcggaugugguuucccgagcccugggcguccgucucugagc

SEQ ID NO: 2772 - RNA, 106 nt, Human
gcuuggagccucccccagagguguggcaggugcugaagacccaccccggagacccccgcuuccagugcagucucuuggcaucucuauccccuaugaggcaccacgu

SEQ ID NO: 2773 - RNA, 73 nt, Human
gcuuggaguucuaugauuuucucagguaccgacauuuacgagcacccguuagaaagagcgugggacccucagc

SEQ ID NO: 2774 - RNA, 83 nt, Human
gcuuggccaacauggugaaaccccaucucuacuaaaaauacaaaaauuagcugagcaugguggugcgcgccuguaauccaagc

SEQ ID NO: 2775 - RNA, 77 nt, Human
gcuuggccuaugacaggucaccguguguaaaucuuucccaauaaaguguugcacaaaggcauccuguccgugcaggu

SEQ ID NO: 2776 - RNA, 84 nt, Human
gcuuguaacuuuccaaagaauucuccuuuugggcuuucugguuuuauuuuaagcccaaaggugaauuuuuugggaaguuugagc

SEQ ID NO: 2777 - RNA, 77 nt, Human
gcuugucucucuauauugugaugaucugcugacuucuagccucuucaacuagacucuaagcuccuugagagacaugu

SEQ ID NO: 2778 - RNA, 74 nt, Human
gcuugucugcaacagccccaaacuggaaacaacccauauccaucaaguuuauccagcaggguggacaaauaagc

SEQ ID NO: 2779 - RNA, 81 nt, Human
gcuuguggagaaccuucaggcagagggagaguuggcuccuuaacaggggcuuguugaccucaguggaauguuguccaaagu

SEQ ID NO: 2780 - RNA, 67 nt, Human
gcuuguucuguucuaccagugucuugacaguuaaucaugaucuuugcacaguagaugcagaacuagu

SEQ ID NO: 2781 - RNA, 123 nt, Human
gcuuuaaauaauuggcuugagguuuuuuuggauaucagaggaaguaagucuuuuuauucuaccuagcaucuaguuuuugauagacaaguuuccuuauuauaccccucuucugguugguuuggc

SEQ ID NO: 2782 - RNA, 72 nt, Human
gcuuucaccagcuuuacccaaacgccuuuugucuuccgaagucaccugugugaaggggacaguggugcaagu

SEQ ID NO: 2783 - RNA, 73 nt, Human
gcuuucccucuccuuuauaaauugcauauauuuuuaacauauauuaacacuuuaaaaccgugggguggaaagu

SEQ ID NO: 2784 - RNA, 78 nt, Human
gcuuugccugcauggauggacaagaguuccgcuucgcacagcuguguggucuucacaucgucauucaugcagaugagc

SEQ ID NO: 2785 - RNA, 60 nt, Human
gcuuuggucucugcuggacagcccuugggggagcagggaguccagcagggccaguccugc

SEQ ID NO: 2786 - RNA, 61 nt, Human
gcuuuguuaaaugugcaucauuucacucuuuugauugaaugauugccggaaagugcaaggc

SEQ ID NO: 2787 - RNA, 83 nt, Human
gcuuuucuuucauaucugaaaccuagcugcuuacuuggcuuuucaauuucaguaguuaggauucugauuuugucuacucuagc

SEQ ID NO: 2788 - RNA, 103 nt, Human
gcuuuuugggguuuuuuaagaggugaagucuugcucugucacccaggcuggagugcagccacaugagcucaagagauccucccucuucagccuccaaagcagc

SEQ ID NO: 2789 - RNA, 89 nt, Human
ggaaaaaaacuuuaauuggcgccaaaaaacagaaugaaaugggcuuggccuuauauuguguuuuuugcguuggucugggguuuucuucu

SEQ ID NO: 2790 - RNA, 71 nt, Human
ggaaaaaacgccggagaaauuugggguuggaaaccccuguuuuuggccccgcaacuccuugaccuaaaucc

SEQ ID NO: 2791 - RNA, 70 nt, Human
ggaaaacggcaaaauuguguacguugauguaccgccgagaggugggacuuugaccugcaauuagguuucc

SEQ ID NO: 2792 - RNA, 70 nt, Human
ggaaaaugggagaugauuaagaguugguguggccuagucacaccaaaauguauuuauuacauccugcucc

SEQ ID NO: 2793 - RNA, 85 nt, Human
ggaaacagggaaagguuuuuuugcguguagggguugugcaaacccuaaugcauaacggagcaugaaaagacuuuccccuguugcc

SEQ ID NO: 2794 - RNA, 63 nt, Human
ggaaaccccacguguccuuuccuaaccaggaagcccguccucuaaggagggggcauggguccc

SEQ ID NO: 2795 - RNA, 77 nt, Human
ggaaacuggggccuucuuugaguacuagugaguaagacauuuugcaacagugcugaguaugaaaggcccuggucucu

SEQ ID NO: 2796 - RNA, 69 nt, Human
ggaaagagguugugagcugauuggauuaaagaccuggcacuucaguaacucagcacgcuuccacuucac

SEQ ID NO: 2797 - RNA, 75 nt, Human
ggaaaggcuucguucugccaaacagagacuccaaguguugccagucuccaaaaauucggagaaaagagccuuucc

SEQ ID NO: 2798 - RNA, 85 nt, Human
ggaaagguccagagcuguggagaaagaaggggcucccugucuccaggguuuguuuaagguuuucuccauggccuagggcccagcc

SEQ ID NO: 2799 - RNA, 87 nt, Human
ggaaaugguuauugaaucagauagaccaguucuguugagggucuuaaagagucucaauuuucucaucuauaaaaccaauaccuuucc

SEQ ID NO: 2800 - RNA, 62 nt, Human
ggaaauuacacugaggcggugagacgaugggagaacguccgugucucuagcccggugggucc

SEQ ID NO: 2801 - RNA, 65 nt, Human
ggaacaccauaggaguugccaucagagauaacacccauggacacaaacucucccucugggguucc

SEQ ID NO: 2802 - RNA, 72 nt, Human
ggaacagggagggccugugucuggccaggcugagguuccagaucuguugccaucauggccccuucagggucc

SEQ ID NO: 2803 - RNA, 107 nt, Human
ggaacagguccuuuaccucuuaccauguuuuagacuaguugguugguugguugguuugguuuugauugguuaguuaguugguuuguggguagugguuugugcugucc

SEQ ID NO: 2804 - RNA, 79 nt, Human
ggaacauacuugccuggagauagccuuugcgauauuuaaauguccguggauacagaaaucucugcaggcaaguugcucc

SEQ ID NO: 2805 - RNA, 130 nt, Human
ggaacucagauaaucaucccuuuccagaaaguucugagcagccugggagcagcagggaaggagaagucagcucuauuccaggggcuccacagaacuaaugagguuggggagggaagcuuaaaagauagcc

SEQ ID NO: 2806 - RNA, 129 nt, Human
ggaacuccaaauauauguauacuagacuacuugauauuguuuaaaggccauggaggcgguuccuuuuuucucccuggucuuuuuuccucucugugcuucaguguggguaguuucuguugcugugucucc

SEQ ID NO: 2807 - RNA, 86 nt, Human
ggaagacgagugcuccgggacugcauacacucauggugccgaugucucugucucguggcacguagugguaagcggcauuugguucc

SEQ ID NO: 2808 - RNA, 108 nt, Human
ggaagacuugaagagguuaucacgacauuuaaggaaucugauccucagaacuucucugggacaauuucaguucuaauaaugucuuaaauuuuauuccaguccuguucu

SEQ ID NO: 2809 - RNA, 73 nt, Human
ggaagagauaugcaacuggcuaguccucgcguccuugcaauguacaaguggagcuucagaagcaaucucuucc

SEQ ID NO: 2810 - RNA, 76 nt, Human
ggaagagugccucagggcagcggaaccggcucauugcaauggugauggacuggccgucagagcucguaacucuucu

SEQ ID NO: 2811 - RNA, 103 nt, Human
ggaagcaaagguggcacauugauuauaacacacagcugaggucucgaucacacuagaugucuccagucagucguguggaaaucgaugugcuucagaacagucu

SEQ ID NO: 2812 - RNA, 73 nt, Human
ggaagcauucagcagcuggacgcugagcugaggaacaccaagugggagauggccgcccagcugcgagaauacc

SEQ ID NO: 2813 - RNA, 87 nt, Human
ggaagccaagacaugcugggcuuaaacuacccaugagaugcacuucucuggugacaguuuaccuggugauaugguuuggcuguaucc

SEQ ID NO: 2814 - RNA, 65 nt, Human
ggaagccaugaagcagucuucuugccgugaaugggguaaauauggacugcgcauucauggguucc

SEQ ID NO: 2815 - RNA, 130 nt, Human
ggaagccuucccuuaccucagccugguugagggcccccugggcuguuuucacugguugaugguaucugaucccuuccagccugagguuccuggagggccaguccaggucugaggucugguucaugcuucc

SEQ ID NO: 2816 - RNA, 67 nt, Human
ggaagcgagcgagcgcuucgcugccggcuacauccagugcaugcacgaggugcacacguucgugucc

SEQ ID NO: 2817 - RNA, 97 nt, Human
ggaagcugggaggacgcagauccuucggaccggggggcgacccuuuuuaggcugugacucggggguggccccaggcccgggauagcccccagauucc

SEQ ID NO: 2818 - RNA, 87 nt, Human
ggaaggagccagaauggaggcccaggcugggagguguccgugcuggagccaguuuugagccaagccucaggaagcuggcugccuucu

SEQ ID NO: 2819 - RNA, 94 nt, Human
ggaaggauuggagagccacuugaggucauauguuaagguauguaaaacacacuguucugaucacuuacaucuguggcucuccaguuuuccuucu

SEQ ID NO: 2820 - RNA, 94 nt, Human
ggaaggauuggagagccacuugaggucauguguuaagguauguaaaacacacuguucugaucacuuacaucuguggcucuccaguuuuccuucu

SEQ ID NO: 2821 - RNA, 73 nt, Human
ggaagggcagcuuggcagagccucaggauggacccccuuggggacacgcugcggcgacugcgggaggccuucc

SEQ ID NO: 2822 - RNA, 73 nt, Human
ggaaggucacgugcgacaaaaguucuggaggccuuuugaaaggcacaccgagcaugugguucgcaccacuucu

SEQ ID NO: 2823 - RNA, 102 nt, Human
ggaagguucaacacgaauugugcaaaaucucuggauauauuaguuuagcgauaugguuguugaagaaaauaauauguuuuaagcauucacaacgugaccucc

SEQ ID NO: 2824 - RNA, 72 nt, Human
ggaaguccagugucaaggugccauuagguuuggugauucugauuccaggauggcaccuugaacgcugcgucc

SEQ ID NO: 2825 - RNA, 80 nt, Human
ggaagucucaaccuggagaagaugcuauacaaugcaagaggugaacucugccuuaguaaaauccagcuggugggauauuc

SEQ ID NO: 2826 - RNA, 86 nt, Human
ggaagucugauuaguugcugggauggucccauccaugaagcacuggacacaugcugggaaccaucugugcauaaaucagaagagcc

SEQ ID NO: 2827 - RNA, 90 nt, Human
ggaagugaccugcaggagagcauacuuggcaaggaugagaauaccugugugauaaacacagcaucugcacauauuuccugcuugauuucc

SEQ ID NO: 2828 - RNA, 79 nt, Human
ggaauaaaccugagaaaggauaguggcucuagagaaacaguaauagcaccuuucuagcaccuuugauuuuucucagucc

SEQ ID NO: 2829 - RNA, 64 nt, Human
ggaauacaucaauggggacaaguauuuccagcagauuuuugauuguccccggcugaaguuuucu

SEQ ID NO: 2830 - RNA, 98 nt, Human
ggaauauaaagaucuuguuucuucauauuucaaacaccaaauaguauuagucuacuacuaauaguguuagaacaccagauacaaagcuaaaauauucc

SEQ ID NO: 2831 - RNA, 79 nt, Human
ggaauaucugauccaugauuucaccuuaaugguagaaguaccugcuauuuuugguaaugaucuucaggcagauuuggcc

SEQ ID NO: 2832 - RNA, 96 nt, Human
ggaaucugcacauacuuaucuaauacuguguuuucugaauuaugcucacaagaugcuaagauggaaaagaacaugagugguagugcagcugguucc

SEQ ID NO: 2833 - RNA, 83 nt, Human
ggaaucuggcaggaagcauccagggcccagccucugucaggccuggcuuggccugggggccccagcugcuucuuccauugucu

SEQ ID NO: 2834 - RNA, 83 nt, Human
ggaaugaggucugaacuccacugaauuaaaccacuggcauuugggggcuguguauuauagcagugcaaagaguuccuuuaucc

SEQ ID NO: 2835 - RNA, 85 nt, Human
ggaaugcugcaaaaauacucuaguucaacaaagaguuaugaucacaaaauaauuuuuauccauucuacaguguuucagaauuacc

SEQ ID NO: 2836 - RNA, 76 nt, Human
ggaaugguauuagucaaacauggugccagugucuuuuacaaaaacagauggcauagugucagauguaccuuacucu

SEQ ID NO: 2837 - RNA, 103 nt, Human
ggaauuuuggguuauacuacgauucuggacugaaaugguaugcagguaugacuuaaaagccauagguauacugggcaccauuugagcacguauagccacuucc

SEQ ID NO: 2838 - RNA, 95 nt, Human
ggacaagcugauuuccugaggcaucgaugaggcucauggcacuggcaugggagagguuggugcaagagaccccauugauugccaagagcuggucc

SEQ ID NO: 2839 - RNA, 83 nt, Human
ggacaaggaccaggaccugaucaccaucauuggaaaggaggacgccguccgagaggcacagaaggagcuggaggccuugaucc

SEQ ID NO: 2840 - RNA, 75 nt, Human
ggacacccgggccuccggcccuggcagucagaugugcucacccuggucggccaacaccgccggacccgggcgucc

SEQ ID NO: 2841 - RNA, 60 nt, Human
ggacaggaacacugaccccugaagucgagccugggggucuaacauaguggucauuugucc

SEQ ID NO: 2842 - RNA, 69 nt, Human
ggacaggcucugcccaggaagagcugccgccuccuggcacagcaaacguuccaggccugggcccuguuc

SEQ ID NO: 2843 - RNA, 86 nt, Human
ggacaguuuggcuggacauaguaugucuuauuuggcaguuuguccccuucugcacugugaauauauuaugucagucccuucuggcc

SEQ ID NO: 2844 - RNA, 128 nt, Human
ggacaucaaagaauaaauaagcugcucuaauugccaagaauucacaugugguuguaugcagcuuuacugggagacugaaguguaucugcaugugauucugcugugauggacacuuguaaguuugugcc

SEQ ID NO: 2845 - RNA, 94 nt, Human
ggacauccaccucuucccugcucgucacugaacggagcuugaugaccccauccuugaguuccugcucgccgaugauagccaccagugggaugcc

SEQ ID NO: 2846 - RNA, 93 nt, Human
ggacauguagagugcuuuuguagugagcuaaccuugaucucuaaggacuaacuacccagguccaggucuucacuagggguacugacaguguuu

SEQ ID NO: 2847 - RNA, 68 nt, Human
ggacauuugguggcugaggagagcgcgucacugcuauugaauagcuccauuuaacaccagccaugucu

SEQ ID NO: 2848 - RNA, 77 nt, Human
ggaccacagguguaggccaccaugucuggcugauuuuuuaauuuuuuuguagucaugggggucucacuauguugucc

SEQ ID NO: 2849 - RNA, 85 nt, Human
ggacccccaucucugugacuuccuggagcaccucacuuccuagcaugaggaacgugaagcuuuaucacagaagcauggggugacc

SEQ ID NO: 2850 - RNA, 76 nt, Human
ggacccgggggacuggggaggcucuggccggcguaguccuugccgccagccuucacagcggguucucugagggucu

SEQ ID NO: 2851 - RNA, 114 nt, Human
ggacccuuucaccuccccuuucuaacuguaccugggaggagcuuaggcucucuucuuauggaccaacugauguucacucagguaggaugaaauggggugcaagaaauuagguuc

SEQ ID NO: 2852 - RNA, 77 nt, Human
ggaccucagguggcugaaggagacgaauguauuuggugucugccauaucuuugcauccuucaaugacacuuuugucc

SEQ ID NO: 2853 - RNA, 104 nt, Human
ggaccugcagcugucgcgcgaggggucugggagauggggccacuggauccagcauccucuccguacuccaggaccucuucucugucaccuggcucaauaggucc

SEQ ID NO: 2854 - RNA, 64 nt, Human
ggaccugucaccccaccauggagaaaagagucuuuugguucuuuuuaacauaagugauuaguuu

SEQ ID NO: 2855 - RNA, 95 nt, Human
ggacgauucugcagaggcauuaagauaacgcuguccagauacauacucucccgugugcaucugggauccuggguccugaggccuuucaggagucc

SEQ ID NO: 2856 - RNA, 79 nt, Human
ggacgauugcaugguuauuucuugaauauuugacuugauccccaugaaggucaauauuuuaaaugugaugcaguuguuu

SEQ ID NO: 2857 - RNA, 79 nt, Human
ggacuccacuuacgacuauuaugaggcaaacaucugccugugcaguuugucuuuccauccagucuauucuuuggggucc

SEQ ID NO: 2858 - RNA, 91 nt, Human
ggacuccagcccgccccagaagccgagguuucuccugagcgaggugagcaccuguaccuggagguuggagacaggggcagggcuggcagcc

SEQ ID NO: 2859 - RNA, 78 nt, Human
ggacucggcccccugccagcccccgaagcauugcagccaggagugcagcgugggggcccugcaggccauggccaggcc

SEQ ID NO: 2860 - RNA, 98 nt, Human
ggacucgguccccgagcugcgcuggcugcccgugcugcggcacuacgacuuggacuuggugcgcgccgcgauggcgcaagucaucggggacagagucc

SEQ ID NO: 2861 - RNA, 85 nt, Human
ggacucuauagaggggcacgccggggcuauuuaggacuaucaguuggcgaauuuuccuggggacucccuuuuaguacuggagucc

SEQ ID NO: 2862 - RNA, 95 nt, Human
ggacugaaagagaacugggauggaggagaauuagaggauggugugguguuucccaagacauccccugaucuugcuaucccagcaucuccuagacc

SEQ ID NO: 2863 - RNA, 60 nt, Human
ggacuguucuacucagccucuguggaagaaaacuucccacagggcugcacuagcacagcc

SEQ ID NO: 2864 - RNA, 79 nt, Human
ggacuuccagaguucaguuccuucuggcagagagguaucuuucuccaugccauauggaugugacucaaaugaggggucc

SEQ ID NO: 2865 - RNA, 67 nt, Human
ggacuugcagagagaguuuucuacuggaauguaagagguuuugaaggcucucuuuucugcaaaggcc

SEQ ID NO: 2866 - RNA, 106 nt, Human
ggacuuuuucucugcccuucgucauuaugcagccugugaacagcgucugggaaagucguggucauugguugcauaauuccauuugaggcuuauggaggaaaggacc

SEQ ID NO: 2867 - RNA, 61 nt, Human
ggagaaaaaguccuacuuuucuggguccccaggugcagcaccucccagagacuguuucucc

SEQ ID NO: 2868 - RNA, 106 nt, Human
ggagaaacagacaggaggggggaaggaaccaaacuguuuucuaaggaucgguugucugcaugaagaaauuucgguuucccuccaaccgcccccuccucgauucucc

SEQ ID NO: 2869 - RNA, 79 nt, Human
ggagaaaggcugagcuuggagaaaaggugcuugaggaccccacugccuaaggaccugcucuaggaaacauucccacucc

SEQ ID NO: 2870 - RNA, 74 nt, Human
ggagaagaucaccucuucucacagcacacaaauuuuauguuugucucauugcaguguagaagguauucuguucc

SEQ ID NO: 2871 - RNA, 88 nt, Human
ggagaaucacuugaacccaggagguggagguugcagugagccaagaucaugcuacuguacuccagucugggcaacagagugagacucc

SEQ ID NO: 2872 - RNA, 88 nt, Human
ggagaaucacuugaacccgggaggcaaagguugcagugagcugagaucgugccacuguacugcagccugggagacagagugagacucc

SEQ ID NO: 2873 - RNA, 91 nt, Human
ggagaaucacuugaaccugggaggcagagguuguugcagugagccgagauugcaccacugcacuccagccugggugacagagugagacucc

SEQ ID NO: 2874 - RNA, 91 nt, Human
ggagaaucacuugagcccaggaggcggagguugcagugggagccaagauaacgccauugcacuccagccugggcgacaagagugagacucu

SEQ ID NO: 2875 - RNA, 88 nt, Human
ggagaaucacuuuaaccagagaguuggagguugcagggagccgagaucgcaccacugcacuccagccugggugacaaagcgagacucc

SEQ ID NO: 2876 - RNA, 89 nt, Human
ggagaaucauuugaacccaggagguggaaguugcagugagcucagaucgcaccauugcacuccagccuggguaacaagaaugaaacucc

SEQ ID NO: 2877 - RNA, 88 nt, Human
ggagaaucgcuugaaccaggagguggagguugcagugagccaagaucaagccauugcacuccagccuggucaacaagggcgaaacucc

SEQ ID NO: 2878 - RNA, 88 nt, Human
ggagaaucgcuugaacccgggaggcagaggcagcagugagcugagaucacaccacugcacuccagccugggcaacaaugugaaacucc

SEQ ID NO: 2879 - RNA, 112 nt, Human
ggagaaugacacagaucaaagagcuuuuuccaagccaguauuuuccaaaccgcggguuauaaucucuagcgcauugugaaauugguuugguagaucgggaucaucacccucc

SEQ ID NO: 2880 - RNA, 88 nt, Human
ggagaauggcaugaacccgggagguggagcuugcagugagcagagaucacgccacugcacuccagccugggcaacagagcgagacucc

SEQ ID NO: 2881 - RNA, 89 nt, Human
ggagaaugggccugaacccgggaggcggacguugcagugagccgagauugcaccacugcacuccagccugggcaacagagcgagacucc

SEQ ID NO: 2882 - RNA, 88 nt, Human
ggagaauugcuugaacccaagagguggagguugcagugagccacgauugugccauugcacuccagccugggugacagagugagacucc

SEQ ID NO: 2883 - RNA, 89 nt, Human
ggagaauugcuugaacccggguggcggagguuguggugagugaagauugcacuauugcacuccagccugggcaacaagagugaaacucc

SEQ ID NO: 2884 - RNA, 88 nt, Human
ggagaauugcuugaacccuggagguggagguugcagugagccaagauugcgccauugcacuccagccugggugaagaagugagacucc

SEQ ID NO: 2885 - RNA, 89 nt, Human
ggagaauugcuugaaccugggaggcagaaguugcagugagcugagaucaugccauugcacucuagccugggcaacaagagcaaaacucc

SEQ ID NO: 2886 - RNA, 88 nt, Human
ggagaauugcuugacccgggaggcggagguugcagugagccaagauugcgccauugcacuccacccugggcaacaacagcgaaacucc

SEQ ID NO: 2887 - RNA, 88 nt, Human
ggagaauuucuugaacccaggagguggagguugcagugagccgagauugcgccacugcacuccagccugggcaacagaacaagacucc

SEQ ID NO: 2888 - RNA, 60 nt, Human
ggagacaaauaucuggggccugcaguucuuaugcaggccuaucgcuggaugauugacucc

SEQ ID NO: 2889 - RNA, 112 nt, Human
ggagacaugauguagcagaugaugggacugucuuacauaacuggaucuuuuagaacuaucgaagauuaaguaguaaaaugguauaaaaaguuucuugacaauguuauuuucc

SEQ ID NO: 2890 - RNA, 82 nt, Human
ggagacauggagugggaggucagcaguggugauggauucuggagauacuggaucaccaugagcagagcucucauuucucucc

SEQ ID NO: 2891 - RNA, 83 nt, Human
ggagagaggguguagagucaugccaguucuuaggugcuccugacaaggagaucugcagcacucugcucacauuccuguuuucc

SEQ ID NO: 2892 - RNA, 76 nt, Human
ggagagcagugucccaggccugaugcccacuccucauuccuaagggagggugcuuucuccugggucuccugugucc

SEQ ID NO: 2893 - RNA, 78 nt, Human
ggagagcauuuguauguuauggugaaugccaaauuugaaguggaggcaauguucacugcaaugugcgaaugccaggcc

SEQ ID NO: 2894 - RNA, 85 nt, Human
ggagaggucaagagacugagcagaccaugguguuaguucuguugaaaagaacucaggucuucugagcucaaucucuggucucucc

SEQ ID NO: 2895 - RNA, 76 nt, Human
ggagaggugaugagcccagacaaggcaggguguuagguuuaacugguuugcccucaucagguuuucgcaucuuuuu

SEQ ID NO: 2896 - RNA, 78 nt, Human
ggagagguggaugccuggcccggccagcgagagcgggccaccgccauccugcuggccugccgccaccugccccucucc

SEQ ID NO: 2897 - RNA, 88 nt, Human
ggagaguugcuugaauccaggaaguggagauugcaguaagcaaagaucgugccacugcacuccagccugggugacacagcaagacucc

SEQ ID NO: 2898 - RNA, 71 nt, Human
ggagaugggagaaaaaagauaccagggauaauuaaaauccacagcaguuucaucaguuuccucauccaucc

SEQ ID NO: 2899 - RNA, 73 nt, Human
ggagcaccugccagaugccagccagagcucuccuguaugaggugucugucggccccaucugggaggugucucc

SEQ ID NO: 2900 - RNA, 68 nt, Human
ggagcagagugaaggcaagaugacugacauguggaauugagguccuagcucugcuacuuacucacucc

SEQ ID NO: 2901 - RNA, 72 nt, Human
ggagcagggccugacugcgcaggauucacagauuaaucucuugagguccuggaugccucaucccuuaguuuc

SEQ ID NO: 2902 - RNA, 111 nt, Human
ggagcauucuugucccucuauccucacagagaagcagaggcuucucuccccaagaucuuggggugaggcugggccaugugcugggguugugaggaugagucaaggaggccc

SEQ ID NO: 2903 - RNA, 74 nt, Human
ggagccacagcagcagccgccgggguuucagugccagcucagccaggcucccuggggucagccgcucuggcuuc

SEQ ID NO: 2904 - RNA, 88 nt, Human
ggagcccagaugaacuuaaagaagcgagcaugggauucuuaguuuuucaagauccguacacacgaagccuuuaaucagcaucaacucc

SEQ ID NO: 2905 - RNA, 78 nt, Human
ggagccgggaagaugccaaggcugggcuaugggaugagggcgaaaugaccgggaccagcaaggagcucccagggcacc

SEQ ID NO: 2906 - RNA, 73 nt, Human
ggagccugagagguggaggaguucugaucccccguuacuuccuagcauuuucuccucuugccuuaaaaguucc

SEQ ID NO: 2907 - RNA, 75 nt, Human
ggagcgcccuuugggguuggaagcaccccccgacagucggugggagggugauauggcgaccuauuuugggcgccc

SEQ ID NO: 2908 - RNA, 68 nt, Human
ggagcuggcccugggcagcaacaagcugggugaugugggcauggcggagcugugcccagggcugcucc

SEQ ID NO: 2909 - RNA, 73 nt, Human
ggagcuguccugugucagccugaaauaaucaaaaggaucaaaaauccuguuuuaggcaacauaggaagacucc

SEQ ID NO: 2910 - RNA, 92 nt, Human
ggagcuuugacaaggacccacugucuggccccaucuucagagauuccaauaggucuggggugugcacaggcacuggcgucuuuaaaaucucc

SEQ ID NO: 2911 - RNA, 74 nt, Human
ggaggaaugcuggacuggaggccccuggagccagauggcaagagggugacagcuuccuuuccuguguguacucu

SEQ ID NO: 2912 - RNA, 103 nt, Human
ggaggaccuggccaaaguggguggugcagggguggucuuaggagggcuuuccugaaggaguggccaggguucacccaucuuuccacccacggacccauccucu

SEQ ID NO: 2913 - RNA, 79 nt, Human
ggaggagacaagcaagcugucauguuauaagcagcccuuugagggguccaugugaugucaaggaaugaagucucuagcc

SEQ ID NO: 2914 - RNA, 73 nt, Human
ggaggagacucuucuguuaccaccaagccaggaaguuucauggcuugggaagaccaagaggaaguccaccucc

SEQ ID NO: 2915 - RNA, 78 nt, Human
ggaggagaggcugguggucuugagcuuuuggccuggaauuccagucugaauuuucaaauauucccugccuccaacccc

SEQ ID NO: 2916 - RNA, 72 nt, Human
ggaggagcagcugacucagggguggaggagccuaggaaugccucucuccaggcccaagucgugcucuccuuc

SEQ ID NO: 2917 - RNA, 94 nt, Human
ggaggagcgugcggaggaccagcaggaggaggaggcggcggcgccgcgcguaccuggacgagcugccgagccgcugcugcugcgcgugcuggcc

SEQ ID NO: 2918 - RNA, 92 nt, Human
ggaggaucgcuugagcccaggaggcggagguugcagugagcugagauggcaccacuuauugcacuccagcccgggcgacagagcgagacucc

SEQ ID NO: 2919 - RNA, 87 nt, Human
ggaggaugcaaucuuauugugucuuugaauaaguacccaggcuaguauggggacuuguguaacacagaaagaacaucugcaaccuuc

SEQ ID NO: 2920 - RNA, 73 nt, Human
ggaggcagugcuggggcuugcgcccucgggggaccccccuucaucccucgagcagucggguccggcguccucc

SEQ ID NO: 2921 - RNA, 72 nt, Human
ggaggcggggcagacgggcugcaagagggagccggcccgacgcggaccgcuucccugcagugccccgagucc

SEQ ID NO: 2922 - RNA, 70 nt, Human
ggaggcucucuguguugcccaagcuggacuugaacucuugggcuccagcaguccucccacaugagccucc

SEQ ID NO: 2923 - RNA, 83 nt, Human
ggaggcugggaggccgcccccagccgcugcuacccacgcagagccgggcuggcuucgcgggggcggcgggcggcccgagcccc

SEQ ID NO: 2924 - RNA, 75 nt, Human
ggaggcuguucugugcauuguuggauuuuuagcagcgucccugaccucaguccaauagaugccaguaacaacucc

SEQ ID NO: 2925 - RNA, 69 nt, Human
ggagggacuuccagcuccuagucguguggguugcaggccguccugucccagggcugggggacuuccuuc

SEQ ID NO: 2926 - RNA, 92 nt, Human
ggagggccagugacccagcccaggcugcugaccguccugcuccaggcuagaguccagagguucaagagccugggcuguguccauaccccacc

SEQ ID NO: 2927 - RNA, 93 nt, Human
ggaggggaaggggcuagcagguguguaaacagaggguuccaucaggcuggggcagguggccgccuuccgcacacuugaggaacccuccccucu

SEQ ID NO: 2928 - RNA, 81 nt, Human
ggagggggaugaugguacugagagaguaugugucccagagcuugucaggacacaguggcagaauugcucucauccucuucu

SEQ ID NO: 2929 - RNA, 78 nt, Human
ggagguccccuuagaggaaauccuggaccugcagugggugggcucagggcccaggugcugucuuccuggggcgcuucc

SEQ ID NO: 2930 - RNA, 80 nt, Human
ggaggucuuguguaucuguggcaaacagggaguucccuuaaucacucuuuauuugcugcgguuaaagcuggccaaccucc

SEQ ID NO: 2931 - RNA, 77 nt, Human
ggagguggcagguguaggaucaucuggugagcaaguagagucaccaagucuggaugaccacuacccccacuaccccc

SEQ ID NO: 2932 - RNA, 74 nt, Human
ggagucaaaaggcccagagucugagucccagcccugagcacuuaggagccuucugacuuaggguuugucacucc

SEQ ID NO: 2933 - RNA, 87 nt, Human
ggagucuaugaacuggccacuuuucagaugaaaccuggugggccagcucuguggggugaugcauuuaaaagggcaguucaaugcuuc

SEQ ID NO: 2934 - RNA, 87 nt, Human
ggagucucacucugucacccaggcuggagugcaguggcacgaucucggcucacugcaaacucugccuccugguucaagcgauucucc

SEQ ID NO: 2935 - RNA, 87 nt, Human
ggagucucacucuguugcccaggcuggggugcaguggucuagucuuggcucacugcaaccucugccuccugguucaagcgauucucc

SEQ ID NO: 2936 - RNA, 86 nt, Human
ggagucucacugucacccaggcuggaguguagugcugcgauccugacucgcugcaaccuccaccucuggaguucaggugauucucc

SEQ ID NO: 2937 - RNA, 88 nt, Human
ggagucucccucugucgcccaggcuggagugcaguggugugaucucgguucacugcaaccucugccucccggguuccagugauucucc

SEQ ID NO: 2938 - RNA, 88 nt, Human
ggagucucgcucugucacccaggcuggagugcagugguaagaucucugcucacugcaagcucugccucccggguucacgccauucucc

SEQ ID NO: 2939 - RNA, 87 nt, Human
ggagucucgcucugucacccaggcuggagugcaguggugcgaucuuggcucacugcaaccuccaccuuuguguucaagcaauucucc

SEQ ID NO: 2940 - RNA, 88 nt, Human
ggagucucgcucugucacccaggcuggagugcaguggugugauuucagcucacugcaaucucugccugccggguucaagcgauucuuc

SEQ ID NO: 2941 - RNA, 91 nt, Human
ggagucucgcucuguccuccaggcuggaggagugcaguggcacgaucucagcucacugcaaccuccgccucccagcuucaagcgauucuuc

SEQ ID NO: 2942 - RNA, 101 nt, Human
ggagucuuaaacgugguagcucugugcuagagagugguaaccugauggcucccggaggaggugguauuaauccuuagcaucagggcaaaucuugagacucu

SEQ ID NO: 2943 - RNA, 86 nt, Human
ggagucuuacuuugucacccaggcuggagugcaguggugugaucucggcucacuacggccuccccauccuggguccaagcgauucu

SEQ ID NO: 2944 - RNA, 88 nt, Human
ggagucuugcucugucgcccagguuggagugcaguggcgugaucucggcuuacugcaacuuccagcuccuggguucgaacgauucucc

SEQ ID NO: 2945 - RNA, 68 nt, Human
ggagugaccuggagcacugugggggacgggacuccgccugcuguucccgcgcugagcuacaggacucc

SEQ ID NO: 2946 - RNA, 93 nt, Human
ggaguggaggagggcagaggacacgucucagggccaguaaccuaggcuuauagaagacgucaucaccguccucaugauguucaccccgucucc

SEQ ID NO: 2947 - RNA, 71 nt, Human
ggaguggugaugcacacauuuggggguuaugccaacagcaaagcugucacacuggaggcuucauuuacucc

SEQ ID NO: 2948 - RNA, 76 nt, Human
ggagugucuuggaggccuuggugaccaaugccagcagaguccugcggggugugggcccggccucccuggauucucu

SEQ ID NO: 2949 - RNA, 89 nt, Human
ggaguuuagcucuuguugcccaggcuggagugcagugguacgaucucggcucacugcaacuucucccuccugguuucaagcaacucucc

SEQ ID NO: 2950 - RNA, 89 nt, Human
ggaguuucgcucuuguugcccaagcuggagugcaauggcacaauauuggcucacugcaaccuccaccucccggguucaagcgauucucc

SEQ ID NO: 2951 - RNA, 105 nt, Human
ggaguuucuuccaaacuucaccaucuggauacugguguuucuuuacagauuccuccuucauuucuguugaguagccgggauccuugggaggcauguaggaagccc

SEQ ID NO: 2952 - RNA, 98 nt, Human
ggauagcggaucugcaucguagcgaucuccaauuccaauagggaacacugucacucuguuggaccuggcggcaucagcugcugcauccacugaaaucc

SEQ ID NO: 2953 - RNA, 79 nt, Human
ggauaguuggaacuaauguacagaacuaaauuuuuuaaacuuuauuugcuguuaaaauucugugaaguuucaguuaucu

SEQ ID NO: 2954 - RNA, 86 nt, Human
ggauauccaucaacacuagugguggcagcuucaggaaccgguuuggugcuggugcuggaggcggcuauggcuuuggagguggugcc

SEQ ID NO: 2955 - RNA, 111 nt, Human
ggauauggagaaugauaccagguaucaagcucauagcggccaaaagcaauuguuuuaaucauguugcuucccucugugauuuggacuugcagccuuaacuucuccaaaucc

SEQ ID NO: 2956 - RNA, 93 nt, Human
ggauauuuugugacaucgguggcucgaucauccuuaagcaacugaaguuaaaauuguugacggaaaaggcacuuaaauguuacuuucaugucc

SEQ ID NO: 2957 - RNA, 85 nt, Human
ggaucacagauggagaagugucaaacaaggaugguugcgggcaagagggcugcacccuaucuuggagaccuucucccaggugucc

SEQ ID NO: 2958 - RNA, 62 nt, Human
ggaucaccccuucuuuguuaagcuuuacuucacauuucaggacgacgagaagcuguguaucc

SEQ ID NO: 2959 - RNA, 109 nt, Human
ggaucagagaggaaaagucacuugcccaaagucacacagcugaacagugguggaguucaacuuugaccgugggcugucuggccccaagguguaugcuugcuucucuccc

SEQ ID NO: 2960 - RNA, 84 nt, Human
ggaucauuuacuggaucccuucuucuuucacuggguccgugcucccagcaggugcagagaaucuuagaagacgcagguguaucc

SEQ ID NO: 2961 - RNA, 73 nt, Human
ggauccgcugccaguccccacugaggaaggaaacccccuccucaaacacuaucgggggcccgcaggggaugcc

SEQ ID NO: 2962 - RNA, 72 nt, Human
ggaucuagaccaugcagcuuuucccuacugucaccagauugggagcagggauuggcugccauuguccucucc

SEQ ID NO: 2963 - RNA, 84 nt, Human
ggaucucuugaggcugggaaacagagguugcagugagccgagaucacgccacucugcuccagccugggugacaaagugagaucc

SEQ ID NO: 2964 - RNA, 65 nt, Human
ggaugaaaacauggaccucuuggaagguauaacuggcuuugaagacucuguccgaaaguuuaucu

SEQ ID NO: 2965 - RNA, 94 nt, Human
ggaugaacaauagucugcaauuuccccuaagccaggccuugggauucggacuuuugaggaccuggguaguaguuaguugacaugcuauuuaucu

SEQ ID NO: 2966 - RNA, 71 nt, Human
ggaugaggaggguaggcucguaguagccaugcaggaacugcaggucgaugauguugagcagcuucucgucu

SEQ ID NO: 2967 - RNA, 77 nt, Human
ggaugauggcccaccgaugggcggguggcaacuucuuggaagcacuuacaccccacccgacguggccauuguaaucc

SEQ ID NO: 2968 - RNA, 98 nt, Human
ggaugcauauaggauguuugggagcauaauccgugaagaaaaaaucaauuaaaucauuguguucaacaggaauauuuacaaauauucugcaugaaucc

SEQ ID NO: 2969 - RNA, 113 nt, Human
ggaugccugcaaaccaaccacuagcugcuccugcaaacacauuauguguuccuuuucccugagaaauauccuugauguguuugguggcaguaucuacagaagcggcagccacc

SEQ ID NO: 2970 - RNA, 81 nt, Human
ggauggaguggcagcugaaggugcaggaacuggaccccgccgggcacaagucccugugcgugaacgaggugcccuccuucu

SEQ ID NO: 2971 - RNA, 75 nt, Human
ggaugggacguacucauacucaggaugcuguuccccuuacucuugggcaggaauuuaggugguuauguuccaccc

SEQ ID NO: 2972 - RNA, 74 nt, Human
ggaugggcuucccaagaugccuugcacugucccagaaacggaugugccccagcucuuccgggagccuuacaucc

SEQ ID NO: 2973 - RNA, 85 nt, Human
ggauggggcagagcugagaagccaaggggggaagaguuggggcugaccucuucuucaccucgggccuuaaucacugaccaagucc

SEQ ID NO: 2974 - RNA, 64 nt, Human
ggauggucucaagugaucaggauaguguggucgguacacccaaagcuugugaaugacuccaucc

SEQ ID NO: 2975 - RNA, 86 nt, Human
ggauguagucguucaacuaacggugacuuuuacaaaugagacggaaaaucauguaaacuguauccuuuaguuuuaucgcuguaucu

SEQ ID NO: 2976 - RNA, 60 nt, Human
ggaugucucauucuagagugacagccaaaaggguaucucacccuagagugacagcuaucc

SEQ ID NO: 2977 - RNA, 79 nt, Human
ggaugucugugucaggcauguuaacuucaaacaaaaucugagaucggcuuuuuccauugacauucuuagcacagcaccc

SEQ ID NO: 2978 - RNA, 76 nt, Human
ggaugugguugaugaagguuucccauaugguuucagggccaaaccaaggaagaaucuaacuuucagccucaugucc

SEQ ID NO: 2979 - RNA, 69 nt, Human
ggauuacagcuaggaccuccagaacacugacaaaaagaaguggugcaguggaaauccuugccuuguucc

SEQ ID NO: 2980 - RNA, 80 nt, Human
ggauuauccuuuucuggagaaguagucuagaccacggcaauuggcagaacacauucuaugguuccaggagaggccauucc

SEQ ID NO: 2981 - RNA, 69 nt, Human
ggauucuuguuuuccacaugugguaucuuccagaguauccuggaaugucuacaugcccgauuagaaucc

SEQ ID NO: 2982 - RNA, 87 nt, Human
ggauugacagauugaugcucuuucucgauuccgugggaugugugcauugccguucuuaguugguggagcgauuugucugguuaauuc

SEQ ID NO: 2983 - RNA, 75 nt, Human
ggauugaguaugucuuucuuguuuuuccuggucuugaugaccuugaugugacuaugaauuacagaucucaacucc

SEQ ID NO: 2984 - RNA, 82 nt, Human
ggauugccaaaacggucaccagcacauuucccaggagcuugaaguucucaggauccacaugcagcuugucacagugcaguuc

SEQ ID NO: 2985 - RNA, 80 nt, Human
ggauugcuccauuaaguuagacuaugauacuuaguuuauaaacagauuauaccaucauagcuauuuaagagaagcccucc

SEQ ID NO: 2986 - RNA, 77 nt, Human
ggauuuauacauacagagauuguaguauuuaguauaugaaauauuuugaauacacaucucugucagugugaaaauuc

SEQ ID NO: 2987 - RNA, 83 nt, Human
ggauuugaauaacuagacauuauuuaugcugccaaacucauuuguugcaguuguuuguaaugucuaguggggcuucaucaucc

SEQ ID NO: 2988 - RNA, 102 nt, Human
ggauuuuagucuguaacaaaguugucgcuauugugcuucauccguucagcugaacaggaggauggauacagccgcgaggcuaaaaaacggauuuccucuucc

SEQ ID NO: 2989 - RNA, 96 nt, Human
ggcaacacuucgaugguuccggaucaccaugugggguuguuaggcgaaugugcccucgacuggcacuggggccgggagaucuaacaggagugugcu

SEQ ID NO: 2990 - RNA, 71 nt, Human
ggcaacgacguguuacccguggggaauuagcaggcgcucugaacgcaugcacggaggacacgcccauugcc

SEQ ID NO: 2991 - RNA, 86 nt, Human
ggcaacuacaaauaucucuuuaccaucuuggcuucucauaauccugcagggaggcccuugaagggaagagaacagauuugguugcc

SEQ ID NO: 2992 - RNA, 78 nt, Human
ggcaacuucaggaugacaaaaacaaagucucuucugcugggaaaucccaguacagaucguuucucaucucuaagugcc

SEQ ID NO: 2993 - RNA, 79 nt, Human
ggcaacuucaggaugacaaaaaccaaagucucuucugcugggaaaucccaguacagaucguuucucaucucuaagugcc

SEQ ID NO: 2994 - RNA, 69 nt, Human
ggcaagaaggugcugacuuccuugggagaugccauaaagcaccuggaugaucucaagggcaccuuugcc

SEQ ID NO: 2995 - RNA, 131 nt, Human
ggcaagauccucgcuccaaccguggcccguguucucuccuuuuguccccauagugugacuccgccaggaacuuggaauggcugaagacugugaaugagagucaugggucuguggaacgcucaucccugacc

SEQ ID NO: 2996 - RNA, 93 nt, Human
ggcaaggauuccugcacgucaagggccucaggugacuuucaugcacacccaagucagaaggcucuccugaauccuggaugucaccuuccugcc

SEQ ID NO: 2997 - RNA, 63 nt, Human
ggcaaugaggguuggacaggcagauaauacacauauauucuuuaacuuugcaaacccauuguc

SEQ ID NO: 2998 - RNA, 90 nt, Human
ggcaauggacgcuaccccagaugggucagcuucggaggccugcccaaggcuccugaucaggcggccgucugguccaaucagcaucuugcc

SEQ ID NO: 2999 - RNA, 77 nt, Human
ggcacaauuaaccccugugggucggcagccuggcccagaucaaaggcuuccugaccgauagagguuguuauguggcc

SEQ ID NO: 3000 - RNA, 85 nt, Human
ggcacagugagacagauguggaagagcagacccaggagcugaagaccaucacucagcuccagggugagccugcaccgccgugacc

SEQ ID NO: 3001 - RNA, 79 nt, Human
ggcaccagcucuuugggccuaggauacugccgggccccccaaggggguccccagcaaccaggccuggccuccugguguc

SEQ ID NO: 3002 - RNA, 79 nt, Human
ggcaccagcucuuugggccuaggauacugccgggcccccccaagggguccccagcaaccaggccuggccuccugguguc

SEQ ID NO: 3003 - RNA, 96 nt, Human
ggcacccagaucggaaacaccaugagagcacuuuaucuguagguccuuugggccagcaauuugggcucacaaauggacaccucugagcugagggcu

SEQ ID NO: 3004 - RNA, 90 nt, Human
ggcaccccgggguguggccagaggacuucggcgacgcuuccccgagaguagccccccuccucaacccagaaaagacaaccccgcggggcu

SEQ ID NO: 3005 - RNA, 88 nt, Human
ggcacccucggcugugccuccucugaggcuggcaguuccuuccuggauaugcaaggucaagagcggagggggaagcagagagagugcc

SEQ ID NO: 3006 - RNA, 88 nt, Human
ggcacccucggugcugccuccucugaggcuggcaguuccuuccuggauaugcaaggucaagagcggagggggaagcagagagagugcc

SEQ ID NO: 3007 - RNA, 75 nt, Human
ggcacgcgucucugugcaacaccaacacgggcaagugcuucugcaccaccaagggcgucaagggggacgagugcc

SEQ ID NO: 3008 - RNA, 90 nt, Human
ggcacggguucgcugguguucgcgcugccccacuucacggcuggccgcuaugagguggaguuggacgcgggugucaggacgugcccugcc

SEQ ID NO: 3009 - RNA, 68 nt, Human
ggcacucaagagauccuccugccucagccucccaaagggcugggauuauaggcaugaggcuccgugcc

SEQ ID NO: 3010 - RNA, 99 nt, Human
ggcacugucuuugcccgcauggccccugagcagaagacagagcuggugugcgagcuacagaagcuucaguacugcgugggcaugugcggagacggugcc

SEQ ID NO: 3011 - RNA, 71 nt, Human
ggcagaaggcuuuuacaccacaagugcagugaaagaacugcacggugaguuuaaaacaaccgcuuguggcc

SEQ ID NO: 3012 - RNA, 89 nt, Human
ggcagagcgcugccucucugcaggccgugugcuuugcucgguugaucuugcagagccuaagacacaggcccagagaggcagugaucgcc

SEQ ID NO: 3013 - RNA, 103 nt, Human
ggcagaggagggcucacuuuucaaaguuccaaauagggcaaaauguguguuucccuaggaaguauuuuuuaaaaacauuuuugagauagagucuugcucuguc

SEQ ID NO: 3014 - RNA, 93 nt, Human
ggcagagggcucuccuaauggguucacagugagauuucuuugaagaaaaagcuucaguugagcucaguaacaucuuagcgagaaccaagugcc

SEQ ID NO: 3015 - RNA, 62 nt, Human
ggcagagugacucccaucccaucauugaugucuggcuuugacuuggcaugggagacauugcc

SEQ ID NO: 3016 - RNA, 70 nt, Human
ggcagcacaaaggcggggcggugcacgucggaguuguaguacuucagcugcaucugcgccaccugcugcu

SEQ ID NO: 3017 - RNA, 72 nt, Human
ggcagcagagcuuugugcaggucagaguguccccauccgucuccgaguuccugcuccaguuagacagcugcc

SEQ ID NO: 3018 - RNA, 73 nt, Human
ggcagcaggggugggcauccgggcuaaggcuuuacuuggcggcagucucaucggauuuugcagcuucugggcc

SEQ ID NO: 3019 - RNA, 104 nt, Human
ggcagccacagguuucaacucccauuugugaauaaauuaaaugacucuuuacaaaaccaucagcagucuugguguaucacauuugguauuuagaaacuuuuguc

SEQ ID NO: 3020 - RNA, 94 nt, Human
ggcaggagaaucgcuuaaacccgggagguggagguuguggagcugagauugugccauugcacugcagccugggcaauaacagcaaaacuccguc

SEQ ID NO: 3021 - RNA, 103 nt, Human
ggcaggagaauugcuugaacacaggaggcagagauugcagugagucaagaucaugccacugcacuccagcacuccagccuaagugacagagcaagauccuguu

SEQ ID NO: 3022 - RNA, 105 nt, Human
ggcaggagugggagaaggaggagagaaaagcugguccucugcagucuuuacacccacagcucugcccuuuucccuuucaaccucuccuccgcugucaugccugcu

SEQ ID NO: 3023 - RNA, 100 nt, Human
ggcagggaccaaccccuaaucccuccccagcggcaagccccucuuuucagagugggcagaggguugccuauggugggcacuaggaaugagguccccugcc

SEQ ID NO: 3024 - RNA, 86 nt, Human
ggcagggcccagggcagcggccgacccggggccccggacuuuaucaccgugcgcugccccagcugcugcaggggccugacauuguc

SEQ ID NO: 3025 - RNA, 77 nt, Human
ggcagggccccuuugagguaccaguugacaccugucgucacgacugcaccugaagcccagccaaugagcggcccgcc

SEQ ID NO: 3026 - RNA, 94 nt, Human
ggcagucuucuaagacuaguaucaauauuuuaagaguauggugagcuuuuuugaaauuauaccuauaauagaauuagaugcuuaugcugcuguc

SEQ ID NO: 3027 - RNA, 75 nt, Human
ggcaguggcugauugacacccucuaugccuucaacaguggaaaacguagagcgguuccagacucugaagacugcc

SEQ ID NO: 3028 - RNA, 75 nt, Human
ggcaguguucggguaucagaaaucacuuaaacuagcaauuggccuuauaaagugaugauacacugggcuuuugcc

SEQ ID NO: 3029 - RNA, 89 nt, Human
ggcauagaccauguacaggaauccaucuucaucuuucucacucucauacaccucugagauugguguggagacgcugaccaugcuguguc

SEQ ID NO: 3030 - RNA, 90 nt, Human
ggcaucagauucucauaaggagcgugcaaccuacaucccucgugugugcaguucacaauagggcucgugcugcuaugagaaucuaaugcc

SEQ ID NO: 3031 - RNA, 73 nt, Human
ggcaucauugaggccaggagcucugcccgugaccuguaucccacguacucuaucuuccauuccucgcccugcc

SEQ ID NO: 3032 - RNA, 75 nt, Human
ggcaugcuauuuuaaucauuaaauucuugaugaugacgaucaucaucaagaugagaaagaaaagaaauaugagcc

SEQ ID NO: 3033 - RNA, 61 nt, Human
ggcauggaggcaaaaacaucugugguucacucagccucaauuuccaaugugucucugugcc

SEQ ID NO: 3034 - RNA, 65 nt, Human
ggcauggcagagccuugauuuguaauguuugcuaauuuacgugguacaagugcuccaguacggcc

SEQ ID NO: 3035 - RNA, 62 nt, Human
ggcauggggagguucccggguaucuccgacacugggggggcccaggccgagcuccuugugcc

SEQ ID NO: 3036 - RNA, 90 nt, Human
ggcauuauauucuuauaaggaggacgcaaccuagaucccucacaugugcagugugcaauagggcuugcauuccuuugagaaucugaugcu

SEQ ID NO: 3037 - RNA, 81 nt, Human
ggcauugccugugauugggggugagguuaucuauucugagauucaagauggaagccuccauugccccuccuaagccaugcu

SEQ ID NO: 3038 - RNA, 102 nt, Human
ggcauuguggugcacgccuguaaucccagcuacucgggaggcugaggcaggagaauugcuugaaccugggaggcggugguugcaguguucagagaucacgcc

SEQ ID NO: 3039 - RNA, 100 nt, Human
ggccaaaagagauccacuguugccccaguugguggaaaagacuuuacagaugcaacaugccaugaaguaccacccuuuggggguggucggcuuacgggcc

SEQ ID NO: 3040 - RNA, 92 nt, Human
ggccaagguguaggcguccagccacgagaugaccucuugacacuuguccagaaccuucuucuuguccgacucgcugaucuugcccuugagcc

SEQ ID NO: 3041 - RNA, 78 nt, Human
ggccaaguuccagaggaucuguuugccaaaugaguugaccuugguaccuauauaacaaaggucccuuggacauugccc

SEQ ID NO: 3042 - RNA, 89 nt, Human
ggccaauugaaacaaacaguucugauaccguucuuccaccacugauuaagagugggguggcagguauuagggauaauauucauuuagcc

SEQ ID NO: 3043 - RNA, 74 nt, Human
ggccacgugcugccccuccuggacaauaauuuagcaauaaauacugcgcagggcagggguagggcaccaaggcc

SEQ ID NO: 3044 - RNA, 84 nt, Human
ggccagaggggaguuccugggugcuccacaugccuguccuaggcuuuuggacaugcuggcccccagaucugccccuccauggcu

SEQ ID NO: 3045 - RNA, 86 nt, Human
ggccagcgcagggccucguggcacccaugcaggagaaggugucccccuucuuccaguccucggcugccacgcgcaguaugcugguc

SEQ ID NO: 3046 - RNA, 88 nt, Human
ggccagcgcgagggcaucguggcgaccgaugcaggagaaggugucccccuucuuccaguccucggcugccacgcgcaguaugcugguc

SEQ ID NO: 3047 - RNA, 82 nt, Human
ggccaggacugcgcucaggaucccgccccggagcccccagcccgggggagagggggagggaaguugggacgaagcccaggcc

SEQ ID NO: 3048 - RNA, 93 nt, Human
ggccaggcacgguggcucacgccugugaucccagcacuuugggagaccaaggcugguggauuacaagaucaggaguuugagaccauccuggcc

SEQ ID NO: 3049 - RNA, 73 nt, Human
ggccaggcggacgaaccccuccucagugcuuggucaucuuggccgggcucgggggguauccgaccuucaggcc

SEQ ID NO: 3050 - RNA, 76 nt, Human
ggccaguugcucuaaguggauuggauaugguuggaguggcacagacuggaucugggcuagagagaggcgaugggcc

SEQ ID NO: 3051 - RNA, 100 nt, Human
ggccaucuuugaacuccuggacuauauugugaacgagccaccuccuaagcugcccaacgguguguucacccccgacuuccaggaguugucaauaaaugcc

SEQ ID NO: 3052 - RNA, 101 nt, Human
ggccaucuuugaacuccuggacuauauugugaacgagccaccuccuaagcugcccaacgguguguucacccccgacuuccaggaguuugucaauaaaugcc

SEQ ID NO: 3053 - RNA, 71 nt, Human
ggcccagaguuaccacgcugccaggccacauccaggccguguauguucagaacguggucaagcuuuacgcc

SEQ ID NO: 3054 - RNA, 74 nt, Human
ggcccagcagauggagggccaggaggaggaagagucugcagcauuuguucuccuggcucccacccugccagguc

SEQ ID NO: 3055 - RNA, 60 nt, Human
ggcccagcuuggggcuggcgggggaggcugugucuucaaaccuuugcccccaguuggguc

SEQ ID NO: 3056 - RNA, 83 nt, Human
ggcccaggaucggcagggcugcuggcagaggaaucccagcugggguucccaugccaccaggcuccugcaggacuugcugggcc

SEQ ID NO: 3057 - RNA, 83 nt, Human
ggcccagggaucggcagggcugcuggcagaggaaucccagcugggguucccaugccccaggcuccugcaggacuugcugggcc

SEQ ID NO: 3058 - RNA, 107 nt, Human
ggcccaugacugccccugccccagugccauuggccgccccacccgcaccacuggcuggggguccggggguccggccagugcaggcacccuggggcaguagcagggcc

SEQ ID NO: 3059 - RNA, 61 nt, Human
ggcccccaugggcccggguccauucacccuuuugggcaauugggaccgguucccggggguc

SEQ ID NO: 3060 - RNA, 63 nt, Human
ggcccccgcuggcuugccaagcuuggggaauuccagagaggggcaguuaguauuaguggggcc

SEQ ID NO: 3061 - RNA, 99 nt, Human
ggccccgcaggaacaggcucugguagaucuguaauccuguuggcuggcgacacgugucgccagccaacaggaugggaggaagggcagacugugguggcc

SEQ ID NO: 3062 - RNA, 91 nt, Human
ggccccguucguuggggggcucaucaagcugucgucaugcgcccaugucgcgcgaagaagcccgaucgaguccccugagacguacugugcc

SEQ ID NO: 3063 - RNA, 61 nt, Human
ggcccgccugcgccgcgaguaccuguaccgcaaggcccgggaggaggcgcagcgcguggcc

SEQ ID NO: 3064 - RNA, 73 nt, Human
ggcccggggccuaccucaaaggagcggggucgcgaagcuagcuagcagcggccccccuccagguccccgggcc

SEQ ID NO: 3065 - RNA, 62 nt, Human
ggcccuacccugggagggcccauccagcuaccugcugguaggccaccuccaggagaugggcc

SEQ ID NO: 3066 - RNA, 76 nt, Human
ggcccucagaggcuccucccuaucuccuggcuaguuaccacuaggcuaccaggucucuaggggccugagagaggcc

SEQ ID NO: 3067 - RNA, 67 nt, Human
ggcccugcaccagugcugcauugaugauuuccgagagauggugcagcagcuccuggaggcuggggcc

SEQ ID NO: 3068 - RNA, 82 nt, Human
ggcccuguggcucugauguuccccccugggaggcuccaccgggucucuuuuuuggggaugagagcagugccccaggcccgcc

SEQ ID NO: 3069 - RNA, 88 nt, Human
ggccgaccccgaggcgcgggcagaggcuggugagcagccaggcacagcugagcgggcccugcuccgagaucagcccagggccguggcc

SEQ ID NO: 3070 - RNA, 70 nt, Human
ggccgcgcucgggcgccccucgcgcagcgcuccaugcccguguggugcugccgcugcucccuggccgguc

SEQ ID NO: 3071 - RNA, 83 nt, Human
ggccgcugggagccuugagagccaugugcaaagaggacagauccuguuccugucaccauugcucucgauucacucagcuggcu

SEQ ID NO: 3072 - RNA, 112 nt, Human
ggccgcuucgggcuggcggcuggagagcgcucgggucaugucugcccagggggacugcgaguuccuggugcagcgagcccgggaguuggugccgcaagaccugugggcagcc

SEQ ID NO: 3073 - RNA, 67 nt, Human
ggccggcgagcaguucggacagcugggccgggagcugcgcgcccaggagugucugcccuacgcggcc

SEQ ID NO: 3074 - RNA, 82 nt, Human
ggccggcggagaggccagcagcccccgggacaccagugccuucuuccuggagaccaaggagcgccuguaccuccuggcggcc

SEQ ID NO: 3075 - RNA, 69 nt, Human
ggccgggcccacucgccgcgcgcccagccaugaaccuggcgagccagagcggggaggccggcaccgguc

SEQ ID NO: 3076 - RNA, 72 nt, Human
ggccgugcucuuuggaauuuuccuguacaugggagucaccucccuuaacgggauccaguucuaugagcggcu

SEQ ID NO: 3077 - RNA, 78 nt, Human
ggccguggcucccauccuccggaaucugcaaaauggcuacuucuucagacauaauggggagagggauggcaagaggcc

SEQ ID NO: 3078 - RNA, 72 nt, Human
ggccuaaaagcaagguucuuauucuccggaaccaugggccucgugucaguuggagagagcguugaggaggcc

SEQ ID NO: 3079 - RNA, 75 nt, Human
ggccuaaagcaagguguguauuuguuauucugaaauuguuuugcaucuggacaaauacuaaauaucccaguggcc

SEQ ID NO: 3080 - RNA, 61 nt, Human
ggccuacaggcagcuguggcccagcaggacacucugauggaagcccgguucccugagggcc

SEQ ID NO: 3081 - RNA, 68 nt, Human
ggccuccaugccuauguggugguacaaugucacugacggauccugccagcuguuuguguaugggggcu

SEQ ID NO: 3082 - RNA, 79 nt, Human
ggccucccaaagugcugagauuacaggcaugagccacugcaccuggcccuugccucuauuucaaagcuacuuuggugcc

SEQ ID NO: 3083 - RNA, 84 nt, Human
ggccucugcugcccuuucugugccccccagguucuaucuccccgucacacccgaggccuggcuucaggagggagcggagcagcc

SEQ ID NO: 3084 - RNA, 61 nt, Human
ggccugccacuggucauggguagcuagagcugcuggcuucccuguggcuuagcugguggcc

SEQ ID NO: 3085 - RNA, 75 nt, Human
ggccuggaccucccaacgugcugggauuacacacgugauugucugacaagcagaggcaugagcuggguccaggcc

SEQ ID NO: 3086 - RNA, 65 nt, Human
ggccugggagggcaugggucaagggcguccgggaagcuggagcucuuccugcugaccuuccggcc

SEQ ID NO: 3087 - RNA, 76 nt, Human
ggccuucugcauguagugauccggggcucccccaaggggaaccgcccagccauccucaccuaccaugaugugggcc

SEQ ID NO: 3088 - RNA, 70 nt, Human
ggccuugagugcugcuugcuugggcaccggagggugggacaugggccccgguagcaagcauggcagggcc

SEQ ID NO: 3089 - RNA, 87 nt, Human
ggccuuggauggccauggugguuucucuacauagucuuuccacuuaugagaugcguuguacaggaauguccuggccauccuaaggcc

SEQ ID NO: 3090 - RNA, 64 nt, Human
ggccuuucagcuaacauucauggaugcaaaccacuacuggucuguggacggucugcugaaugcc

SEQ ID NO: 3091 - RNA, 76 nt, Human
ggcgaagcugaugcugagagguggcccgcuguacugauuuuguaaaaccagcaggaaaaccucugcucggccgacc

SEQ ID NO: 3092 - RNA, 61 nt, Human
ggcgaccaucuuguauucaagugcugacaaccgugaugucauuuacuucagagauuuugcc

SEQ ID NO: 3093 - RNA, 106 nt, Human
ggcgaccugaucaggggagguggggguacacaucaauuuggaguuguuucagggcuacugaaacauuuaaaaugugaauucccaaacuuuuccuuuugggcuuguc

SEQ ID NO: 3094 - RNA, 75 nt, Human
ggcgagagaagaaggaauggguugagaaacugacugaaguguucuaucagcgucugaugccuucuucccuuugcc

SEQ ID NO: 3095 - RNA, 63 nt, Human
ggcgagcaccgcgccggcccugagccucccgcucgcuccccacggccgcggugcauguucgcc

SEQ ID NO: 3096 - RNA, 77 nt, Human
ggcgcaaaugggccccgggcggcccagguccuccuacuguggaaggagcagggaagcugcccgagggaacccaagcc

SEQ ID NO: 3097 - RNA, 83 nt, Human
ggcgcacccgguggccgcccggaccugcuuauugcugucaagucgguggcagaggacuucgagcggcgccaaggccgugcgcc

SEQ ID NO: 3098 - RNA, 83 nt, Human
ggcgccaccaaagccaggcuugagggcugggaguccggacugagaaagggguccugggccacccuggccgggguaggaucgcc

SEQ ID NO: 3099 - RNA, 84 nt, Human
ggcgccuaugggcaggcggugcgcuaccagggccgcgcgcaggccgugcugcagcaguaccaacaccugcccucguuccgcgcc

SEQ ID NO: 3100 - RNA, 66 nt, Human
ggcgcuauauauggauccaauggcaagaucaucaugacagaucugcgcgcgaucgauaucagcgcu

SEQ ID NO: 3101 - RNA, 93 nt, Human
ggcgcuggugucaaacaguuaugugaugcuuugaagcacccucacuguagaugagagugucuugcacugcaaacauagccgaucacccgugcc

SEQ ID NO: 3102 - RNA, 60 nt, Human
ggcggaguuucuccauguaggucagguuggucucgaaauccugaccucagguuaucugcc

SEQ ID NO: 3103 - RNA, 70 nt, Human
ggcggcagggcgcugcaccgugcucccccggcucugcucgacagcagcacgcagugagagccucgccgcc

SEQ ID NO: 3104 - RNA, 62 nt, Human
ggcggcccgcuuggcuuccggccaauaggcaucaucucgccgguccaggucguagggccgcc

SEQ ID NO: 3105 - RNA, 72 nt, Human
ggcggccucugggaggacccuuccuuaguccccucucccaccacucaggcuccugcuucccagagaguggcc

SEQ ID NO: 3106 - RNA, 81 nt, Human
ggcggcggcgguuagggcuguguagggcgaggccucccccuuccuccucgccauccuacuccucccuccucgucauccucc

SEQ ID NO: 3107 - RNA, 95 nt, Human
ggcggcggggccgaugagcgggauggauggcuccgagcgcugaccccggcauguccaggauguuaccguuccugcugucugcucugguuucugcc

SEQ ID NO: 3108 - RNA, 71 nt, Human
ggcggcgguggcggcggcgacugcugcggugaaggaggaggaggagccgagcgggcgcuggcaccgaggcc

SEQ ID NO: 3109 - RNA, 108 nt, Human
ggcggcugggucuuggaaggagccugcugaaggaggugggcugucuucugacaggcagcucuccgaaucuuccaccaaggacuccuugaagucuaugacccugccguc

SEQ ID NO: 3110 - RNA, 60 nt, Human
ggcgggcacggggcguaggagcuggcuggcggccggcucugcauguucuuguugccuguc

SEQ ID NO: 3111 - RNA, 90 nt, Human
ggcggggagugggaaaggguccggggcggagugccguugguuaaggagaagccaaaaauguuugccaagggaacugagaucacccaugcu

SEQ ID NO: 3112 - RNA, 81 nt, Human
ggcggggggcagagaagaauuuuaacuuggaugauucccaugcccacuccagcuguaacuuucuuugacugugacccagcc

SEQ ID NO: 3113 - RNA, 67 nt, Human
ggcgggguggggaauaaauauauuaagugccucuuggcauuugggguguuuaaacaauaacccggcc

SEQ ID NO: 3114 - RNA, 91 nt, Human
ggcgguugaaggcguuguaggcugacuccaggucgaacagcaucugacgcaccugugagucguccagcucaucugacgccgacaugccgcu

SEQ ID NO: 3115 - RNA, 72 nt, Human
ggcgucugguacucagaugucacgaagcacgccauuggacuaagauggugguuucgcauagugccaagcacc

SEQ ID NO: 3116 - RNA, 91 nt, Human
ggcgucuugcucuauuggcaggcuggagugcaguggugcgaucucagcucacugcaacccccgccucccagauucaagcaauucuccugcc

SEQ ID NO: 3117 - RNA, 71 nt, Human
ggcgugcacaccuucccggcuguccuacaguccucaggacucuacucccucagcagcguggugaccgugcc

SEQ ID NO: 3118 - RNA, 73 nt, Human
ggcguugggggcgcccgauauccuguggggggaaggguuucccgguucccuuuugggggccccuuuauuugcc

SEQ ID NO: 3119 - RNA, 93 nt, Human
ggcguuuuuggcuccauuuaacagaagaaggaccauagugaucauuuaaucucuaugagucugucuuaucuucuggaaaaggggccuaacacc

SEQ ID NO: 3120 - RNA, 90 nt, Human
ggcuaaauuuauuuucuugugucugccuagcaagauaauuucucuauucuuugacaguauugucucaggcaccugaaucagaccuaagcc

SEQ ID NO: 3121 - RNA, 71 nt, Human
ggcuaagugccagcuccucuuugcccucaaggugcucaagcaugaugcccgaggagaagcugguugaggcc

SEQ ID NO: 3122 - RNA, 84 nt, Human
ggcuacgaacgaggcugcggaccuaucgcuuggguuauaugaagucaaggguuaacacgguucuagguggccucacucgugguu

SEQ ID NO: 3123 - RNA, 74 nt, Human
ggcuacgaaguccagauaccuugaaacauuguggggccugcuuggaauccacuugacaacugacuucuguggcc

SEQ ID NO: 3124 - RNA, 62 nt, Human
ggcuaguguaauacuccacagagaaguagacaccccaaacuggagagcauguugcauuugcc

SEQ ID NO: 3125 - RNA, 62 nt, Human
ggcuaguuccuugauagcaucuuacucucaccuucuuugugucugugaugaaaggaacaguc

SEQ ID NO: 3126 - RNA, 73 nt, Human
ggcuauuugcacugggcuucuuuucaugccgcuacucuaagccucccugaauuuucccccgggacaaucagcc

SEQ ID NO: 3127 - RNA, 71 nt, Human
ggcucaaggaacagcuggcaaggggggcagagaaggcacaggaaggagcccucacucuggcuguccaagcc

SEQ ID NO: 3128 - RNA, 63 nt, Human
ggcucacgcaugggccggcuggaggugcuggggacgguguuugcuggacccaaggugugagcc

SEQ ID NO: 3129 - RNA, 58 nt, Human
ggcucaugcauauaaucccaacuaucuaggaggcugaggugggaggauuguaugagcc

SEQ ID NO: 3130 - RNA, 62 nt, Human
ggcucauucgauaucuccucacucaccugucuggugccucggugauggcuguugugugagcc

SEQ ID NO: 3131 - RNA, 72 nt, Human
ggcucauugcuuaggugcccagguuuuucaggugcaauuaaaauuuagaacuaccacacaaaggcauuggcu

SEQ ID NO: 3132 - RNA, 62 nt, Human
ggcuccgcccccacccugccugcccccucgcuggagcaacgcaagcaggaggcgggggaguc

SEQ ID NO: 3133 - RNA, 93 nt, Human
ggcuccuccuguccggggcggagcccugcgucgcgggccuggggaggccccgccagcacccuugacgucugggucccgagcagugcggcagcc

SEQ ID NO: 3134 - RNA, 62 nt, Human
ggcuccugugucuucucacucuugguauuccugcuugugcaggagccuguguacacagggcc

SEQ ID NO: 3135 - RNA, 63 nt, Human
ggcucgccgcgcuagcccugcugaccugcagccuguggccggcacgggcagacaacgcgagcc

SEQ ID NO: 3136 - RNA, 63 nt, Human
ggcucgccgcgcucgcccugcugaccugcagccuguggccggcacgggcagacaacgcgagcc

SEQ ID NO: 3137 - RNA, 78 nt, Human
ggcucgcucuggaccucacugcuggucuccagcugggcagggccggucugggggcugcagccuggcucgagcacugcc

SEQ ID NO: 3138 - RNA, 74 nt, Human
ggcucggugcuaaauauggagauauagcagugucaacacacaaguggucccuccauguugucacagcugauguc

SEQ ID NO: 3139 - RNA, 70 nt, Human
ggcucucggccuuggcaacggccgucgucaugguuacuggccccuaggcgccgauggccgaggccgcgcc

SEQ ID NO: 3140 - RNA, 84 nt, Human
ggcucugcaggcuuaucaguucagcacaacgugcuccugcauucaagaaacagggcauggggcugcucacuggcacuggaggcc

SEQ ID NO: 3141 - RNA, 97 nt, Human
ggcucuuggcucugcucucuccucccucucaucuucugcccuccccucugcuauguggggaacaugaagaugaagggccuccugagugaguccggcu

SEQ ID NO: 3142 - RNA, 102 nt, Human
ggcugacugggcccgaaaguggagggggaccguggagaagggcccccaguaugacacacuggagaaggccuggcaugccuuuuucacggcggcugagcggcu

SEQ ID NO: 3143 - RNA, 77 nt, Human
ggcugagaccacccuugccugcccccuucuuucugccuuaagaauguccuuuuaggcugggcaugguggcucacgcc

SEQ ID NO: 3144 - RNA, 91 nt, Human
ggcugaggggcuccaguuugcaaccucuauaagugaaucucaacauucuuucauaauagguaaagguugucucaacuacagcuauccagcc

SEQ ID NO: 3145 - RNA, 71 nt, Human
ggcugaggugggaggauggcuugaacauggggcagugagccuugauugcaccauacucuccagccugggcc

SEQ ID NO: 3146 - RNA, 74 nt, Human
ggcugagguggguggaucacaaggucaagagauggagacaauccuggccaacauggugaaaccucaucucuacu

SEQ ID NO: 3147 - RNA, 67 nt, Human
ggcugaguucuguaguuuccagaguuggcuggcuagagccuucuaagagguuacagaacuauuagcu

SEQ ID NO: 3148 - RNA, 79 nt, Human
ggcugccagaugggaccucacugacccagacguuccgggcccgggaacagcuggcagcugugaggcucuauguggagcu

SEQ ID NO: 3149 - RNA, 83 nt, Human
ggcugcggcgggcuccacgggggggcaggagugggccgugaugucgcugugcuuguacgccgccucguccagguccagcagcc

SEQ ID NO: 3150 - RNA, 80 nt, Human
ggcugcguuagguggaagcagcggaggaaggagacaaaagggauugucauuuucaugucguggcuuuuuagaagacagcc

SEQ ID NO: 3151 - RNA, 80 nt, Human
ggcugcguuagguggaagcagcggaggaaggagacgaaagggauugucauuuucaugucguggcuuuuuagaagacagcc

SEQ ID NO: 3152 - RNA, 65 nt, Human
ggcugcuggugagggcugugcagcugcugggagaacuggacgggcugcagggcugccaggcugcc

SEQ ID NO: 3153 - RNA, 88 nt, Human
ggcugggacugaggucauguucugucagguuccaaagagcgccaggaagacucugagaccacagagcacggccugcuuucucccagcc

SEQ ID NO: 3154 - RNA, 89 nt, Human
ggcugggucaaaugguauuucuggcucuagauccuugaggaauugccacacugucuuccacaaggguugaacuaauuuacccucccgcc

SEQ ID NO: 3155 - RNA, 87 nt, Human
ggcuggucucgaacuucugaccucaagugaucugcucucuugggccucccaaagugcuggaauuacaggcaugauucgcacccagcc

SEQ ID NO: 3156 - RNA, 97 nt, Human
ggcugucuagaagagucaguuguugcaccacuagugucuguuuuauuucuacauggguguuaugggcgaugcaaaccugauuuucuucgaaucggcc

SEQ ID NO: 3157 - RNA, 89 nt, Human
ggcugugaaguguucguggcaguagacucugaagcuaaggagcugagggcuuaacaaguuucuagaagcugccaucaacaugccaaguc

SEQ ID NO: 3158 - RNA, 84 nt, Human
ggcuguggcuggauucaaguaauccaggauaggcuguuuccaucugugaggccuauucuugauuacuuguuucuggaggcagcu

SEQ ID NO: 3159 - RNA, 67 nt, Human
ggcuguggggggaugagcucacucugguccccucagaccuguggcuccaaggaaucuucccacggcc

SEQ ID NO: 3160 - RNA, 80 nt, Human
ggcuuaguuuucugcccaguggaggcugaaguagagacagaucuuuggccucuucuggaagugcuguugaauacacagcc

SEQ ID NO: 3161 - RNA, 87 nt, Human
ggcuuccgucccugcugcugcugcugcuggccggggccgggcugucagccgccucgcccccagcagcgccgcgcuucaacgugagcc

SEQ ID NO: 3162 - RNA, 78 nt, Human
ggcuuccugcuccacugacugguucgagggugccaaguacuucuccuggaugcccagcguggaagaaaaaaggaaguc

SEQ ID NO: 3163 - RNA, 72 nt, Human
ggcuuccuggcagaagauggugacuggaguggccagugcccuguccuccagauaccacugagcucacuggcc

SEQ ID NO: 3164 - RNA, 62 nt, Human
ggcuuccuguauguggcugggcuugguggcucacaccuguaaucccagcacuuugggaggcc

SEQ ID NO: 3165 - RNA, 99 nt, Human
ggcuugagccagccucaggucucgaacauggcacagcuggugcacagcacuuucucguacaugucacugcaguccacgaggccacacaggguacaggcc

SEQ ID NO: 3166 - RNA, 73 nt, Human
ggcuugauuugcuuggugaccgaauuacuaggugacuaguuuacuaacuaggucauucaaggaacgucaaguu

SEQ ID NO: 3167 - RNA, 70 nt, Human
ggcuugauuuguuggugaccgaauuacuagugacuaguuuacuaacuaggucauucaaggaagucaaguu

SEQ ID NO: 3168 - RNA, 73 nt, Human
ggcuugauuuugcuuggugaccgaauuacuagugacuaguuuacuaacuaggucauucaagggaagucaaguu

SEQ ID NO: 3169 - RNA, 85 nt, Human
ggcuugcgauuccacuccgggcaggcuucaggcuaucugggacggagacugccaggcugaagccuguuccugcggaacgcaggcc

SEQ ID NO: 3170 - RNA, 72 nt, Human
ggcuuggccauggcggcuggugcugauaaccauuucuuggcagaagugcccgccaaagcuguggcccuaguc

SEQ ID NO: 3171 - RNA, 59 nt, Human
ggcuugggccgaccccagagagagcccaucaccuucuuuuugggguuuggggcuuggcc

SEQ ID NO: 3172 - RNA, 80 nt, Human
ggcuugguccgguggucucucgcggcgcgccuuuguguacucgaugcucgcuacggcggggugcaucggcgggcugagcc

SEQ ID NO: 3173 - RNA, 96 nt, Human
ggcuuuacaggaggugacuuaaguucaaaggaggccuguuagucuaauccaacauggguguccuuuggacauaagaagauaccagcacugugugcc

SEQ ID NO: 3174 - RNA, 90 nt, Human
ggcuuugcuggggcagcaagccugauaagcaugaagcucuuaucuuugguggcuguggucggguguuugcuggugcccccagcugaagcc

SEQ ID NO: 3175 - RNA, 73 nt, Human
ggcuuuuucuucuggggacagcaucaccccaggaaacaacuccuuggagcuguccauugcagaccacagggcc

SEQ ID NO: 3176 - RNA, 86 nt, Human
gggaaaagaacaauauauccaaauaaaagaccuagaaggagacaguaaucuucccuagguuugcauuuguuuacucuauuuuuccc

SEQ ID NO: 3177 - RNA, 60 nt, Human
gggaaaagcuguucccaucaaggauggcauccucuucaaauuucccugguuagcuuuccc

SEQ ID NO: 3178 - RNA, 71 nt, Human
gggaaacuccgaggacagagggcuaaauccaugaagucuguggauggccugaugauccacagcggagaccc

SEQ ID NO: 3179 - RNA, 76 nt, Human
gggaaagcagaagguuggggcuggaggucugcuggcaggcaggcagacauuuggagccaacuuuccugcucagccc

SEQ ID NO: 3180 - RNA, 96 nt, Human
gggaaaggccaucacccuccguggacggggucucggccaccacauccaccuucugaagguggcccagacaccuccacgcugcugacugcacuuccc

SEQ ID NO: 3181 - RNA, 77 nt, Human
gggaaaggcccaggagggggagaaaggcagacucagccagggaugggugaggguuucccugucccaaagcaagaccc

SEQ ID NO: 3182 - RNA, 107 nt, Human
ugguugucuuuucaauaccugguaugguaugaggcacaggauaguugcugacaaacauuuguuagcuaauuaucaugugcugggggaguuggagggagauugaacca

SEQ ID NO: 3183 - RNA, 107 nt, Human
ugguuuagcuuaggaacagcaucuggcacauaguaaguguucagugaacguuagcuauuaccaucaucacuauuaaugugugcuagugacuguccugaguuacauua

SEQ ID NO: 3184 - RNA, 75 nt, Human
ugguuuuaguccauugguagcauuguguguaugaggagauucaacaccacagacagcugcaggacucgauaucca

SEQ ID NO: 3185 - RNA, 73 nt, Human
ugguuuugguggcccaggcugggagugcaagggcgcaaucucagcucagugaaaccucggccucccgugucca

SEQ ID NO: 3186 - RNA, 92 nt, Human
uguaaaaacuuugccacaaacagaaucugccuuaacuaugagacuugugcuccacuuguauucucaggcaagcucuuggcagagucagugca

SEQ ID NO: 3187 - RNA, 72 nt, Human
uguaaagcggacaguuugaaacuuggggcauaugccaaccaaaacuucguuucugcaugucagaaaagugca

SEQ ID NO: 3188 - RNA, 131 nt, Human
uguaauacaaggaaggugaugacuugcuccauugucuguggcuuucuuauguuguaaugggagcuuaucagugugcaccaugaucagguuacagcaucaggaggagcucuacaaccuauuuuagauucaca

SEQ ID NO: 3189 - RNA, 85 nt, Human
uguaccauuguuguuuuagacauaaugcuacugcacacuucauagacuacaguacaguauaguauaaauacaacuuuugugugca

SEQ ID NO: 3190 - RNA, 90 nt, Human
uguaccuauaaauauaugcugucugucaguguacaguaugguacaaacuccuuuucuggcacacuuaaaaugcaagcaaucuaugggaca

SEQ ID NO: 3191 - RNA, 81 nt, Human
uguaccugggaaagcucaguggugggugacacaauucgcuucauuauuguucgcguaaccugcugauccuuucccgggaca

SEQ ID NO: 3192 - RNA, 76 nt, Human
uguacggcaguucaguaguuaucaaaucaguuggucucaggaccccuguguacucauaauuauugagacccaaaca

SEQ ID NO: 3193 - RNA, 85 nt, Human
uguacuauuuguuuaaugaaugcauaugagguguuuuuauuccaacaagaaaauuauucguacgcgauuauugaaugaauagaca

SEQ ID NO: 3194 - RNA, 92 nt, Human
uguacuucaggacccgaagacccggacucucuggcaagggacuggggccaagcccaguaagaggucugaccggcgaaagucuugaggguaca

SEQ ID NO: 3195 - RNA, 75 nt, Human
uguagcaugaaucaaauguauuuauuaauagcacuuaugacuauagaauauaauuggcauaugauucauauuaca

SEQ ID NO: 3196 - RNA, 61 nt, Human
uguaggccaggcuggucucgaacauccugaccucaagugauccaccugccuuggccuuuca

SEQ ID NO: 3197 - RNA, 60 nt, Human
uguauacagaggugacucgcuaccuggacuucaaggugguggagggcagcuuugucuaca

SEQ ID NO: 3198 - RNA, 107 nt, Human
uguauauacaugugugcauguaugugugcauguguguguuaugcuuauguaagugcauggauguggcuguguaugcacaugaaugugcauguacacauguguauaca

SEQ ID NO: 3199 - RNA, 87 nt, Human
uguaucaucauuguuauuucauuagauucucaaaucauaaugcugagugguuuaauaaaauaauccagugguacgaauuaagguaca

SEQ ID NO: 3200 - RNA, 71 nt, Human
uguauuaaauugugugaaauagucucccguggguugauuuguauagacuucauucauauauuuuuucugca

SEQ ID NO: 3201 - RNA, 121 nt, Human
uguauugcagcagguuggcagccucaguaaaucuccauuuguaaaugugacagucagcagaaucuccaguuacagucaacucaaagcaagcaggggcaugccacauacauguucauauaua

SEQ ID NO: 3202 - RNA, 72 nt, Human
uguauuuugacaucauuaugagauuuaaacaaauuccucagugaauguuugguugugauauguuaaccugca

SEQ ID NO: 3203 - RNA, 77 nt, Human
ugucaaauuuguaagcuucauagggauggacaucauaucuauaaugcccuucuauaugugcuaccauagaugugaca

SEQ ID NO: 3204 - RNA, 71 nt, Human
ugucaggcucgggcucuggggccuacaaggagccagccauccucguggggccugagaaccucacccugaca

SEQ ID NO: 3205 - RNA, 68 nt, Human
ugucauccaucuucccuggaagucucccaccggggagugaggugcuugucaggguucacuggguaaca

SEQ ID NO: 3206 - RNA, 78 nt, Human
uguccaguucccauuuugguccucauaaucaaaacagcuuaacaugacagucaucaccaguaauaguggcauuggaua

SEQ ID NO: 3207 - RNA, 83 nt, Human
ugucccaagcaaggauagggaaggggaaugguugagccucuggagaucauuguaaccaacuccugccagaccuguuuggggca

SEQ ID NO: 3208 - RNA, 90 nt, Human
ugucccguucaucaauuucuccucugcagggugagcuguggugcccgcagccaaacuggguuccaguuaggggcaguagaguuggggaca

SEQ ID NO: 3209 - RNA, 94 nt, Human
ugucccuuccaagcuguguuaacuguucaaacucaggccugugugacuccauuggggugagaggugaaagcauaacauggguacagaggggaca

SEQ ID NO: 3210 - RNA, 64 nt, Human
ugucgacauccguggaggauggccagauccccgaggucaucuucuacaccuaggcuguccgaca

SEQ ID NO: 3211 - RNA, 131 nt, Human
ugucggcggggagggaucugacacucaagcugagguucuugcuguugugcuguacccacacacgaaugucauguuuguggagaagaguagcuagugaaugaagccguggugguggaggggggccugaugca

SEQ ID NO: 3212 - RNA, 60 nt, Human
ugucggguagcuggaacuacacagguguguaccaccacaucugguaccaccacacccaca

SEQ ID NO: 3213 - RNA, 71 nt, Human
ugucucagcucaaauggaauauugucgcaccccaugcacugucaguugcaauauuccuguggugucuggca

SEQ ID NO: 3214 - RNA, 74 nt, Human
ugucuccauugagauuaauguggccccugcuuaguucuuacuaaucagaacacuuaauuuacaaucaaaugaca

SEQ ID NO: 3215 - RNA, 97 nt, Human
ugucugaaggaaacauugggaucuucugugauauggaugggaaaugcagucucaucaggaaucauuugguuugggucccuugucuugguaauugaua

SEQ ID NO: 3216 - RNA, 79 nt, Human
ugucugauaaccacacuaauucaucugcuuccagguuacagcuccgucuagcagcaagguugaaaagguuaaaaaggca

SEQ ID NO: 3217 - RNA, 104 nt, Human
ugucugguaacggcaaugcggcugcaacggcggaagaaaacagcccaaagaugagagugauucgcguggguacccgcaagagccagcuugcucgcauacagacg

SEQ ID NO: 3218 - RNA, 84 nt, Human
ugucuuuugccgaaaugcuaaugauuucugugaaaacucacuaggguacaggagacaaucauuuauguuuaagaaaagaaggca

SEQ ID NO: 3219 - RNA, 101 nt, Human
ugugaaacacagccaguuucuuugaugacucaaaacguacuuugugaucuugccaagcuuugagaucaucguuacaagcagcauuuugguugugaaaaaca

SEQ ID NO: 3220 - RNA, 76 nt, Human
ugugaaaguagauuuuuauuacagagcaaauuuuucuaucaauucaaugcuuuaaauaaaacaacauaauaccaua

SEQ ID NO: 3221 - RNA, 70 nt, Human
ugugagagauugggcgaagaaacaacguggcuccuauuuuuggcacccucuucuccuugugauccuuaca

SEQ ID NO: 3222 - RNA, 89 nt, Human
ugugagcccgaguggugugaugccugaggacccacucuucauccuguacaccaguggcuccacaggcaaacccaagggugugguucaca

SEQ ID NO: 3223 - RNA, 64 nt, Human
ugugaucccaaaguuaaccuuggcuaucuauaauuugugauggcagcuauucuuuggguaaaca

SEQ ID NO: 3224 - RNA, 72 nt, Human
ugugaugauuugauucagguauagcccaaauuaguaaggggcuuuagcuguaaacugaaaacaauauucaca

SEQ ID NO: 3225 - RNA, 94 nt, Human
ugugaugggaggaguccucuguaucucagucugauccuggucucccucucggccauggucucacacuagugcugcugggaaaccaucccucaca

SEQ ID NO: 3226 - RNA, 72 nt, Human
ugugcaaggcggaaaggcuggggcagcagcuggagaaucagcucagcaggccuuggcccucccccguggaca

SEQ ID NO: 3227 - RNA, 80 nt, Human
ugugccacugcacuccagccugggcaacagagugagacccugucucuaaaauaaauaaauaggccgggcgcgguggcuca

SEQ ID NO: 3228 - RNA, 75 nt, Human
uguggaaacuuuuggcuguggggaccccauuucacugaugauugaauggguccaccucugucaaaggaauucaga

SEQ ID NO: 3229 - RNA, 108 nt, Human
uguggagaauuaaaaaggguagugaggcuggcauuuauagaaucuggcuuucuuguauuggguggaaagcuagaugaaaccaguuucucucagccuuuucucuccuca

SEQ ID NO: 3230 - RNA, 61 nt, Human
uguggcccagaggugcaaggagcuggguaucaccgcccuacacaucaaacuccgggccaca

SEQ ID NO: 3231 - RNA, 88 nt, Human
uguggcgaguuugacaaugcuggcgccaaugaugaguguggaccgagacccucauugugcucuuuccagauccucaagcccgccgaca

SEQ ID NO: 3232 - RNA, 92 nt, Human
uguggcucugccucccugucucacucucccuauaacuggccucucccugcucagaccuuccuggacgagcugcaugagacagggcagcugca

SEQ ID NO: 3233 - RNA, 78 nt, Human
ugugggaagaugcuggcaaggugcuggagggcccuggaggcaaagggccugccucgaccuugccccccauaacccaca

SEQ ID NO: 3234 - RNA, 71 nt, Human
ugugguacaggaggcugcuuagcaguuuugagauaguuuaaucuacuaaauguggccucagcugugucgca

SEQ ID NO: 3235 - RNA, 102 nt, Human
ugugguccacaaggggagagcaggggacacagcauuggcaggaaccucaaauuccugaccaaacccucuuccacacaaugccucccgaaagaaaggaaccca

SEQ ID NO: 3236 - RNA, 72 nt, Human
uguggucuuaaacuucuguuuuacaaaauccaaaagguaaauacagaagaaaucaauacaauagagauuaua

SEQ ID NO: 3237 - RNA, 65 nt, Human
ugugucccagcuaguucacuccuuucgccgugcgugguggaggcuggccucucuggcugggugca

SEQ ID NO: 3238 - RNA, 64 nt, Human
uguguguguauauauguauguguguauguguguguauauauagauguauauauauacacacaca

SEQ ID NO: 3239 - RNA, 78 nt, Human
ugugugugugugugugugugugucugucugucugucugguagaggcagagaggaauguaaacaaauauuguauaugca

SEQ ID NO: 3240 - RNA, 72 nt, Human
uguguuugcuguuuuccaucauguguuauccuaagaguugggguuuuuuuaaaaucuguuucaccaggcgca

SEQ ID NO: 3241 - RNA, 131 nt, Human
uguuaaauucaacaucucuuguaauugucauuugucuguuuuucaaauaacccaaggauuucuaucagugcauuugaaaggaaccuggggauagcuaucaaguggaaagagagagagaaagaauucauaca

SEQ ID NO: 3242 - RNA, 82 nt, Human
uguuacaagguuagugguccuaagccccgcagugacuguucaucgccagaacagcggguuguaccauuguagccggguuaca

SEQ ID NO: 3243 - RNA, 78 nt, Human
uguuauggcugagggaagcagugauggggguaggcaccacagucuguaaccccuccccuucuaucuuaguacccaaca

SEQ ID NO: 3244 - RNA, 81 nt, Human
uguuauguuauuaaaucaaaacaaaacacaagguacggauuacuucacuguccuuuaucuugauugguuucuuacaaaaca

SEQ ID NO: 3245 - RNA, 81 nt, Human
uguucuccucaucuggaaaauaauuuggcuguauaaucgugguauucaggaaguuagggcagguguuuagguggaagagca

SEQ ID NO: 3246 - RNA, 77 nt, Human
uguucuuggugagaagggccggcggauucgggaacugacugcuguaguucagaagagguuuggcuuuccagagggca

SEQ ID NO: 3247 - RNA, 77 nt, Human
uguugaauuuagggcaaaaugacauguuuauauuuuaaauaaaugaaaucuagucauuaaagagucuuaauaaagca

SEQ ID NO: 3248 - RNA, 82 nt, Human
uguugagaugaggguuucagggaagcagaaaaaccaagugcuggaucauuucuccuuugaggggccuuuguccaauucagca

SEQ ID NO: 3249 - RNA, 72 nt, Human
uguugagugcagaugaaggguuguaugaggccccauccugggagggcuguacaccuucuuggcacagcagca

SEQ ID NO: 3250 - RNA, 87 nt, Human
uguugauggucucauaacugaauauauuaaaaacuuaaauuguauacuuuaaguuggugauuguaugauauaugaguuuuaucaaua

SEQ ID NO: 3251 - RNA, 74 nt, Human
uguugauggugguccgcacauaggagguggcaggcuuccgcuggccggaucuccgcuuaaugaccaccacgaca

SEQ ID NO: 3252 - RNA, 91 nt, Human
uguugcccaggcuggucuugaacucuauaguguuugaucauagaaguggagauacuaaccaaaaaucuuuucaaauuaagccuaauaaaca

SEQ ID NO: 3253 - RNA, 77 nt, Human
uguugcuaucuaucacuuucauguaacaauggacuuaguguccauuaaacugccugagaagugguuugagccugaca

SEQ ID NO: 3254 - RNA, 81 nt, Human
uguuggugacggggcagcuugggggacgaacggggagcagugcagcggccgcccacgucucccggguuauccucgcuggca

SEQ ID NO: 3255 - RNA, 62 nt, Human
uguugucauugcucccuuguguuguacuaaucacgaauacaagguucgcacuuugaccaaca

SEQ ID NO: 3256 - RNA, 83 nt, Human
uguuguuaccugucuuccauaaauaccauaguuaaauguuuugugugcauacauguucguauuugucuauaaagguauugaua

SEQ ID NO: 3257 - RNA, 83 nt, Human
uguuuaguagcagaucuccuuucuugauaguuucuugguacugccaguucuugcuaucaggucuguugguuucuacuauuuca

SEQ ID NO: 3258 - RNA, 83 nt, Human
uguuuaguggcaucagcccuaauccaucugaugcuuuuucauuauuaggcauguuggagacuugggcaaugugacugcugaca

SEQ ID NO: 3259 - RNA, 86 nt, Human
uguuugguacuagacauguuugcuagcugaccaucuacccaacugaaguaugccuuuggucauaagcauuucuuaucuaccgaaca

SEQ ID NO: 3260 - RNA, 92 nt, Human
uguuugugccgucuuuggucugggaggagucggauuggcaguuaucaugggcuguaaaguggcuggugcuucccggaucauugguguggaca

SEQ ID NO: 3261 - RNA, 83 nt, Human
uguuuugcacugacuaguacugaauaauacaaccacucuuauuuaauguuaguauuauuuauuugacaacucagugucuaaca

SEQ ID NO: 3262 - RNA, 62 nt, Human
uguuuuuggcauuauuccaacaugcuuuguuuuaagaagccuugaagggaaugucagauuca

SEQ ID NO: 3263 - RNA, 79 nt, Human
uuaaagaacagcauuugauuugcuuaaacaaaguaguaacagcugaaguuccuuccaaaucacuuuucugauucucuaa

SEQ ID NO: 3264 - RNA, 80 nt, Human
uuaaaugcagauucccaggcccugggccagagcuaccaaaucaaagucucuaagaacaaggccuggaaaucugccuuuag

SEQ ID NO: 3265 - RNA, 79 nt, Human
uuaacacgccugcauugggcaccaaguauccaacagaugaacuucugggggacacauucaaaucguugcgggguauuaa

SEQ ID NO: 3266 - RNA, 60 nt, Human
uuaaccauggacauggaucuucuuuauaauucuaauuugaagugcugucuccauggucgg

SEQ ID NO: 3267 - RNA, 86 nt, Human
uuaacuacuaaaaacuuagaauuaugaaaggcauuugguuaaugaauucuauguaaugagaguaauguucugagauuaguaauuga

SEQ ID NO: 3268 - RNA, 70 nt, Human
uuaagacuccugacccccaaguggcaugcagcccccaugcccaccgggaccuggucagcacagaucuuga

SEQ ID NO: 3269 - RNA, 71 nt, Human
uuaaggaauuaguuuauucauucauuuucauucaaaaggcuaccuacuuugagugucuucucauuccuuaa

SEQ ID NO: 3270 - RNA, 101 nt, Human
uuaaguuuuaggguuauuguaaagauguacagcaguuaaaagagucucuggcacauagaaagcacuauauaaaaguuguauauuauuauuucuagacuuga

SEQ ID NO: 3271 - RNA, 103 nt, Human
uuaaucccuccagugacagcgguggggcagcuguuuuguuucuauuucacagaugagaaaggcggagaggcuccaaaagggcuaaugauuggauggagauugg

SEQ ID NO: 3272 - RNA, 71 nt, Human
uuacacauaaagaaaugacaaccucuggggcuugaaaaagccuccagacaaaguuaacuccuauguuguag

SEQ ID NO: 3273 - RNA, 103 nt, Human
uuacacuugaucuuagccaaaagucugagaagugauuuuauauuauauuuauaaagaucacuuuagcuuucuccuggagacuggauugguagggacaagguga

SEQ ID NO: 3274 - RNA, 106 nt, Human
uuacagauucaaguggaugaaaaggggaagauuguggaugcuagguuuaaaacauuuggcugugguuccgcaauugccuccagcucauuagccacugaauggguga

SEQ ID NO: 3275 - RNA, 75 nt, Human
uuacucugucaccaggcuggagugcaguggugcacucucagcucacugcaaccuccaccuccuggguucaaguga

SEQ ID NO: 3276 - RNA, 96 nt, Human
uuacugacaaaacugggcagcugaaaauaaaagagaauaaauucuauuccacuguaagaaguugauuucuuuucagcuuucuuuguauaucaguaa

SEQ ID NO: 3277 - RNA, 101 nt, Human
uuacugaguauucaccaggugcuggguggagaaagaagacuuaaagauucccuagacaucuccucuccccuagacucaggaccauggcacuuauuuucuag

SEQ ID NO: 3278 - RNA, 107 nt, Human
uuacuguuccauuuugcaacauccugcaacaccauccugggagacaagagcauuaccgagcuuggcuuucacgggggaggguuguauucaguaaaaaagaauaguaa

SEQ ID NO: 3279 - RNA, 81 nt, Human
uuacuguuuauggaaggggagacuuaguaucauaaugaugucaaucuucugcauacugaucacuaauucaaucaacaauag

SEQ ID NO: 3280 - RNA, 93 nt, Human
uuacuuuugaggagagggauaucauugaaggagccuuucgucaaggucucauucgggucuuggcggcaacuucuacucuuucuucugggguga

SEQ ID NO: 3281 - RNA, 80 nt, Human
uuagaaaagugcugccagaaacauccuugccaugcuucuguauguacuggugcuaguguuucuaucagauaaauuuuuag

SEQ ID NO: 3282 - RNA, 72 nt, Human
uuagaaacuauugacuguccauagugguuauugauauuccucucaacccuuuuaagucugauccccuucuaa

SEQ ID NO: 3283 - RNA, 76 nt, Human
uuagaccugcuagccaguauguucccuggugagaaugagcucauagugaaugaccagcuggcuguagcagaacuga

SEQ ID NO: 3284 - RNA, 82 nt, Human
uuagaggaucccugggaggcaggacacuggaggaugacaaagagucuuagggaaaaugcacugaguuugagggauaaacuag

SEQ ID NO: 3285 - RNA, 115 nt, Human
uuagcaccugccuauauuacauucauuuugaugguuuguaucucaaaggaguacagugaacgaaacuuguuuaaagauacaccggaaagaaaaagagaagaggcagaguggcuug

SEQ ID NO: 3286 - RNA, 78 nt, Human
uuagcuggggccuugaagaugaugaagauaugacacuuacaagguggacaggcaugauuauugggccaccaaggcugg

SEQ ID NO: 3287 - RNA, 101 nt, Human
uuaggaggagccgcgggugguggauaugcccaggucauccccauggaggagguaagaccuugaagagaugcgggucagcuaucacuguguuuccuuccuga

SEQ ID NO: 3288 - RNA, 72 nt, Human
uuaguuguggacugauccaacuucgggagauaaggggguaccccccgcucuauagacuccaguuauaacuga

SEQ ID NO: 3289 - RNA, 89 nt, Human
uuauacagcaaacaauuucuucaauuagcagucuagacauuucuauaaacagaaaucuuggacaauugauaauauuucugacuguauaa

SEQ ID NO: 3290 - RNA, 89 nt, Human
uuauaguacaccacuacagacacauaaaaaguugacuuaucuaauuaaaacauuuucccuuccuauguuucuaauucugaaaacuauaa

SEQ ID NO: 3291 - RNA, 111 nt, Human
uuaucucacauccccaucuuacuuuccuacauguucucaaaacacaguaguaccagccuuaccuuucugcuguauguagauagucagaucauccuacugggggugggauga

SEQ ID NO: 3292 - RNA, 60 nt, Human
uuaucuguaagcucucagcacugaucauggccugugggugugcaacaaguuuggggauaa

SEQ ID NO: 3293 - RNA, 77 nt, Human
uuaugaugaaguaucgggagacggguuuucaagaagaaaguccgguauucaggauaucucuaaaguuaucauuauaa

SEQ ID NO: 3294 - RNA, 78 nt, Human
uuauggcagauugauaccugccuggucgcaugaugcaaugaguauuuuuagacgagggaauuauuucaagggccauga

SEQ ID NO: 3295 - RNA, 75 nt, Human
uuauggggacaugagaauuacugcgaaaauaaauagaauguccuuuuguaaaagcagcaauaucaugucuuguaa

SEQ ID NO: 3296 - RNA, 75 nt, Human
uuauggggacaugagaauuacugcgaaaauaaauagaauguccuuuugugaaagcagcaauaucaugucuuguaa

SEQ ID NO: 3297 - RNA, 80 nt, Human
uuauguuauuagguguaaagaaaguguaugcugugccuguuuugguacugcgagcaguucuuccaauucgaugaauauaa

SEQ ID NO: 3298 - RNA, 75 nt, Human
uuauuagugaugaguuauguguuagcggagugucguguuguuauacuaagcguaggagugauucguagauaauaa

SEQ ID NO: 3299 - RNA, 77 nt, Human
uuauucaaaaucaacaucuuggguccgaauuugaacuucuuccaaucucuuggcacuucaaggguuguuaagaauag

SEQ ID NO: 3300 - RNA, 71 nt, Human
uuauugcccauucugggaguguugagcguuuuaaguuugcuaugcuuguaaaaaucaaugaauggcaaugg

SEQ ID NO: 3301 - RNA, 71 nt, Human
uuauuggucugaauucauuuuagguuacuuuaacauuuuaauuuccuguaacuguccaugagagaauauaa

SEQ ID NO: 3302 - RNA, 95 nt, Human
uuauuuacaaugcuagaaauacagacuuaccuuacaucaauuuuguccuaaaccgaauuucucaggauuacugugguuucuuucauucugauuga

SEQ ID NO: 3303 - RNA, 77 nt, Human
uuauuucaaugggauuuauauacacgguauuuuacaauggucagcagugguagaaaguguucguccauucggaauaa

SEQ ID NO: 3304 - RNA, 92 nt, Human
uuauuuccuggcaacugcucucuguaccgacaaaaucuaucccaaggcauugaccuugugauuagauuuacacagagcuuuugcuuuuauaa

SEQ ID NO: 3305 - RNA, 106 nt, Human
uuauuugucaauauguggggauaaccuguagcugcauucaugagguagcaaauagcaguuuuggccuguggggugaacagcuaaacaguguucuggcaucagauaa

SEQ ID NO: 3306 - RNA, 71 nt, Human
uucaaaaccagaagcagucgagacauaggacaaccuagcaguuggccuuauaaguggcucuuuguuuugaa

SEQ ID NO: 3307 - RNA, 110 nt, Human
uucaaaauguucacuuuuaacacaaagucuucccauaaaaaauguggcuacauuuuccccccaaugacuacauacauagauggguagcagcaagaaaagaugaaaaugaa

SEQ ID NO: 3308 - RNA, 65 nt, Human
uucaagaauguuagaaguucaagccagaaguuucuuucaggguuuuggucuaucucauuugggaa

SEQ ID NO: 3309 - RNA, 71 nt, Human
uucaauuguaugcugggaagcgggagguagugauuauaccuucucccaaaucuuucuagcacacuaaugaa

SEQ ID NO: 3310 - RNA, 65 nt, Human
uucacaaugggguggucaagggugaucuucagguggcuuuugggcaucauauaccccauggugga

SEQ ID NO: 3311 - RNA, 78 nt, Human
uucaccugaucuccagaaggccucgaaauccaccuaucgacuaauaccggauuuaagcaaggcaaaggagauagugag

SEQ ID NO: 3312 - RNA, 78 nt, Human
uucacuucugauccagcacuucugucauuugcugaauauuucugcaagccaacugugaacaugggucagaaacaggaa

SEQ ID NO: 3313 - RNA, 67 nt, Human
uucacuuucccguggaagguucaggaagcgacaccguuguuaucaggggcccuuccucggaugugga

SEQ ID NO: 3314 - RNA, 74 nt, Human
uucagacccucgaggauucggucauaugggaauugcuguuccugauguauacagugcuuguaaaacgguuugaa

SEQ ID NO: 3315 - RNA, 71 nt, Human
uucagcaagguucuggcgcaggugcagcacccccugcugcauuaccucagcguucacaggccugugcagaa

SEQ ID NO: 3316 - RNA, 83 nt, Human
uucagcauaacguuuauggacaaaauguauauaguauaucuuauauucuauauguauuuuaucacauaguaaggaaugcugag

SEQ ID NO: 3317 - RNA, 76 nt, Human
uucagcauuuaggggguuccuggugagggcucaggagagaucugggcccagagccagccacacuccuuguguugag

SEQ ID NO: 3318 - RNA, 87 nt, Human
uucaggaaguacaagaagauaauaaggguucuucuaucacgaaaggggaagaggccuaaaaauuccuucgcauuguaaauucaggaa

SEQ ID NO: 3319 - RNA, 79 nt, Human
uucaggggcagcgaagaagaugauacgucaugcuucccggucaagggcagcuggcgcaaucuugcagcugagaucugaa

SEQ ID NO: 3320 - RNA, 101 nt, Human
uucaguauagcaaggugcuagguuuuuuccuuuccccaccugucucuuagccuggggaauuaaaugagaagccuuagaauggguggcccuugugaccugaa

SEQ ID NO: 3321 - RNA, 81 nt, Human
uucaguggcauugggccuuggcugggaugcugaguuauccacuggagcaucggcaguacaggcaggcacagaggcagugga

SEQ ID NO: 3322 - RNA, 78 nt, Human
uucaguucucgaggagaaaagauccuuauggcagaugcugauggagccacaaaguuuccagauguugagaacuuagaa

SEQ ID NO: 3323 - RNA, 81 nt, Human
uucauccauuucuguauuuguauccauuucuguauccccagugcuucauacaguaggauuuaauauaugcagggugaugag

SEQ ID NO: 3324 - RNA, 72 nt, Human
uucaugggggccagcagcuucacagugcugcguugcaccagcuuugcacuggagagcugugcccacccugaa

SEQ ID NO: 3325 - RNA, 105 nt, Human
uucauguuuuuguauuauguaucuuuuuguaugguaaagacuauauuuuguacuuaaccagauauauuuuuaccccagauggggauauucuuuguaaaaaaugaa

SEQ ID NO: 3326 - RNA, 69 nt, Human
uucauucccuuggguagacaaaauccaacauucaacgacaguuggagguauacaccaagcggaggugaa

SEQ ID NO: 3327 - RNA, 90 nt, Human
uuccagggcccggggccgguggggcuuucggcucgaugggcggcaaggacuucgagcagccucucgccauuucccgcgucacuccuggaa

SEQ ID NO: 3328 - RNA, 97 nt, Human
uuccaguguuucaaagaaagcacuuuuaaaaauguauauacaugaaugaacauuucauuauaucauaaaauaaaugcugcgcuguaagauaaaggaa

SEQ ID NO: 3329 - RNA, 116 nt, Human
uuccauucagggacuugauacaaaaaauuuaguuugaacugcuauuagcagguggcaggagccaccuucaaaugaaucuucaaauuggaaaauacugcuucaccaccuguugggga

SEQ ID NO: 3330 - RNA, 71 nt, Human
uuccccggcaagguuuuauguacauauguagucuuucuuuauccuacuuuaauacucauuuugcuacagaa

SEQ ID NO: 3331 - RNA, 102 nt, Human
uucccucacguuugucacccaguccuucugucuuuuaaauuguucaccguagcauccaguagacuauuaaaauagcggaguggaaguuggguuaagagggag

SEQ ID NO: 3332 - RNA, 86 nt, Human
uucccugagacucuuuaacuucuugaaaaaaguugaugcuguuuuauuugaaaaaucgucaagacuauuaaaaggcaaauagggga

SEQ ID NO: 3333 - RNA, 62 nt, Human
uuccgccggccuguuggcaccgcaacaggggaucccuucccagcgaauuacaggcggcggaa

SEQ ID NO: 3334 - RNA, 97 nt, Human
uuccuaaugcacagucuugagucuugcagggcaggcuuguuaaggauuugguuucuaacccuccccucuccagggugaacucaagcugucauaggag

SEQ ID NO: 3335 - RNA, 73 nt, Human
uuccuacgguuuguccacaacuuccagagcugaagaguagcucaaggacaucaaagggcagaggcccuaggaa

SEQ ID NO: 3336 - RNA, 71 nt, Human
uuccugcgcucuacgguuuuccaugcccccuccaguuugggggucuaaaccaaacaggaaaggugcagggg

SEQ ID NO: 3337 - RNA, 80 nt, Human
uuccugcucuuuaacuuucuggcuuuggggagagguaggcaacucuucuuugcagaaauagaaaggccgaagagggggag

SEQ ID NO: 3338 - RNA, 100 nt, Human
uuccuuuuaccuuaccaggguaggacucuaaucugauuaugggucauaagacucuuguucgaaucagagaggguccugccucauccucugggggaaggaa

SEQ ID NO: 3339 - RNA, 85 nt, Human
uucgcuggcucgcaaaucacauuucaucaagcucagaugacuuauuuggcaugugggcucgugcaggaugucaugcagaagugaa

SEQ ID NO: 3340 - RNA, 79 nt, Human
uucggugcuuuuaccuaccuacaacgagcgcgagaaccugccgcucaucguguggcugcuggugaaaagcuucuccgag

SEQ ID NO: 3341 - RNA, 100 nt, Human
uucucaaccagcaaugcgacuagacaagaugguggccacgucaugugcugggcgcuguguguguggacccauguugaccuugagcguugucgguggagga

SEQ ID NO: 3342 - RNA, 92 nt, Human
uucucagaugggcgggugucugucucugcucgaauugacagaaaaggauucugugaaggugaugagauuuccauccaugcugacuuugagaa

SEQ ID NO: 3343 - RNA, 101 nt, Human
uucucugcugcugggcuaccacacaaugagauugcagcucagaucugucgccaggcugguuugguaaagaaauccaaagauguaguagacuacagugagga

SEQ ID NO: 3344 - RNA, 91 nt, Human
uucugaaaacuuuaaguucaguaauaugccagggguucccaagaccacuugagaccugguaauuuauuggaagucucuaagggaaucagaa

SEQ ID NO: 3345 - RNA, 85 nt, Human
uucugaacugugacacuuucucagucuuuucuuaaauuucaugaccuugagaacuuugaagaguacugguuaguguuuuguagaa

SEQ ID NO: 3346 - RNA, 128 nt, Human
uucugcaccacuggcauggauggcggcaugaguaucugggaugugaagagcuuggagucagccuugaaggaccucaagaucaaaugaccugugaggaauauguugccuucauccuagcugcuggggaa

SEQ ID NO: 3347 - RNA, 79 nt, Human
uucugcucuguucuuuguuuuauguuuaacugcuguuucuaauugcagguguauuacagauacaaauaagaguacagaa

SEQ ID NO: 3348 - RNA, 82 nt, Human
uucugguagcaggaugggauggagaaagagacuguguuccaaguauugauauguuuguuuucucaucccaaaauuaucagag

SEQ ID NO: 3349 - RNA, 99 nt, Human
uucuuaaugaaauuaugaaggaagaaaggcaguucucugaaagaaguuuauccaauuaucaauaagagaauaauguuuucuucuggguuuaauuaagga

SEQ ID NO: 3350 - RNA, 75 nt, Human
uucuuauagucuccuaacauuugucucuagccuuugccuuuguacaaucacagauauccuauggagauuuaagga

SEQ ID NO: 3351 - RNA, 66 nt, Human
uucuucccuguuagggagagcugagggcagcugccacugagucuccugucccugagaaggggagga

SEQ ID NO: 3352 - RNA, 89 nt, Human
uucuucuuucuucaaauaucaccauugauuucuguggauauccuuagggugacacucuggaaaucuuggaugaaaguuaggaaguagaa

SEQ ID NO: 3353 - RNA, 66 nt, Human
uucuugggcuaacaguagagcugaacuuuuccauaucauguuuagagaccacugguagccuaagaa

SEQ ID NO: 3354 - RNA, 80 nt, Human
uucuugguaauuuugcagcacgucagcaucaauaucgucauagauacucaugcugucagcacuugcaacgguauuaaggg

SEQ ID NO: 3355 - RNA, 75 nt, Human
uucuuuggcuucacucucacaaacuccuugaauuucuucucuuuauucuuuuccuugucuuuuguaguuggggaa

SEQ ID NO: 3356 - RNA, 73 nt, Human
uucuuuuuaggguguuaaucuuuaugugaaaaaucuugaugaugguauugaugaugaacgucuccggaaagag

SEQ ID NO: 3357 - RNA, 102 nt, Human
uugaaauggggucuuacucugucaccaggcuggagugcaguggugcacucucagcucacugcaaccuccaccuccuggguucaagugauucuucugccucag

SEQ ID NO: 3358 - RNA, 67 nt, Human
uugaacccaggaggcggagcuugcagugggccgagauugcgccacugcgcuccagccugggcaacag

SEQ ID NO: 3359 - RNA, 104 nt, Human
uugaagccagagcaaguauguccuucaucagguaaucaggaacucuucaguugaagcugaggaacuaacugauuaguuguugaucauaauauaauugguuacaa

SEQ ID NO: 3360 - RNA, 78 nt, Human
uugaauugauaauuagaauauugaauaagcaauccuaugauccacuaauuuguuuuaucaguuaauaauauuaaucaa

SEQ ID NO: 3361 - RNA, 79 nt, Human
uugaccagccggaaagcauuggggaugacggccgacagcagggugguguggaugucacccaggacuuuccggaaggcaa

SEQ ID NO: 3362 - RNA, 74 nt, Human
uugagaagcgccgacgagaccggaucaauaacaguuugucugagcugagaaggcugguacccagugcuuuugag

SEQ ID NO: 3363 - RNA, 104 nt, Human
uugagacacagucucgcucugucacccaggcugcggugcaguggugugaucuuggccucacugcaaccucugccuccuggguucaagugauucuucugccucag

SEQ ID NO: 3364 - RNA, 109 nt, Human
uugagacagacagggucuugcucuguugcccaggcugggaaugcaguggcgccaucuuggcucacugcaaccucugccucccggguucaaggcaagucuugcgucucag

SEQ ID NO: 3365 - RNA, 103 nt, Human
uugagacagagucuugcucugucacccaggcuggacuccaguggcacaaucucagcucacugcaaccuccgccuccuggguucaggcaaaucuccugccucaa

SEQ ID NO: 3366 - RNA, 104 nt, Human
uugagacagaguuucgcucuuguugcccaggcuggagugcaauggugcgaucucagcucacugcaaacuccaccucccggguucaagcgauucuccugccucag

SEQ ID NO: 3367 - RNA, 101 nt, Human
uugagacagucucacucuguugcccaggcuggagugcaguggcguggucuugacucacugcaaccuccaccucccagguucaagcaguucucaugucucag

SEQ ID NO: 3368 - RNA, 103 nt, Human
uugagacggacucucgcugugucacccaggcuggaguucaguggcaugaucucagcucacugcaaccucugucuccuggguucaagcgauucaccugccucag

SEQ ID NO: 3369 - RNA, 104 nt, Human
uugagacggaguuuagcucuuguugcccaggcuggagugcagugguacgaucucggcucacugcaacuucucccuccugguuucaagcaacucuccugccucag

SEQ ID NO: 3370 - RNA, 102 nt, Human
uugagacggcgucuugcucuauuggcaggcuggagugcaguggugcgaucucagcucacugcaacccccgccucccagauucaagcaauucuccugccucag

SEQ ID NO: 3371 - RNA, 103 nt, Human
uugagauggagucucgccgugucgcccaggcuagagugcagugacgcaaucucggcucaccgcaagcucugccuccuggguucacuccauucucccgccucag

SEQ ID NO: 3372 - RNA, 103 nt, Human
uugagauggagucuugcuuugucacccaggcuggagugcaguggugugaucuccacucacugcaaccuccaccucccagcuucaagugauucuccugccucaa

SEQ ID NO: 3373 - RNA, 79 nt, Human
uugagugugcagcucacaacagacaucaggaucacuguccaggaguguccuggguuaaccuuuguuggcugggccucag

SEQ ID NO: 3374 - RNA, 92 nt, Human
uugaguguuugauaagaguagcauuagguauuagugggaaaugauuggauuuuucauuuaagcauuguugggacaacuuguuaaccauuugg

SEQ ID NO: 3375 - RNA, 76 nt, Human
uugaguucauaaucuggucaugugggaauugcuaucuuugugauuuugauuauuucuuccagauuauuuuauucaa

SEQ ID NO: 3376 - RNA, 93 nt, Human
uugauacaaagcuuaaaauucugcauauggucauagaaaaugcauauugguuuguguuuuuaucacuugcuuccaacuuaggcuuuggcucag

SEQ ID NO: 3377 - RNA, 114 nt, Human
uugaucucuuggcgaucuucuucuugcccauggcagcugucacuuugcggggguagcggucaauuccagccaccagagcauggcuguaggggcgaucugaggugccaucaucaa

SEQ ID NO: 3378 - RNA, 91 nt, Human
uugauuuucauuaauccagagcugcagcaccagagauaauuucaaucaacucuuuugugaugacagcuuggcggguacgguugaaugucaa

SEQ ID NO: 3379 - RNA, 100 nt, Human
uugcaauuauuugaggaacuccgccgccuggcgcccauuacacagcgaccccacagaagccaccgcgugggugccguggaggccucuucaagugcugcag

SEQ ID NO: 3380 - RNA, 72 nt, Human
uugcaggaauugaagcuuuuacagcuggagacugagaaguaggcaucuguacuguaaaccuuugaccuguga

SEQ ID NO: 3381 - RNA, 91 nt, Human
uugcagugguuuuagugggugaaaaugucccaucugcaccaguacacaggcaggcauuaucauucuucaccuacuuuuuaaauaguggcaa

SEQ ID NO: 3382 - RNA, 74 nt, Human
uugcauuuccagaauucugaguuaaagaaacaaaguguuugcuuuguaacaggccaaaauucuauuuccugcaa

SEQ ID NO: 3383 - RNA, 100 nt, Human
uugccccaaccccaagguaauggucaucuacuuugcaaccuauggagauccugauagcucccauacaaagugagguacacuguugccaauuuggaggcag

SEQ ID NO: 3384 - RNA, 76 nt, Human
uugcccgucaacaaaaaucaggcauguucugugaaagucagcauggcuuccaucucagacauccuuuucugugcaa

SEQ ID NO: 3385 - RNA, 81 nt, Human
uugcgcuuuccuuucugucaagaagcaguuugaagaauuaacccuuggugaauuuuugaaacuggacagagaaagagccaa

SEQ ID NO: 3386 - RNA, 60 nt, Human
uugcggcauccacgagaccaccuucaacuccaucaugaagugugacguggacauccgcaa

SEQ ID NO: 3387 - RNA, 86 nt, Human
uugcuccaaaacaccagagaagugcagaaugaggagcugccaugcucaggcagucauucugcaugauucuuauucuacaggaggaa

SEQ ID NO: 3388 - RNA, 105 nt, Human
uugcuggaucugucuguggcuauuuuuuuccauguuuuucucacucaagcaaagucuguuaguggaaacaugggcugggggauggggagaggacagauaaagcaa

SEQ ID NO: 3389 - RNA, 106 nt, Human
uugcugguuaauucuggauugugaaucuccauguaucuuugggaccugucagccguggcagucucccuuccuagccauggaagagcauauccuuguuuauuggcaa

SEQ ID NO: 3390 - RNA, 74 nt, Human
uugcuguugccuaggcuggagugcaguggcacaaucauagcucacugcagcuucgaacuccugggcucaagcaa

SEQ ID NO: 3391 - RNA, 91 nt, Human
uugcuuccucuugagugcaacggaaagggcuaucagauaucugcacguuugugagauuuauagcuccuccauuacacuucuucauaagcaa

SEQ ID NO: 3392 - RNA, 76 nt, Human
uugcuugaaccuaggauuuggagguugcagugagcugagaucaugcuacugcacuccagccugggcaacagagcaa

SEQ ID NO: 3393 - RNA, 60 nt, Human
uuggaaaagguucuagggcagggaaaaugcacccauuuccccuuuucccuuuuuuuccaa

SEQ ID NO: 3394 - RNA, 89 nt, Human
uuggaaugaguuacagagauaucgauaugaguacaaugagagagaagguacuuuagucauauguugauaaaaacuuguacaucacccaa

SEQ ID NO: 3395 - RNA, 86 nt, Human
uuggacagggacgacauucaggagccaaacaggccgcaagagcaacuggcagauccaaggucccguggaugacugucuuugaacaa

SEQ ID NO: 3396 - RNA, 87 nt, Human
uuggaccuaaguguaacuccuucaugcacuaaacuggacagagccaugcugucuagucuugaaguccucauuuacacagagguucag

SEQ ID NO: 3397 - RNA, 75 nt, Human
uuggagccaggagccugccaugagguuuugagaacagagugcuguuuuagagcuggcagcagcaucucagcccaa

SEQ ID NO: 3398 - RNA, 65 nt, Human
uuggaggggagcguggggagggcgagugcugguaaaucucugcaccucacccugaucuccuccaa

SEQ ID NO: 3399 - RNA, 72 nt, Human
uuggauggguccugugggaggagcaccucaaaccgaauauggaguuuucagccaaaaagagcccacuuucaa

SEQ ID NO: 3400 - RNA, 80 nt, Human
uuggauguggcuggcucacacucuagaggacaaucuguccuacucaaaguccauggagcuaaaaguugauuuucauccaa

SEQ ID NO: 3401 - RNA, 72 nt, Human
uuggcacagcuauuuccagacuaauccugaguccuauuuauaggcugagaugauuagguuggccugugucag

SEQ ID NO: 3402 - RNA, 77 nt, Human
uuggcauggacuaguucaaguaucagugccuccaucaauguuuuuacaagucacuaaauacugaaaguccuugacaa

SEQ ID NO: 3403 - RNA, 86 nt, Human
uuggccucugggacucagauuccuccucuuuaaaauggugcuaauaauagcacccacccucugugaggaggaugcugugaggacaa

SEQ ID NO: 3404 - RNA, 71 nt, Human
uuggcuccacaaggaggcucaccagcucuucuuggaaccugaggugcuggacccagagucuguggagcuga

SEQ ID NO: 3405 - RNA, 84 nt, Human
uuggcucuguuguuccuuuuuuaauuccccagggucuagcaucucagagacacuuguggaaugaauucauuaacgacuggcuga

SEQ ID NO: 3406 - RNA, 109 nt, Human
uugggcugcaaucacacaaugggugcaucaccagugcggacaccuaggcguacagggaaccauggcuuggggaguguaaagaaggauguuaccccaggaugcaguucag

SEQ ID NO: 3407 - RNA, 82 nt, Human
uugggggagaacugccauccuaaaaauauuaaaucuuuucaaaauaucaacauuuaaugucuuuccauuuaguuuccuuuaa

SEQ ID NO: 3408 - RNA, 64 nt, Human
uuggguaauccacuuaguuuccagguaacauacguaagaauguccacuggguuggaaaccccaa

SEQ ID NO: 3409 - RNA, 93 nt, Human
uuggguccuaguaguaccaaagugcucauagugcagguaguuuuggcaugacucuacuguaguaugggcacuuccaguacucuuggauaacaa

SEQ ID NO: 3410 - RNA, 103 nt, Human
uuggugaaaccccgucucuacuaaaaaauacaaaaauuagccaggcauggugaugggcgccugucccaggcuguuuuuauguuauguggggaugaggcacuga

SEQ ID NO: 3411 - RNA, 82 nt, Human
uuggugguuguuguuaaaguggccuuuaaaaagggguucacucugcuaaaaggaggcucauccugauaauugcaaucacuaa

SEQ ID NO: 3412 - RNA, 75 nt, Human
uugguguagacuccaggccuguucuucugggcacagcauagccccaggagacaauuccuuggagcucuccauugg

SEQ ID NO: 3413 - RNA, 80 nt, Human
uugguuagguaguggaaccuucuaaaugacgcacuaugugauuccugugucauauagaauguucuaugauucuuagccag

SEQ ID NO: 3414 - RNA, 71 nt, Human
uuguaccaugaacugacagaccuaccagucaaauucauguacccagauaauggucucucacauggcaacaa

SEQ ID NO: 3415 - RNA, 62 nt, Human
uuguauaguaauguuucagaccaucauccagcuuuggcugcugaaaucauacagcugugcaa

SEQ ID NO: 3416 - RNA, 71 nt, Human
uugucacauaugccacuguggaggagguggaugcagcuaugcaugcaaggccacacaagguggauggacag

SEQ ID NO: 3417 - RNA, 86 nt, Human
uuguccuucauauacugcuccugaaaaaugcucaagucuuccaaaaccauucaucuugucaucuuuccagcuuccuguguagacaa

SEQ ID NO: 3418 - RNA, 62 nt, Human
uugucucaaaguuaugccuaccuggcucguaggaugccaacguuaggagugaaaauagucaa

SEQ ID NO: 3419 - RNA, 62 nt, Human
uugucuucaggacugcucuguuccaguauuuuugcugucauacaguacaugucccagagcaa

SEQ ID NO: 3420 - RNA, 71 nt, Human
uugucuuccuaaugcuaccuuuguugguccuuucuuccuuaagugccaagugcugagcuaaaggaggauaa

SEQ ID NO: 3421 - RNA, 66 nt, Human
uugucuucuaguacagucugcaggguucaccuuuucccugacucagucuucuccuaagagugacaa

SEQ ID NO: 3422 - RNA, 82 nt, Human
uugucuucuguagacuagacugggcauuaguuccuuaauaagagaggcaaugagugcaauauaauagucaugaagagggcag

SEQ ID NO: 3423 - RNA, 76 nt, Human
uugugagaucgaucuguccuggcaguuaacacgaugugcaacaguguguuagcauggaacagaacgcuuuucacaa

SEQ ID NO: 3424 - RNA, 107 nt, Human
uugugcaugggaagauuguaguuacucuugagggaagcggauuuacgccaaagugcgguacaaauucaucuaacuuccaggaaagcacuuucaguccauaugcacaa

SEQ ID NO: 3425 - RNA, 73 nt, Human
uugugcgccucuuaucaagucagcacacaccuuuuccaaggauuuuacguugcggcuuguuagggugauucga

SEQ ID NO: 3426 - RNA, 91 nt, Human
uuguggauauugaaguuugaagccuguuguucaucuauagaugcacuggaugggauuggaagucuucagauuucaguaggguuuuccacaa

SEQ ID NO: 3427 - RNA, 82 nt, Human
uugugucuuacuaaagcagcuuauuguagguguggcguucuaaaacguuuccugccugcgaugguucacaaaauaaacacaa

SEQ ID NO: 3428 - RNA, 109 nt, Human
uuguguucaacaguuaaucaaaaccagagagucuagggcagccucucugaugucguccaugauguacauucagucccugguuucucuacuuuucugucugaugucacag

SEQ ID NO: 3429 - RNA, 75 nt, Human
uuguucauaaucccaaacaagggcccugcuggcagcaacaggacagguggggccaggacagggaagcuggagcag

SEQ ID NO: 3430 - RNA, 76 nt, Human
uuguugaagggcagugaagguagguuucagguuugguuuuacaaaccuguuaacuaccuccuguccagcuugacag

SEQ ID NO: 3431 - RNA, 71 nt, Human
uuguugcccaggcuggagugcaauggcacgaucuuagcucacugcaaccucugccucauggguugaagcaa

SEQ ID NO: 3432 - RNA, 106 nt, Human
uuguuucggacuauagagugcugauggcagagauuggugaggauuuggauaaaucugauguguccucauuaauuuuccucaugaaggauuacaugggccgaggcag

SEQ ID NO: 3433 - RNA, 65 nt, Human
uuguuuggaggguguuguggucuccaaucccggcuugacggggcugcuaucugccuuccaggcaa

SEQ ID NO: 3434 - RNA, 85 nt, Human
uuuaaaaaaauaccacugugagaauaaagcgcuaguaagauacaucacuuacugauuuuaaaaauacagaaagauuuugaguaaa

SEQ ID NO: 3435 - RNA, 76 nt, Human
uuuaaaaaucuuacuucucgugacaguccuacaugaaaaauuaaaaaucacaaggauucauggauggaaaacugag

SEQ ID NO: 3436 - RNA, 75 nt, Human
uuuacugagcgucuacuuugggcccgacacuuuucuagguacaggagauauggcagggaacaaaugccaagugaa

SEQ ID NO: 3437 - RNA, 105 nt, Human
uuuagaaagaagaggcacaucuugauaacaugcugagaacugaggcaacugaugucuuuaggcucuuauagucccagcauguuuuuaagagcuacugaauuugaa

SEQ ID NO: 3438 - RNA, 73 nt, Human
uuuagauuucuggugguaaauauaaaugaguuucauuuuaaguaaacucauuuugugggauuugagauuuaaa

SEQ ID NO: 3439 - RNA, 95 nt, Human
uuuagcaguacaaaaucuuugacuaugaccaugggacacagacaugaguuuauguuuugguuuguuguggucuggggaucauguacuuuucuaaa

SEQ ID NO: 3440 - RNA, 93 nt, Human
uuuaguaaggucaguuugauuggauacuuaaguuuuagaaaugagaaaaauacagaguuuuagaaaugagaucuagagaacacgucuucuaaa

SEQ ID NO: 3441 - RNA, 83 nt, Human
uuuaguuccucaggaacagagaacuuugcaaugaugaucucaacucugcaucaucuggugacuccugauucugcaggacuaag

SEQ ID NO: 3442 - RNA, 79 nt, Human
uuuauaaaacuuucauugucaggugaaccagugugcaagcccacaguacgcagcacaacugucaaugcaggucaaugag

SEQ ID NO: 3443 - RNA, 119 nt, Human
uuuauggcuuagaguccuccugucuucccuuuucaccccucuagucccuccuccguccauuucuugaagggaacuaugagugugauagaagguggaguggggauucccuguggccugaa

SEQ ID NO: 3444 - RNA, 74 nt, Human
uuuauugacuacuuuaaguagaacaaacuaaauacauauuuaacaguuuugguucauuuauacaguacauuaaa

SEQ ID NO: 3445 - RNA, 103 nt, Human
uuuauuuugauuuguuuucggccacaaugaguccuuuagugccauuguggacucacaaugcacauggacaucaggcugugaaugaagacagaggcaguuuaaa

SEQ ID NO: 3446 - RNA, 76 nt, Human
uuuauuuuggccacauagaucaaaguuaguuucagucuuuucaagcucuaaaauuuugguucugugguuauuuaaa

SEQ ID NO: 3447 - RNA, 105 nt, Human
uuucaacuuccugaaguugaagagcgaauuccauuucuucugaacugaaaggaagacuucacaaggagaaucuggaauuuguccuuucgauuuuuuaguuagaag

SEQ ID NO: 3448 - RNA, 77 nt, Human
uuucaauaaaaguuaugcacaaaugugaacaccugagauggagcugaacauuucuucacuuuguucuuuuucugaag

SEQ ID NO: 3449 - RNA, 83 nt, Human
uuucaauuugacaauguccggcccuugaaauuucauacccggugggaaaauuuuaaauggccgggaccuugguugguuugaga

SEQ ID NO: 3450 - RNA, 87 nt, Human
uuucagaugugcuucgcuuuugaaugucuguaucuaacuaaugagggaugcaaaauaaccaagaaguuaaaagcguaagaucuggaa

SEQ ID NO: 3451 - RNA, 66 nt, Human
uuucaggaguuggagaacggaguacauuuuuaaaauuuuuuguuccauucugaucaacuaaagaaa

SEQ ID NO: 3452 - RNA, 84 nt, Human
uuucaguucuuuacguauugucacccagagaacaguguucacuaaaaacauuauucccacugccagauagaaaaggacaugaaa

SEQ ID NO: 3453 - RNA, 124 nt, Human
uuucccacgacacgauguucccuuucuacagcugcuggaggacuggacugcuacuacuacuccuggcuguggcagugagagaauccuggcagacagaagaaaaaacuugcgacuugguaggaga

SEQ ID NO: 3454 - RNA, 64 nt, Human
uuuccccuuaaauuggucagcauagugccccauuuuggggcauccuucaucuggacaagggaaa

SEQ ID NO: 3455 - RNA, 81 nt, Human
uuucccgcgucacuccuggaagcaaggcggcucuagcuaauuuauguauuggagauguaaucacagccauugauggggaaa

SEQ ID NO: 3456 - RNA, 72 nt, Human
uuucccuaaaucaaaucaauauuaauugugccuuauuucacuuaacauagacuugaauuauuuuuagggaaa

SEQ ID NO: 3457 - RNA, 126 nt, Human
uuuccgggucuguuccuccuugagccguuucaaaacagcuuugugcucacucuuugggguagucuccagcaggugauuucuuaaugcuuuguacugucugguuuggauuuugcagguauccugaaa

SEQ ID NO: 3458 - RNA, 69 nt, Human
uuuccucaagagugcauuccagaaggggaccugcuauucuucgaggggaccugcuauucuucgagggga

SEQ ID NO: 3459 - RNA, 72 nt, Human
uuuccuuuuucuguaggccgccuuaagcuuucuaaauuuggaacaucuaagcaagcugaagggaaaaggggg

SEQ ID NO: 3460 - RNA, 113 nt, Human
uuucuaacacuggccucagcacuaguucccugagacuuccuuagguugucauggaaaccagccacaccuggagaggcaucagggcccacugggcuuguggugggaucgagaga

SEQ ID NO: 3461 - RNA, 113 nt, Human
uuucuacugguggaccacuucagacagaggagagagacucuaucucuuuuauuugccuaauuuaagugucugagaaacagaaucuccuuuguucugcuggacuguaauggaag

SEQ ID NO: 3462 - RNA, 82 nt, Human
uuucuauagagaggcuuucacuuuugaguucuuugaguuuaaagauugcuuuucuugaaaugcucuuuuuuuaauguagaaa

SEQ ID NO: 3463 - RNA, 79 nt, Human
uuucugaacguggugggauucccgcugaaccacuucugcaagcagcuggugaagcucuacuacccgccccguccggagg

SEQ ID NO: 3464 - RNA, 85 nt, Human
uuucugauggcugcuaugugucugacacugugccaugaucuguaggagaaacaagugaacaggggacaaucucagccuuuaggaa

SEQ ID NO: 3465 - RNA, 61 nt, Human
uuucuggguacuuacgguccugagucucaaguucgucuucgagaugcuguugugccagaag

SEQ ID NO: 3466 - RNA, 86 nt, Human
uuucuguucacaccagcuuguuucaguuuaguauauuucuuucugucuacauuuauacuuacugauaaauucacugugaucaggaa

SEQ ID NO: 3467 - RNA, 75 nt, Human
uuucuuuauuggcacuaguauaaaacagagcagaucaacuggccucucggucuguacaaaguguggggcgugaaa

SEQ ID NO: 3468 - RNA, 85 nt, Human
uuugaaaagaacacuuuuuggggcagccuucaaaaagguucauacauaccaacgggcuuucuuaaaauuggguucuaauguuaaa

SEQ ID NO: 3469 - RNA, 104 nt, Human
uuugaccaggagaucugagauugaugcugggacugcugcugagauccagaggaucaacaagcucauagcagcuuccucagcaccaugagaucuggauuguuaaa

SEQ ID NO: 3470 - RNA, 93 nt, Human
uuugacccuuuugagauggaacuuucauaaaguuucuuggcaguaguuuauuugcuucaaauaaacuuauuugaaaaguugucucaagucaaa

SEQ ID NO: 3471 - RNA, 77 nt, Human
uuugagguggaugggucuucucuuuuuugggguuuccagcucacugggacucucagaccuuaccuuuccagcucaaa

SEQ ID NO: 3472 - RNA, 85 nt, Human
uuugaucgaggagcgcgguuaccggacgggcugggucuauggucgcuccgcgggccgcuccgccggcuggugcuuuuuuaucagg

SEQ ID NO: 3473 - RNA, 77 nt, Human
uuugcacuaagucauuugcacucguuggaguuguggagacggccuugagucucaguacgagugugcgugagugugag

SEQ ID NO: 3474 - RNA, 83 nt, Human
uuugcagcuaacuacuauguguagacagguuuuauauuauaaaguaugcauucuuaucaccuaguauauaguuaguuuguaga

SEQ ID NO: 3475 - RNA, 117 nt, Human
uuugcgcuauuaaaggcaagcugauauaaauuagaacucuucugaaugggccuucuauauuuaaaugggcuuuuucuaggaaguguauauuuguaaacuugucuugaauggaaaaaa

SEQ ID NO: 3476 - RNA, 71 nt, Human
uuugcuauagacaaggggucugaaaacuauggccugugguucaaauccaaccccuugucuguuucugcaaa

SEQ ID NO: 3477 - RNA, 98 nt, Human
uuuggaaggaaagcaaguauauagaucaagcuguauuaaaaugaaagugcagagauagucuuagaaugagaauauaaagugcuuuuuuuaaauccaaa

SEQ ID NO: 3478 - RNA, 52 nt, Human
uuuggaguaauucaguauagguucguuuaaaagagauuuuuauaacuucaga

SEQ ID NO: 3479 - RNA, 71 nt, Human
uuuggauguauaauaguuuagcaagauguuacuuuuguaagacaucagauguucaaaaaagugcauccgaa

SEQ ID NO: 3480 - RNA, 68 nt, Human
uuuggcuuccuuuuauuucuugaggauuacaugaaacgugaacuauacaggaaaguauggcagccagg

SEQ ID NO: 3481 - RNA, 84 nt, Human
uuugggacauaugcaugcggaaugaggcuguuggacgagaacugcucauuuucuuggcccaguaccuaugcaacgaauaccaga

SEQ ID NO: 3482 - RNA, 63 nt, Human
uuugggccgcccucggcccccagaaaaguuuuucaaaaccucuuuugggcgccgggccccaga

SEQ ID NO: 3483 - RNA, 68 nt, Human
uuugugccagauauuggagauaaaaaggucagugaggcaugaccuuuggguucacauucuggugggag

SEQ ID NO: 3484 - RNA, 81 nt, Human
uuugugcuauuuuaucacaggcuuacacuacaauuguuaauaaauacuucauuuggagauguaugguguaaaacacacaaa

SEQ ID NO: 3485 - RNA, 70 nt, Human
uuuguggauauagugauuucugccaucaugcaggguaccauugaagcagagauuauagauguuaaucaga

SEQ ID NO: 3486 - RNA, 112 nt, Human
uuuguggccccugugugcagucaagccccaaccuccuggcuuggucuccgcuuguuguuggcuaccuaguuccagguugagggcccacuccuguaguuacagccccgucaag

SEQ ID NO: 3487 - RNA, 76 nt, Human
uuugugugugaagcuuaagggucauauguuugcuuguauuuuuacugcuaaucugugaacauuauugacaggcgaa

SEQ ID NO: 3488 - RNA, 64 nt, Human
uuuguuacuuuuuucggaguuagggagggauugaagacugaaccucccuuggaagaauaccaga

SEQ ID NO: 3489 - RNA, 91 nt, Human
uuuguuucauuauuuggaacucaauaauagagacuuuaaguacaaauugugagucuaggagaauuuuugauuuccacagaugagaaauaaa

SEQ ID NO: 3490 - RNA, 72 nt, Human
uuuguuuguuuuguuuuguuuuguuuucucaaaaauguugaauuuggaaagagaacuauccagaaagauaga

SEQ ID NO: 3491 - RNA, 123 nt, Human
uuuuaaaagcgauguaacuuggcagguguuaagcugguuucaguaaucuuagcaucuauuuccuuuuccccagugauuuucaaguagcuaaauuagcugccugccggguccagguuuuugaag

SEQ ID NO: 3492 - RNA, 102 nt, Human
uuuuaagaagagcugugugcucccuuugguuccggggaccccgcuuauagccagcaaaaauggccuuggaccacagccuuccagacauaguuccuuuuagaa

SEQ ID NO: 3493 - RNA, 99 nt, Human
uuuuaggaaacaaaagguuuauugaaaugcauguagauaaauuaucaucagcauaaaacuguuauggaguuuucaacauggggucuuuugcucuuaaaa

SEQ ID NO: 3494 - RNA, 75 nt, Human
uuuuagugauuauuaagcacuucugucagucuuugaaaaaagaacguauuuuuugugcuuugaagaucucugaag

SEQ ID NO: 3495 - RNA, 81 nt, Human
uuuuaugccauuaguugucuggcuuucauggcucugcaccacauuacagucagagcaggaaggccagcaguggagauagaa

SEQ ID NO: 3496 - RNA, 112 nt, Human
uuuucaauuuuuaaaaauuagauuuauugcagacuggccucaagcucccagacuauauuuuuuagcugcauuauuuagggguugaaaugccagcuuuugagacuuuugaaaa

SEQ ID NO: 3497 - RNA, 74 nt, Human
uuuucccauucuuggccacuuuaauucagaagaagguuuuuuuuccuuauuuucagggccaaacccggggagga

SEQ ID NO: 3498 - RNA, 88 nt, Human
uuuuccuugugaagagcccuacagcugccccuauuuacugacuugggagaaguaaagucagaaagaacgaacagcuguggggggaaaa

SEQ ID NO: 3499 - RNA, 62 nt, Human
uuuucucuaccccagccucucccuaagacccuauagcgucuaaggaagggcuggauugaaag

SEQ ID NO: 3500 - RNA, 97 nt, Human
uuuucugucuuacuuguucaccucaucaugaagauuuaguagccauuggcuacaaggauggcauaguggugauaauugacaucaguaagaaaggaga

SEQ ID NO: 3501 - RNA, 77 nt, Human
uuuucugugaaccaugcacgugcuggcacuggccucaggagacagugcccugccuuggcugucagguccacggagaa

SEQ ID NO: 3502 - RNA, 73 nt, Human
uuuugagacagagucucacucuguugcccagacuggacggcaguggcaacaagagcgaaacuccaucucaaaa

SEQ ID NO: 3503 - RNA, 108 nt, Human
uuuugagauuuuauugaguacuacuaaucuugacauauuuugguuggcaccacauucuugguauaguggguuagugguugaauaguuugcagacuuugugaaacaaaa

SEQ ID NO: 3504 - RNA, 61 nt, Human
uuuuggaacagacuuucuuacugcaauuaagaaccgcuauguguuagaagauggaccagag

SEQ ID NO: 3505 - RNA, 73 nt, Human
uuuuggcccggcucaagacccgucuggugcagcccuucuauggguugcaguccggaacuguugcuggcugaaa

SEQ ID NO: 3506 - RNA, 106 nt, Human
uuuuggcccugugcucuugauaacagaguguuugagggacaacuuucacauuugaguuuuuccaaaauuaaagguuguagaagagucacaguaucuauugucaaaa

SEQ ID NO: 3507 - RNA, 78 nt, Human
uuuuggcucucugaccagcaccauggcgguuggcaagaacaagcgccuuacgaaagggcggcaaaaagggagccaaga

SEQ ID NO: 3508 - RNA, 85 nt, Human
uuuugggcuuuccuucuccuuuauaaauugcauauauuuuuaacauauauuaacacuuuaaaaccgugggguggaaaguuuaaaa

SEQ ID NO: 3509 - RNA, 94 nt, Human
uuuuguauuuuaguagagauggguuucaccauguuggcaaggcuggucuugaacuccugaccucaggugauacacccaucucggccucccaaag

SEQ ID NO: 3510 - RNA, 75 nt, Human
uuuuuacugacaacuaauaaacacuguauguguacauauucauauacacuguggacuggagaaagucaguaugga

SEQ ID NO: 3511 - RNA, 77 nt, Human
uuuuuauaauccuacucacaaaugacuagcuucuccucuuguauuuugaagcagugugggugcuggauugauaaaaa

SEQ ID NO: 3512 - RNA, 91 nt, Human
uuuuugagucugggucucgcucugucacccaggcuggaguacaguggugagaucauagcuuacuguagccucgaccucccgggcucaaaga

SEQ ID NO: 3513 - RNA, 86 nt, Human
uuuuugcaguguuuuauacccucggcaaucuugcugcguuacgcaguacaugcuuuuuaaugggaccugugaagcaacugaagaaa

SEQ ID NO: 3514 - RNA, 89 nt, Human
uuuuuggggaagucaugcugagggugguagugugacccugccugaaaaaagggucucuuacccucccagcccuggcucaacucugaaga

SEQ ID NO: 3515 - RNA, 65 nt, Human
uuuuuugagauggaauuuugcucuugcugcccaggcugggguugcaauggugagaucucaaaaaa

SEQ ID NO: 3516 - RNA, 107 nt, Human
uuuuuugagauggagucucacucugucgcccaggcuggaaugcagugagcagagaucgcaccacugcacuccagccugggcaagagugagacugugucgucaaaagg

SEQ ID NO: 3517 - RNA, 82 nt, Human
uuuuuugauauagaugaucuuacuuucuugaaagcuucuucaaaaugcuuaugacuaaccuugaguucaccuuagcaaaaga

SEQ ID NO: 3518 - RNA, 71 nt, Human
uuuuuuggagacggagucucgcucugucacuccagcccugggcgauagagugagacucaggcucaaaaaaa

SEQ ID NO: 3519 - RNA, 71 nt, Human
uuuuuuucagaagucacacucagaauuuaauuucuccaaaaguuguuucuguguuugauucauguagaaaa

SEQ ID NO: 3520 - RNA, 70 nt, Human
uuuuuuuccuccccucucaguagcacggaguccgaauuaauuggauuucauucacuggggaggaacaaaa

SEQ ID NO: 3521 - RNA, 80 nt, Human
uuuuuuuucagcuacauaaacauuuuucucauguuuuguuacuaaaacaacuuguuuaggguuuuaugguugggggaaaa

SEQ ID NO: 3522 - RNA, 109 nt, Human
aguacagggugcugugagaucuaagaauacaaggcugaugcguucucauugugguuagggcugcugcauugcuuugcgaauucuuauguuaaaauaugcauuccguacu

SEQ ID NO: 3523 - RNA, 71 nt, Human
aguaccguuuuugagguucaguccuuaaacauuugcuuuaagaaaacaggcuugaauuucacaaugcugcu

SEQ ID NO: 3524 - RNA, 71 nt, Human
aguagaacuauuuauuuuccuuugcguauauacccaguaaugagauugcugcauugaaugauaguucugcu

SEQ ID NO: 3525 - RNA, 61 nt, Human
aguauccuaagaucagcugggcaugguggcuuacaacuguaaucccagcacuugggagacu

SEQ ID NO: 3526 - RNA, 106 nt, Human
aguaucuggaauucuauugugugugagucugugcaggaacacaaugagucucaaagugaaaaaaacuuuggauuccugguuccuacagcacuuuuguucagauacu

SEQ ID NO: 3527 - RNA, 66 nt, Human
aguauggaugugucuugaauguguugaggcccuuggaagggacucuuucugcaagauaccuguacu

SEQ ID NO: 3528 - RNA, 89 nt, Human
aguauuauuaagacuuuuccugggucugggcugugccuguugcugccucugagacaagucagccuaauacaggaaaagcuuaauucucu

SEQ ID NO: 3529 - RNA, 72 nt, Human
aguauuugacugcuaaauucuccacauuauguaaccugauuaauuacauuuggguguaaagcaguaaaugcu

SEQ ID NO: 3530 - RNA, 70 nt, Human
agucacuggaaaaugccuacaggcaguagccaccaucauguggcacaaagugggcaucauccuagugucu

SEQ ID NO: 3531 - RNA, 70 nt, Human
agucacuggaaaaugcuuacaggcaguagccaccaucauguggcacaaagugggcaucauccuagugucu

SEQ ID NO: 3532 - RNA, 72 nt, Human
agucagagagaaacuugaauggugaauuccuagaaaaaucaaacaaauucucaagcaaauuaaguucugacu

SEQ ID NO: 3533 - RNA, 71 nt, Human
agucaguccugcugugggaagcccacacaucaguguguuggagcaaaguucacgaaggccaugggcugacu

SEQ ID NO: 3534 - RNA, 78 nt, Human
agucauuguuuucaugacaccacucuuuuuucucuuuuacguuaggaaacgacuacgugugguuaugugaacuugacu

SEQ ID NO: 3535 - RNA, 62 nt, Human
aguccaacgucucugaugcgguggcucagagcacccguaucauuuauggaggcucugugacu

SEQ ID NO: 3536 - RNA, 130 nt, Human
aguccaggacuguuuuccuacagcgugccucaaaaguguuguagagggcaggauucuacauucacagccuguuccaucuacgagauuuuccagaugcuacuugugguagacauuccuaacucaugguacu

SEQ ID NO: 3537 - RNA, 59 nt, Human
aguccauugguagcauuguguguaugaggagauucaacaccacagacagcugcaggacu

SEQ ID NO: 3538 - RNA, 110 nt, Human
agucccgaggcuacgugaaggaacaguuugccuggagacauuucuacugguaccuuaccaaugaggguauccaguaucuccgugauuaccuucaucugcccccggagauu

SEQ ID NO: 3539 - RNA, 79 nt, Human
agucggcuucgguaaaggccaagaaaaagcggcguacaaaaaaauuccuccgcccaccggcaaaguaccgacaucgacu

SEQ ID NO: 3540 - RNA, 84 nt, Human
agucucacucugucuccuaggcuggagugcaguggcgugaucucaucucauugcaaccuccaccuccuggauucaagugauucu

SEQ ID NO: 3541 - RNA, 84 nt, Human
agucucacucuguugcccaggcuggagugcaguggugcgaucucagcucacugcaaccuccaccuccuggguucaagugauucu

SEQ ID NO: 3542 - RNA, 60 nt, Human
agucucgaacuccugagcucaagcaguccgcccaccuugaccucccaaagugcugggauu

SEQ ID NO: 3543 - RNA, 92 nt, Human
agucucucucuggcuggaccuggacugcagucacacucuaagagcuccucuuucuacaccucugccagugggcguucggucagagacaagcu

SEQ ID NO: 3544 - RNA, 83 nt, Human
agucucugaccagccugaacgugucuuaugucacuuguuuggaaaugaugugauugaagauuucagagaggucauuggaggcu

SEQ ID NO: 3545 - RNA, 76 nt, Human
agucuguuguuagucuuaaaaaugaggaggaaaaugaaaauuccauuucucaguacaaagaauccgugaagagacu

SEQ ID NO: 3546 - RNA, 84 nt, Human
agucuugcucuguugccuaggcuggagugcagugaugcaauuuuggcucacugcaaccuccaccuccuggguucaagcauuucu

SEQ ID NO: 3547 - RNA, 67 nt, Human
agucuuguauagcaauaugcuuggagaggagaauacuuaucucuggcgcacaucacuauauuuggcu

SEQ ID NO: 3548 - RNA, 76 nt, Human
agugaaccagaaugcaguuuuccuugagauaccuguuuuaaaagguuuuucagacaauuuugcagaaaggugcauu

SEQ ID NO: 3549 - RNA, 72 nt, Human
agugacuuuauucgacaugguuaguguccuagggaauuaaguuuuuuggggcagaacuagguaccaagcacu

SEQ ID NO: 3550 - RNA, 73 nt, Human
agugaggggcaggaugaaaucaucuaggguagguauuuagagggagggcgccgugcaaaauaaaauccucacu

SEQ ID NO: 3551 - RNA, 65 nt, Human
agugauggucaguauuucuuugaaauucuacaaggaacuucaggcacaugugcugaugaguuauu

SEQ ID NO: 3552 - RNA, 99 nt, Human
agugcaggaugugcggguuuguuacauagguaaacgugucccauggugguuugcugcaccuaucaaccuaucaccuagguauuaagccccacaugcauu

SEQ ID NO: 3553 - RNA, 75 nt, Human
agugccacggagagugagguggcccggggcaaaaacauccucagaaaugcccugguaucucaucuagauggcacu

SEQ ID NO: 3554 - RNA, 76 nt, Human
agugcgcagccuagaucccucacaugcacaguucacaguaggguuugcgcugcuaugagaaucuaaggcugccacu

SEQ ID NO: 3555 - RNA, 76 nt, Human
agugcguaacuggcaugaggacuauuggucuuugagaaauucuggccaacaguuaucaaaugguauuguacacacu

SEQ ID NO: 3556 - RNA, 61 nt, Human
aguggaaaacggcgauggggaacaacauacggaucugugaaaauucccccuuuucuccauu

SEQ ID NO: 3557 - RNA, 79 nt, Human
aguggacaaugucauguuuggagaaagauaacaacacaaauaauguaaccuuuccuuaaaaggcagaacucaauccauu

SEQ ID NO: 3558 - RNA, 100 nt, Human
aguggcacuuaacaugcagcuucuuugaccucguggccaccaggccuccagagggccuugugcacaucggacaaacaggagcagcaggagaagugacgcu

SEQ ID NO: 3559 - RNA, 91 nt, Human
agugggccuaauccuuaugcgcguacccguucucccuuuggucagggcuauacccaaccugagaccugguuaucgauaaggagggcucucu

SEQ ID NO: 3560 - RNA, 79 nt, Human
agugggggugaauucauguguaguacaagccgauagacagaccaguccuugcuugacgcacaagucugaaugcuccacu

SEQ ID NO: 3561 - RNA, 62 nt, Human
agugggugaaaaugucccaucugcaccaguacacaggcaggcauuaucauucuucaccuacu

SEQ ID NO: 3562 - RNA, 124 nt, Human
agugguaaugccguguguugauagaaauauguaaucgaucuuuucuuuggugggcaauuagcaauauugaggaaaguuaaagauguauguaucccuaccacuugaaacaccuggaaaugccauu

SEQ ID NO: 3563 - RNA, 89 nt, Human
agugguuucuccgaggcagucuggggcagcugguuaagaaaucuugcaucuuccagccagaguccauggacuagucacgcuugaucacu

SEQ ID NO: 3564 - RNA, 76 nt, Human
aguguagguaggaaugagguuuccuggucggcuuaauuguucuagaugauuccucaauauucccuucccugcugcu

SEQ ID NO: 3565 - RNA, 125 nt, Human
agugucuccagauugcacgaacauuucauuuuucacacagggucaccagaauaccaucaauuuuuugguaucacugucaaaagugauccuagcaccuucugaaauaacgugagcugccagauucu

SEQ ID NO: 3566 - RNA, 123 nt, Human
agugugaagacaaaagccacuuucuaaggaugguggagcagaaaggcaggaguccugcucccuggcaccaucauggagcaugcccagcccagaucugccccccucugaauuuccuguugcauu

SEQ ID NO: 3567 - RNA, 112 nt, Human
agugugaguuacaucauagucuauuucuugcuaaggccaaaguagaggaagucgagguaaauuugcaaaugcuauuugagccaguggccauggaaauaauuaugcucacauu

SEQ ID NO: 3568 - RNA, 75 nt, Human
agugugauaucaagaaagggcuucaccaggaugaucaaugcaaauggauauggagcuuucuuggaaugaaacauu

SEQ ID NO: 3569 - RNA, 114 nt, Human
aguguuggguugacuugaauggaggugauuguuuuagaagaaggucagaagacuagauuugcuuuucucuccaauuugaaauaccucuucuauucgaggacacccaggaacauu

SEQ ID NO: 3570 - RNA, 79 nt, Human
aguuaauauagagaauacuggcuuuaacagugaacuggaauaaugagggcuucacugguaaaaugcuucugaauugacu

SEQ ID NO: 3571 - RNA, 79 nt, Human
aguuaauauagagaauucuggcuuuaacagugaacuggaauaaugagggcuucacugguaaaaugcuucugaauugacu

SEQ ID NO: 3572 - RNA, 74 nt, Human
aguuagcaguggggauggcagcaguagaaggaaucacuguuucuccuaggagucugaaggccucgcugcuuucu

SEQ ID NO: 3573 - RNA, 82 nt, Human
aguuauaugugauaucaaugaagaaauauuuguagcauguaaacgguuauuucuguuucuuaaaaaguauuguuagugggcu

SEQ ID NO: 3574 - RNA, 61 nt, Human
aguuaucucuaccagugguucucaaacuuuagacuuuuugagaaucaccugguggguugcu

SEQ ID NO: 3575 - RNA, 99 nt, Human
aguucaagaccagccugggcaacauggugaaaccccaucuauacaaaaacucggcaaggcaugguggcaugcaccuguugucccagcuacucaggggcu

SEQ ID NO: 3576 - RNA, 59 nt, Human
aguucacaguggcugaagcuguucccauaagacccugaaucuagcagccacuguguacu

SEQ ID NO: 3577 - RNA, 76 nt, Human
aguucagacauucuagacuguuccgucagacucaguuucaaaagagaaugugugggagaacagucuuuguccgacu

SEQ ID NO: 3578 - RNA, 76 nt, Human
aguucauccagccgccgcuugacaugggggcagggagcccgccaggaugcaggcgcacuuugguugggguaggacu

SEQ ID NO: 3579 - RNA, 82 nt, Human
aguucuaggguacauaugcacaacaugcagguuuguuacauauguauacaugugccauguuggugugcugcacccauuaacu

SEQ ID NO: 3580 - RNA, 74 nt, Human
aguucuucagcagacucaacuaucauggacauucaggucccgacacgagccccagaugcagucuacacagaacu

SEQ ID NO: 3581 - RNA, 77 nt, Human
aguugcugcagagggagaaggacaggcagugucguggccuggagcucauugccucagagaacuucugcagccgagcu

SEQ ID NO: 3582 - RNA, 67 nt, Human
aguugguagagauacugaugagaccuauugcauugacacgaggccucuaugauaucugcuuccgacu

SEQ ID NO: 3583 - RNA, 105 nt, Human
aguuguaagagaauuuaugugaugcugagauaugugauagaguugagaugauguaaaugaagagauuuuggaaaguagaaagcacuacauaaagauauuccaacu

SEQ ID NO: 3584 - RNA, 85 nt, Human
aguugucgagaaaggagggaccagaaaucagaugaacugaguaauucaucaugucaucuugaaggcuuuuccacucuggacaacu

SEQ ID NO: 3585 - RNA, 61 nt, Human
aguuuaguggcaaguucuuuagccuuugccuuuucgagcuuggcgauacgagccacaaacu

SEQ ID NO: 3586 - RNA, 85 nt, Human
aguuucacucuugucacccaggcuggagugcaguggugccaucuuggcucacugcaaccuccgccugccgaguucaagcgauucu

SEQ ID NO: 3587 - RNA, 62 nt, Human
aguuucccggggggcaggcgggggccagauguucucccccgcugugggcccucagggggacu

SEQ ID NO: 3588 - RNA, 107 nt, Human
aguuuggguaaugaagccacagagauuugcugauacauuugcuaggcacgacuucuggucauuuagaaagcuauuuuguggcuucaucaauaagguauuccccagcu

SEQ ID NO: 3589 - RNA, 82 nt, Human
aguuuuaggguacaugugcacaacaugcagguuuguuacauauguauacaugugccauguuggugugcugcacccauuaacu

SEQ ID NO: 3590 - RNA, 74 nt, Human
auaagaaaaucaaagacaaugacauccucagcucccucucaccccaaguaugccauugucuuuguaauucuuau

SEQ ID NO: 3591 - RNA, 101 nt, Human
auaagcugcucuaauugccaagaauucacaugugguuguaugcagcauuacugggaaauugaaguguaucugcaugugauucugcugugauggacacuugu

SEQ ID NO: 3592 - RNA, 101 nt, Human
auaagcugcucuaauugccaagaauucacaugugguuguaugcagcuuuacugggagacugaaguguaucugcaugugauucugcugugauggacacuugu

SEQ ID NO: 3593 - RNA, 79 nt, Human
auaauaguguaaaucagauauaauugagggcuauauggcaguaaaacugcuagugccaguuuucuuguuugccuguuau

SEQ ID NO: 3594 - RNA, 97 nt, Human
auaauuccuucccuuagaugcauagggagagucucuaaauuugauggaaauggacacuugaguagugacuuagccuuauguacucuguuggaauugu

SEQ ID NO: 3595 - RNA, 73 nt, Human
auaauugugucaugauuaauguguauuuacuguacuaauuagaaaauauaguuugaggcugggcacacauuau

SEQ ID NO: 3596 - RNA, 103 nt, Human
auacaaaaaauuugcagggcgugguggugcgggccuguggucucagccuccugggcugcugggacuacaggcaccugcccccacaucuggcuaauuuuuguau

SEQ ID NO: 3597 - RNA, 102 nt, Human
auacaggacuaauugucagccuagaaaaggaacuugcuccauuguuugaagaacugagacaaguuguggaaguuucuuaaucugacagugguuucagugugu

SEQ ID NO: 3598 - RNA, 91 nt, Human
auacuguuuucaguguugucacagccucuuucaaauaaucccgccuaacuugcguuaugaugaggcggcuguuggcagcaucguucagugu

SEQ ID NO: 3599 - RNA, 84 nt, Human
auagaaaaacacacuaauuaugugcgggguauauggcaugugcucuggccuuaauccaugaacaucauuauaucauuuuuuuau

SEQ ID NO: 3600 - RNA, 78 nt, Human
auagaaauauguauuuuaagcacucaugcaaagguaaaugaacacuguuuaaaugugugcuuagcuuauuuuuucugu

SEQ ID NO: 3601 - RNA, 100 nt, Human
auagacaggucucacucuguugcccaggcuggagugcaguggugugacuguagcucacuauagccaccaaguccugggcucaagcgauccuccugucuau

SEQ ID NO: 3602 - RNA, 61 nt, Human
auagagggcuuucuaugugccaggugcugguccaagccccuuuucaacauaagcucucugu

SEQ ID NO: 3603 - RNA, 73 nt, Human
auagcauugaaggacucguggauaucuaacagcaauaccugaucacuacuucgcacuaguuucucgguacuau

SEQ ID NO: 3604 - RNA, 65 nt, Human
auagguacuucucgaaauucuuaagagguuaaauguauuauggucuucauuugaggggugcuuau

SEQ ID NO: 3605 - RNA, 81 nt, Human
auaguacugaacccuuuaucaacuauguuuuuucagucuacaaccaaggcggcuacuaagugacuaaggggcagguaguau

SEQ ID NO: 3606 - RNA, 77 nt, Human
auaucaaaaggaaguuauaaggccauugagagaaaaucucagaagaagucaacaggcccaagauaccucagugauau

SEQ ID NO: 3607 - RNA, 86 nt, Human
auaucaucaaagucaugacauuggaaauauugcagcuuuucacagucauuagaaaugcuuauuuccugaaguuccuuugauuguau

SEQ ID NO: 3608 - RNA, 78 nt, Human
auaucccaaaugcugcuugcuucaaacaggcacccucggugcugccuccucugaggcuggcaguuccuuccuggauau

SEQ ID NO: 3609 - RNA, 60 nt, Human
auaugguuacauucuauagcgauuggucuugugccgagugguugggaaauguuaccauau

SEQ ID NO: 3610 - RNA, 62 nt, Human
auauuauggcuugcaaccuggagaccucugguagauuucuuuagugcaucccagccaagugu

SEQ ID NO: 3611 - RNA, 109 nt, Human
auauuugugguaguagugugaacauuaaaaagauaauguaugugaaguaccauucgaguggugaauacguuuuuaugagaaugucauacugaaaaaauauugcaaauau

SEQ ID NO: 3612 - RNA, 81 nt, Human
aucaacuuccaauaccugcugccugucucccugacccaugaaucuggcaacguuaggcacagucagacauggacaguugau

SEQ ID NO: 3613 - RNA, 69 nt, Human
aucaaucacacugggugaccuuuacucccugucaggucaguaagagucacccaguguaaacagcaugau

SEQ ID NO: 3614 - RNA, 72 nt, Human
aucacaagugggguguacucccccuugcauauugggaacaacaucacaagugggguguacugccucugugau

SEQ ID NO: 3615 - RNA, 74 nt, Human
aucacuugaacccgggagguggagguugcagugagcugagaucaugccacugcacuccagccugggcaagagau

SEQ ID NO: 3616 - RNA, 79 nt, Human
aucagaaauuuuggaaaucaaaggacagaacugggaagaacaagugaauagucugccugaaguuuucagaaaagcuggu

SEQ ID NO: 3617 - RNA, 73 nt, Human
aucauaauucuggagggaagcucuuggaggcugugagucucccuguacaguguuaccauccccgacaucugau

SEQ ID NO: 3618 - RNA, 63 nt, Human
aucauguccaccccugcagauccuuggaaaagaaaauguuuauguugcaggguauugcauggu

SEQ ID NO: 3619 - RNA, 84 nt, Human
auccaauaaaccaaauuacaaucugcugcuucuucucauuuucaaauacuauaaagauucacacuguuaaaggguuuuuugggu

SEQ ID NO: 3620 - RNA, 83 nt, Human
auccagcaagaugcaagccuucagaaucugggauguuaaccagaagaccuucuaucugaggaacaaccaacuaguugcuggau

SEQ ID NO: 3621 - RNA, 78 nt, Human
auccauggauuuugguaucuuggcaggagggugguccuggaauuagccgccaccaugcccagcuaauaccccauggau

SEQ ID NO: 3622 - RNA, 72 nt, Human
aucgugccuuagcaaacaucuucgugugagcuacuucgugagcccacauguauguguuuguugaggggcgau

SEQ ID NO: 3623 - RNA, 84 nt, Human
aucguucagcagugguuagaauacagggugacucaaguagaugggcacuccaguaaaaaugacauccucacacuguugaaggau

SEQ ID NO: 3624 - RNA, 77 nt, Human
aucuaaaagaaguuacugaggaagauuugaauaaucacuuuaagucuuugggaagcagugauuugaaauuuugaggu

SEQ ID NO: 3625 - RNA, 90 nt, Human
aucuaugaaggccaaguggaggugacuggugaugaauacaauguagaaagcauugauggucagccaggugccuucaccugcuauauggau

SEQ ID NO: 3626 - RNA, 90 nt, Human
aucuaugaaggccaaguggaggugacuggugaugaauacaauguggaaagcauugauggucagccaggugccuucaccugcuauuuggau

SEQ ID NO: 3627 - RNA, 130 nt, Human
aucucggcucauugcaagcucugccuccuggguucacgccauucuccugacucagccucccgaguagcugggaggcugaagcaggagaaucacuugaacccaggagguagagguugcagugagucgagau

SEQ ID NO: 3628 - RNA, 61 nt, Human
aucugcacuccuucaaagcuugcacgggcacugcaggacuugucccaaggaaagucuagau

SEQ ID NO: 3629 - RNA, 63 nt, Human
aucuguuggaugcuugcggcggugcugcacuccaugugccacuguugcuuggcccugacugau

SEQ ID NO: 3630 - RNA, 65 nt, Human
aucuucugguucaaagaacacaucagaugcaaggauaauaucuuguggugguagagccagaagau

SEQ ID NO: 3631 - RNA, 104 nt, Human
aucuuggccaggcuggucuuaaacuccugaccuugugauccacccgccucaccuccuaaagugcugagauuacagggcaugaggccaccaugcccggccaagau

SEQ ID NO: 3632 - RNA, 72 nt, Human
aucuuuguauguaaaacuuuaacugauuucugucauucaucaaugaguagaaguaaauacauuauaguugau

SEQ ID NO: 3633 - RNA, 79 nt, Human
augaaacaauaaaacaaaacaaaagucauuucaaacaaagcuguuguuuugaaaacucuugcuuucuuuugguguccau

SEQ ID NO: 3634 - RNA, 75 nt, Human
augaagacgaguaugaaguaaauuugaaagacuuugagccacagcccgguaauaugucucauccucggccuuggu

SEQ ID NO: 3635 - RNA, 79 nt, Human
augacagcaagacacuggcccuggaauccuccgugucacaugugggcugcugacaggaagaaugugcuuuuguuguugu

SEQ ID NO: 3636 - RNA, 82 nt, Human
augacccucacucgcgccaguggaggugacaucccuaggaaagaaacggauuugucuccagcugacgggcuggaggguucau

SEQ ID NO: 3637 - RNA, 66 nt, Human
augacugggucagcgugugccuaaccuacgccggcaggcgcggguaaaccguugaaacccauucgu

SEQ ID NO: 3638 - RNA, 84 nt, Human
augagcuauacagugugaggcauauuucauagcaacguugguugauugccaaggagacucugccaccguucuggauaagcucau

SEQ ID NO: 3639 - RNA, 83 nt, Human
augaguauugaucugucccagccugugcauugcuccgaggcaguucugaguggaugauguacagaugggauuccucagcucau

SEQ ID NO: 3640 - RNA, 72 nt, Human
augauuggagacaaaguuuauguccauuacaaaggaaaauugucaaauggaaagaaguuugauuccagucau

SEQ ID NO: 3641 - RNA, 91 nt, Human
augcaaaugucuucagguuagaaagccuuuauuuacuuuggaaaugaacaagaaaugccucugucuuagaaaccuggagauuauuugacgu

SEQ ID NO: 3642 - RNA, 98 nt, Human
augcacaucaccaccuacuugaguguugaggauucaauuaguuaauguacuucaaauaaucauguaguaaaugcucaguagugugugugugugugugu

SEQ ID NO: 3643 - RNA, 131 nt, Human
augcacgaguuuauggcuugccgguucccuuuccacaugacuccagaccaccgucacggggacgggauagacacaguggggcuaugaugcaaggacuuuagaggcggaaaagaagccguaaaucgaugcau

SEQ ID NO: 3644 - RNA, 73 nt, Human
augcacggucagccaauuuuauuuaucuuaagcaucagcugguucaauaaguccccaaucugguugccggcau

SEQ ID NO: 3645 - RNA, 71 nt, Human
augcagguccagagccaacugcaguccuguccaaucccauagguacaagggccuggcuccucuuccugugu

SEQ ID NO: 3646 - RNA, 60 nt, Human
augcauguauccuuacccccaugggaaaauguugguguguucucaaggguaugcaugugu

SEQ ID NO: 3647 - RNA, 91 nt, Human
augccuggcugggaagucuggggaagggauacagagcuuggugggccuaacaccauucauaucccuuacccucugucucuccucccuguau

SEQ ID NO: 3648 - RNA, 71 nt, Human
augcuagggugagugguaggaaguuuuuucauaggagguguaugagugggucguagcggaaucggggguau

SEQ ID NO: 3649 - RNA, 74 nt, Human
augcuguuuuaccaagacuuuauagcagauggacccagaaagaauuuucugcuauguguucacuacaacaggau

SEQ ID NO: 3650 - RNA, 110 nt, Human
auggaagcugccucugguggauaugcggaggugggccgaguucuuuuggauaaaggugcugauguuaaugccccuccaguucccuccucaagagauacagcuuuaaccau

SEQ ID NO: 3651 - RNA, 72 nt, Human
auggacaguauuagccaucauugaggcacucugucgcacucaacauagggcguguuggcugagauuguccau

SEQ ID NO: 3652 - RNA, 83 nt, Human
auggacuaagcuucauuccaguucaauaacuaaacgagggcccauaggacuugugcugaaacccauuggagucaagguuccau

SEQ ID NO: 3653 - RNA, 109 nt, Human
auggacuacauauaugacacugucccauaagauuauaauggagcauugggauaaaguaaguacuugauggcucugaggaaucugugugacuugggcauuguggauccau

SEQ ID NO: 3654 - RNA, 67 nt, Human
auggagaggaggagguggagacuuuugccuuucaggcagaaauugcccaacucaugucccucaucau

SEQ ID NO: 3655 - RNA, 104 nt, Human
auggcaccccacgggguuuccacacguuggugcguaugagcaucuuugacucuuagucgcucggcaccgcauaacaccccugugggcacgucugauugugccgu

SEQ ID NO: 3656 - RNA, 60 nt, Human
auggcagccuuucagcaugcgguuaaaaucggaacugauaugcuagaauuggacugccau

SEQ ID NO: 3657 - RNA, 101 nt, Human
auggcaugcacguguuggaaguuaguggaggcuaucuccccaguggucaaaggaggucuugcuggagaaauuauauuuuacuaacuugaagcagcagcugu

SEQ ID NO: 3658 - RNA, 71 nt, Human
auggccacugagggguugucugggucaugggaagaauccuucaugaauaagauuaauauucucauggaaau

SEQ ID NO: 3659 - RNA, 94 nt, Human
augggaacagcaagauggcaaaagcuugcugagugguacagcgccagccuggguaguggccuccccagcaaguugcaugucacuagcuuccugu

SEQ ID NO: 3660 - RNA, 62 nt, Human
augggagcuuaauuucguucagcacaccauaaaaguuguggcagaguaaagauuauuccugu

SEQ ID NO: 3661 - RNA, 78 nt, Human
auggggaugcaguggaccugccucggauagcagcacacaugucccaucugccaucucaugcuucacuaaauccaccau

SEQ ID NO: 3662 - RNA, 80 nt, Human
augggggccuccuuaaauacacaccagcagucaaguggaggaaaacuugaacaauaaugagucgcuucuugggucucuau

SEQ ID NO: 3663 - RNA, 87 nt, Human
auggguagcaugaacuaagguagauaaaggcuucacgugguguuuggcauggcguagguguagauuggaccucaguuuucugcccau

SEQ ID NO: 3664 - RNA, 65 nt, Human
auggucaccccaggccaugcuugcacucagaaguuuucucaugaggagauggccauggcgaccgu

SEQ ID NO: 3665 - RNA, 74 nt, Human
auggucguucuacugggcugauuuuggacaguggagccacucauaccacugcaauuccaguccacgauggcuau

SEQ ID NO: 3666 - RNA, 62 nt, Human
auggugacaaacaugcuggagccaagugcuaaaugccugguucaagggauggaagucaccgu

SEQ ID NO: 3667 - RNA, 62 nt, Human
auggugacaacaugcuggagccaagugcuaaauggcuugguucacggauggcaagucaccgu

SEQ ID NO: 3668 - RNA, 62 nt, Human
auggugacaacaugcuggagcccagugcuacaugccuugguucacgggauggaagucaccgu

SEQ ID NO: 3669 - RNA, 66 nt, Human
auggugacacacaugcuggagccaagugcuaacaugccuugguucaagggauggaaagucaaccgu

SEQ ID NO: 3670 - RNA, 60 nt, Human
auggugacacaugcuggagccagugcuaacaugccugguucacggauggcaagucaccgu

SEQ ID NO: 3671 - RNA, 93 nt, Human
auggugcuaaggaaauuugcuaugcucuucgagcugaggguuauugggcugacuuuauugacccaucaucugguuuggcauuuuuuggaccau

SEQ ID NO: 3672 - RNA, 90 nt, Human
augguuuaacuuuguuguuuaacuauccucagcauccuuuccaucaagaauggaggugcuuugauuaaugguuaaaacuuguuuuacuau

SEQ ID NO: 3673 - RNA, 90 nt, Human
auguacaugcucaggguugucccccaguagaagugaugggcugcuuugagccguucuuacugaugucuggucugaucccuggguggucau

SEQ ID NO: 3674 - RNA, 102 nt, Human
augucaauucuauuuacugcaggagccuaguaccuggcacagaguagguacucauaauauuuacucaggccgggugugguggcucaugccuuguuauugcau

SEQ ID NO: 3675 - RNA, 71 nt, Human
auguccuuuuuuucccuuuuaauucuucuccucagaggauagacuaauguagaggaguuaaaaauggauau

SEQ ID NO: 3676 - RNA, 80 nt, Human
auguggucaguggguugcaucuucggggagcugcugacucagaagccucuguuccccgggaagucagaaaucgaucagau

SEQ ID NO: 3677 - RNA, 91 nt, Human
auguucaagaaauccucuagcaggucuagcaucuggucaucugggaaaagaugaguacacgaugcccacccuccuuaagguucuugagcau

SEQ ID NO: 3678 - RNA, 112 nt, Human
auguuggccaggcuggucuuaaacuccugaccucgugaucugcccacuuuggccucccaaagugcugggauuacaggcaugagccaccgcacccagccaaguaauccuauau

SEQ ID NO: 3679 - RNA, 78 nt, Human
auuaagacuuuuccugggucugggcugugccuguugcugccucugagacaagucagccuaauacaggaaaagcuuaau

SEQ ID NO: 3680 - RNA, 60 nt, Human
auuaggcccuaauugccugacuuaaauuaauauugguuaaggcccacuuaggguccuggu

SEQ ID NO: 3681 - RNA, 91 nt, Human
auuauacccuuuaaacagagagaguuuauauaaaggccucuauagaggggugacaauuuuauaaacaauuuucuuuaaaacggguguuaau

SEQ ID NO: 3682 - RNA, 72 nt, Human
auuauuagagacaagaguaccaaagcgguguguguuuuuugugugugugguuuggcugucguuuguggugau

SEQ ID NO: 3683 - RNA, 93 nt, Human
auuauucugaugaaaauccacaaugucuuugagcuucugguuguguaaugcugggguuuaaagucaccauuuguggguuuggcaucaauuaau

SEQ ID NO: 3684 - RNA, 82 nt, Human
auucaaacugggcucaguggcucacaccuauaauccaacacuuuggaaagcugaggugagaggaucacuugagcccacgagu

SEQ ID NO: 3685 - RNA, 94 nt, Human
auucaaguggaugaaaaggggaagauuguggaugcuagguuuaaaacauuuggcugugguuccgcaauugccuccagcucauuagccacugaau

SEQ ID NO: 3686 - RNA, 77 nt, Human
auuccaagugcuccaaggguaacucauaaagucaaggggccaaucggcggcccaaugggcccuccaagaguuggaau

SEQ ID NO: 3687 - RNA, 75 nt, Human
auuccuauucuuuuuauaaaaauuguaaaaucucaguaugagguguuucaaggauauguauggagcagcgggaau

SEQ ID NO: 3688 - RNA, 81 nt, Human
auucucuaacuggucaucaucaauuguucuacaggcaaauacagacucugugaacagucucugaugaaaggcugggagaau

SEQ ID NO: 3689 - RNA, 75 nt, Human
auucugaaucuguugacuggagugaauucaguggucacaauaccaccaucaaauaagaaucaacuuccucagagu

SEQ ID NO: 3690 - RNA, 79 nt, Human
auucugaguuguuggugccugcccuuccccugaaucuaagaacugauuaguggguuagacugcaacagcagcucaggau

SEQ ID NO: 3691 - RNA, 87 nt, Human
auucuucaaauguucccucagugauccuuuuacucuccuugucacuuauuugggagaaauaggggcacaugagauaagaagaagaau

SEQ ID NO: 3692 - RNA, 86 nt, Human
auugcaggauggagcacugagaaagcaagauguuggcuaccagaaauggaguuucaaaaauuuucuuaaaagcucuauuggacaau

SEQ ID NO: 3693 - RNA, 60 nt, Human
auugccagacagcugcaccacagacugagucacguggaugugguuaaaguugucugcaau

SEQ ID NO: 3694 - RNA, 77 nt, Human
auugcuuucaguuucuucuuuagguucuugauuuuuuugucuaucucaggguccccagaaauugacugagagacagu

SEQ ID NO: 3695 - RNA, 68 nt, Human
auugguggccuagaaucugaucuguccuguuuaugcacaccggagggauaggaucuguaccguccagu

SEQ ID NO: 3696 - RNA, 125 nt, Human
auuguauugcagcagguuggcagccucaguaaaucuccauuuguaaaugugacagucagcagaaucuccaguuacagucaacucaaagcaagcaggggcaugccacauacauguucauauauagu

SEQ ID NO: 3697 - RNA, 99 nt, Human
auugugauuuccuucguuggagcugugagcagcagcacauuggcccuaauccugccaccuuugguugaaauucuuacauuuucgaaggaacauuauaau

SEQ ID NO: 3698 - RNA, 73 nt, Human
auugugcgaaacgcuucgccagacaugcagggccuaccuuguuaguacgggucuagaagccaguugcaucaau

SEQ ID NO: 3699 - RNA, 78 nt, Human
auuguugagauuauaauaucaauaacuuacugcaguuuugagugagcuacuuagugcaugguauuauaaaacaacgau

SEQ ID NO: 3700 - RNA, 101 nt, Human
auuguuggcuggcugauucuugcaaagagaugcauaaguaaacuagucaaguacaucuuaaccauuuugggugucauuuagucagucagucaugaaacagu

SEQ ID NO: 3701 - RNA, 77 nt, Human
auuuagggcaggccgauuuguuagaagucacugaugcuccaguaggcuuuuguuauaaucaggccuguuuccugagu

SEQ ID NO: 3702 - RNA, 63 nt, Human
auuucacagucuuggcccuucacauccugcccccugagcaguggagagccacacgugugaaau

SEQ ID NO: 3703 - RNA, 88 nt, Human
auuugagaauggaaaggacaaucuuugggaugacauagcuuaggacacuugcucauuuauuugaaagaguccgauacacagugcagau

SEQ ID NO: 3704 - RNA, 78 nt, Human
auuugcaagcugaccuacauaaacaucuguguaauaaauuuauggauacggauuuaacaauggauaaguucuguaagu

SEQ ID NO: 3705 - RNA, 98 nt, Human
auuugugucuaucuaauggguuauugagaaaaucaaauaaaauaaugcaugcaaaguacuuuuagcacagguccaauauccaugguaagaauacaaau

SEQ ID NO: 3706 - RNA, 85 nt, Human
auuuucugagcugugagccugccuuccagugacauguucuaaaaauugcaaguuauuugaggaggcuuuacagccaauaggaagu

SEQ ID NO: 3707 - RNA, 96 nt, Human
auuuugcauucuuugugugccuuaucauguguuaaguaccaugaggguacacccaggcuuagcacaaugcauuugguauacaaaaccauguaaaau

SEQ ID NO: 3708 - RNA, 73 nt, Human
caaaaccaaauuuaaguucacaaggccaugcuacuuccagagagugaaugcccuuguuuagaaugggucucug

SEQ ID NO: 3709 - RNA, 87 nt, Human
caaaacgguaaugaucagaugccaaaacgagugugaaugugcauaauuuacgaaagacauuuuugagaacugguuacaugaguuuug

SEQ ID NO: 3710 - RNA, 65 nt, Human
caaaacucccgccuuaccugcgguggcagcacugacaugcugccacgggcccggcgggauuuuug

SEQ ID NO: 3711 - RNA, 92 nt, Human
caaaaucccuugacaaaagcgcauagguuauuucaaaccaggcauuguuuuuuauguaaccuguuuuaccgcaucuucucaggcagguuuug

SEQ ID NO: 3712 - RNA, 83 nt, Human
caaacaaucuguggaugggaaaagcaccacuuguuacuuggagaugaugaugaugaugaaguuccagaucuguggagaauuug

SEQ ID NO: 3713 - RNA, 94 nt, Human
caaacacaaagcagguuugguugaggacagacacucagggaauuuuugaccaccaaaaaaguuuuggggguuuguuuuuccuguuuuuuguaug

SEQ ID NO: 3714 - RNA, 71 nt, Human
caaagacugaagaaauuucacagcaguuuauuaauguauauaaacuuauaaauauuucuccagcaaauuug

SEQ ID NO: 3715 - RNA, 79 nt, Human
caaagagguguagaaucuggguugguccuucaaggcagcucauugcagcuacuggccuccagugaaacaggucucuuug

SEQ ID NO: 3716 - RNA, 85 nt, Human
caaagaucauccugugagguaauuccaguacauuaaaaggaauugacuugaguguagugggaagccuuccucagggugcuauuug

SEQ ID NO: 3717 - RNA, 87 nt, Human
caaagccuccgcuggggcuguuucuuaacacggaguuacaaacuuuaagaacagacagcuccagacggaaauccacgccaggcuuug

SEQ ID NO: 3718 - RNA, 84 nt, Human
caaaggaaauacuguguuagaauuuucuaguaggacucuuuaaaccuuuuggggaaagcuaucagauaauucgcaguaccuuug

SEQ ID NO: 3719 - RNA, 73 nt, Human
caaaggcaggcuucuccgguggcauggugguagacuacccuaacagugccaaagcaaagaaauucuaccucug

SEQ ID NO: 3720 - RNA, 110 nt, Human
caaaguucauaauuuuucugagcuuucuaggguuuccaggcaagcuuaugaggggccaccguuacagcaacuuguugggaacaccuggauaguggaacaagaaagcuuug

SEQ ID NO: 3721 - RNA, 66 nt, Human
caaauguaguuguauuucaagguuugguccaaagaccagagaaucccuaaguaggaagacaguuug

SEQ ID NO: 3722 - RNA, 73 nt, Human
caaauugugccagcguugggcaauaaaaguuaggaacaggaacuuaucuuggugugcccuuccuguacuuuug

SEQ ID NO: 3723 - RNA, 79 nt, Human
caacaucgagagcuucuucagcgggagcugguccaucuucugggucaagauggccuccugcuggauaugcgugcuguug

SEQ ID NO: 3724 - RNA, 90 nt, Human
caaccccgagccuggcguccggccuguggcgcacccugcaagugggcuggaacaugcagcugcugcccgcgggcuuggcguccuuuguug

SEQ ID NO: 3725 - RNA, 73 nt, Human
caacuaauguuggaacuaugaaaagcucuucucuacuuuuaacaaagcuuagucacaaacaguuccccaguug

SEQ ID NO: 3726 - RNA, 82 nt, Human
caacuuuucagguggagagccauuucuucaagaccggggagaauaccugggcaaguuggugagguucugcaaaguagaguug

SEQ ID NO: 3727 - RNA, 87 nt, Human
caagacuuacccaaggaugcuuaccugaguacaacgggaucuuuagauagaaccaccacugggauagcuccugcaaguaaggacuug

SEQ ID NO: 3728 - RNA, 121 nt, Human
caagaggaguugcacccuuccagacuugcggaugaguagcuugccaaccugacccucugucaggucagccaggguacaagcauucucugccaauuuggcuucucggucuuucuccugcuug

SEQ ID NO: 3729 - RNA, 62 nt, Human
caagauucuugauacugcacucucuaagauuggagagaaaagccuguuuaccaaggagcuug

SEQ ID NO: 3730 - RNA, 74 nt, Human
caagcaaucccccuguugggguugggaacgggcaagcgcguggcaaagccccccaaagaacaagggaaaaauug

SEQ ID NO: 3731 - RNA, 88 nt, Human
caagcagugaagggugcagaucauggauagagcuuucaagaaguuuguucuaguucuucuccugaaacuggaccucccuccuagcuug

SEQ ID NO: 3732 - RNA, 75 nt, Human
caagcuaccaaugacuuucuucacagaauuggaaaaaacuacuuuaaaguucauauagaaucaaaaaagagcuug

SEQ ID NO: 3733 - RNA, 66 nt, Human
caagguagagccgagagacaagguagagccgcucgggucuaccuuguuucccaacggguuuccuug

SEQ ID NO: 3734 - RNA, 99 nt, Human
caagguugugguuuccugagcaggauggauugggcagacaaaaucagcaaugccccugcuccugagagaggccucgccaucccuguuccauaagucuug

SEQ ID NO: 3735 - RNA, 91 nt, Human
caaguaauuauaaucucucucucuggccaucauuggcgagugcaguguugagcuaaaagugacccagaggaggugaacuauaauuuacuug

SEQ ID NO: 3736 - RNA, 70 nt, Human
caaguccccuacaauugucuuacaagugucuuauguccagagaacauguaagaugagugcuagagacuug

SEQ ID NO: 3737 - RNA, 88 nt, Human
caauaauagagauacugagcauguuuucauuugcacaaaggaucauggcauuuuguuaggugagagcauguuuggauugcuacuguug

SEQ ID NO: 3738 - RNA, 78 nt, Human
caaugugcaacugacaucugcuagugaugaucugguaauauacaaccuguccaguagccgaacaguuuguuuuuauug

SEQ ID NO: 3739 - RNA, 87 nt, Human
caauguguugcuccaagcauaugcacgcagauccgcaugucccuucgcgguaaggcuguggugcuugauagggcaagaacaccauug

SEQ ID NO: 3740 - RNA, 74 nt, Human
caauuacaguccuacaaguaccuggguugccucccuccugaccuggagaacaguccccugguacacugucauug

SEQ ID NO: 3741 - RNA, 89 nt, Human
caauucugugaagaaagucaugguggcugauggggauggcauuuaaucuauacauuaccuugggcaguauggccauuuucacgauauug

SEQ ID NO: 3742 - RNA, 64 nt, Human
cacaaaaugggacugcugaagaguggacaguuggaccuuacuuuggugaccccauacguuugug

SEQ ID NO: 3743 - RNA, 67 nt, Human
cacaagacaguuagacaaccaaggauucaucaggagaaguucugggaauggucaucuaugucucgug

SEQ ID NO: 3744 - RNA, 104 nt, Human
cacaccauucuccugccucagccuccggaguagcugggacuacaggcgcccgccaccacgcccggcuauuuuguauuuuuaguagagacagggguuucaccgug

SEQ ID NO: 3745 - RNA, 85 nt, Human
cacaccucagccuuccaaguaguugggacuacaggcauauaucaucaugccuggcuaaauuaacuauuuuauuuuaagagaugug

SEQ ID NO: 3746 - RNA, 85 nt, Human
cacagaaucagaccaugacuaccuucaccuggaacaucaaccacgcccggcugauggugguggaggaaccgauguguuuacugug

SEQ ID NO: 3747 - RNA, 61 nt, Human
cacagagggcuugcugagggcagggcugcugcuccgcagagaacagacuuggcccucugug

SEQ ID NO: 3748 - RNA, 83 nt, Human
cacagcaggcuuuuacggugauugcugauugggaagaucucuuucucccuuacggcgucauucaugucaaggcccggucugug

SEQ ID NO: 3749 - RNA, 87 nt, Human
cacagccaguuucuuugaugacucaaaacguacuuugugaucuugccaagcuuugagaucaucguuacaagcagcauuuugguugug

SEQ ID NO: 3750 - RNA, 92 nt, Human
cacagcucuguuuagucucuugcucuuaauacguauagcaucuuccuucuccuguugugcuaaucuaaagaacgaaucaauucggagcugug

SEQ ID NO: 3751 - RNA, 86 nt, Human
cacaggagggauccuuggguuaaggauuguauuuaaaaacccccaaacggcguuuuaacaaugguaaccccccuagggcuccugug

SEQ ID NO: 3752 - RNA, 68 nt, Human
cacaggccccguugcccauggcugucagccgggggcuccccccgcagcagccacagcagccgcuucug

SEQ ID NO: 3753 - RNA, 64 nt, Human
cacagggauacuccauuguccccuccucuggcugucccuuggagaggcacuuuggauccuugug

SEQ ID NO: 3754 - RNA, 76 nt, Human
cacaggggacagcauaagcaaaggcacacgagggggagaacagaggugucuggguggagauggggaguccuuugug

SEQ ID NO: 3755 - RNA, 78 nt, Human
cacaggguggcuugacaaauauuaacuugguuccccagcaauaaacugagucuuccagggucaagucauugccuucug

SEQ ID NO: 3756 - RNA, 103 nt, Human
cacaggucgggggccuagagaccaccaaugcccuuggacacacagaauccccuugauuuccaggagguaguggguggcauucucugagccuuugcacauggug

SEQ ID NO: 3757 - RNA, 100 nt, Human
cacaguggggcaccugaucuagcacacauucagaggguagggaggggaagggaucuagcuauacucugggcauggagcagggaaggucguccuugcuaug

SEQ ID NO: 3758 - RNA, 81 nt, Human
cacauugauuuucaguaugacucugauggcucucacgacugccuuugaaccgccugacgagcuaugcauacugaacaagug

SEQ ID NO: 3759 - RNA, 63 nt, Human
caccaagaaguugacagccaggugaauguuauacacaagcucaucgucugucaucuucacgug

SEQ ID NO: 3760 - RNA, 68 nt, Human
caccaccgccacuucgucauccgcagaggccaggucuugcgggagaugcugaagaguauggcggggug

SEQ ID NO: 3761 - RNA, 84 nt, Human
caccaggcaggcagguuaaguuccuugaugcccuccuuuggaaagaaguggagggugagggaaaaaggacuuccauuucaggug

SEQ ID NO: 3762 - RNA, 76 nt, Human
caccaugcgggccucagguggcagagaggcccagccucacaggccuguggccccacacaccagucccagcaaggug

SEQ ID NO: 3763 - RNA, 107 nt, Human
caccccaugcuauagcgauucuucacagcaugcucagguaaccacgcaacuguguguguucgaucauguuugugaguuugugcugugaugacuuuauuaauggguug

SEQ ID NO: 3764 - RNA, 93 nt, Human
caccgaugaacucuuaagucauaucacaguuuacuuauuuacuuauggugcugacuauguggccgaugugaaauggcuagcuaguuaguggug

SEQ ID NO: 3765 - RNA, 69 nt, Human
caccgccugcugcugggacugcacagugagcuguuccuggagcugcuaaguaaccagagcgaggcggug

SEQ ID NO: 3766 - RNA, 88 nt, Human
caccucguucugcucaccuggccuggcaggcugugcuugguucacacuaccagccuggaucccacaccugccacgggugaaccaggug

SEQ ID NO: 3767 - RNA, 75 nt, Human
caccugauuuuuaagcuuugacaccugcacauuuuaaguuuccaugucuaguauuuguacaaacuaaaugaggug

SEQ ID NO: 3768 - RNA, 106 nt, Human
caccugccuauauuacauucauuuugaugguuuguaucucaaaggaguacagugaacgaaacuuguuuaaagauacaccggaaagaaaaagagaagaggcagagug

SEQ ID NO: 3769 - RNA, 76 nt, Human
caccugggagacugcugguaaagaugggagguggccuuugccgcuuuccaucuucucacugcaguuucuucacgug

SEQ ID NO: 3770 - RNA, 74 nt, Human
caccuuuuaaauauuuaauucuuauguggacuuauuuccagaaaacuuggugauaauucuugagacaaaaggug

SEQ ID NO: 3771 - RNA, 101 nt, Human
cacgaggucauuuaaaaguucauuuugagggaauaacauguaauauaauuugaaauaaagguauaguaaccuuaaaaagaacauuauaacugauuguugug

SEQ ID NO: 3772 - RNA, 105 nt, Human
cacgcgagucagaaccuaaagugcucucugggcaaccugaguggguagagugauuccgucuuucucuggcccugcuaggcccaaaggagaggugugacuaucgug

SEQ ID NO: 3773 - RNA, 77 nt, Human
cacgcgccgggcgcggcccccucccaaacugugacugguauuuauuggacccagagaaccgggccgggcacagcgug

SEQ ID NO: 3774 - RNA, 112 nt, Human
cacggauuuccuggaagaccuggauuuuucggaagcuauggauuugagggaagacaaggauuuucuggaagacauggauagucuggaagacauggcuuuguuggaagacgug

SEQ ID NO: 3775 - RNA, 71 nt, Human
cacggccauuugcucuuuuccuagacuagcuauggcugggccuggucaagcuuugggaggcugaggcugug

SEQ ID NO: 3776 - RNA, 89 nt, Human
cacuauggguuuccugugacauuuugagcaaguaugccucugugacugggguucuuacacuccagaauggaugagaagcaccguaagug

SEQ ID NO: 3777 - RNA, 70 nt, Human
cacuauguuggccaggcuggucucgaucuccugaucucagaugauccaccugccucggccucccaaagug

SEQ ID NO: 3778 - RNA, 92 nt, Human
cacucuucuccuuacccugagaugugcuguuagagaucuucgaagccauauuuucuccagauguuuugggaugaggagacacaacaacagug

SEQ ID NO: 3779 - RNA, 74 nt, Human
cacugccaccacuuggccuggcguggccacguucuuacucaucuggagccaggcaaggcaaagugaugguggug

SEQ ID NO: 3780 - RNA, 83 nt, Human
cacugcuugaauacacugagacccggaaucaguuccuugaugagcucauggagcuugagaucuucuuagcccagagagcagug

SEQ ID NO: 3781 - RNA, 79 nt, Human
cacugcuuugcacaacuccaggggaugcuguucacauacaacacaaaaugaauuguguuuccuggaguugagagcugug

SEQ ID NO: 3782 - RNA, 87 nt, Human
cacuggcagcaguucuacuuccugagcaagcguggccggaaccuucugcguaacccgugugggggaagaggacuuggaaggcuggug

SEQ ID NO: 3783 - RNA, 69 nt, Human
cacuggcuuccaagugcagcaacccagcccauggagauugccucuucuaggcaguugcucaagccagug

SEQ ID NO: 3784 - RNA, 84 nt, Human
cacuggugcuuucaucaucagaggucaaauuauuaugauaacuauuccauuaaguuugccaaacauuugucgugguuaccagug

SEQ ID NO: 3785 - RNA, 97 nt, Human
cacuguagggcaguaaggaaagaauguucuuuuucaaaaauagucugagccaauuggauguuuuuguggaauauuuuuuuaauuugcccugcaugug

SEQ ID NO: 3786 - RNA, 85 nt, Human
cacugucaucugagccucccccagcaccauagcccgccaccaucaauacuucagucgggcgugcuggacaccccucggagccgug

SEQ ID NO: 3787 - RNA, 75 nt, Human
cacugugugauuugauuccaagcuacccaugaagaaacccagacucagaggucacuugccuagggucacacagug

SEQ ID NO: 3788 - RNA, 77 nt, Human
cacuuccuaaaauaccuguaucacagaugaccuugaagaagaccauuuguccaaugaaccaagguaugccugaagug

SEQ ID NO: 3789 - RNA, 61 nt, Human
cacuucgcuggcucggaagacuggggucggaaacccugcccgggccgugccagcggagcug

SEQ ID NO: 3790 - RNA, 74 nt, Human
cacuugagcccaggaggcggagguuggagugagcugagauuguaccacugcacuccagccugggugacaaagug

SEQ ID NO: 3791 - RNA, 96 nt, Human
cacuuucaugucugccuucuuugcuggaaggugccucccuauuccacagacuuuggaucagugggugugggggaauccaaggcagaccaugaaaug

SEQ ID NO: 3792 - RNA, 87 nt, Human
cagaaacgucccacaugcccaccaggagcaagcuucaaaauguucagcuugcuuacauuaagcagaguaauuccagggauguuucug

SEQ ID NO: 3793 - RNA, 79 nt, Human
cagaaaggggcguggcaccagcaccacccaaccagaagaaaaaucucucuuuggugcuagugucauagcucccuaucug

SEQ ID NO: 3794 - RNA, 92 nt, Human
cagaaaugaacaaaacuaaugcuagcagguuaaaaucaaucaaaauguuuaaaaauugauucuguccucagcauguuauuuccucagcucug

SEQ ID NO: 3795 - RNA, 69 nt, Human
cagaaaugcuuccuggaauauuacgucagcuuggugcugacaguuuaacaagccuuaggaaguuagcug

SEQ ID NO: 3796 - RNA, 85 nt, Human
cagaacuguggagaaugaacugaacacaaagugaaagaaaaugaggagaacacuuuguauuuaccccaaaaucuuuucaguugug

SEQ ID NO: 3797 - RNA, 111 nt, Human
cagaagggguuuuuaucaaaaauauguagauucuacuacaauauuuuagcuaaagaagaagaaguaguaguagcaguaguagucaguauuuuugacccugacccaacucug

SEQ ID NO: 3798 - RNA, 72 nt, Human
cagaaguacuggccaaagcgaggaauggaggagcauucacuggcuucuccccgccuacguuccagacuccug

SEQ ID NO: 3799 - RNA, 74 nt, Human
cagaagucucccugcugaaucgaaaggaagugcuacaauauucuuucaaauucaucgcaguugagagaaaacug

SEQ ID NO: 3800 - RNA, 60 nt, Human
cagaagugauuugcuccuuaaaggggcuguuccuugcccagaaaaggugucacacuuuug

SEQ ID NO: 3801 - RNA, 67 nt, Human
cagaaugucagagcugagucugguguuacugacuaaggaacaaccugacucaggcucuagauggcug

SEQ ID NO: 3802 - RNA, 67 nt, Human
cagaauguggaucugccgaauugaagaggccugauuucagcuccaccagaugcagauuuguguuuug

SEQ ID NO: 3803 - RNA, 93 nt, Human
cagacaugagccacugugcccagccagggcuguguguuauguagugacagcucacugauacagcucucucuggggacuuaggaaccaaguuug

SEQ ID NO: 3804 - RNA, 96 nt, Human
cagacugggccaauguccacaaagaauuccuggucagcaccaccgaugucaaaaggugcaauaucaaggaagggcaaggcgugauggcuuaauuug

SEQ ID NO: 3805 - RNA, 77 nt, Human
cagacuucacagagaaugcaguugucuugacuucaggucugucuguucuguuggcaaguaaaugcaguacuguucug

SEQ ID NO: 3806 - RNA, 80 nt, Human
cagacuuccguauggcaucguuggauuucagaggcuuucugguguaucuguaaaucugaauguugccuucugccagucug

SEQ ID NO: 3807 - RNA, 66 nt, Human
cagagagggagacgcagagccagaccugacgggcugugcuuucaaaacugugcagucuccuuccug

SEQ ID NO: 3808 - RNA, 72 nt, Human
cagagaugaggcagaguggagagaaacaacucuggcugagccagagucuccagccacuacuucuuauuccug

SEQ ID NO: 3809 - RNA, 94 nt, Human
cagagcccaugcagggcuuuagauuuggacacacaagaguugauaacuuccucaugaacuccuugccugaucuaaacucauauuauggguucug

SEQ ID NO: 3810 - RNA, 78 nt, Human
cagaguauaugggggccucugccaccccccaggcugggacuggggccugugaccuugagaaccucaucucacauucug

SEQ ID NO: 3811 - RNA, 70 nt, Human
cagaguccccuuucucagaaguacagcccuuccacagagaaaugccuggcugagauucaggggaucuuug

SEQ ID NO: 3812 - RNA, 61 nt, Human
cagaguucagugcccugcuucagggcagagaccaaguuguggagucaggaacugaaagcug

SEQ ID NO: 3813 - RNA, 89 nt, Human
cagaucaaugccuggggguacagggcaggggacaguagauauguccccugauaaugcaucaccuucccuaaacaucccaacauggucug

SEQ ID NO: 3814 - RNA, 91 nt, Human
cagaucauuaaaucagauuuaaagaacuccaacaggacugggaaucuagccuccucagaccugcgaugauguuccuugcucuugagaucug

SEQ ID NO: 3815 - RNA, 76 nt, Human
cagaucccggaaugccugaaccaacuguuuugagccuacuuuggggauaacaggauuauuuggucuucuggauuug

SEQ ID NO: 3816 - RNA, 86 nt, Human
cagaugccugucucagcacagcuggguucugugcucagggucuccccaggcugaaauccaggugcuguggacugcgcucucgucug

SEQ ID NO: 3817 - RNA, 73 nt, Human
cagauggcuaaugagcaggcguuucuucauuuuucuuugcaaguuuguucuauaugcucguauggccugaaug

SEQ ID NO: 3818 - RNA, 69 nt, Human
cagauucugaaaauguccuaggagaagaugagucuucugaugaccaggacauggaagucaacgagucug

SEQ ID NO: 3819 - RNA, 90 nt, Human
cagcaaagaggaggcugaaagaggguugccacuuuuacaguugaauccaaaagcuuuuauaagaaaaaacuccuuucaucucuguagcug

SEQ ID NO: 3820 - RNA, 70 nt, Human
cagcaccgaggcgcugugccucgccaucucuaggaacuccgagcagauggccagccacagcgcagugcug

SEQ ID NO: 3821 - RNA, 76 nt, Human
cagcagcuauugcuauucaauggagacgguggccaccauuuccccugcaucgucucuccuacguaaucagucccug

SEQ ID NO: 3822 - RNA, 92 nt, Human
cagccaaagagucuacuucagaagcggaggcacugggaguccgguuugggauugccaggcugugguugugagucugagcuugugagcggcug

SEQ ID NO: 3823 - RNA, 70 nt, Human
cagccacugcccuugcccuggucagcaccauucagguuggugucgaccuugcaggcagcggcaggagcug

SEQ ID NO: 3824 - RNA, 63 nt, Human
cagcccugagugcccaguccacugaggcccuggaagggcuaagugggcggggacccaaggcug

SEQ ID NO: 3825 - RNA, 80 nt, Human
cagcccugggcugaucccagcugugugucaccagaagcuuucccggcuucucugugaggggucccaccagcccagggcug

SEQ ID NO: 3826 - RNA, 62 nt, Human
cagcccugugccuuugcuagagaaccgacaaucaaacccuuuucuguggaggaucaaggcug

SEQ ID NO: 3827 - RNA, 60 nt, Human
cagccuugugugaaaaugccuucuuccucuuuaagaaaaaggacaauuuuuaagcugcug

SEQ ID NO: 3828 - RNA, 65 nt, Human
cagcgacaguguaagccugaaucucuugcuuuucaucaucauuuuaggaucaacacuguauguug

SEQ ID NO: 3829 - RNA, 130 nt, Human
cagcgcggcucccgccacccucaauaaauguugcuuggaguggaccgaggcucugcaggaaugcagggagggccgggcuccgccccaggguuauuucuaaguugaggacaggagguugugaguucugcug

SEQ ID NO: 3830 - RNA, 84 nt, Human
cagcgcugggcaugcuggcggcagggggugcggggcuggccguggcucugcauucggcugugagugccaguugaccuggagcug

SEQ ID NO: 3831 - RNA, 99 nt, Human
cagcggggcggcggcggcggcggcggcggcuguggaggccgcaguccggguccuggcuucggccucagccccaccauggugacgcuugcugaacugcug

SEQ ID NO: 3832 - RNA, 88 nt, Human
cagcggucuucgugcuggcacccuacagcagauggagccugucaacggacaggugacgguccuggucaugugccacacgagggagcug

SEQ ID NO: 3833 - RNA, 63 nt, Human
cagcguccaaggcuuccugaaaagcagucuugcucucgaucugcuucaccaucuuggcugcug

SEQ ID NO: 3834 - RNA, 100 nt, Human
cagcuccacccaacucccaucccucuuccagcaaccacagauaaugacaauuguuugugaggugcuuggagauccccuagaugaaagguucugggugcug

SEQ ID NO: 3835 - RNA, 63 nt, Human
cagcucugaggggccucaaaccaggcccugaggaugggccgggcaggaggagcuccggagcug

SEQ ID NO: 3836 - RNA, 81 nt, Human
cagcucugucucgaucugcuccucgaggucucgaaccucccgcaugauggugccuguguccucgauggucuggaugagcug

SEQ ID NO: 3837 - RNA, 79 nt, Human
cagcucuuaucugaaaacuacaccgcuguggcccagacugugaaccugcuggccgaguggcucauucagacagguguug

SEQ ID NO: 3838 - RNA, 84 nt, Human
cagcucuucucuuuggacacaugggccuucuuagaggguucagucuaggacccggcucuccuggcccuguguugaggguagcug

SEQ ID NO: 3839 - RNA, 91 nt, Human
cagcugaaaagagagggucagggggaggcuggcugcuugcuuagguggaauccaaguuuucccguggcccugccuauacucugguggccug

SEQ ID NO: 3840 - RNA, 101 nt, Human
cagcugcucagagccagggcagugggugagggacaggaacccagggagggaccauucccauaacugccccacuaagucccugcccuccaaugacucaucug

SEQ ID NO: 3841 - RNA, 87 nt, Human
cagcuuccaaagccaggaugaagaggaggagaaaggaugggguccacaccuuguuuucuccaccaucauccaggggcucugcugcug

SEQ ID NO: 3842 - RNA, 70 nt, Human
cagcuucucuuucuuucugccuuucagaugggcuucuuucgccgaagguacaaagaaauuaucgaagcug

SEQ ID NO: 3843 - RNA, 94 nt, Human
caggaacugcgcuucgcuuccgagauccugugcacaggcaccugccaaauacacgguguaugacgcaaagggauaugugaagccccagaacuug

SEQ ID NO: 3844 - RNA, 73 nt, Human
caggaagacgggcacuggggggcuggguggggcuuagcgcagguccuccucaucgcccuggauggucuucuug

SEQ ID NO: 3845 - RNA, 85 nt, Human
caggaauguuuuuuugucucugccgugacuucuaacauagcauaugagguuaaaacacugcuuuaguaaaaauggaauacucuug

SEQ ID NO: 3846 - RNA, 88 nt, Human
caggacccagugaggcacgacgugguuuacuagaaguggccgguuuccuggcagcuuuguaaauggacucuaaccucaguggaaucug

SEQ ID NO: 3847 - RNA, 89 nt, Human
caggacuuggagucuaggggagggaugauggcaaugaaagguuucuuuucuccugucacaucuugcuccagacgucaucuugucuccug

SEQ ID NO: 3848 - RNA, 82 nt, Human
caggagaagucuaauccacagguuacaccuauguuugauaugauauaaguucucuuugcguaggccacuggguuuucuccug

SEQ ID NO: 3849 - RNA, 75 nt, Human
caggaggcagaaaguuccagaaaccaaggagccaaccuguggauuaaaggguauugugacucacauguccuccug

SEQ ID NO: 3850 - RNA, 65 nt, Human
caggagguccggcccggggcuggaggggccgaggcaccccgcaggcuccaagguccgagguccug

SEQ ID NO: 3851 - RNA, 96 nt, Human
caggaguacgacgcugugguagcuaugaucaugccacugcacuccagccugggugacagagcaagaucuagauaauuacagucuguccugcuccug

SEQ ID NO: 3852 - RNA, 79 nt, Human
caggaucgagggcgugcugugcggggccgugaagcagcugaaggucacccgcgccaagccugacagcacccucuaccug

SEQ ID NO: 3853 - RNA, 73 nt, Human
caggaugcuacacaaugggguugggaaaggcccuggggccgaggagaaggguuccaaaccggugugguaccug

SEQ ID NO: 3854 - RNA, 62 nt, Human
caggauuucacugcgcuaaccaggaugggucucgaucuccugaccucgugauugaaauucug

SEQ ID NO: 3855 - RNA, 74 nt, Human
caggcagaagaagaugcccaugauggcgcccugcauggagcgcggggccucugaguaggcaaacuccaggccug

SEQ ID NO: 3856 - RNA, 68 nt, Human
caggcaggcaguugcagucaccugggacuagcaagguuuugaugcuucagugagugacugugugucug

SEQ ID NO: 3857 - RNA, 99 nt, Human
caggccaggcaggggccacgugugggccagucagccacuacaagauuuuugcuaagcuuugggcuguuggcagcaucuuggaccucaugccugggccug

SEQ ID NO: 3858 - RNA, 61 nt, Human
caggcccugccacggccaacucaggucagccagccugaggcuguggccuccaaagggucug

SEQ ID NO: 3859 - RNA, 61 nt, Human
caggcccugccacggucaacucaggucagccagccugaggcuguggccuccaaagggucug

SEQ ID NO: 3860 - RNA, 72 nt, Human
caggccgagaagaacguggagaagaaaauggaaaauaacagaggucucaagaaccauggacuccugggucug

SEQ ID NO: 3861 - RNA, 69 nt, Human
caggcgcguaccauagcuuuccuucuugaacaagccuuccgcaucaaggaggacaucucugcuugccug

SEQ ID NO: 3862 - RNA, 62 nt, Human
caggcuggagcgcaguggcgaucauggcccacugcggccucgaccuccugggcuccagcgug

SEQ ID NO: 3863 - RNA, 71 nt, Human
caggcuguaaucugucucugcuggggugaagggacggagggagacagaugagaaaugagaacacagaccug

SEQ ID NO: 3864 - RNA, 64 nt, Human
cagggacaaccauccucucccuguguccccugccccccacacugagggaaugucuguguccuug

SEQ ID NO: 3865 - RNA, 89 nt, Human
cagggacacugagcuggcuaucucggcgcuucgggcaagaacugcaacaggcucuccugggguccugcagguguacagccgggccccug

SEQ ID NO: 3866 - RNA, 73 nt, Human
cagggaggcugcauggggccagcgcuagguggcugacucagcagcagccauggggcuggaagaagcuucccug

SEQ ID NO: 3867 - RNA, 88 nt, Human
cagggcaaacaaccaggucggccuggcccccguggcuuaagccuaagucucuucagccaccucccaggaagaucuggccucuguccug

SEQ ID NO: 3868 - RNA, 80 nt, Human
cagggcauggcagccugagaagucagagcuggaagcauccaguugccugcucuucacuugugucaggcuguuccuuccug

SEQ ID NO: 3869 - RNA, 84 nt, Human
cagggcauuccgcagggcaucugccuccuggcugccgcucagacugaggagccaggagaccccaccgcccagcguguugcccug

SEQ ID NO: 3870 - RNA, 85 nt, Human
caggggaccuggaaguuggaacaauuuugcuccugggacaccgaggggcuuacgucgaagauucgccagacuuuugggccuccug

SEQ ID NO: 3871 - RNA, 66 nt, Human
cagggggccuggccacaugagggaguccacagaaaaccuucccuccuggcccacccagguccccug

SEQ ID NO: 3872 - RNA, 74 nt, Human
cagggggucuggcugggggcugguccaugcuugugguuaguggacagcagccacccauuugacagcuaccucug

SEQ ID NO: 3873 - RNA, 74 nt, Human
caggguugcugggucagacugugcaagaccccccuuggccacuuguaaaguucggaucucaguuccagccacug

SEQ ID NO: 3874 - RNA, 79 nt, Human
cagguaugacaugugccacugugucugaaauuccugagcaccgagggccgcuucaggcaccaggcacuuugccaaccug

SEQ ID NO: 3875 - RNA, 66 nt, Human
cagguccccgcagguccgggcacuagcaccccucccagcagccccgugcggaccugcgggccccug

SEQ ID NO: 3876 - RNA, 85 nt, Human
cagguccugccuguuccccauggugcuucucacccugaaacccucagagcuacagccagggauagagcagaugagcagugagcug

SEQ ID NO: 3877 - RNA, 60 nt, Human
caggucgcgcugccgccgccacugcugccgcucaaacagcaggguggcgcgagcccccug

SEQ ID NO: 3878 - RNA, 89 nt, Human
caggugcaugucaccaugucuggcuaauuuuuguauuuuugguagagacaggguuucaccauguuggccaggcuggucuugagcuccug

SEQ ID NO: 3879 - RNA, 91 nt, Human
caggugugcauggggaggccuguuggcugcucacuggcauuugggaccuggaggcggggagcagacacaucagcacucgagugaacaccug

SEQ ID NO: 3880 - RNA, 66 nt, Human
cagguguuugugaaauuuuccauugcacaaauuauagucaguacggagaaaaucauucagcagcug

SEQ ID NO: 3881 - RNA, 92 nt, Human
cagguucagccuaugacccagguccaaaaguuccagccuucucugccaccuccagagcuagcuucagguucuggucaaagagcucacaccug

SEQ ID NO: 3882 - RNA, 71 nt, Human
cagguuuguuacacguguauacaugugccauguugguguggacagagcacauuuuuguauaaacaaaccug

SEQ ID NO: 3883 - RNA, 92 nt, Human
caguaaacauaaguuccucaggagaguuugaugugugucaggugcuuagaacagggccugauauauaaucagcccaugaugagcuauuacug

SEQ ID NO: 3884 - RNA, 68 nt, Human
caguacucaucgggaucguguggauuaugagccaucgcauuaggaaucccuacgaucucgauauacug

SEQ ID NO: 3885 - RNA, 76 nt, Human
caguagagcaguuauuaaaccuuaaaguuccaaaaugaucuccuucgacuuuaugucucacauucaugucaugcug

SEQ ID NO: 3886 - RNA, 96 nt, Human
caguaggccagcaccgugucgcgcagcgccagguucucgggcagugccuuggcccaguagcccggccgcgugaccagguccgggcaggcguacuug

SEQ ID NO: 3887 - RNA, 79 nt, Human
caguauaacuaugacccuucuggaacugcuucuccacaaaccacuacagagcaggcaauuuuggaaggucaguaugcug

SEQ ID NO: 3888 - RNA, 130 nt, Human
caguauguuccucuaagguugucauaauaagugcaucauuaccaaguauuacagcagguacugguuugcaucagggcugcugacguugucugugggcauuguuaagaaaccaaucugggaaacaaaucug

SEQ ID NO: 3889 - RNA, 80 nt, Human
caguccagggaaaacagcugaagaccaagauggugagcucugauugcuucaguuggucaucaacuauuuucccuugacug

SEQ ID NO: 3890 - RNA, 76 nt, Human
cagugaaggaagaaccuguagaagaugaccucguuccggagcuggguaucucaaaucugcuuucauccagccacug

SEQ ID NO: 3891 - RNA, 73 nt, Human
cagugauuuugugaucugcuaauggguugccacccacaaccauugcuuuagcacuuuuacuucaaaucagaug

SEQ ID NO: 3892 - RNA, 72 nt, Human
caguggccccugggcaggggcacccaggcugaacccugaggugcugccugcuugguccugccuuggccucug

SEQ ID NO: 3893 - RNA, 76 nt, Human
cagugggaaggggggccgauacacuguacgagagugaguagcaggucucacagugaaccggucucuuucccuacug

SEQ ID NO: 3894 - RNA, 72 nt, Human
cagugucccauugucaucuacucagucucuaauagggcuaaggagcaugauaguaucuauuuauaagcacug

SEQ ID NO: 3895 - RNA, 63 nt, Human
caguguggagcaggggcugggucugaggccccuccugaggcuucauccuugcucugcagccug

SEQ ID NO: 3896 - RNA, 91 nt, Human
caguguggucaguguuaccauccauacugugucaguauuaagaucacuaaagugguucuuagcaaagguuggaggugucuugagugcacug

SEQ ID NO: 3897 - RNA, 117 nt, Human
caguuagcaugccaggaauauacaguaaagaacaagguggaucuucuucacggagguuacugugugagacgaaagacaguucacuguucaucacuggaaauacuguacgugcuacug

SEQ ID NO: 3898 - RNA, 61 nt, Human
caguucggcuuccgcgaaaacgacucuugcuguccacauagccagccgugaagccaaacug

SEQ ID NO: 3899 - RNA, 68 nt, Human
caguucgugguguuggcgggccugaggaguaugaacggugccuuagcguuuguggacacuucggacug

SEQ ID NO: 3900 - RNA, 79 nt, Human
caguuugcaauuacuuucucgauuggugucaguaguuuuacugauuaggacuuuuauugugaauuacaguugaaagcug

SEQ ID NO: 3901 - RNA, 80 nt, Human
cauagcacaggagauucagagggcugggaugacuucugagcugcucucuauacccaaggcccuuucaauuucuagcugug

SEQ ID NO: 3902 - RNA, 82 nt, Human
cauagucuugcugucacccaggcuggagugcaguggcgcaaucucugcucacugcaaccucuggguucaagcaauucucaug

SEQ ID NO: 3903 - RNA, 74 nt, Human
cauauccugaacugagauaugcaaaauacucauuuucaaguuauggaaauguguuuguggcauauaggacugug

SEQ ID NO: 3904 - RNA, 60 nt, Human
cauaucgacguagaaugucugcaugccccaugguuaucaacagacuaugcgucugaagug

SEQ ID NO: 3905 - RNA, 106 nt, Human
cauaugguccaauaucaaagggaaugauagcauugaaggacucggggauaucuaacagcaauaccugaucacuacuucgcacuaguuucucgguacuacgcauaug

SEQ ID NO: 3906 - RNA, 104 nt, Human
caucaacgagaagcugugcuacguugcccugggauucgagcaggagaugggcaacgccggaucuccucuccucugggggacgacgcuacgcagcuugccggaug

SEQ ID NO: 3907 - RNA, 94 nt, Human
caucacccaaagcaguggccaacaucgcggaccccugugccuugucacagaugggugcugguccucaggcguuggggacacugcugggucgaug

SEQ ID NO: 3908 - RNA, 131 nt, Human
caucacccagugguucucucagcaacagacauguccaguggaccguaguguugugacggucgcccaucugcgcccaguaccucggaucaugcggaacauguugucaaagcugcagauugccugugacaacg

SEQ ID NO: 3909 - RNA, 63 nt, Human
caucacgccagucauuuuauuuccaucaucauccuugugaagaaauggaagucuggagaggug

SEQ ID NO: 3910 - RNA, 79 nt, Human
caucagcuauuccuguucuagaaagggcacucuggcugcaauguggaggagggagugacuggaggaagggagguaagug

SEQ ID NO: 3911 - RNA, 65 nt, Human
caucaggaccagcucugagaucccuuaaggagagcagauugagggagacaugaggugguucuaug

SEQ ID NO: 3912 - RNA, 76 nt, Human
caucaggccgaaucaggguguugaccuuggccacaucaaugucauacagcuucuucacagccuguuuaaucuggug

SEQ ID NO: 3913 - RNA, 64 nt, Human
caucauuagagcccugguagaaugacagccuuuuucagguugccagucuccucauccauguaug

SEQ ID NO: 3914 - RNA, 66 nt, Human
cauccacaccuaauguccacauggucagcaccacccugccuguggacagcaggaugauugaggaug

SEQ ID NO: 3915 - RNA, 83 nt, Human
cauccaucuucacauuaacaacuuuuuaauuaaccuucugacacugucaauaagaaguuucacuguuguuguggaaagggaug

SEQ ID NO: 3916 - RNA, 71 nt, Human
caucccaucucugaucugugacacgaggagaggagccccucacucacccgacacagcucaggguggugaug

SEQ ID NO: 3917 - RNA, 76 nt, Human
cauccgcagccaggccucccugacaacccagcaggccaucggccugaagcauuacagugacuuccuggaacguaug

SEQ ID NO: 3918 - RNA, 64 nt, Human
cauccucucaggcagagcagggugguccgggccacacugggccuaccucuccagccucaggaug

SEQ ID NO: 3919 - RNA, 62 nt, Human
caucgucaccaaggcacgggggaagaguggaccacucuucaacuuugauguucaugacgaug

SEQ ID NO: 3920 - RNA, 82 nt, Human
caucucgagacagcgguucagaaagucccggaagauagcugacagcuucucuggguucugaaguucuggggucccauuggug

SEQ ID NO: 3921 - RNA, 75 nt, Human
caucucuacagucuucacaugccccacuccagccgugugguagcacgccuugcuugugacccugggauagagaug

SEQ ID NO: 3922 - RNA, 85 nt, Human
caucucuuccuuuugaagauccgucugcuaugauuaagauccagcaauccaccccuuuggcagugauuuuggauaugaagacaug

SEQ ID NO: 3923 - RNA, 80 nt, Human
caucuggauuguuaagaccacagcaacuggcacauucgaccaaguucuuagggugaagucucaguaggccaguccaggug

SEQ ID NO: 3924 - RNA, 62 nt, Human
caucuuggucccucucuaggcugugauggaaucugaaaugaaguuugacaaggaccaugaug

SEQ ID NO: 3925 - RNA, 65 nt, Human
caucuuucacuggaauugcaaagggauagccauaugaaacagcuccuccucauccaagagagaug

SEQ ID NO: 3926 - RNA, 65 nt, Human
caucuuugcccgucuccuggggaccccccaagaaauguggaguccucgggggccgugcacugaug

SEQ ID NO: 3927 - RNA, 63 nt, Human
caucuuuggguauuugaauagcaagcgcucuuuuuugaguggcgcugcuuaaaaaccgagaug

SEQ ID NO: 3928 - RNA, 71 nt, Human
caugaacacgugugggccucggucaccuggcuuugagggcagucugaccaggcuagaccacacgugccgug

SEQ ID NO: 3929 - RNA, 73 nt, Human
caugaccacaguccaugccaucacugccacccagaagacuguggauggccccuccgggaaaacuguggccgug

SEQ ID NO: 3930 - RNA, 71 nt, Human
caugaccacaguccaugccaucacugccacccagaagacuguggauggccccuccgggaaacuguggcgug

SEQ ID NO: 3931 - RNA, 108 nt, Human
caugacuguuggcugaacucaacuggugauucuuacuuugaauggcuuaugugacugcgaucacaccaggacuggaguuaccugaagacucagcugggcagguuacug

SEQ ID NO: 3932 - RNA, 99 nt, Human
caugaugggacugguggcuuuaugaggagaggaagagcaacuggaacugggacacaugcuugcucugucuugccuuuugaugccuccugccaugucaug

SEQ ID NO: 3933 - RNA, 79 nt, Human
caugcccagggccgcgugugcccccagaggugcucuuggaggagggugccagggggaagagcgauggguccugugggug

SEQ ID NO: 3934 - RNA, 67 nt, Human
caugcgggaugcccagggacggcuggacagcacgcgugggcugcugugcggccugggcgcuggcgug

SEQ ID NO: 3935 - RNA, 85 nt, Human
caugcuucgggcauuccaugcagccuugcggaacucucccgucaacaccaagaaucaagcugugaaggagcgagcccagggcgug

SEQ ID NO: 3936 - RNA, 77 nt, Human
cauggaauaugagaaaauagcagaaacagauuuugagaagcgagauuuucggaagguuguuuucugcauggaccgug

SEQ ID NO: 3937 - RNA, 131 nt, Human
cauggaauuaaacuuucagucccacuguucauuuuauucauacauuaggguggcaaggguggucuugcucauugcaagcaaagucauccugguucaugaaaugaagaauguggacugugcaguuuucccag

SEQ ID NO: 3938 - RNA, 125 nt, Human
cauggaugacuuggggaccuuguauggacagaacuggcucaaugaccaggugaugaacauguauggagaccuggucauggacacagucccugaaaaggugcauuucuucaauaguuucuucuaug

SEQ ID NO: 3939 - RNA, 75 nt, Human
cauggcugagcauccaugggguccugggagucuugccccucagagucaacagggagccccaggguggcagacaug

SEQ ID NO: 3940 - RNA, 130 nt, Human
cauggggucgugucacugggcuccucagggaaggcaguagguuguauaguuaucuuccgaggggcaacaucacugcccugaaaccacacaaccuacuaccucaccccgccaggcccggccuugcacugcg

SEQ ID NO: 3941 - RNA, 73 nt, Human
cauggucugugagagguggcaggaauggggacccucaccccccaagcagccugugcccucuggccgcacugug

SEQ ID NO: 3942 - RNA, 80 nt, Human
cauguaauuucugcuuuguuggucaggguuuacagcauuaauggacaguucacccugacuacaagucggaacgugacaug

SEQ ID NO: 3943 - RNA, 68 nt, Human
caugucagaagcucaaagcgacucauaaugcaugugaauuugcuuuggagagacuuaucuucugagug

SEQ ID NO: 3944 - RNA, 76 nt, Human
caugucuuaucccgcugaugauuaugagucugaggcggcuuaugaccccuacgcuuaucccagcgacuaugauaug

SEQ ID NO: 3945 - RNA, 79 nt, Human
cauguguguguauauguuucuguccguaugucaucuuuaucaucagugugaaacacgacuuccucuauauacacguuug

SEQ ID NO: 3946 - RNA, 79 nt, Human
cauguugucacuuaacccccaggaguuauuuauuaucuuuuuguuaaagucaggcucauuugggguaaugugaugacug

SEQ ID NO: 3947 - RNA, 102 nt, Human
cauuacugcagcgggcaugaaaaccggcaggguguuaggcucauggccugaagagaagucacaucaccagccgauguuuucaugcaaaaggcaaucgugaug

SEQ ID NO: 3948 - RNA, 60 nt, Human
cauuagagcccuguagaaugacagcccuuuucagguuggcagucuacuaauuccuguaug

SEQ ID NO: 3949 - RNA, 100 nt, Human
cauucaccuuuucacucaacucuuacaacucugugaaguaguaacuauuauuaucccuauuuuacagagauagguaagcagggagauaaguggguggaug

SEQ ID NO: 3950 - RNA, 62 nt, Human
cauuccccugucugucugcauuugucucagaacauuuccuuggcuggacagaugggguuaug

SEQ ID NO: 3951 - RNA, 77 nt, Human
cauugcuuccuccgugugauuuccgaagcaaagcaaugggacccuacgcuucagagucuuauugggguggggcagug

SEQ ID NO: 3952 - RNA, 70 nt, Human
cauuggacgcaacaaagacgccaagauguaguuguauacaacaauguugguucuuucgucugcuacagug

SEQ ID NO: 3953 - RNA, 67 nt, Human
cauugucgucauuggacacguagauucgggcaaguccaccacuacguggccaucugaucuauaaaug

SEQ ID NO: 3954 - RNA, 92 nt, Human
cauuucauaucuaccucccaaagauauuccuguagauucagucuuacacacuuaauuugacuuggaauugucuuaaggaugcuuuugaauug

SEQ ID NO: 3955 - RNA, 78 nt, Human
cauuuccagauuuauuuccaauuucaguuucaaaacaaacugaccugaaauuuuuaguauuuacuaucugugacaaug

SEQ ID NO: 3956 - RNA, 72 nt, Human
cauuugaauugguagaccgaguaaugaagaggcagcccucccuaaugugcauggacaucauccaauucauug

SEQ ID NO: 3957 - RNA, 79 nt, Human
cauuuguuucacuguguucaauuuugaguuuccuaacauccauucuacaggucaaucaaaauacaaaggcgugcaaaug

SEQ ID NO: 3958 - RNA, 79 nt, Human
cauuuuucacucuuuaaaaucacauucaaaaaucggcaaagaaacgccccggggaaugaguagacgggaggggagggug

SEQ ID NO: 3959 - RNA, 92 nt, Human
ccaaagagcugaauguuauguuuauugaaaagugcaaaagcuggauacaauguaaagcagcucuuucgacguguagcagcagcuuugccggg

SEQ ID NO: 3960 - RNA, 94 nt, Human
ccaaagucccaacggccacgccuaacaauuauaaaaguguucagcgagaguguuggcgugagugugaaugggugugcgcuggggggcacggugg

SEQ ID NO: 3961 - RNA, 77 nt, Human
ccaaagucuggggguuagaaagaaggaagcuugacccaaacaaaguuucauuuacaguauauacagucaggccuugg

SEQ ID NO: 3962 - RNA, 103 nt, Human
ccaaauuugucagguggggauuucaccccagccuuaugacucaguuuuagauuuaacuugauucauuuaagguuggaguuuauuucuggcuggcaaaauaugg

SEQ ID NO: 3963 - RNA, 89 nt, Human
ccaacaucugccacuuaggagcccugggaacgggugaccuucauaugacgaagaggcaccuccagcagccuugagaagcaagaacaugg

SEQ ID NO: 3964 - RNA, 83 nt, Human
ccaacgucuguucauggcugugguuuuaaaagagucccucaacagaugcucuauuuaauaaccaguuuguuccucagaugugg

SEQ ID NO: 3965 - RNA, 90 nt, Human
ccaacucauuacacagcugaaucagaaccacacacuucucagaccuaaggacagaguaggucugauucaugauguguuucagcuaguugg

SEQ ID NO: 3966 - RNA, 99 nt, Human
ccaagaacuuuuuggccccguguuggaugcagugucucgggacuucgucaguguccugcacaggucgcaucaagaaggcgggcuccggaacuuacucgg

SEQ ID NO: 3967 - RNA, 79 nt, Human
ccaagaucacucaauuuaucaguaauggagcuuacuucaucagcuuccuugccugcuuuuauaaauuagguucuauugg

SEQ ID NO: 3968 - RNA, 81 nt, Human
ccaagcugguuuggaacuccuggccucaagcaaucugcccgccccagccucccaaagugcuaggagcauaagccagcaugg

SEQ ID NO: 3969 - RNA, 73 nt, Human
ccaaggagaacuucaguugcuugacucguuuggaucacaaccgagcuaaagcucaaauugcucuuaaacuugg

SEQ ID NO: 3970 - RNA, 80 nt, Human
ccaagggagugcaauuuuucaucuuccaauggcggccucaaccuugaggcgaauccacuggcgaaagaugccuuucuagg

SEQ ID NO: 3971 - RNA, 64 nt, Human
ccaagucugacccacucugcguccuuuuacaggaugugggagggggcagcugggcugagcuugg

SEQ ID NO: 3972 - RNA, 131 nt, Human
ccacaauaguuuauuuacaauugaacucuuuauaagauauuuacaagacaaccaauuuuacacaucagaaaugguaucaaaaguuaugaauuacaacacagacaacaauaugaaaugggcauaaaacaaag

SEQ ID NO: 3973 - RNA, 105 nt, Human
ccacaauggcacugggggcaaguccaucuaugggaagaaguucgaugaugaaaacuuuauccucaagcauacgggaccaggucuacuauccauggccaacucugg

SEQ ID NO: 3974 - RNA, 64 nt, Human
ccacacagcccuauggucaaacaauccuacguuugugccucugcuuuuaaaggugcugugcugg

SEQ ID NO: 3975 - RNA, 71 nt, Human
ccacaccacuaugcaaccuuucugauauuccuccuguuggcauaaagagcaaagcaguugugguuccaugg

SEQ ID NO: 3976 - RNA, 120 nt, Human
ccacaccagaggcugugaccauggcuaguagacaguggcaacauagucauccccaagaugcuaaucuucugcuggaacugucauacguuaucauggucaauguaaaccugguuugugugg

SEQ ID NO: 3977 - RNA, 69 nt, Human
ccacaguucaagaaucacugguguccgaggagaucgugcacgaccuggauaccugugaggucacggugg

SEQ ID NO: 3978 - RNA, 89 nt, Human
ccaccaagcucuggggacuggaaugcaggcaguggaagccccagauugacuuaaccuguugacagaucuucagagaaacugcugguagg

SEQ ID NO: 3979 - RNA, 101 nt, Human
ccaccaguccaggggugggaauacagggggugggaggugugcauaagagguuauaggcacaggccagcccgguacagaacccuaggcguccugacaggugg

SEQ ID NO: 3980 - RNA, 65 nt, Human
ccaccauuaagcaguucauggacaucuucucgcuaccggagaugcucugcuguccuguguggugg

SEQ ID NO: 3981 - RNA, 65 nt, Human
ccaccugccccugagggagaggaaaggugaaguauuccugccaccucucccuccaagggaagggg

SEQ ID NO: 3982 - RNA, 78 nt, Human
ccaccugggagacugcugguaaagaugggagguggccuuugccgcuuuccaucuucucacugcaguuucuucacgugg

SEQ ID NO: 3983 - RNA, 63 nt, Human
ccacgccuggcuaauuuuuguauuuuuaauaaagaugcagugucaccauauuggccaggcugg

SEQ ID NO: 3984 - RNA, 77 nt, Human
ccacgggcuugguucuuaauaaaguuauucaacuucaaauuuuugugggagacugauuaaguaacuucggccagugg

SEQ ID NO: 3985 - RNA, 74 nt, Human
ccacuauuccuaaccgggggccuggcagggguggagugaugugaacuaagggucccuggaaaaggguggagugg

SEQ ID NO: 3986 - RNA, 75 nt, Human
ccacugcuucaugagcucaaaucuguuuuuucuagcuaagagaccacaggccaaagaacuaaagggcaagcaggg

SEQ ID NO: 3987 - RNA, 90 nt, Human
ccacugucuguaagauucccagcagcugcagccucaaaauuuuuaacaaucaggaguugcucagcuucuggcucaaucugucaaccaugg

SEQ ID NO: 3988 - RNA, 79 nt, Human
ccacuuagucucaacccggaaugaaauaugacugaggacucucagagaaacuuucguucaguauauuaugagaaagugg

SEQ ID NO: 3989 - RNA, 86 nt, Human
ccacuucugaaaacauccacggugaagggcagggccaggccuggcuguggagugggccagcugaguaccugggcgucacgaagugg

SEQ ID NO: 3990 - RNA, 108 nt, Human
ccacuugcaauuauuugaggaacuccgccgccuggcgcccauuaccagcgaccccacagaagccaccgccgugggugccguggaggccuccuucaagugcugcagugg

SEQ ID NO: 3991 - RNA, 83 nt, Human
ccacuuuauuauggaugauccagcaggaaacaguuacuugcagaauguguaugcgccugaagaugauccugagaugaaggugg

SEQ ID NO: 3992 - RNA, 69 nt, Human
ccagaaaggacaucacagguaaacugaaggacccugcgaacuuucaguauccugccgagucuguucugg

SEQ ID NO: 3993 - RNA, 80 nt, Human
ccagaacgauggugugcccucgguuggguccgggcucgaguccuucaugcuguccgggguugggaccgccgcguucucgg

SEQ ID NO: 3994 - RNA, 90 nt, Human
ccagaauguuuugagcuacuucgggauacuugguaaagggggcuauggaaagguucuccaaguacgagaaguaacaggagcaaauacugg

SEQ ID NO: 3995 - RNA, 88 nt, Human
ccagaugccagucacugccuaaggcacuggguauaugguauccccaaacaagaggcauaaucccaguccuuagguagugcuagcaugg

SEQ ID NO: 3996 - RNA, 91 nt, Human
ccagauucagcccauuuggccccgacgccucuguucucggaauccgggugcugcggauugaggucccgguuccuaacggacugcaagaugg

SEQ ID NO: 3997 - RNA, 77 nt, Human
ccagcagcccgcucuggccggggccgacuggcagcuccuaguggagaccucgggcaucagcaucuaccggcugcugg

SEQ ID NO: 3998 - RNA, 73 nt, Human
ccagcaucaucgcagagauccugagugucuaccagaagugcaaggacaagcaggcugcugcuaagugagcugg

SEQ ID NO: 3999 - RNA, 73 nt, Human
ccagcaugauccugaaaucugcauccgccgugguuuguauucauugugcauaucagggauacccucaagcugg

SEQ ID NO: 4000 - RNA, 63 nt, Human
ccagcaugaugggugcggccagcagcgaguccucacacguguugugcagcaccaguguguugg

SEQ ID NO: 4001 - RNA, 75 nt, Human
ccagcauucgcccaucucaagguuggcgugggacaucgguuggaugcccaggcuucugggaguacuugugcucgg

SEQ ID NO: 4002 - RNA, 121 nt, Human
ccagccaaugaagucuguacucugguggcuuccaguggaaaaggcauuuuggaggcagccugcagguccuggcucuggcauccgagagagacuggagcacccaguguuacacgugagcugg

SEQ ID NO: 4003 - RNA, 77 nt, Human
ccagccuaguguugcuuccauuacgccaguguuggaauccagccgccacuguuagcuaccuggaaaaccugggcugg

SEQ ID NO: 4004 - RNA, 72 nt, Human
ccagcuucccuacuccuacccuggcccuuuuauacuaggacuccuuaggaggagugagacaggugauaaugg

SEQ ID NO: 4005 - RNA, 91 nt, Human
ccaggaaaaguuguucuggccccucaucugguuucaugaaggacaauaucuagcaugagagugacagggguuagaauaauggacauuuugg

SEQ ID NO: 4006 - RNA, 68 nt, Human
ccaggacagggaggcuggccggagguuccugcagagggagcgucaaggcccugugcugcugucccugg

SEQ ID NO: 4007 - RNA, 74 nt, Human
ccaggagcuacacaccuucgaggugaccggccaggaaacggucgcccagaucaaggcucauguagccucacugg

SEQ ID NO: 4008 - RNA, 97 nt, Human
ccaggccugaccugucucuugaaggaguauuuguguugaagaugggugguaacguucagcaaaagccaugcccaggagacaggcacaguacccaugg

SEQ ID NO: 4009 - RNA, 89 nt, Human
ccagggaaaguaguaaguuguauaguuaucuucuaauuggggccuaauaucccuaccccacaacaauacaacuuacuaccucacccugg

SEQ ID NO: 4010 - RNA, 116 nt, Human
ccagguaucagucuuuuugucuauuccuggauuuuggugaaaacagaaucuaaucuuauauucgcagccuuaagguuagaaggucacuuacauccaguaaucacaguaagaucugg

SEQ ID NO: 4011 - RNA, 95 nt, Human
ccagguuaaauaaggguuccaaaaauucucugguccgggauuuuaaccuucgcuggaaucugucacacguuuggaacccucaaguguccaccugg

SEQ ID NO: 4012 - RNA, 75 nt, Human
ccagguuccacuucuauagccacgugagaaaaacauggaauaggugguccacacgaaguuauaguggaaacuagg

SEQ ID NO: 4013 - RNA, 63 nt, Human
ccagucaccagccucaggacagauacaaagcugucuggcuuaucuucuucaugcugggucugg

SEQ ID NO: 4014 - RNA, 85 nt, Human
ccagucagcucaggccucuauggagcaaagaaacugguguccuucuuggagcgcugccuucaucuccuugaacugagccaacugg

SEQ ID NO: 4015 - RNA, 67 nt, Human
ccagugaauuucccagcuauucuaaagcugcuuuauaguaauucugggaggauggguuauuauaugg

SEQ ID NO: 4016 - RNA, 81 nt, Human
ccauauaugcaacuauauuucauguuguaauacaaaggauuaaacuacaaaagugaaaauuaaaagucauugcauaugugg

SEQ ID NO: 4017 - RNA, 61 nt, Human
ccauauggaugaaggacuuggguaggaaagauguuccuguugaaguuacccaaccaaaugg

SEQ ID NO: 4018 - RNA, 90 nt, Human
ccauauuggacuuuccaucugucagaaggaugauggcaugucggauuuccugccaggccaucguuuccaugccgagguagucgcauuugg

SEQ ID NO: 4019 - RNA, 75 nt, Human
ccaucagucaggucugaauaacuuucgggauucuuugggaauguuuuaagaguucaugggauagaccgcaggugg

SEQ ID NO: 4020 - RNA, 66 nt, Human
ccauccauucacuguucagcuguacugugauuuaguuuuuacaccguuaaaacccugaguggaugg

SEQ ID NO: 4021 - RNA, 95 nt, Human
ccaucucugcuuauuccucugccacgucuuucccuucuccucucugcucucauaaagaagaaugggagaugaaaguggaggggcagcugaggugg

SEQ ID NO: 4022 - RNA, 78 nt, Human
ccaucugauuuugagcacaccauccauguuggcuuugaugcuguuacuggagaauucacuggcaugccagaacagugg

SEQ ID NO: 4023 - RNA, 74 nt, Human
ccaugcaggcuacuccauguuuggggcuggcaucaccguaggccugucuaaccucuucuguggagucugcgugg

SEQ ID NO: 4024 - RNA, 74 nt, Human
ccaugcaggcuacuccauguuuggggcuggccucaccguaggccugucuaaccucuucuguggagucugcgugg

SEQ ID NO: 4025 - RNA, 83 nt, Human
ccaugccugaagcuaaaaauauauacggguuuuugaaugcagcagccaauaaauuccauuuuguguggugguuuaggcuaugg

SEQ ID NO: 4026 - RNA, 84 nt, Human
ccauggaccgccuguacuuugugauggaguacgugaaugggggcgaccucauguaucacauccagcaagucggccgguucaagg

SEQ ID NO: 4027 - RNA, 106 nt, Human
ccaugggcucauugugacaggaaaagugccugcugcugcuucuuuacacccacccuggccaacagaaguacacagugcaguucaccuucaagaaugaagcaucagg

SEQ ID NO: 4028 - RNA, 83 nt, Human
ccauuaagauauuguagagcuuauuccuuccucaaauuccagcugguuuggaggugggaugcagaggcucugugucuuagagg

SEQ ID NO: 4029 - RNA, 101 nt, Human
ccauuauuuaaucagaauuacccuugcucuguuuaucugugaggccucagacacaacggugguucagcccucucccuaagcaguagcaagcugaguaaugg

SEQ ID NO: 4030 - RNA, 82 nt, Human
ccauuccaacggagucaguugggacuacaagccacucauuguuaaacacuuagugcuuuuaaaccaacuugcggaauacagg

SEQ ID NO: 4031 - RNA, 72 nt, Human
ccauugccacguagacauugcccagagugaagugguucacagcaaaguguggugcgaucucuacugccaugg

SEQ ID NO: 4032 - RNA, 92 nt, Human
ccauuugcucaguagaaguuuaauggagaaaucguuguuuaaaacaaucagucaaaaagaacagcucuuuuacaaacaaguuauggcagugg

SEQ ID NO: 4033 - RNA, 71 nt, Human
cccaaaacuauuguuuguguuucuguguuucauauucagugauuuaauacaguaucaugggcugagguggg

SEQ ID NO: 4034 - RNA, 111 nt, Human
cccaaacuacuagaacuguccaaggccaggaggaauuggaaagaagaugguuucuugaaaucucucuuccauacuucuuuggucuuuugcagcagacaguaacuuauuggg

SEQ ID NO: 4035 - RNA, 73 nt, Human
cccaagcaagccuccaggcccugaguguucugaugccugaaggguagucauaggucccgagguggagucgggg

SEQ ID NO: 4036 - RNA, 80 nt, Human
cccaagcccuugaccuccuuuuccuuaucugaaauguugcugugauuccuguggugagaucagaugaggcagcacuuggg

SEQ ID NO: 4037 - RNA, 69 nt, Human
cccaagcugggcccgcgacucgaaggugacugggauggugaucucguuggacugcguggcuagcuuggg

SEQ ID NO: 4038 - RNA, 95 nt, Human
cccaagcuucucucuguccccuucccuccaagcucugucucuuaaguuauuuaaauuauggcuggggucggggagggguacaggggggcacuggg

SEQ ID NO: 4039 - RNA, 94 nt, Human
cccaagguuacuugguaaguaaagagagaagccagaagccuggggccuccugacggcuccugcuucucuuuuuacuaaggucuucugccauggg

SEQ ID NO: 4040 - RNA, 63 nt, Human
cccacucuuacagccucugucucuuuauuuucaaggaagaaagaggcagacugaaauagaagg

SEQ ID NO: 4041 - RNA, 73 nt, Human
cccacucuugaagaagaaggcggcuccuccgggguccaaggugguuggccgcgucuucucccucggaagcggg

SEQ ID NO: 4042 - RNA, 87 nt, Human
cccagacagugcccguuuugagaugugaccugguggccaccaaaugccuuggccucagugcaaacuaagcagggcacacugccuggg

SEQ ID NO: 4043 - RNA, 73 nt, Human
cccagacgccaugaaagcugccauggccuggagaaaaagcugaaccaggccuuuggaaucuuaaugcccuggg

SEQ ID NO: 4044 - RNA, 72 nt, Human
cccagagccaugaaagcugcauggccuggagaaaaagcugaaccaggccuuuguggaucuucaugcccuggg

SEQ ID NO: 4045 - RNA, 75 nt, Human
cccagaggagucgauuccgaagcccgucacacucgcuucaaggacgacgacggcgacgaggaggacgaaaauggg

SEQ ID NO: 4046 - RNA, 84 nt, Human
cccagcccaagauugaauucugauuaaaggaggcugaauugcagagccuccuuucaucaaauucgaguuuugaauugagcuggg

SEQ ID NO: 4047 - RNA, 70 nt, Human
cccagcuacggcgcccggcggucagcagcgcggcagcgucuaugcaggcgcugggggccuggccaccggg

SEQ ID NO: 4048 - RNA, 94 nt, Human
cccaggaacuuuuggggaaggggccggcggggucaggaaucacuuuggaggguccggcaaguuuuggaaccccccgggcccaggcccacuuggg

SEQ ID NO: 4049 - RNA, 78 nt, Human
cccaggaggagcgcagcgggauggcguggaccuuguuggugguguagcugucccagaugaugagcuucccauccuggg

SEQ ID NO: 4050 - RNA, 111 nt, Human
cccaggagucggugacuaaucugggcaacauuguuauacccuaucucuauaaaaauaauuaaaaaauuaagcaggcauuagggugcaugcccauaguuccagcuccucagg

SEQ ID NO: 4051 - RNA, 71 nt, Human
cccaggaugaguucuaccgcagcggcugggcccugaacaugaaggagcugaagcugcugcagaccaucggg

SEQ ID NO: 4052 - RNA, 76 nt, Human
cccaggcgucgaagcaaugcuccggucuuagccucccaaguagcggcgaguacaggcacagugccacgacgccggg

SEQ ID NO: 4053 - RNA, 75 nt, Human
cccagggcaugaagaucacaaugggccugguucagauuuuucuccagggccguggcagcuuucauggcaucuggg

SEQ ID NO: 4054 - RNA, 113 nt, Human
cccaggggcacauggcauggagaguaaauggcagaaucagaauguggacacaaauuuguuugggucugaauccuguguucuuuucauuauaucgagugucuggccuccuuggg

SEQ ID NO: 4055 - RNA, 88 nt, Human
cccaggugguguugcuguccuucuccaauugugagucuguugaaugggauuaucuucauagugguuuucuucauggaauaccaccggg

SEQ ID NO: 4056 - RNA, 64 nt, Human
cccaucucugugacuuccuggagacucauuucuagaugggaagggaaguuaucaagacgauggg

SEQ ID NO: 4057 - RNA, 67 nt, Human
cccaucuggccguggggguccucccccagcuaugggccgaggagcuacccccuccaggcaugauggg

SEQ ID NO: 4058 - RNA, 83 nt, Human
cccauggcauaugucuugcagcccucuuuguguggaaaguaacuuauggcacgccaaguggcguugugagauaaccugccggg

SEQ ID NO: 4059 - RNA, 70 nt, Human
cccauugcgggccugggcuagggggaccaggcacucaccgccuccucccugguacacaggcuucuguggg

SEQ ID NO: 4060 - RNA, 71 nt, Human
ccccaaaauggaggacuuugcuaccaggaccuacggcaccaguggccuggacaacagaccucuguuugggg

SEQ ID NO: 4061 - RNA, 66 nt, Human
ccccacgcucaguccuggucaaaggcgugccagaccuuucugagugcccccagggaggggcugggg

SEQ ID NO: 4062 - RNA, 64 nt, Human
ccccacgcucaguccuggucaaaggcugccagaccuuucugagugcccccaggaggggcugggg

SEQ ID NO: 4063 - RNA, 66 nt, Human
ccccacgcucaguccuggucaaaggcugccagaccuuucugagugcccccagggagggugcugggg

SEQ ID NO: 4064 - RNA, 92 nt, Human
ccccagaugcaaugcgaucacagggucguuaccaucuucuuuauuaauuggucaacauuuugugugauccagcauuugagugacacuggugg

SEQ ID NO: 4065 - RNA, 63 nt, Human
ccccagccaaagaugacagcagaacaacauaauuuacacugugauuuaucuuuuugcugaggg

SEQ ID NO: 4066 - RNA, 75 nt, Human
ccccagcccggaagccuccacuaucuccagcccagacaaacccugugguccagaggaggaaugagggugcagggg

SEQ ID NO: 4067 - RNA, 64 nt, Human
ccccaggaggcggcgggggcgcaggggcgcgcgggggcgcccgugccggagccgcccaaggagg

SEQ ID NO: 4068 - RNA, 63 nt, Human
ccccagggcugggccauggggagggaaggacuuucucccaggggaagcccccagcccuguggg

SEQ ID NO: 4069 - RNA, 61 nt, Human
ccccccaggucgcaggugucugaggccagccaaccugcagagcacucgcggcguggguggg

SEQ ID NO: 4070 - RNA, 88 nt, Human
cccccguuugagggaguccaacuugccggguuguuaaaagaaccuccaggccuuuaagcauucggcuggguuggcccuuaaagggggg

SEQ ID NO: 4071 - RNA, 110 nt, Human
ccccgagggugugacugagagccaguccccagcacccuuguccagauggggaccaggaggugggugaagauauuuggggucugagcucugugcugguugcccccgagggg

SEQ ID NO: 4072 - RNA, 75 nt, Human
ccccggacacacccuuacucuccaaaaauugauggaaccagaacaacccgagaugacgaggagaagaggccaagg

SEQ ID NO: 4073 - RNA, 71 nt, Human
ccccggacucuuaccaccccauucuaggccccugaaacccaggggagcgagggcaacgugguaaacugggg

SEQ ID NO: 4074 - RNA, 121 nt, Human
ccccgguaucauuccucgaauuucagugcgggaaccaaugcagacuggcauuaagcuguggauagcuggugccaauggucguggucagcgugaacugauuauggugacggacagacugggg

SEQ ID NO: 4075 - RNA, 106 nt, Human
ccccgucuugcuaagcaguuuaguuagacugcaggccagucucuguggugugacaccccccaguggcaaggagcugccaaaacugagcuucugggcaagacguggg

SEQ ID NO: 4076 - RNA, 80 nt, Human
ccccucagcacccugccuugucuccaggagguccgaagcucugugggaccucuugggggcaagguggggugaggccgggg

SEQ ID NO: 4077 - RNA, 95 nt, Human
ccccuccauggcgacggcggccggggccgcuaggacugaagcaccucgccggaggacgaggcugguggcgacgggcugucggcugucgugagggg

SEQ ID NO: 4078 - RNA, 75 nt, Human
ccccuguaaucucagcuacucaggagguugaggcaggagaaucucuugaaucugggaggcggagguugcaguggg

SEQ ID NO: 4079 - RNA, 61 nt, Human
ccccuguccuccugucccuugcccugggccucugcuggcugaggagggacaaggugagggg

SEQ ID NO: 4080 - RNA, 92 nt, Human
ccccuguucaaucaugucugaagcuggucacaacauuuuucugcuucuugguagaaguguggucaguuucauccccauugauuuuaucuggg

SEQ ID NO: 4081 - RNA, 62 nt, Human
cccgcggcggguuggcucgcgcuucguugucagaucugaggcgaggcuaggugagccguggg

SEQ ID NO: 4082 - RNA, 76 nt, Human
cccgcggggcccgugacuggugcugggcuucagccaugaagacccucauagccgccuacuccgggguccugcgcgg

SEQ ID NO: 4083 - RNA, 75 nt, Human
cccgcguauagcuucuggccugagcuuggccuggauuguuggacgaguucuuuaugcuuauggcuauuacacggg

SEQ ID NO: 4084 - RNA, 90 nt, Human
cccgcuugggcuguggaguggaucgaacuuccucggggucucucucuauccucuuugggaucugcucgaacccuccgaggcuggagcagg

SEQ ID NO: 4085 - RNA, 108 nt, Human
cccggaguuuauggucuggugagaagaucccugcucugagucacugccaagcucuagcuaugugacuuugaacagggaauuucugucccuaucuauaaaauaaacggg

SEQ ID NO: 4086 - RNA, 71 nt, Human
cccggcccucccugcccuccauucagggagaaaccucuccuucccgugugagaagggccagaggguccagg

SEQ ID NO: 4087 - RNA, 72 nt, Human
cccgguuuccuugggggccaccuccguugugaauaacgccacugucuccaagauggauggcucccagucggg

SEQ ID NO: 4088 - RNA, 65 nt, Human
cccuaaauaccccagcgggcuccgggggguuaccaaccccaguaaaacccgcggggugaaccggg

SEQ ID NO: 4089 - RNA, 84 nt, Human
cccuccacccuccugucugcccuggcugauuugagagaacaaaagccacacuagaucuucagacuuugggaggaaaagggaggg

SEQ ID NO: 4090 - RNA, 68 nt, Human
cccugagcgcaagagccaagccgccagcgcugcgaugugggccacgcugccgcugcucugcgccgggg

SEQ ID NO: 4091 - RNA, 77 nt, Human
cccugccaagcugcacaacucccucauuggcaccaagggccgucugauccgcuccaucauggaggagugcggcgggg

SEQ ID NO: 4092 - RNA, 81 nt, Human
cccugcccccagccgucuuucuggggcuugcgcgcaaaaucuacaagcggagaaagugaccuagagauugcaagggcgggg

SEQ ID NO: 4093 - RNA, 92 nt, Human
cccugccgcaggagagccacuuucagagaugcccugagugaucgucaccagcugcauccugcaaacuucaucuugcugucccuguggcuugg

SEQ ID NO: 4094 - RNA, 65 nt, Human
cccugccgggggguuggccgaggcccugggaaagggguugccgggggugugggccccgggcaggg

SEQ ID NO: 4095 - RNA, 67 nt, Human
cccuggaggagaucuaucucuucucccugccuauuaaggaaucagagaucauugauuucuuccuggg

SEQ ID NO: 4096 - RNA, 67 nt, Human
cccuggaggagaucuaucucuucugccugcccauuaaggaaucagagaucauugauuucuuccuggg

SEQ ID NO: 4097 - RNA, 61 nt, Human
cccugggguuggggccucaccccucuggagggccuggaggcaggagguggaaaccccaggg

SEQ ID NO: 4098 - RNA, 60 nt, Human
cccugggguuuccaccuccugccuccggccuccagagggugugaggccccaaccccaggg

SEQ ID NO: 4099 - RNA, 61 nt, Human
cccugguggccaauuggaaccggguguuguaaaaccccggauugggguggccacccuaggg

SEQ ID NO: 4100 - RNA, 84 nt, Human
cccuguacauaaaauguauuugguuuuguuggagagugucagacugauacucuccaacaaaaccaaauacauuucguauggagg

SEQ ID NO: 4101 - RNA, 89 nt, Human
cccuguccugucuucgaguauuuguuuuuaaugcugggugucgaucgagacaacaagcgcucagagcaaagcaaggaugcauuacgggg

SEQ ID NO: 4102 - RNA, 102 nt, Human
cccugucuccacuggaagugaguggugcagcaucucuuuggcagguggggggcaucaguaccuggccagagggguccucgucgcugagcuccuggaucaggg

SEQ ID NO: 4103 - RNA, 85 nt, Human
cccuucgagaugugcccuucucagcccuguacugguucaacuaugagcuggugaagagcuggcucaaugggcucaggccgaaggg

SEQ ID NO: 4104 - RNA, 80 nt, Human
cccuuucaaaacaaagcuuucccaggauagcccugggcagaacuccugggauugacugggcaguaauguaguugagaggg

SEQ ID NO: 4105 - RNA, 67 nt, Human
ccgaaagcugagugccgccggggucccuugggggggccucugguuuaggcgcccgaaaggcuuuggg

SEQ ID NO: 4106 - RNA, 101 nt, Human
ccgaggcuacgugaaggaacacuuugccuggagacauuucuacugguaccuuaccaaugaggguauccaguaucuccgugauuaccuucaucugcccccgg

SEQ ID NO: 4107 - RNA, 65 nt, Human
ccgaggguaccucgccggggccgccgcuccaccuggcgauggccucgguggacucgcuccucugg

SEQ ID NO: 4108 - RNA, 87 nt, Human
ccgagguccgucgcaagguugcccagguccgggccgccguggaggguggugaggcgccggggcccacugagugaggacggagcuggg

SEQ ID NO: 4109 - RNA, 131 nt, Human
ccgaggucgugccacugcaguccaccuggccaacacagcaggccucucucuaaaauaauaauuauuauuauuguuauucuugacaggccaguguagaacagguggggcaucugugguaugacagaacuggg

SEQ ID NO: 4110 - RNA, 68 nt, Human
ccgaugaucaagcugaugaacgccuacugcgagaggcagggcuugucaaugaugcagaucauauucgg

SEQ ID NO: 4111 - RNA, 62 nt, Human
ccgaugggguuuacuggaagcaucucuuucaaagguugcauccaagucaccuuccccaaugg

SEQ ID NO: 4112 - RNA, 85 nt, Human
ccgauucacugcuagucccagaagguguccagccgagacucuuucgggaggaggcucuucgugcugguacugguguugugaucgg

SEQ ID NO: 4113 - RNA, 96 nt, Human
ccgcagggagaagagcugugugcugugaugugguuuauaaauuaccauuuggaaggagcugcacagcacagcagccugcaacuacucuuccugagg

SEQ ID NO: 4114 - RNA, 95 nt, Human
ccgcaucuucuugucuuccuuuucaucagaugccacaucucuuuacuauagaccuuaaaggagaugucuaccaguuggaaagggggaguaugugg

SEQ ID NO: 4115 - RNA, 65 nt, Human
ccgcccagucccggggaccgucccuaccgcgagggucugaggcgcggcugccccggggagggugg

SEQ ID NO: 4116 - RNA, 81 nt, Human
ccgccucaaugauguuugcaaaggagcugaagcuggugucccgggcgcccagcgaaugaaccgauggucgacaugaagugg

SEQ ID NO: 4117 - RNA, 87 nt, Human
ccgcgauguggaucauguccuuaucaauguagaagucaaccucugaggcugacugaaauucaccauccagggcugagauaccgcugg

SEQ ID NO: 4118 - RNA, 62 nt, Human
ccgcuccagacuuuagucacuagguucuaggagugagcuggggccugcugaggugggggugg

SEQ ID NO: 4119 - RNA, 74 nt, Human
ccggacaagccuaucacccaguauccacaugcgguggggaagaacacccuccucauugcugggcuccaggccgg

SEQ ID NO: 4120 - RNA, 83 nt, Human
ccggacucuccgucaugggcgugugcuugugauuccaggacuggcuacugcguacauccacagguucacuaacgggggcaagg

SEQ ID NO: 4121 - RNA, 91 nt, Human
ccggccucugagcaagacagugcgcuucaacgugcucaaggucaccaaggcugccggcaccaagaagcaguuccagaaguucugaggcugg

SEQ ID NO: 4122 - RNA, 74 nt, Human
ccgggaggccccgaggaggcggcuccucuucaagagugggagggggcaggccuggaguguugggggcagccugg

SEQ ID NO: 4123 - RNA, 85 nt, Human
ccgggcgagcugcugcugcgucugcugcggaugaucaucuugccgcugguggugugcagcuugaucggcggcgccgccagccugg

SEQ ID NO: 4124 - RNA, 67 nt, Human
ccggggagggaugcgccggcacccgcggcgagucagcccagcggcugcgggaaacacaacucgccgg

SEQ ID NO: 4125 - RNA, 76 nt, Human
ccggggcggccucgcgggugacuccgggcuccguggcugucccggaccccaccucuucccugccgcccgccaccgg

SEQ ID NO: 4126 - RNA, 63 nt, Human
ccggguccccuucagcaaggagggcggcccacugcucugcuggugcuggaaggaggaccccgg

SEQ ID NO: 4127 - RNA, 72 nt, Human
ccgggugcgauggugcaugccuguaaucccagcuacucgggaggcugaggcaggagaaucgcuugaaccugg

SEQ ID NO: 4128 - RNA, 79 nt, Human
ccgggugcggcuccaccccuuccacgucauccgcaucaacaagauguuguccugugcuggggcugacaggugagcuugg

SEQ ID NO: 4129 - RNA, 102 nt, Human
ccgguagguuuagaaugaggucugugucacugugguauuacgauauuuugacugguuauuauaaccacagugucacagaguccaucaaaaacccaugccugg

SEQ ID NO: 4130 - RNA, 63 nt, Human
ccgguugaccuccagugucaugcagccgcgguagaacgcggugacuggcgcugaagucaccgg

SEQ ID NO: 4131 - RNA, 65 nt, Human
ccgguugccaauguaugcuuguacuccaggcuccuuggaguuauacagguaugaaauggccaugg

SEQ ID NO: 4132 - RNA, 82 nt, Human
ccguaagcaugugacuggccauuugugccgaguucuuauuuuuacggagggcuuguggccuuagacgccaguuugcuuaugg

SEQ ID NO: 4133 - RNA, 78 nt, Human
ccguaugaaugcagcgaaugugggaaagccuuuagguuugaagucuccauucguuguacaccagagaacucauacagg

SEQ ID NO: 4134 - RNA, 72 nt, Human
ccgugcgcguugcugcggccgugguccgcgcccuuccucggcgggccggacuggucuccagaaaugcugugg

SEQ ID NO: 4135 - RNA, 72 nt, Human
ccgugcgcguugcugcggccgugguccgcgcccuuccucggcgggccggacuggucuccagaaaugcuuugg

SEQ ID NO: 4136 - RNA, 73 nt, Human
ccguggaagacccugggccccucaccgcaggcagcaguuugcguuuugaaagguuauugggucccuuccucgg

SEQ ID NO: 4137 - RNA, 95 nt, Human
ccguggcccguguucucuccuuuuguccccauagugugacuccgccaggaacuuggaauggcugaagacugugaaugagagucaugggucugugg

SEQ ID NO: 4138 - RNA, 76 nt, Human
ccguucauguaacacgggccugaggucagcaguagaggaccaguauugguuuuggccccagccucugcguggaugg

SEQ ID NO: 4139 - RNA, 77 nt, Human
ccuaaaaaaucuuugcccaaaccaauguccuguagcauuucuucaguguuuuguucuagcagauucauaguuuuagg

SEQ ID NO: 4140 - RNA, 78 nt, Human
ccuaaaacauaagugaagaucaggcuacagugcuuuucucaugacauggagccuuguuguuuguucacucauucuagg

SEQ ID NO: 4141 - RNA, 84 nt, Human
ccuaaacagaugaaaaaauaggaggugggcuggauguggcccauggcuacagguuuccuggccccucacucauuucacuggugg

SEQ ID NO: 4142 - RNA, 80 nt, Human
ccuacaaggaggccuuucggaaggacaugauccgcuggggagaggagaaacgccaggcugacccaggcuucuuuugcagg

SEQ ID NO: 4143 - RNA, 74 nt, Human
ccuacagcacaaucccccgcucagcuggcugguagggcccuucgccuugcccgcuggcgggcaguagcuguagg

SEQ ID NO: 4144 - RNA, 112 nt, Human
ccuacauguguuacacucaguguguaaauaacugugaagaggcaauugucagauagcaaauugggcaccugcuguguacgguauauugcacuggggcugacggguguguagg

SEQ ID NO: 4145 - RNA, 79 nt, Human
ccuaccaugacuguucucaaaguuugaaguugagcauaccgaugcgccacuccugcuucaaugcuugagaagucguagg

SEQ ID NO: 4146 - RNA, 72 nt, Human
ccuaccuauguaaucuuguuuccucacaccugagcuaugugcuaugugugaagggagagaaggguggguggg

SEQ ID NO: 4147 - RNA, 108 nt, Human
ccuacucuccauuaugauuacuuuuucucuauuucucuguccaucuacuaggaaaauggguguugcuaggaaaugggaaaaggggauccacaguaaggucgggauagg

SEQ ID NO: 4148 - RNA, 74 nt, Human
ccuacuucagagugucccugagccaugacugcuugacuccacagauggcuucaggaagacagcacagaagaggg

SEQ ID NO: 4149 - RNA, 76 nt, Human
ccuagaccccgcguuguccgauguucaugaguuccgcagaagggguuuauucccacacggcacccgcgccucuugg

SEQ ID NO: 4150 - RNA, 68 nt, Human
ccuagaggccuuucucucugcacgaaaaacagguaguuugcagucugagauaugggagagcuuuuagg

SEQ ID NO: 4151 - RNA, 98 nt, Human
ccuagagucuggccucugauucacaaucuucccagccuacgguguuagaggugggguggucaagaagugaagacagaugguccuugacuuacaauagg

SEQ ID NO: 4152 - RNA, 105 nt, Human
ccuaggcaucuaaacuuauuccacauuuccugggggccuuaggacagaguuuagauuucacuucaagaacccucaggaggcuggggcgguuuggaucaccuuagg

SEQ ID NO: 4153 - RNA, 77 nt, Human
ccuaggccuggagccccuggcacccagcucagcucccacccugggcccugggugcugcuggcuuuauuuggcuuagg

SEQ ID NO: 4154 - RNA, 87 nt, Human
ccuauaaauacuuacuucaguuaccagguaaaccaagugagaaccaaauuuucacaggcauuuacucauggcugaaaguuccagagg

SEQ ID NO: 4155 - RNA, 71 nt, Human
ccuaugcgauagugauucaaaucaacauccucugcaucucuguccagguugaugguuuccauguccacagg

SEQ ID NO: 4156 - RNA, 112 nt, Human
ccuauuauauaggguuauaccuuuuuucuuaugccucagcucuguaccugacaauuuaugauucaguggagccaagcuagaaggaacaaaggucaucuaacacugugauggg

SEQ ID NO: 4157 - RNA, 113 nt, Human
ccucaacccuggcauguggggcccagcaguguaccugugcuauaaggugggccuggcgaaggccaacacgcugguguacgaggcagagcugcugggccgcuacccggaggagg

SEQ ID NO: 4158 - RNA, 75 nt, Human
ccucaacugcuguucuagacugugggggugcauuccugucucagcaccaaggaucccaacaggcaggcagggagg

SEQ ID NO: 4159 - RNA, 108 nt, Human
ccucagcagacaucagaaaauucaugcucggaagaaugccuacaggaaugaaaacuuaauaauugugggaaauacuugagcaaaauaucugguuucaugguauguagg

SEQ ID NO: 4160 - RNA, 95 nt, Human
ccuccaaggcccagggagugcuauugcgucaugaagagcauugucaggacuuccuggcaggccauucacgggcuauggagccccugccucggugg

SEQ ID NO: 4161 - RNA, 70 nt, Human
ccuccacuuuuuuuaaucggaacaccuccauuugauuacauaugggguaugggauugaugagggcauggg

SEQ ID NO: 4162 - RNA, 96 nt, Human
ccucccauguacacaggacacgaguacacagucaggucggcuggggcuggcaagucacuuggugcccggggccugugugcugaugcugacgggagg

SEQ ID NO: 4163 - RNA, 66 nt, Human
ccuccccgggggguguggcuaagggacgaggcaguucucguccagagcccagguaauccgggcggg

SEQ ID NO: 4164 - RNA, 96 nt, Human
ccuccccucaccccugaggaccaaauagggguggcagagccaaacccucgcugggcgucugugaccaaagccuaagaagccagggguggggccggg

SEQ ID NO: 4165 - RNA, 92 nt, Human
ccucccucccuuggugccagccucugaggucuucuuccucaagugcaaagaguggucugagagugguggagccugguuccaaggaagggggg

SEQ ID NO: 4166 - RNA, 77 nt, Human
ccuccggccucgguagaaccgccagcccgcguccgaaggcggaggcgaggggaacuggccgcgugaggggccugagg

SEQ ID NO: 4167 - RNA, 67 nt, Human
ccuccucccgucacuccacgcagcuggcagagagcacagugaucaccagcgugagugguggaggagg

SEQ ID NO: 4168 - RNA, 110 nt, Human
ccuccugcgcagccuucagguucuccuucuucccgccccaggccuucagggcaaaggccugcagggcucggccguaggagaaggucagggcccagggcuucagcaggggg

SEQ ID NO: 4169 - RNA, 60 nt, Human
ccuccuggcccuuuggggugguacccccaauguaaugcuaaucccuaagggaaaaggagg

SEQ ID NO: 4170 - RNA, 80 nt, Human
ccuccuucugcuugcacaaguuuccugggcuggaccguuucaacagagaggcuuauuugacuuuaugcuagaagaugagg

SEQ ID NO: 4171 - RNA, 98 nt, Human
ccucggccgacuuucccaggcagugcaggcuagcccaguccaggagugugcagccuggcuugggucgagcucugucacaucuggauaagcaacugggg

SEQ ID NO: 4172 - RNA, 66 nt, Human
ccucggcggcccggcuggugaaucacacacucuauguucaccugcagccgggcaugagccuggagg

SEQ ID NO: 4173 - RNA, 71 nt, Human
ccucgggacacaugguuaucucagugauaccuugaagaagcugaagauaacagcuguggacaagacugagg

SEQ ID NO: 4174 - RNA, 97 nt, Human
ccucuagagggauaugaagcaccgccaggguccuuugaguuuuaagcuguggcucguaguguucuggcgggcaguuauguugauuuaacuguugagg

SEQ ID NO: 4175 - RNA, 98 nt, Human
ccucuccuacauugagcacaucuuugagaucucccgccguccugaccuacucacuauggugguugacuacagaacccgugugcugaagaucucugagg

SEQ ID NO: 4176 - RNA, 117 nt, Human
ccucucucugugugggaccaggacaguggcuuaagucuccacuccaggaaagaaucaaaguuucuagaguugugagaaaaccagagaguggcuguccugauucuucacugugagggg

SEQ ID NO: 4177 - RNA, 71 nt, Human
ccucugccacuacugcugccacaugggaacugugaaggaggcacccuggcaagcagcagugaugggggagg

SEQ ID NO: 4178 - RNA, 87 nt, Human
ccucuggcccuuccugggcaucguggcugaggugcuggugcugggucaccaucaucuucaucuacgagaagcgccggaagcccgagg

SEQ ID NO: 4179 - RNA, 84 nt, Human
ccucuggcccuuccugggcaucguggcugaggugcuggugcuggucaccaucaucuucaucuacgagaagcgccggagccgagg

SEQ ID NO: 4180 - RNA, 84 nt, Human
ccucuggccuucugggcaucguggcugaggugcuggugcugggucaccaucaucuucaucuacgagaagcgccggaagccgagg

SEQ ID NO: 4181 - RNA, 89 nt, Human
ccucuucccugggaggcguucacucccgccgggccgaggaccaggucgccgaucccagcggcuagggugagcgcgcccucggggagggg

SEQ ID NO: 4182 - RNA, 74 nt, Human
ccucuuccgugaggcgcgcugagacccggaccggcccuccugagaggaugccggugcgggcgcccgcggagagg

SEQ ID NO: 4183 - RNA, 90 nt, Human
ccucuuccuccucuuccuccucuuccucauccacuccagcuccccccuccuccuggaugggagggguccccucggagggaggagcagagg

SEQ ID NO: 4184 - RNA, 78 nt, Human
ccugaaagaccgaccauucuucccugggcuggugaaguacaugaacucagggccgguuguggccauggucugggaggg

SEQ ID NO: 4185 - RNA, 88 nt, Human
ccugaaauuuuccacuugcugcuucuuggugugaggcgagaaaugccaccacguggcacugcaggaguagacugguggaagccacagg

SEQ ID NO: 4186 - RNA, 66 nt, Human
acgaggcgggugaaggcuguggguguccuggcgucccugggccaccugucagccccucguccuggu

SEQ ID NO: 4187 - RNA, 70 nt, Human
acggaggggaggagacucaguuccucuucaucccuuuacuuccugauaaacuugucucacuuuacucugu

SEQ ID NO: 4188 - RNA, 61 nt, Human
acggaucccaggagcccacacaugacauccugcagaugcucagugaccuccaggagucugu

SEQ ID NO: 4189 - RNA, 77 nt, Human
acggccgaggggguagcuuuaacugugacgggugucgcccaggugaagaucaugacggagaaggaacuccuggccgu

SEQ ID NO: 4190 - RNA, 131 nt, Human
acgugcacaagagugugacgacuuagggaguggaguggcacagaccuaugggcuuggcuugccaaguggggaccaugacggugucacuucuaucuguggccucccgaacuggcaugcgugaaccaacaugu

SEQ ID NO: 4191 - RNA, 75 nt, Human
acgugcuaugauggguugaaaagagguuggucugaaauugacgagccucccauuucagaggcucaggaaguuugu

SEQ ID NO: 4192 - RNA, 61 nt, Human
acguggccuggggggagcugugacuaccuggugguggacacugcccccgugggaccuccgu

SEQ ID NO: 4193 - RNA, 130 nt, Human
acuaaaaucaacacaauaauugaaauauuuucaagcugauuacaccgcagcccgaggcuagccugguugcuaagggugagcuccgcgguugcuagggggaguaaaucaucuugcauuauuugauuuuugu

SEQ ID NO: 4194 - RNA, 76 nt, Human
acuagauugugagcuucuggaagacaaggcuaugucuuugauuguugucuccccuaccacagcccaguacuuuagu

SEQ ID NO: 4195 - RNA, 67 nt, Human
acuauugagaccgcaacugcuugcacugaucauuuugguucgugagcaguuggugaguuuagauggu

SEQ ID NO: 4196 - RNA, 76 nt, Human
acucagauggcgacaugguggucagcugcucagccaucagcagccugcccgacaucgucuucaccaucaauggagu

SEQ ID NO: 4197 - RNA, 92 nt, Human
acuccaaggaucuggggguuaccaagaaugguguuaaauggucagguaaaauauacuuucuugacgccaagguagcuuaaaggcuggugggu

SEQ ID NO: 4198 - RNA, 75 nt, Human
acuccugccucugggaucucuccagauauggucgcugcucaauggagagcuaccgggagaaccuggagcgggugu

SEQ ID NO: 4199 - RNA, 113 nt, Human
acucuaucugaucuccuaagcgaagcauguggcuauccauuauagagauguuucccagccucucugcagcuaggaguggccauuugacuauguucuggucaaaacauaugagu

SEQ ID NO: 4200 - RNA, 83 nt, Human
acucugaagaugaucagacagggcaagcgaaauuggucauucucgcuaacacugcccagcuuugaggagaucugaaauagagu

SEQ ID NO: 4201 - RNA, 60 nt, Human
acucugugcuauauuacuugaggggcuaagaaaaauguauggucagugaaacacaguagu

SEQ ID NO: 4202 - RNA, 91 nt, Human
acucuuaaaccuuuagaaaugcuacagcaucuagcuucucuagaucaauaaucacagaggcuuaagugcugaccucauaaagauaaagagu

SEQ ID NO: 4203 - RNA, 78 nt, Human
acucuuccgcgccucgaggaacccgaucagcuguugccaacauugcccuggcugaaggccuuacucgaguggaggagu

SEQ ID NO: 4204 - RNA, 63 nt, Human
acucuugaguuugguguucaggcaucauuauuaaaaaguggaguccuauguaccagacugagu

SEQ ID NO: 4205 - RNA, 77 nt, Human
acucuugguucucuauucaaaguguuuggaaucuuuauucuguuuaaaacacugaugacauuugccaauuuuugagu

SEQ ID NO: 4206 - RNA, 73 nt, Human
acugaggccugugaaucuaagaggguugagcaugaaggacaugcgcagccuuaaaagggggcacaggccaggu

SEQ ID NO: 4207 - RNA, 78 nt, Human
acugcucucaccagguuccccaccacccugaaauagcuggcuugaaagaaugguggaauggccuugggaagauucagu

SEQ ID NO: 4208 - RNA, 92 nt, Human
acuggaaaucacugccauuuccaggagaucaccuauccuaguuuugaggaauagucauugagguggguuuccuuaauggcaucucuucuagu

SEQ ID NO: 4209 - RNA, 83 nt, Human
acuggaacaacguuugacgguguuggggggugcuguacauuggcugauaacacuuagcaaacacugaucuuacugugugaagu

SEQ ID NO: 4210 - RNA, 94 nt, Human
acuggcgcugcaaggcugugggcaaggucaucccuugagcugaacgggaagcucacuggcauggccuuccgugucccacugccaacgugucagu

SEQ ID NO: 4211 - RNA, 69 nt, Human
acuggugacacaugcuggagccaagugcuaacauugccuugguuccacgggcaugugacagucacccgu

SEQ ID NO: 4212 - RNA, 116 nt, Human
acugguuaacuucuugagcuauuucguggaacuuggaacacagccugccacccagugaaguguccagaccauugucuuccaaccccagcuggccucuagaacacccacuggccagu

SEQ ID NO: 4213 - RNA, 70 nt, Human
acuucaguggagaacaggaugcucugucucuugcuguccggggcaaggauggacuccauuugccugaagu

SEQ ID NO: 4214 - RNA, 79 nt, Human
acuuccauguucugggugauggaaacugccaaaccuccugucagugaggacucuuuccgacugcccagaaagugggggu

SEQ ID NO: 4215 - RNA, 71 nt, Human
acuucccaaaaaauucaccuuugggcuuaaaauaaaaccagaaagcccaaaaggagaauucuuuggaaagu

SEQ ID NO: 4216 - RNA, 73 nt, Human
acuuccuguccuuacucccucuuuaagauugcguacccacugcagagugcugaagacgggguagccacgaggu

SEQ ID NO: 4217 - RNA, 78 nt, Human
acuucgcucccacucccgcacagccugacaggguacacagaguggguucaacauggcugugagggaguccuagcaggu

SEQ ID NO: 4218 - RNA, 74 nt, Human
acuuggaaauaaauaugaauugguagguuaccuauuaaacaaguguguuagaguagccuagcaguuuucaaagu

SEQ ID NO: 4219 - RNA, 81 nt, Human
acuuguauuugcugagccagugguauuaacucaugcauaaaacaaauuucgguuugcuauuucuucuagcaaauuucaagu

SEQ ID NO: 4220 - RNA, 105 nt, Human
acuugugcugauauuuuaaggaugugcucaagaguaugaagcagggugcuuuugucccuuucucuccucccuaguaauucccuccucccuaucccauagccaagu

SEQ ID NO: 4221 - RNA, 99 nt, Human
acuuuaagaacucgaauauaggucuuuuaaauuaaccagucagacaaaguaacaaguaggacugaaacgaacaaggcuugagaauccgguugguaaagu

SEQ ID NO: 4222 - RNA, 79 nt, Human
acuuugcuuccuagcugaugucaucccacauugguacagguguuauucaguacugggugguucagcagggaagccaggu

SEQ ID NO: 4223 - RNA, 84 nt, Human
agaaaagcuagauuuuucguauacuuugaaauaaugugucacaacagauuguaugcagaaauagauaugaaaauccugcugucu

SEQ ID NO: 4224 - RNA, 65 nt, Human
agaaauaaccuguggggcuguguugauaaaaagcucuuuuuuuccccacagcgcaggugguuucu

SEQ ID NO: 4225 - RNA, 63 nt, Human
agaaauuccuucacaaaauuugggguaaaaacccuuacaaggcaauuuugugggcgaguuucu

SEQ ID NO: 4226 - RNA, 94 nt, Human
agaacaagggcuaaauucaaaucaaauuuucccuguacccuaagaaaaauaauuaggccgggagauguuugacuaagugaguaggcauuguucu

SEQ ID NO: 4227 - RNA, 61 nt, Human
agaaccuuccccuugcuuagccaacucuauuuccccuccuugaggaagacgggaggauucu

SEQ ID NO: 4228 - RNA, 70 nt, Human
agaacuggaugggaauuuccacucuucacccucuaccuaggugacuuugagcaaguuauuuauccuuucu

SEQ ID NO: 4229 - RNA, 67 nt, Human
agaaggugcugacuuccuuggggagaugccauuaaagcaccugggaugaucucaaggggcaccuuuu

SEQ ID NO: 4230 - RNA, 73 nt, Human
agaagugaucguuccagcauucuuggccuaggcuuauugccagcgcaaauauaagaugacugaaugaaacucu

SEQ ID NO: 4231 - RNA, 84 nt, Human
agaaucgcuugaacccaggaggcggagguugcagugagccaggaucacgccacuguacuccacccugggcgacagagcgagacu

SEQ ID NO: 4232 - RNA, 63 nt, Human
agacacgccugccccaugacaagaccaagugcuucaaguucaucuaggggcagcgcacggucu

SEQ ID NO: 4233 - RNA, 75 nt, Human
agacagaagcugagcuagcaaccccagaaggcaucuaugagaggccuguggacuaccugccugagagggauguuu

SEQ ID NO: 4234 - RNA, 97 nt, Human
agacaggagaguugcuugaauccaggaaguggagauugcaguaagcaaagaucgugccacugcacuccagccugggugacacagcaagacuccaucu

SEQ ID NO: 4235 - RNA, 72 nt, Human
agacagggggcacaugccaaacaccacagggcaucagaugcugcucugugugcucacaaguguucccugucu

SEQ ID NO: 4236 - RNA, 113 nt, Human
agacagugcugggucaaacagccuuuauuuuagcaguugugagacccuagagaacuccuuugguguuuuggggucuccccagcaugcacaauggggguuaugcuagcaucucu

SEQ ID NO: 4237 - RNA, 75 nt, Human
agaccuuccucuggaaccucaguuaaauucacuuaaucuaagugggucuaggugcugggggcccuuaucuugucu

SEQ ID NO: 4238 - RNA, 64 nt, Human
agacgcucuuugugcuagggugaugucaauuggacagauucucccuuucuucacaaugggcucu

SEQ ID NO: 4239 - RNA, 130 nt, Human
agacguggggucucgcuauguuggccagguuggucuugaacucuuggccucaagcauuccuccugccucagcuucccaaagugcuaggauuacagccaugagccaauaguaguaaaaugacuuuuuguuu

SEQ ID NO: 4240 - RNA, 75 nt, Human
agacuaaggccaacacagcagaaagggcaaagggcuggaaagaagcuaaguccugauggaggcuuucugaagucu

SEQ ID NO: 4241 - RNA, 93 nt, Human
agacugaggaccaagacugacacagacucucuucuguuucccuuaucuccuuuccaaaguaagucugugaaucuacccugguccuuuccuucu

SEQ ID NO: 4242 - RNA, 71 nt, Human
agacugggcaauauagcaagaccccaucucuaaaaaauuaggcaugguggugcaugccuguauucccagcu

SEQ ID NO: 4243 - RNA, 86 nt, Human
agacuugauguuuuugaaaguugucaccaguuuauugucaccuuccaacugaaccacugucuugacuuucuccccugucauugucu

SEQ ID NO: 4244 - RNA, 69 nt, Human
agacuuggagucaucuggacugcagagaaggaacuccucugaagcaagcuccggagacuucuuagaucu

SEQ ID NO: 4245 - RNA, 93 nt, Human
agagagagucucacucugucgcccaggcuggagugcaguggugugaucucggcucacugcaaccucugccuuccggauucaagugauucuccu

SEQ ID NO: 4246 - RNA, 105 nt, Human
agagaggaccaugugaaggaggugaaguauuuaaaguggaaaggaggaaaauaaccugaacucuuaacugcucuugaaaguucacucugucuucacuccagcucu

SEQ ID NO: 4247 - RNA, 77 nt, Human
agagcaagaugaacagaaucuguauucucaaagagcacauagccaaacccuuugccgaugccugucauuuugucucu

SEQ ID NO: 4248 - RNA, 92 nt, Human
agagccagaagauggagaggaggcugcaaacccuuagcugcucuauaaauauaaucauugaggcuugauugucccuugccaucucuugcuuu

SEQ ID NO: 4249 - RNA, 79 nt, Human
agagcugcucugcaagcuagaacgugggacgcacacauccugggugcugucuugugaagccuugcugcaggcaagcccu

SEQ ID NO: 4250 - RNA, 83 nt, Human
agagcugguguguagcggguaccuucugucugcuggcacuagguauuuuacacauuaaaucagcucguucucacaucagcucu

SEQ ID NO: 4251 - RNA, 85 nt, Human
agaggacagacuuaucuucagaacauuucagucauuccucaaaguggcuagaaacuugucagcaugaaucagaugagcagccucu

SEQ ID NO: 4252 - RNA, 130 nt, Human
agaggagucuggauuuuaaguccuugugcacggauggucucaagugaucaggauaguguggucgguacacccaaagcuugugaaugacuccauccaaagagcaucagucuguauucccaugacccccagu

SEQ ID NO: 4253 - RNA, 101 nt, Human
agaggccuaacaguaagcccauggcacuuuauucucucgaauccaucaagaugaccuucauagauuugagcaacaagaugccgucccugcuguuugguucu

SEQ ID NO: 4254 - RNA, 93 nt, Human
agagggcaaaugucaacugcuggagagagugcauggacagaagugcaagcaaaauaaaguccagcucuuccagguugaccacuuugugccccu

SEQ ID NO: 4255 - RNA, 75 nt, Human
agagggucguuucuggcaggaacggagugguugguagucucaggcgccaggcguccugccagguaugcccgcucu

SEQ ID NO: 4256 - RNA, 124 nt, Human
agaguauaccugugcccgguugcuguagcucaugccuguaaucccaccacuuugggaggccaaggcggguggaucauuugagguuaguaguuugagaccagcuuggccaacauggggaaacucu

SEQ ID NO: 4257 - RNA, 87 nt, Human
agagucccacuuuguugcccaggcuggagugcaguaggcaugaucuuggcucacugcaaccuccaccuccuggguucaagcgauucu

SEQ ID NO: 4258 - RNA, 88 nt, Human
agagucucacucugucaccuaggcugaagugcaguggcgugaucucagcucacugcagccuccaccucccggguucaagugauucucu

SEQ ID NO: 4259 - RNA, 86 nt, Human
agagucuugaucugucacccaggcugcaguguaguggcaugaucucggcucacugcaacccccgccuccuggguucaagccauucu

SEQ ID NO: 4260 - RNA, 80 nt, Human
agauaaagauugugaugugcugguugguuauaaagcuguguaucggaucagcuuugccauggccaucuuuuucuuugucu

SEQ ID NO: 4261 - RNA, 69 nt, Human
agauaccauacacaugaugaaguugcuguuugaaaguacuguugaagcacuguacaaguuugugguucu

SEQ ID NO: 4262 - RNA, 65 nt, Human
agauagaucuuaaagggcaaagcaguauauugguaguugucaauauagcagugcuagcucugucu

SEQ ID NO: 4263 - RNA, 97 nt, Human
agauaugauuagacuucguuaguaauguucaacuuuucacaaaagauggcugaagugccaucuuaacaaacuuacuggcagauugguuuuuauauuu

SEQ ID NO: 4264 - RNA, 83 nt, Human
agaucugagauugaugcugggacugcugcugagauccagaggaucaacaagcucauagcagcuuccucagcaccaugagaucu

SEQ ID NO: 4265 - RNA, 64 nt, Human
agaugaggucucagaugcgagaucaacucuaauacgaaauccaucugcaaucugggccccauuu

SEQ ID NO: 4266 - RNA, 85 nt, Human
agaugccaggcauguaugcaacagagaaaauccagcugcacagaaacccuguggaggagcagcucaguccagcgugaaggcgucu

SEQ ID NO: 4267 - RNA, 81 nt, Human
agaugcgcugcugcugcugucguccugccuggcgccuuggccuacaggggccgcgguuaagggugggagugggggugcacu

SEQ ID NO: 4268 - RNA, 91 nt, Human
agaugcuuuuggugugucucauacuguguuuggcagagagguccaaucuguccucucuguggagacaggaagucgucccagagguccaucu

SEQ ID NO: 4269 - RNA, 70 nt, Human
agauguguuaggaaugucaacagagcaaggagaaaaaaggcaguccuggaaucacauucuuagcacaccu

SEQ ID NO: 4270 - RNA, 83 nt, Human
agauguuauguaaaaguuugagguugagaugacauaucugacacucuguuguuacucucagaagcuacuacaugugaaauucu

SEQ ID NO: 4271 - RNA, 73 nt, Human
ccugaaugagaaugucugcgguauuucccgaaauaaguaucccucaaggaugauacuguggaccucacucagg

SEQ ID NO: 4272 - RNA, 97 nt, Human
ccugacucuguccugcugccugggucaaauguggcugucccuggaguuucucuucaggggugccuaccuugagaggcagugugguguggugguuagg

SEQ ID NO: 4273 - RNA, 79 nt, Human
ccugccccaucccuuccccagugcacucugaccuagcuagugccuggugcccagugaccugggggagccuggcugcagg

SEQ ID NO: 4274 - RNA, 104 nt, Human
ccugccccccugccugccaucugagagcccugcagugugccugcgcccugccuacagccggcgcgcucagccgggcaacuucaaugcagcgggggguccucggg

SEQ ID NO: 4275 - RNA, 65 nt, Human
ccugcggucugguuccuccaucagggcgcuguggguauggcccugaggugaggggcaggccuggg

SEQ ID NO: 4276 - RNA, 61 nt, Human
ccuggcacagaaucugggaauuuguauuucuggcgaguuuccaauugaugcugaugcuggg

SEQ ID NO: 4277 - RNA, 104 nt, Human
ccuggccgcccucuggcccuuccugggcaucguggcugaggugcuggugcuggucaccaucaucuucaucuacgagaagcgccggaagcccgaggacguccugg

SEQ ID NO: 4278 - RNA, 94 nt, Human
ccuggccggccuccggcaguucuucaagcagcugcccagcccgcccuuccugccggccgccgggacagcagacugccgguaacgcgcggccggg

SEQ ID NO: 4279 - RNA, 77 nt, Human
ccuggcugaccugguguuugucugcacucugcccuucugggccuaugcaggcauccaugaauggguguuuggccagg

SEQ ID NO: 4280 - RNA, 89 nt, Human
ccugggccugcccacucccacgcccuucaccaaugccguccagcugcugcugacgcugaagcuggugagccuggccagugaaguccagg

SEQ ID NO: 4281 - RNA, 112 nt, Human
ccuggguccagucccucaccugguaccuuugugcauguugccuucauuccugagcagguaucauccucagggaaccagcauggcaccuaccaggccaggcucuguucuuagg

SEQ ID NO: 4282 - RNA, 69 nt, Human
ccuggucaaucaacaaagucuugccaaugguuuccaucacucucuuggacauugguuuaccuugccagg

SEQ ID NO: 4283 - RNA, 86 nt, Human
ccuggugucccucgacucugacagugauggggagcugggauccagauacuccuccggguauucaucugcagagcaggugaaccagg

SEQ ID NO: 4284 - RNA, 86 nt, Human
ccugguugggccgacguggggacuagcggugcucucaaacccggguauggcgggcaccuuugguucucagucaacguucacacggg

SEQ ID NO: 4285 - RNA, 86 nt, Human
ccuguacaaagcagccuuggaccaggagggaaaaccccaaggcucugcagccucccugcuccccuccguuuaaggcuguggucagg

SEQ ID NO: 4286 - RNA, 98 nt, Human
ccuguauuucuccaucuccaggucuggacagugcaaguugccaagaaaaaggaccuaguguagccauugcacugcagaugaaauaauggaggcucagg

SEQ ID NO: 4287 - RNA, 86 nt, Human
ccugucccucaccugcggugguuuaugguggguccuucagugguuacuacuggagcuggauccgccagcccccaggaaggggcugg

SEQ ID NO: 4288 - RNA, 77 nt, Human
ccuguccuucggucccccaggccugccggucagaagccuggggcugguaggcccuuggugguccucauguggauggg

SEQ ID NO: 4289 - RNA, 80 nt, Human
ccugugccugugcuugucauaaaugaugcuucccagaagaaaggaaagaaggaggugaggagaggacgagcaaggacggg

SEQ ID NO: 4290 - RNA, 61 nt, Human
ccuguggcauuuuccuuauugaauauuaacauaaguacacacugugagacucugcuacagg

SEQ ID NO: 4291 - RNA, 76 nt, Human
ccugugggcuuucuacaguaucccacugugucugguaugugucaauuuaugggauuacugagaauugccucuaagg

SEQ ID NO: 4292 - RNA, 73 nt, Human
ccuguucagugcucugcucaucaagugucuggagaaggagguugcagcauugugcagauacacaccccgcagg

SEQ ID NO: 4293 - RNA, 66 nt, Human
ccuguuggcgggccaucugcaggggcacacaugccgcgugccuagacagaaagggcugcuuguagg

SEQ ID NO: 4294 - RNA, 72 nt, Human
ccuguuguuggcagcgucaagaaugagaagacuuuugugggggguccucuuaaggcaaaugccgagaacagg

SEQ ID NO: 4295 - RNA, 72 nt, Human
ccuuaaaauauggguaugcaauuguuacaaagccauaguaaaugguuuauaaaauguacuuuuauuuuaugg

SEQ ID NO: 4296 - RNA, 62 nt, Human
ccuuaagaaacgcagcgguucgggggaggagacuuuuagaauuaucuuucaaacacuuaagg

SEQ ID NO: 4297 - RNA, 73 nt, Human
ccuuaauggccagcucuccacgcugcucggcaucugcaauggcggcuccagggaagcccucuggccuuugagg

SEQ ID NO: 4298 - RNA, 68 nt, Human
ccuuaauuacuuccuuagcagccccagcuccacagugaagguuggggcuucaacaugggaauuuaggg

SEQ ID NO: 4299 - RNA, 78 nt, Human
ccuuacagugagggcuauacaugguagccaguugaauuuauggaaucuaccaacuguuuagggcccugauuugcuggg

SEQ ID NO: 4300 - RNA, 65 nt, Human
ccuuagauguucugacagcacugcaccuuuggcuugguuucagugguugguggaacaugaauagg

SEQ ID NO: 4301 - RNA, 78 nt, Human
ccuuauggagacuguaucauccuuaucuucaucuuacaggugagaaaucugcagugaagaaagguacaucccaagggg

SEQ ID NO: 4302 - RNA, 74 nt, Human
ccuuauuaaagcaucugcaacagccaggaaucauugagcuaugaguaaaacgcugccuuaggugauuugucagg

SEQ ID NO: 4303 - RNA, 108 nt, Human
ccuucaaaaaguuuguagccuaucgggguggagagauaagccaaguauccagauaaccauggcauaaggcagaauauuuucuguacuaugagagguacaaaggggagg

SEQ ID NO: 4304 - RNA, 109 nt, Human
ccuucaaaaaguuuguagccuaucgggguggagagauaagccaaguauccagauaaccauggcauaaggcagaauauuuucuguacuaugagagguacaaaggggaggg

SEQ ID NO: 4305 - RNA, 72 nt, Human
ccuuccuucuggguguggggcaggccuucucaagaauggggagucuuaugaacuacagucaaacaagguagg

SEQ ID NO: 4306 - RNA, 83 nt, Human
ccuucgagaugugcccuucucagcccuguacugguucaacuaugagcuggugaagagcuggcucaaugggcucaggccgaagg

SEQ ID NO: 4307 - RNA, 68 nt, Human
ccuucguuuucaggccuugucaagaagacaaauuuuuaaaucauuuuccugaccccugagaaagcagg

SEQ ID NO: 4308 - RNA, 79 nt, Human
ccuucuaugcagaagucgagaccauggagguccuacauguggagguaugaucgauaacuuggugcgaucugaaggaagg

SEQ ID NO: 4309 - RNA, 65 nt, Human
ccuucucgaggaggacggggauggccucccuguuguggugcuccuuguggccuuccuugaggagg

SEQ ID NO: 4310 - RNA, 87 nt, Human
ccuugagaguuugauagcuugcuugauccauugaugaacaaaauaucuguuguggcccaacuggaucaggcaguugagaucucaagg

SEQ ID NO: 4311 - RNA, 74 nt, Human
ccuugugaaaguuauaauguaguaggagaugggguaaacaacuaucugauguacauauucaacugucacugagg

SEQ ID NO: 4312 - RNA, 86 nt, Human
ccuuuaaagaaaccuuuagaaggacuuagaccucacauauuaauguugagaaguucugcuuaauuuuaaaaugguuucuauaaagg

SEQ ID NO: 4313 - RNA, 72 nt, Human
ccuuuguuucuaaucuccucucagucuguacuacuacuacuacacuaacaugacuuugguuuuggggaaagg

SEQ ID NO: 4314 - RNA, 63 nt, Human
ccuuuugacaagugggauggcaaggaccuggaggaccugcagauccucaucaaggucaaaggg

SEQ ID NO: 4315 - RNA, 84 nt, Human
cgaaaagcuauggcaaauaucagugagcgugugggaacugagaaacgaagucggggcuguacacucacucuaacaagcgaaucg

SEQ ID NO: 4316 - RNA, 63 nt, Human
cgaacgagacgugagacuugcgcuuaugccauuaucucuuuaccaguauuaaacgaucguuug

SEQ ID NO: 4317 - RNA, 72 nt, Human
cgaacggcgaaccacagacuaggcuauuuacggaaagaaggaaagaagccgauuaugugguuuagccaguug

SEQ ID NO: 4318 - RNA, 89 nt, Human
cgaaguuccaugucaugucuucaguuguagaaguuuuuccucuuuaagguaaagcgaccaacuugaacuuucucuggcaacacgauucg

SEQ ID NO: 4319 - RNA, 67 nt, Human
cgaaucgccaaaaacuuggaacuggaacaagugacugucccaauuggaguucugcuggugaucuuug

SEQ ID NO: 4320 - RNA, 76 nt, Human
cgaccggugggacgacgcuucagacugguccucacuacucuuuggacuccacucacgcgacaucaccacggggacg

SEQ ID NO: 4321 - RNA, 73 nt, Human
cgaccucggguccacgugucccgguacucgccggccggagccuccggcuucccggggccgggggaccuuagcg

SEQ ID NO: 4322 - RNA, 81 nt, Human
cgacgguuacucugguuacugggcccgcgccgcgcuggcgagagccgccgcccgcgagggaugcuggugaggaagccgucg

SEQ ID NO: 4323 - RNA, 79 nt, Human
cgacuugucuccucuauauaaaugcguagggguuuuaguuaaauguccuuugaaguauacuugaggagggugacgggcg

SEQ ID NO: 4324 - RNA, 84 nt, Human
cgagcucgcccagcauaucagguuggugcgccgaaauuguuuguugagauauuggucgauagcaaauauguagugggcgguuug

SEQ ID NO: 4325 - RNA, 73 nt, Human
cgaggagagacuguuuaaagucagcaagaaugaggagaaaccugugcaaaugauguuuaagcaaucuacuuug

SEQ ID NO: 4326 - RNA, 81 nt, Human
cgaggaugaucaguacagccuuguggccagccuugacaacguuaggaaucucuccacuaucuugaaagcuauucauuuccg

SEQ ID NO: 4327 - RNA, 69 nt, Human
cgagggaacuuauuccgcacgggccuacuguaggaccaucugcucccguaauuaggaauuuuccauuug

SEQ ID NO: 4328 - RNA, 73 nt, Human
cgaggguacagcuucaccaacacggccgagcgggaaaaucgugcgcgaacaucaaggagaagcugugcuaacg

SEQ ID NO: 4329 - RNA, 93 nt, Human
cgauaaccugaagcuguucuguuaccucugggcucucauccucuccuauuuauacagugaagcccauggcaaauaggaagaagcucaguaucg

SEQ ID NO: 4330 - RNA, 96 nt, Human
cgaugcugagaucagaauguggccuggacaacuucggggacuuugacugggucaucgagaaccauggaguugaacagccgccuggaggagcaguug

SEQ ID NO: 4331 - RNA, 85 nt, Human
cgcacaucguggugagcuggaugaucgcgcagaccgugacggccguggccggcgugguguccuaccccuucgacacggugcggcg

SEQ ID NO: 4332 - RNA, 69 nt, Human
cgcacgcgcuauguggagcauguguguaugagccacacauacacgcagaaaaaguauguagcgacgucg

SEQ ID NO: 4333 - RNA, 80 nt, Human
cgcagcuccuggcgcucggcggggcuaacugcagcgcggagaucucggccgccaagcuccgccucccgccccgggcugug

SEQ ID NO: 4334 - RNA, 67 nt, Human
cgcagugagcacuaauuguagccuuuccacugauggcguggaggggccgauacccagucgcacugcg

SEQ ID NO: 4335 - RNA, 109 nt, Human
cgccaggaugauccuagcuaucguucuuuucacucugguggauauggccaggaugccuuggguauggaccccaugauggaacaugagauggguggccaccacccuggug

SEQ ID NO: 4336 - RNA, 77 nt, Human
cgcccacugugacgaugucaccgaucuggacgucccugaagcagggggacagguguacagacauguucuugugggcg

SEQ ID NO: 4337 - RNA, 78 nt, Human
cgccgagcacagcuucuccuuaugucacgcacgauuucccgcucggccgugguggugaagcuguagccgcgcucggug

SEQ ID NO: 4338 - RNA, 81 nt, Human
cgccgcggggaugcugagcuucggcgggcggcuggacguuccuaagcagagcucgcagcguggcuugacggcccgcgagcg

SEQ ID NO: 4339 - RNA, 114 nt, Human
cgcgaucgggaauuggcagugagcguguuccagaguucagucugcgccucagguaacacgggccugacgccggcgcgucucucgggaauaaccuggcuguuggugagaucugcg

SEQ ID NO: 4340 - RNA, 72 nt, Human
cgcgcggcgacgcggcacacccggacacacgcucucggcacccccccggcaacgcaacggcaacgccacgcg

SEQ ID NO: 4341 - RNA, 71 nt, Human
cgcgcucgcgucccucgugcgggcuccagccgcagccuuagcuucggcucccggcuuggguggcgcggccg

SEQ ID NO: 4342 - RNA, 74 nt, Human
cgcggccagcaguuaccugagccugaggcccgagcuagugcacgucccacagaagcuacagcugccaggucacg

SEQ ID NO: 4343 - RNA, 80 nt, Human
cgcggguucugguucccgggcacggccuuccacauucgcuugcaaaggcuauguggcgguuccccccacuuuagcccccg

SEQ ID NO: 4344 - RNA, 63 nt, Human
cgcucgcaagaccaccagcgcccagagccccagucugaggcuggcgccgggggucugcgggcg

SEQ ID NO: 4345 - RNA, 77 nt, Human
cgcugaacucaugcagacgcuccgauuucuuggacucuacagagaugagcaucaggauuuuauggaugagcaaaacg

SEQ ID NO: 4346 - RNA, 67 nt, Human
cgcugcccgcgacuccugagcacacucccauggcggguggcgugcucugggugggugugcggcagug

SEQ ID NO: 4347 - RNA, 90 nt, Human
cgcugcgguaggccguuuccgaggcagcaguugcggccgcuuuuagccccugagcggcgaucugcggacugccugcgagucucugcugug

SEQ ID NO: 4348 - RNA, 74 nt, Human
cgcugcuauuagaaugcauugugaaacgacuggaguaugauuaaaaguuguguuccccaaugcuuggaguagug

SEQ ID NO: 4349 - RNA, 71 nt, Human
cgcuguaaagaaguucuugaguggcguguaaaauacagcaaauacaaaccauuaucaaaaccuaaaaagug

SEQ ID NO: 4350 - RNA, 100 nt, Human
cgcuuucuucuuccucuuuuauucccaucaguccuaggaccagagagugaaccaugagugcucuuggguucccgggcagcagggaugagggcagagagug

SEQ ID NO: 4351 - RNA, 84 nt, Human
cggaagugccuccuccccguccccuuccuuuccagccucacgcccgugggcugcaguuggaacgauggcggcuggcagcugccg

SEQ ID NO: 4352 - RNA, 104 nt, Human
cggaagugggcuuauuugcgcaucagcuacuuucgcuucuacuuaaaaacggaggaucuggguaaaagaaccgaaaggcuguacgaaccuaagacuugucuccg

SEQ ID NO: 4353 - RNA, 72 nt, Human
cggaaugcaguacccucagcagcagguuugugcuggucccccggaaccggcugcuguuuuguaauaguuuug

SEQ ID NO: 4354 - RNA, 94 nt, Human
cggaauuuggcacgaaccaugccacuguuucaugggcccgaguuacuuuccccagaugacucugguuuuguuugguuugccgccagagugacug

SEQ ID NO: 4355 - RNA, 84 nt, Human
cggacuuccauaaacucaaccuuccuuaaccccagaaaccacagacuuucaagagugaugacgaggggaagagaugagaagacg

SEQ ID NO: 4356 - RNA, 76 nt, Human
cggagaugccuacauagaagagugacagcagcuagacuaaauguuuaacugcugaacuaguuccucagguauccug

SEQ ID NO: 4357 - RNA, 64 nt, Human
cggagcaccugucuucauugccucucccuucugcagccugaaaggagggauguucaggacucug

SEQ ID NO: 4358 - RNA, 85 nt, Human
cggaggcacgcuccggcgaggcgagaggguuggguuagcaggcaucccggucgccccuuccuucuuuucgccggaguugaaucug

SEQ ID NO: 4359 - RNA, 83 nt, Human
cggaggcugcggcugcagaaguaccgccugcggaguaacugcaaagaugcuguccgugcgcguugcugcggccgugguccgcg

SEQ ID NO: 4360 - RNA, 73 nt, Human
cggagggcugccgggacgaagaggcuacaucuacacagggcgguguaggggaagcccgucucuucgaccuccg

SEQ ID NO: 4361 - RNA, 61 nt, Human
cggaggugucugagguugccaucagccagggcgaggucacccuggcccucaggaaccuccg

SEQ ID NO: 4362 - RNA, 75 nt, Human
cggagugguggccagccagccugcucguguaguggacgaacgggagcagauggccaucaguggcggcuucauccg

SEQ ID NO: 4363 - RNA, 87 nt, Human
cggaguucugcuuuaaucuggguaacugaggcuaauaugagcaagacuuugguuaauuaacuggguucucagaugccacagacuccg

SEQ ID NO: 4364 - RNA, 105 nt, Human
cggcaauugaucagaucaaccaacccggucagcccgcucuccggccccgugccugggguggcgggcgccuggcaggcuuuggugacucuagauuaccucgggccg

SEQ ID NO: 4365 - RNA, 77 nt, Human
cggcacugccacccuuuuggcauuguugccaccauugacugguggcgauggagagcugccaauugggcuggcggccg

SEQ ID NO: 4366 - RNA, 77 nt, Human
cggcccggcccucgcgugccucccaggcuccgcaccccugaugcugcgcgggugcugagcccgcuucggccgggacg

SEQ ID NO: 4367 - RNA, 82 nt, Human
cggccgccgcgcugccgcagcugcuugccguuaagccgcgcccgggaaacuugggccgagcagcugccgggggcuggcgccg

SEQ ID NO: 4368 - RNA, 60 nt, Human
cggccgccgcggaggcgcagcaugucggggcgcccgagggcguggaggccgcggaggccg

SEQ ID NO: 4369 - RNA, 68 nt, Human
cggccgcggccaaucggagccgcucuugcugcgacgcagcggucggaagcggagcaaggucgaggccg

SEQ ID NO: 4370 - RNA, 107 nt, Human
cggccuggggagccgucuuggccuggggagccgucuuggccugcgcgggugcuucggcgccgccaggcuccuguauccccguuuccagagccgcggcccucagggcg

SEQ ID NO: 4371 - RNA, 74 nt, Human
cggcgcuuccgcaaguuccugguguuuguggcaaacuucgaugaagaaugaccccaagaccuuugagggcguug

SEQ ID NO: 4372 - RNA, 73 nt, Human
cggcgcuuccgcaaguuccugguguuuguggcaaacuucgaugagaaugaccccaagaccuuugagggcguug

SEQ ID NO: 4373 - RNA, 91 nt, Human
cggcuccaggcggcgagcugagguugggagccuggcuuuccccuccgagaggguucaggugccucugccauagcuucugucgccugugcug

SEQ ID NO: 4374 - RNA, 72 nt, Human
cggcucccaauguugacguuggccagggccuuugcaaacaagccaggccaaaaaggcucaacauuuacaccg

SEQ ID NO: 4375 - RNA, 82 nt, Human
cggcuccgagaagcagguucuucgugaguuccucgcaagggccggucagagcuacacauugagaaccugaacauggaggccg

SEQ ID NO: 4376 - RNA, 60 nt, Human
cgggagccgcauggagccccgggcggcggacggcugcucccugggcgacguggguuucug

SEQ ID NO: 4377 - RNA, 91 nt, Human
cgggaucucacucugucacccaggcuggagugcaguggugugauuuuggcucacugcaaccuccaucuccuggguucaagcgauucuccug

SEQ ID NO: 4378 - RNA, 75 nt, Human
cgggcacauggggaaagaaucaccugaguuggccuggguaagucacugaaggcuucauggaggugauugugccug

SEQ ID NO: 4379 - RNA, 71 nt, Human
cgggccacuuucucagccuccuucugcccguaauuuuccuucaggaucugguacuguucuggaguggcccg

SEQ ID NO: 4380 - RNA, 71 nt, Human
cgggccagacuacucagcuucacggucauguggaaccgccgguccggcaucacaguggagccccuggcccg

SEQ ID NO: 4381 - RNA, 73 nt, Human
cgggccuugauagugucuccucauggcuuccacuggcaaaagcaugguuacccgaggugaugaucuuggucug

SEQ ID NO: 4382 - RNA, 87 nt, Human
cgggcuugaccggcgucggcccgccgccuccgcugccgcuucgccccaauccggucccucuggcccggccugacccggucuggcuug

SEQ ID NO: 4383 - RNA, 75 nt, Human
cggggacagcgaccugcagcuggaacgcaucaacguguacuacaaugaggccaccggcggcaaguacgugccccg

SEQ ID NO: 4384 - RNA, 72 nt, Human
cggggccgcacccgagcuacgccgugccgcaccgguugggccggucggugggagcucugggagcaggcgcug

SEQ ID NO: 4385 - RNA, 79 nt, Human
cgggggcucugccaguggccuggcuugaacggacgaugcggucaguagggcuggaggucuacacgcagaguuucucccg

SEQ ID NO: 4386 - RNA, 79 nt, Human
cggggggagccgagacugagcuuuccugucuuuccuuuuuucugagagauucaaagccuccacgacucuguuucccccg

SEQ ID NO: 4387 - RNA, 100 nt, Human
cgggucccuggucugggccaugucuggcugugaugcuugggagggagacuguuguucccggagaugcggcgcgcaggacaaggagcauccaagauaccug

SEQ ID NO: 4388 - RNA, 63 nt, Human
cgggucgggguuuaacgcguuucugggccgccguaagcccggccuaggggcagcuuugacucg

SEQ ID NO: 4389 - RNA, 68 nt, Human
cgguagcagugcccagucgagcccggggcagcggcugccgggccagggacuggugcgcugaggggcug

SEQ ID NO: 4390 - RNA, 101 nt, Human
cggucaggccccaucagggauggucacaguccagccacaggggcgacucugcccaucagucccccuggggcagcgaccagauccuggcuggggcagcaccg

SEQ ID NO: 4391 - RNA, 63 nt, Human
cggucgagcgcaguuaccgcgcggggcucugcuccaaagccgcgcuguuccugcugcuggccg

SEQ ID NO: 4392 - RNA, 68 nt, Human
cgguguccgaggaccuggggcuggugcauuuucgguuguugcugaucugucucaggacucugacacug

SEQ ID NO: 4393 - RNA, 61 nt, Human
cgguguguuaaggugauugugaaacaguugcugugaacuuucaugucaccuacauaugcug

SEQ ID NO: 4394 - RNA, 81 nt, Human
cgguugguuucugggccuucaacaaccuuuguauguuaggcucccuugauucggguaccgggguagagguccacccggccg

SEQ ID NO: 4395 - RNA, 71 nt, Human
cguaacauuuuccaaauguuccuuaucaguugguccacugagagccacugaucugauuggaaaacaagacg

SEQ ID NO: 4396 - RNA, 97 nt, Human
cgucagacuuggaagaaauauucuguucuaaaaucuucucacuuuuauaaaaaauaugcuuuucuuuuggauuuaggauguuaucuaauuucugaug

SEQ ID NO: 4397 - RNA, 86 nt, Human
cgucaugucuaagucagagucuccuaaagagcccgaacagcugaggaagcucuucaugggaggguugagcuuggaaacaacugaug

SEQ ID NO: 4398 - RNA, 67 nt, Human
cguccacuuucaucucuuugcucgggagguucaacugcuggaccccaaagagacugcaucauggacg

SEQ ID NO: 4399 - RNA, 91 nt, Human
cgucgagauguuuuuaaccagcgcguuucucaccggcuucucauuucacuguuuguacuccgggaucgggcacggagaagacauccuggcg

SEQ ID NO: 4400 - RNA, 87 nt, Human
cgucgcuggggcucgugucgcugggcggcaaggcgaccacggcgucgcaggccaaggcagugcugagcgccgagcagcugcgcgacg

SEQ ID NO: 4401 - RNA, 94 nt, Human
cgucggcauggcugucauucugaggguggaaaauaacuggauuucggguuaauuggugacauccucaagagcuguggcaagccaugucucggcg

SEQ ID NO: 4402 - RNA, 73 nt, Human
cgucuuggcucucuccgcuucguccuuaccagacuucgcacuuugugaggcgguucaauggugaagccaagug

SEQ ID NO: 4403 - RNA, 98 nt, Human
cgugacccugccccagccuaggccugucugcuggccuucagugccaucccaccccugggcaaggcaggcuuagcagcuaagggaggcugggggucacg

SEQ ID NO: 4404 - RNA, 85 nt, Human
cgugagcuucuuauagacaccagaaaaaguuucaaccuuguguuccacauuguucugcuguucuuuguccaaaugaaccuuuaug

SEQ ID NO: 4405 - RNA, 77 nt, Human
cguggaccuucccuguggccuguacccgucccucaacagagacaggcaauuaccagcgcccaggcuguuguccgacg

SEQ ID NO: 4406 - RNA, 61 nt, Human
cguggccggccaugggaagagccauguuuucaacguggagcuuggcagcgagcuggccaug

SEQ ID NO: 4407 - RNA, 80 nt, Human
cguuccccaacucaaggccgcucaacugucgccguucagaggacuacaguacacagcgagagucuuaccuagggggggcg

SEQ ID NO: 4408 - RNA, 73 nt, Human
cguuuuggaagcaaguggguucagugaaguguguugccacgaauagcacccgcugcuuuuggcuuuauuaacg

SEQ ID NO: 4409 - RNA, 78 nt, Human
cuaauaaacucugcaaugaaaucauguugacugcaucagucuguaccaugaccugaccucauuagcaaguuuauucag

SEQ ID NO: 4410 - RNA, 77 nt, Human
cuacaggacacaauguggcugaccugguggugauacucaagauucugccaacguuggaagcuguugcugcccugggg

SEQ ID NO: 4411 - RNA, 82 nt, Human
cuacuaguaaguagauuucucaaauaaaacauaauaauagcuaaauauagcuaauauuuacugaccauuuacuaugcagcag

SEQ ID NO: 4412 - RNA, 63 nt, Human
cuacucuuauuccuacucauuuagcaguaguucuauugggcacuaguagucaguagggagugg

SEQ ID NO: 4413 - RNA, 71 nt, Human
cuacuggaaagaaggcuuuauggagaucccaggaaccaaggaccauguaagccugaauuugugccaugugg

SEQ ID NO: 4414 - RNA, 93 nt, Human
cuacuuuugagucuugcuuguucagucaacugacugcuuaauaucuuugacaggguaguuugaaaggagaggugagcaaaguuucaggaguag

SEQ ID NO: 4415 - RNA, 71 nt, Human
cuagaaucucguguguuaguuuuaacuguuuugaaaauaauaaguaacauuaacacaauguugauauuugg

SEQ ID NO: 4416 - RNA, 70 nt, Human
cuagagaaggaucgggacggcuugugauuucucucccgagacagcgaucucucucuucuccuaucucuag

SEQ ID NO: 4417 - RNA, 83 nt, Human
cuagagaccccagaccuuuucauauggauauuugagaauguaaugcaucucaggccucgugcuggaacucuagggcacucuag

SEQ ID NO: 4418 - RNA, 63 nt, Human
cuagagcgguccuuggggagacgcgggucccaguccugcggcuccuacuggggagugcgcugg

SEQ ID NO: 4419 - RNA, 96 nt, Human
cuagagcuuuuguugaugauaugaaugaucuggauucagugaguucaguggucauuuaauccaguccuaccucucauacagcagacagauagauag

SEQ ID NO: 4420 - RNA, 112 nt, Human
cuagaguuagcaguguccggggagaguggcuuuagaccagucaguaccuugcucuuugugcauggugcaugucaagucaggaagccaagaaaccguuggcauuaaaaucuag

SEQ ID NO: 4421 - RNA, 87 nt, Human
cuagccaaaauguacaagaccacaccggaugucaucuuuguauuuggauucagaacucauuuggugguggcaagacaacuggcuuag

SEQ ID NO: 4422 - RNA, 60 nt, Human
cuagcccaucauuaccugugaacugcaguggggcagucauggcaaauagaauugggcugg

SEQ ID NO: 4423 - RNA, 73 nt, Human
cuagcugcugccagccaagcugcuaccagaccagcuccugcggaacuggcuguggcauuggugguggcauugg

SEQ ID NO: 4424 - RNA, 95 nt, Human
cuagcuuguuuguauagguagaaugauucaucucuccauuuuagauggcuagauguuuuguggaagaucuuagaauugccugccucauuugcugg

SEQ ID NO: 4425 - RNA, 80 nt, Human
cuagggggucaccuaugugggagccagcucugccuccugccccgaagcuccagagacuucuccuacaacugacucucugg

SEQ ID NO: 4426 - RNA, 77 nt, Human
cuaguccagguucgaacccaggaucacagauugcauuuaguuguuaugucucuuuagucucauuuuaucuggaacag

SEQ ID NO: 4427 - RNA, 82 nt, Human
cuauaccguagucuauuuaaagugugcaauagcguuacaucuacaaaaacaacguauauacuuuaauuugguuaagguaugg

SEQ ID NO: 4428 - RNA, 77 nt, Human
cuauagggaaagcugguacgccugcagguaccgguccggaauucccgggucgacccacgcguccgcauuaccuguag

SEQ ID NO: 4429 - RNA, 81 nt, Human
cuaugaggaaguaauagucucuuuuccaaauacuguuaguccaaaggcuuguuuguagaaucagacuguucuuuguuuugg

SEQ ID NO: 4430 - RNA, 72 nt, Human
cuauggcauuugcagauguucagccccauguagcugacgucauggacagggcuggauguugagugacuguag

SEQ ID NO: 4431 - RNA, 84 nt, Human
cuauggcucggggcucgcugcgccgguugcugcggcuccucgugcuggggcucuggcuggcguugcugcgcuccguggccgggg

SEQ ID NO: 4432 - RNA, 71 nt, Human
cuaugugaaugggaagugguuaaagccugaacacagaaauucagugccuugccaggaucccaucacaggag

SEQ ID NO: 4433 - RNA, 79 nt, Human
cuauuaugaacacaugagaaugauuuuuuucucuuaaucauuauuaaggaaauauuuuaauuucauggucauauaaugg

SEQ ID NO: 4434 - RNA, 109 nt, Human
cucacucucaccccucuagccuuaaauccagaaucuagacugaauauggacugaaugggucagauuuggggaaauguguuucuggggacagcugagggaccagagagag

SEQ ID NO: 4435 - RNA, 67 nt, Human
cucacugcuauauucaaaauuuauugagcugcaacugugugcucagcaaugagaauauagcagugag

SEQ ID NO: 4436 - RNA, 87 nt, Human
cucagacuuuuugacugccauguccuccuuuagaaggacuacaguuuggcuacuuggucucuucuggggcagauguggcauccugag

SEQ ID NO: 4437 - RNA, 73 nt, Human
cucagccagguuuccgauugucgauucaaggaagcaaaaguaauuuuucuugacauuugaggaccuuccugag

SEQ ID NO: 4438 - RNA, 112 nt, Human
cucagccucucccugauguaaucuggguuccuuguguggcaacaguaaugggaagaaaggaccugaaauauuaguugauuccaagggacccucuaagguuagagaggcagag

SEQ ID NO: 4439 - RNA, 72 nt, Human
cucagccuuccgaguagcugggauuacaggcaugcgccaccaggcccagcuaauacggaauauaaaguagag

SEQ ID NO: 4440 - RNA, 70 nt, Human
cucagcugguccugacucguggagaugcagacuuaggugugcccucgguugcuaggucagcgaccagcag

SEQ ID NO: 4441 - RNA, 77 nt, Human
cucaggauggcgcugggcuguccccucgccucuguccuugccagaagauggaggagaggcggcccaacucuucugag

SEQ ID NO: 4442 - RNA, 100 nt, Human
cucagggaacuuuggaaaauaaaauuuggcagccuaucuaaaauuaaaucaauuugugggugaggaacaaaaaccggauuucuuuguaaaucucccugag

SEQ ID NO: 4443 - RNA, 78 nt, Human
cucagguccuuuagugcuucucagucaacagacagggagggagcuuccccugugacugaggugcgcauaaagacugag

SEQ ID NO: 4444 - RNA, 63 nt, Human
cucagugaguucagaauauccuacaccuaaccccccucuuagaugguagcuaugcucagugag

SEQ ID NO: 4445 - RNA, 60 nt, Human
cucagugccuuuacugucgucucaagagaggagacuuguguggaacaguucaggucugag

SEQ ID NO: 4446 - RNA, 99 nt, Human
cucagugugggccauccaucugagguugaugagauauuugaugcuauaucauauagcaaaggugcaucugucauccgaaugcugcaugacuacauuggg

SEQ ID NO: 4447 - RNA, 91 nt, Human
cucaguucugccuccugacuaugacaguaaucccacccagcucaacuaugguguggcaguuacugauguggaccaugauggggacuuugag

SEQ ID NO: 4448 - RNA, 85 nt, Human
agauuacucuguuuuauaagccuuuuugaucuugaacuucguaauagcacuuugauuuccucacuuaaggcaggcaguguacucu

SEQ ID NO: 4449 - RNA, 87 nt, Human
agcaacuggguucccauggcaugugguggccuuagaggagguguucagccugccaccgucggugcuuuggugcucugcccaggagcu

SEQ ID NO: 4450 - RNA, 67 nt, Human
agcaaucaaagguuuucgcaauucuccagugggaguaaaccacagacuacgagggaguuugacagcu

SEQ ID NO: 4451 - RNA, 60 nt, Human
agcacagaacugcuuuuuauuuggggucugugaguuucuuagguauuagcaaucugugcu

SEQ ID NO: 4452 - RNA, 62 nt, Human
agcacaggaagcggaugacagaggaauccccuuuccuccaggucaccuuggcuugcugaguu

SEQ ID NO: 4453 - RNA, 67 nt, Human
agcacuguggcuuuugucagauggagugccggucugcagaggacugcucuuucgaauccacaguguu

SEQ ID NO: 4454 - RNA, 64 nt, Human
agcagaacaguaagcuuccagaggaaaccuacacuucuauccuuugggccuggccuguucuguu

SEQ ID NO: 4455 - RNA, 74 nt, Human
agcagaacugcaacacaauuuaaaugucuguaaauuaggucacaaaagggaugcaaaauguuugcaguuugacu

SEQ ID NO: 4456 - RNA, 101 nt, Human
agcagacugcccuguugaccagaauuuguuagauugcuauuacaaugcugauuauauuuuauagcaauuacugacauaagguuauacuuugggcaauggcu

SEQ ID NO: 4457 - RNA, 71 nt, Human
agcagaggcuggggaauggggguucugcucucacugaaugguggggaaccuucaacugcuuagccugugcu

SEQ ID NO: 4458 - RNA, 97 nt, Human
agcagaggugagguuucugagguuucauuauguugcccaggcuggucuugaacuccugagcucaagugauccucccaccucagccuuccaaagugcu

SEQ ID NO: 4459 - RNA, 88 nt, Human
agcauaugacagcaagacacuggcccuggaauccuccgugucacaugugggcugcugacaggaagaaugugcuuuuguuguuguuguu

SEQ ID NO: 4460 - RNA, 79 nt, Human
agcauauguuacuuaccuuguuauuaaauauuucuugaaaagcaaauuuuaaugguuuaauuuuauguggacguauguu

SEQ ID NO: 4461 - RNA, 105 nt, Human
agcaucugcaguacaucgugaccugguauggacucucugcagcuacauccuaccugugguuuaagaaauuccuacgugggacaccuggugugugacagaucagcu

SEQ ID NO: 4462 - RNA, 77 nt, Human
agccacacccuguaaagcccuggggcaacugaaggaguuuuuuugcugcaaggccccaggacugaagucuguuggcu

SEQ ID NO: 4463 - RNA, 75 nt, Human
agccacauuuugggguuguggugcguauaccauuugcgcgcaagagcgcaugguggcccggcccccuauauggcu

SEQ ID NO: 4464 - RNA, 62 nt, Human
agccagcaccugaugaaacuuccuucagugaggccuugcugaagaggaaucaggaccuggcu

SEQ ID NO: 4465 - RNA, 98 nt, Human
agccagcaggagcaguuggagaccgcuguuacgaggagggaauguacgaggcugccaagcugcucuauagcaauguuucuaacuuugcccggcuggcu

SEQ ID NO: 4466 - RNA, 70 nt, Human
agccagcaucguguuucaaacagugcaugacgcacaccuccggugcaaucaggcaugacaugugcucccu

SEQ ID NO: 4467 - RNA, 77 nt, Human
agccagguccugcaugaggcagcuggagaaguuuguccgcagcgugcauggcuuccagaugcuguaugccgacugcu

SEQ ID NO: 4468 - RNA, 70 nt, Human
agccagucauucuaaggggcuuuguauuggugcuauaaagucaaccucaauuccuuacaguggucugguu

SEQ ID NO: 4469 - RNA, 78 nt, Human
agccauacaagguggcagcggguaaccugcuuguucugucauccagggccucuuugugccccgucugucacccaggcu

SEQ ID NO: 4470 - RNA, 71 nt, Human
agcccaggugaccuucucugaggagucugcaguuccugagaggagcuggcgccucaggccauaccugggcu

SEQ ID NO: 4471 - RNA, 100 nt, Human
agccccagggcucgacgccugucccguuccuggucaaugagaccccaggcccaauaggcuuauaggccagugagcccaggccccuacaagcccugaagcu

SEQ ID NO: 4472 - RNA, 90 nt, Human
agccccuguguccagcugccuccagaagguucccagcaccgggguccacacagccguguugcugccacuuccaggugcuggcuugggguu

SEQ ID NO: 4473 - RNA, 106 nt, Human
agcccgcugccggcgcgcggcgcaugguggcggcuccuuucggagcgcagccgaaccucugacccggacuccguuaccccugcccggcgcgccccggcggccggcu

SEQ ID NO: 4474 - RNA, 67 nt, Human
agcccucaccgcccccaccuaccccaaccucaauggggaaggaaaggggccugagcugggcagggcu

SEQ ID NO: 4475 - RNA, 93 nt, Human
agccgggcaugguggcucacaccuguaaucccagcacuuugggaggccaagguggguggaucacaaggucaggagaucgagaccauccuggcu

SEQ ID NO: 4476 - RNA, 75 nt, Human
agccgggggucuggcaggaaugggaggcauccagaacgagaaggagaccaugcaaagccugaacgacgccuggcu

SEQ ID NO: 4477 - RNA, 77 nt, Human
agccguacauucccacgcaguuucaucucagggaggccaguuggcggccgguccuggauuuguuuuaagguacggcu

SEQ ID NO: 4478 - RNA, 93 nt, Human
agccuccagucccaagcaagccuccaggcccugaguguucugaugccugaaggguagucauaggucccgagguggagucggggguggagugcu

SEQ ID NO: 4479 - RNA, 82 nt, Human
agccuggagcuccucccugccagccccaggggcuggucgcuggucccugggcacagugagcagggcugaggucagacggguu

SEQ ID NO: 4480 - RNA, 68 nt, Human
agccuguccccagcccuucggaagccccggcgccagcccgggcccucggcagggaggaugacggagcu

SEQ ID NO: 4481 - RNA, 74 nt, Human
agccuucaucgucuggcuggccaacggggacacccuccgugucuucaagaugaccaagcgggaggaugggggcu

SEQ ID NO: 4482 - RNA, 81 nt, Human
agccuucugggccagaucuagggaucuucccucccucccugcacucuagcugcaggagcuuccuggugucugcccagagcu

SEQ ID NO: 4483 - RNA, 81 nt, Human
agccuuguggcugaggccugugacacuccggaacacugggaggcaguaccccagagccuagcaggccgacaagcaaggacu

SEQ ID NO: 4484 - RNA, 99 nt, Human
agccuuuacuuaaaaucuucagugucuugucaaaucuagcucuguaucagaugcuggaauauuccuaacauuugacaaacuggaguugaacuaaaggcu

SEQ ID NO: 4485 - RNA, 76 nt, Human
agccuuuuaacagcagaaaauuauccgguagcaaauugucuuagggaaauuacuacacuguuguaacaaaagggcu

SEQ ID NO: 4486 - RNA, 73 nt, Human
agcgagaucguggcuggacuggagaagaugccugcccgccgggcuuccuuaucccaccccagagacaucggcu

SEQ ID NO: 4487 - RNA, 104 nt, Human
agcggaggaagagguccuggguaaaggagcagguguguucuuagaaggcccuccugucugcugcuggaacacaucaccuguuuauucguccuccauuucccgcu

SEQ ID NO: 4488 - RNA, 75 nt, Human
agcggagggacugauaucucuggcuaaauauuuguccuuuuauuaugguuucuaaaucaguuauuuucuucagcu

SEQ ID NO: 4489 - RNA, 71 nt, Human
agcguggaugccgguguggacgcugugaaucguggcuggcccgguucuccgcuucuccccauccccauacu

SEQ ID NO: 4490 - RNA, 85 nt, Human
agcuacuccaauggcugugggagacuuaauuccaauuccaggugauacagccgucagucucccacuagcuguaggauggugugcu

SEQ ID NO: 4491 - RNA, 94 nt, Human
agcuaucacucaagcuucucacaccaucagaaaauucauucuggcaagaaaccuuaugaaugucaugaaugugggaaggcuuuuugugauggcu

SEQ ID NO: 4492 - RNA, 65 nt, Human
agcucagccccucacaguggccucaagugugaugccuuacaaaagcaccacucagaugggcagcu

SEQ ID NO: 4493 - RNA, 85 nt, Human
agcugagacugacgggugauguugcucauaggcuccagcucugcauaagaccuuggcuuggagaccucccucucagucaacagcu

SEQ ID NO: 4494 - RNA, 85 nt, Human
agcugauuuccugaggcaucgaugaggcucauggcacuggcaugggagagguuggugcaagagaccccauugauugccaagagcu

SEQ ID NO: 4495 - RNA, 79 nt, Human
agcugccggguguuggggaaagagucgccugccuccggaccggagugcagaccucugacccuggagucgcucggccgcu

SEQ ID NO: 4496 - RNA, 70 nt, Human
agcugcggggccacccuccgggcagaucgguaauagagcccuccgucuggugggaugcgcacccccugcu

SEQ ID NO: 4497 - RNA, 105 nt, Human
agcuggcuaccgacuccaccuucucccuggaccagcccgguggcacccuggaucugacccugauccgugcccgccuccaggagaaguugucaccucccuacagcu

SEQ ID NO: 4498 - RNA, 78 nt, Human
agcuguacaggcccgggauguaugggaucaccgcccgaagauggcggcucucaaacuccucuccuccgggcuucggcu

SEQ ID NO: 4499 - RNA, 104 nt, Human
agcugucagaguacggcuccugggacgcuuuugcuuauuuuuuguacggcuuuuucgaguuggcuuaggcagaauucuccucugagcgauaaagacgacaugcu

SEQ ID NO: 4500 - RNA, 88 nt, Human
agcuucugaaagccucaaacaucugugagugugcuaagagccgauccuuagguauuuuauacacucuaugcugagucaguuaggaguu

SEQ ID NO: 4501 - RNA, 74 nt, Human
aggaaacagaaaguuugagccuauaagccucuuuaucccaaucaaauggcuaacguccacucuuucuggcuucu

SEQ ID NO: 4502 - RNA, 81 nt, Human
aggaacagacuucauucuuuuucuuaacaaaaaaggcaucuucagugugugauuucaaaagaaagaagauucuggguuccu

SEQ ID NO: 4503 - RNA, 86 nt, Human
aggaacgauucacaggacaaacaaacccaauuuuuaagaaguuuauuugaaacucuuccuggucgaguccagugugaaauguuacu

SEQ ID NO: 4504 - RNA, 86 nt, Human
aggaacgauucacaggacaaacaaacccaauuuuuaagaaguuuauuugaaacucuuccuggucggguccagugugaaauguuacu

SEQ ID NO: 4505 - RNA, 98 nt, Human
aggaagaaagagcuugaggugggagcggcgcugggaggaagggaugggccccgccuuccugggcagccuuuccagccuccugcuggcucucucuuccu

SEQ ID NO: 4506 - RNA, 60 nt, Human
aggacagagccaaacaggaacagaggcugcccaacucccuucuguacugagcucuguuuu

SEQ ID NO: 4507 - RNA, 71 nt, Human
aggacuagagcucaugcugaucaugucggucagggguuugacuggcagaguacggcugcuguuggaguuuu

SEQ ID NO: 4508 - RNA, 63 nt, Human
aggacuagccaggaccggagcgcucgucacuccaauugggugcuccugggucccacugguucu

SEQ ID NO: 4509 - RNA, 93 nt, Human
aggagaaagaggaacaaggagagagggcaaaaccacagaacaguggauucuguuugcccguuuuucuguguaaacucugauauuaacucuccu

SEQ ID NO: 4510 - RNA, 90 nt, Human
aggagacucuuuucccccccaguauguguucuuagugccuuuguugaaaaugaguuggcucuaaguacaaagacuuauuucugaguucuu

SEQ ID NO: 4511 - RNA, 87 nt, Human
aggagcgccauggauuacuacagaaaauaugcagcuaucuuucuggucacauugucgguguuucugcauguucuccauuccgcuccu

SEQ ID NO: 4512 - RNA, 63 nt, Human
aggagcuggcugugagcgcccugggagccauugcuacggcugcccaggccucgcugcugcccu

SEQ ID NO: 4513 - RNA, 76 nt, Human
aggaggcaguccaggcucuuuagcaugguguuggaagcccuuaaugaucugcuacagccugggccuccagccuccu

SEQ ID NO: 4514 - RNA, 86 nt, Human
aggagggaaaggcccaggagggggagaaaggcagacucagccagggaugggugaggguuucccugucccaaagcaagacccaagcu

SEQ ID NO: 4515 - RNA, 119 nt, Human
aggagggcgguauucaggagagugugucagagcccaccagauacauuggaguuuauccaccuaaacuacuaauuacuacaugggcaugaaugcuggcauauugagaaguaccuauucuu

SEQ ID NO: 4516 - RNA, 81 nt, Human
aggaguagagaagggggacaggaguuagggggccccuguguagggguauagggcuccugcaucccucugggaucugagccu

SEQ ID NO: 4517 - RNA, 90 nt, Human
aggagucuugcccuguugcccaggcuggagugcaguggggcgaucuuggcucacugcaaccucugccucccggguucaagcaauucuccu

SEQ ID NO: 4518 - RNA, 78 nt, Human
aggcaaacgagaagaaggaggaacccaaguagcuuuuuggcuucguguccaacccucuugcccuucgccuguuugccu

SEQ ID NO: 4519 - RNA, 68 nt, Human
aggcaaagaaagacuuaagggagcagagggcugucuguugcuaccauuuuuuucaaauucuacugccu

SEQ ID NO: 4520 - RNA, 68 nt, Human
aggcaaagaaagccuuaagggagcagagggcuugucuguugcuaccauuucuucaaauucuacugccu

SEQ ID NO: 4521 - RNA, 104 nt, Human
aggcacacacgcaugguuuucucuuuuauaugcuagauuucaucccugacagcagaaaaugauuggcaaugguuaugacggagaacaugcaauagcgugguccu

SEQ ID NO: 4522 - RNA, 84 nt, Human
aggcagaacggaggguggcgggggacaaacgcgcgggacaauuuucucuccagcugguuaauuuuucuccaauauuuguagccu

SEQ ID NO: 4523 - RNA, 91 nt, Human
aggcagagucucacuuuguugcccaggcuggagugcaguggugcagucuuggcucacugcagccugucuucuggguuaaaacgauucuccu

SEQ ID NO: 4524 - RNA, 131 nt, Human
aggcagcggcauuagaucggaggaaugagauggacagaccugggcugugggcuaggagggcagucagcuggccuaggguagcccgggcuggugucaggguaaggagaggaagggagggaugagggcugauu

SEQ ID NO: 4525 - RNA, 83 nt, Human
aggcaugaaguuugaucgaggcuauauuucuccauacuuuauuaauacaucaaaaggucagaaaugugaauuccaggaugccu

SEQ ID NO: 4526 - RNA, 79 nt, Human
aggccaaauuuccacuuucagcaguuuuauuucagcuguuagcccgaagaaagaagcugcugaaaacagaaguucaccu

SEQ ID NO: 4527 - RNA, 130 nt, Human
aggccagcuuuuugggcugggguugcugagagaugugaugaugaaauguguggccuaccuggcaucuggccccagcuucagcuccauuuacugucuugcuccccacccucacuagccugcauugaggccu

SEQ ID NO: 4528 - RNA, 74 nt, Human
aggccaggcacgguggcucacgucuguaaucauagcacuuugggacuacaggcauaagccaucaugccuggcuu

SEQ ID NO: 4529 - RNA, 80 nt, Human
aggccuccccucuauccuuaucugucuggucgagucauuccgggccgagugggcaccaucaugggacgggcaggaggucu

SEQ ID NO: 4530 - RNA, 68 nt, Human
aggccuccugauaguuggggccaccucuucggacaaagauugugacuucgugcuccuucaggaggccu

SEQ ID NO: 4531 - RNA, 102 nt, Human
aggccucuucccuucagaaacaugccacuuaggucuaguucuccuggggugccaccuggucccagaccucaugacaucucauuuuguugggaucccuggccu

SEQ ID NO: 4532 - RNA, 110 nt, Human
aggccugcaucaccggccgugauuucuccgcuugcagcuucacuccggagcccgcgaaccggcuaccgccccgcugcagcacgaugaugucgcggucugugaguuugucu

SEQ ID NO: 4533 - RNA, 73 nt, Human
cucauaagugugugugggugugagagcacgauggugccuguguucugugaauguguccauaugugucuguaag

SEQ ID NO: 4534 - RNA, 62 nt, Human
cucaucaugaaaacugggaggccgggcaugguggcucaugccuguaaucccagcauuuugag

SEQ ID NO: 4535 - RNA, 77 nt, Human
cucaucgauuuucugguacagaaaaagaucaauccucaagugaugaaggcugggagacucugccaggaaaagaugag

SEQ ID NO: 4536 - RNA, 77 nt, Human
cucaugaugcuguugucuuucacccaaaauuuguagggaagacccuagaaacccuggcaggagaagagugugguggg

SEQ ID NO: 4537 - RNA, 97 nt, Human
cucaugauuccguuucuagguccuaggcccgugccugauccaggauccaagcucccggaagcuggcacugggcccgcccuggguaggcagcagugag

SEQ ID NO: 4538 - RNA, 63 nt, Human
cucaugcagacgcuccgauuucuuggacucuacagagaugagcaucaggauuuuauggaugag

SEQ ID NO: 4539 - RNA, 61 nt, Human
cucauugagccugacuguucugcuccauaaaauaggguaauaaaggucaaacaucagugag

SEQ ID NO: 4540 - RNA, 69 nt, Human
cucauuuuaauccugcagggcugccugccaguggaucuauccagcugcuuccuuguagccaagaaugag

SEQ ID NO: 4541 - RNA, 76 nt, Human
cuccaacgaugccuuuguucugaaaacccccucagccgccuaccuguggguggguacaggagccagcgaggcagag

SEQ ID NO: 4542 - RNA, 65 nt, Human
cuccagcaguguacugggaucauuaggacagccugagucaugaugaccucauuuugcaguugaag

SEQ ID NO: 4543 - RNA, 86 nt, Human
cuccagucccaagcaagccuccaggcccugaguguucugaugccugaaggguagucauaggucccgagguggagucggggguggag

SEQ ID NO: 4544 - RNA, 86 nt, Human
cuccaguuugucaagaguugaaggaggcucuguggccaggugaccuggcugccuuccacuccuuguaccucagucuaaacauggag

SEQ ID NO: 4545 - RNA, 81 nt, Human
cucccagcccagaacuuccagaugcccuggcaccucuagggaccaacugggacucauuauggaagaauggggugagaggag

SEQ ID NO: 4546 - RNA, 70 nt, Human
cucccccagcucugcuggucccggggccacagcgucaggccuguggggguggagguaugaggugggagag

SEQ ID NO: 4547 - RNA, 87 nt, Human
cuccccuuuucuguguucguagcagcuggcacaagcccagcacugggcucugcuccuggugccagugcugccuacugaugugggggg

SEQ ID NO: 4548 - RNA, 72 nt, Human
cucccgcuacacggaggcuaccaguacgagcagcgcucgcugucccccgucgcugccccgccccugcgggag

SEQ ID NO: 4549 - RNA, 75 nt, Human
cucccgcuccggcucccgcucgggaucucgcuccggaucucgcuccgggucccgcagugggucccggagaggaag

SEQ ID NO: 4550 - RNA, 71 nt, Human
cucccucuuuuuugauuuacugguacauuuuuaaaauaauaaaucugccauaaaaugcauuauaucuggag

SEQ ID NO: 4551 - RNA, 84 nt, Human
cuccuaccagaaagccauguucauauuucucagcaaugcuggagcagaaaggaucacagauguggcuuuggauuucuggaggag

SEQ ID NO: 4552 - RNA, 66 nt, Human
cuccucaccgccuggcuaccugaccuugguguugagcuucagguaugccacauagugugucaggag

SEQ ID NO: 4553 - RNA, 81 nt, Human
cuccucaccugcuccuugaaugacagcgccacagaggucacagggcaccgcuggcugaaggggggcguggugcugaaggag

SEQ ID NO: 4554 - RNA, 62 nt, Human
cuccucugcagcugauuggcucuggaguguggccagaagccucucuccugcaauuaaaggag

SEQ ID NO: 4555 - RNA, 93 nt, Human
cuccugcuuuauauaacuucuugaauccagcuaagagauuuauaaacuaauggcauaaaugucuggagccaaccuuggcaguuauagcaggag

SEQ ID NO: 4556 - RNA, 96 nt, Human
cuccugggagguugcgggguggggaugaaaagucccaauccucuaauccugccuuggucuuuugcugccaguccccauccugaagcuaccuagggg

SEQ ID NO: 4557 - RNA, 99 nt, Human
cuccuguaguccuagagcguuucucuugaacccuaauuuuuaggucucaaagagugggcuucagagauaaagagguuuaggcagggacagggcgaggag

SEQ ID NO: 4558 - RNA, 99 nt, Human
cuccuguaguccuagagcguuucucuugaaccuuaauuuuuaggucuuaaagagugggcuucagagauaaagagguuucggcagggacagggcgaggag

SEQ ID NO: 4559 - RNA, 88 nt, Human
cuccugugagcccacauucaacauuuuuugauacauuugauccaucuuugguuucuacagaagaugaagaagauaggcuuagagagag

SEQ ID NO: 4560 - RNA, 79 nt, Human
cuccuuccuccagggaggccucagcaucagugucuguggacguagucucugaagagugcuucagcugauggggaaggag

SEQ ID NO: 4561 - RNA, 97 nt, Human
cucgaaacgccggucucaguggcuauugaguuacccaccaaguuaccccgguuagagcuguuugggguggcucacguuauugcggcaaacuuuggag

SEQ ID NO: 4562 - RNA, 79 nt, Human
cucgagcggcucgagguggugcuggcugaaggcauccgugcgaaggugcuuucgggguccgcugcugcugcucugugag

SEQ ID NO: 4563 - RNA, 78 nt, Human
cucgcuauauggggaagggugucucaaaggcuguugagcacaucaauaaaacuaugugcgccugcccugguuagcaag

SEQ ID NO: 4564 - RNA, 74 nt, Human
cucggaguaaucgccugcauuggggagaagcuagaugaaagggaagcuggcaucacugagaagguguuuucgag

SEQ ID NO: 4565 - RNA, 93 nt, Human
cucggccccugagcuccaggccgugcgcauguuugcugacuaccucgcccacgagaagucggagggacagcaucguggccgagcuggaccgag

SEQ ID NO: 4566 - RNA, 91 nt, Human
cucggcccugagcuccaggccgugcgcauguuugcugacuaccucgcccacgagagucggagggacagcaucguggccgagcuggaccgag

SEQ ID NO: 4567 - RNA, 89 nt, Human
cucggccuccccuucagcagcuuugaccacucuaaagcccacuacuaucgcuaugaugagcaguugaaccugugccuggagcggcugag

SEQ ID NO: 4568 - RNA, 65 nt, Human
cucggcggccuggcgccggccgucgcuguacggugagccccagggaggcggaucugggccccgag

SEQ ID NO: 4569 - RNA, 62 nt, Human
cucggggaggccgccgggccggccuccgagacuccggcgggcaccgagucgccucacucgag

SEQ ID NO: 4570 - RNA, 72 nt, Human
cucgggugguggcgcaugccuguaaucccagcuacucaggaggcugaggcaggagaaucgcuuaaacccggg

SEQ ID NO: 4571 - RNA, 63 nt, Human
cucgucgaucucguucuccaugucuuccgugugcuggauacacuggcagagcucacagaugag

SEQ ID NO: 4572 - RNA, 116 nt, Human
cucguggcugcugcugcuccugcucucccucucccuccuccaggccacggauuucaugucccugugacugguggggcccauggaggagacaggaagccucaaguuccagugcagag

SEQ ID NO: 4573 - RNA, 71 nt, Human
cucuaacacucaucuucaaaagacugggacugcugagauguccucuauucuugaagagcguauucuuggag

SEQ ID NO: 4574 - RNA, 91 nt, Human
cucuagcgugauagucucuucuggguggcugcauccucaggcaggcuccccuccuagucccacauccaggaugacaccuuaacaguuaggg

SEQ ID NO: 4575 - RNA, 72 nt, Human
cucuaugccaugguggugguucucucgaggggcucaagauccugagggaggggcaccccaaggcagcaugag

SEQ ID NO: 4576 - RNA, 73 nt, Human
cucucaagcuccuuagaugcugggcagaagugggaugaguggcccaagaccgagaucccuaagguucugagag

SEQ ID NO: 4577 - RNA, 103 nt, Human
cucucaccccucuagccuuaaauccagaaucuagacugaauauggacugaaugggucagauuuggggaaauguguuucuggggacagcugagggaccagagag

SEQ ID NO: 4578 - RNA, 77 nt, Human
cucucauauuggcacaucugcuguccauuggggguucucaguuuccucccccagacagcccuaccugugccagagag

SEQ ID NO: 4579 - RNA, 85 nt, Human
cucugaaacccuccuccacagcugcagcccauccucccggcucccuccuagucuguccugcguccucuguccccggguuucagag

SEQ ID NO: 4580 - RNA, 66 nt, Human
cucugagccuuauagauuacauauccuuagcuaaaaacugcugcauuuggagucuaaggaaaggag

SEQ ID NO: 4581 - RNA, 69 nt, Human
cucugaggcucauuuugcaguuguugaaauuguccccgcaguuuucaaucaugucugaaccaaucagag

SEQ ID NO: 4582 - RNA, 95 nt, Human
cucugcacagcagcccagcagggauguccucucuagagaugguuuaucaaggguaccccaugagagggcagcuccugaugcagcugccggaagag

SEQ ID NO: 4583 - RNA, 67 nt, Human
cucuggggacuggaaugcaggcaguggaagccccagauugacuuaaccuguugacagaucuucagag

SEQ ID NO: 4584 - RNA, 75 nt, Human
cucuggguuacuggcugaguucugcccuguguggcuuucugcugugccagggcugcacugaguucaaaugcagag

SEQ ID NO: 4585 - RNA, 65 nt, Human
cucugucacucaugccuugccuaauuguucacaaugguggaaagcuucauguaauaugaucaggg

SEQ ID NO: 4586 - RNA, 79 nt, Human
cucugucuccuauagaugcagacagugaggauggagacugggucaucuggaugucacaucuggcaccugggaaacagag

SEQ ID NO: 4587 - RNA, 131 nt, Human
cucugugaugcuuggggaccggcuccucggucacaccccaguccugcucugaagguugccguuuuccaaacagaaggaugguagcuagaggggagauagcaagauucuggagucuggaaagccuucacuug

SEQ ID NO: 4588 - RNA, 90 nt, Human
cucuguuguucaccuuuugcuuuuugcacuguuuguucucuuaucuggauuuugagcuuagugcuaggacugagaggcugcaccauaggg

SEQ ID NO: 4589 - RNA, 79 nt, Human
cucuuacucccuuuuccccucaaaggagaacuguguuuaugaaacuguaguuuugccuuuggaugaaagggcauuugag

SEQ ID NO: 4590 - RNA, 111 nt, Human
cucuuauauauguguguguguguguguguguguauacauguauauauauauacacguguauauacacacacacauauuuuucucucuccuuaaaaauacagaauguaagag

SEQ ID NO: 4591 - RNA, 69 nt, Human
cucuucaucaguacaccacugugagccgacugaaaugauaaucacuugaagcuaucauuggugggagag

SEQ ID NO: 4592 - RNA, 78 nt, Human
cucuucgucacucuuaugucucucuccuuuucugugucuguguguggggagagagagagagagaaagagagagaggag

SEQ ID NO: 4593 - RNA, 96 nt, Human
cucuugacagaucuuggucucaacaauaaauucguuggggaagugucuaaucuuccagcauuuaucaauggcacguuuguugaaacccagcaagag

SEQ ID NO: 4594 - RNA, 85 nt, Human
cucuugaccagagggucucaaaugagggacauuuuaccugccaggggacauuuccaauguuuggggacacuuuugguuaucagag

SEQ ID NO: 4595 - RNA, 82 nt, Human
cucuugaccagagguucucaaaugagggacauuuuaccugccggggacauuuccaauguuuggggacacuuuugguuaucag

SEQ ID NO: 4596 - RNA, 97 nt, Human
cucuugcccaggcuggaguucagugguaugaucacaacucuccuaagccucaaacaccugggaucaagugauccucuggcuucagccucccaaguag

SEQ ID NO: 4597 - RNA, 86 nt, Human
cucuuggcugcccuuaugaagggaagaucuccccagcuaaaguagcugaggucaccaagaaguucuacucaaugggcugcuacgag

SEQ ID NO: 4598 - RNA, 73 nt, Human
cucuuguugcccaggcuggagugcaauggugcgaucuuggcucacugcaaccuccgccucccggguucaagag

SEQ ID NO: 4599 - RNA, 74 nt, Human
cucuuucaguggaaaaccgauggggaaccuggcccccaaggcuggucccccaggaacgggcagcccuucaagag

SEQ ID NO: 4600 - RNA, 64 nt, Human
cucuuucauccuguagucaggcagauaggccacaaaggugcugccaaggaccaggaugauggag

SEQ ID NO: 4601 - RNA, 110 nt, Human
cucuuugagaugacugguauugaauggagcagucuuugaaaggcaccaacccuuccuaacugaugguggucucuugaaagaggcucuuccaaauuugucuucugaaagug

SEQ ID NO: 4602 - RNA, 67 nt, Human
cugaacccaggaguuuaggguugcugugagcauugaucaugccacugcacuccagccugggugacag

SEQ ID NO: 4603 - RNA, 83 nt, Human
cugaaccuugagauccuuucacuagaauacacagggaaaagagaaaaagcuugcccuugugaaaggugaguuucauuguuuag

SEQ ID NO: 4604 - RNA, 84 nt, Human
cugaacuugggccagccacucaucugacuuguccuucguucccuaaccugucaaguaaaacggaagagggauggaccgaaccag

SEQ ID NO: 4605 - RNA, 116 nt, Human
cugaaggguggagagggccucucaugcaggcaugugugagcagcugcaggugugugagcaaaugugcaucacuggggaacaggugucuguggaugagggaggaagugagggugagg

SEQ ID NO: 4606 - RNA, 78 nt, Human
cugaaguuuccuguuuaaaaacugguaauaccuuuaagaagauuuuuuaaagacuagaaaaaguucggcugauuucag

SEQ ID NO: 4607 - RNA, 92 nt, Human
cugaaucaugcaguguauacaggaugucagugaagaggucuggcaggaaugccucacucucuuccuacugacugguacauguuaugaugcag

SEQ ID NO: 4608 - RNA, 74 nt, Human
cugaauccuuccauuucuucugcacaucuacuugcuuaaauugugggcaaaagagaaaaagaaggauugaucag

SEQ ID NO: 4609 - RNA, 72 nt, Human
cugaaugaccugcagucagggcccagaguugggacucuauacuacccugggcucuggucuguagguuuguag

SEQ ID NO: 4610 - RNA, 85 nt, Human
cugaauucuuacuggguuggugaagauuccacauaccaaauuuuuugagguuauccucauugauccauuccauaagagcuaucag

SEQ ID NO: 4611 - RNA, 75 nt, Human
cugacgaagccauugaaacagaugaucugaccauuaagcuggugaucaaggcacuccuggaagugguucagucag

SEQ ID NO: 4612 - RNA, 123 nt, Human
cugagacuggccugcaugaauacagggugugcgugaaugaaacugcccacaugaacuuuaugugcuacgauuuaacugcagccuugaacacacacaaaaauauucuuaagggcucagauuuag

SEQ ID NO: 4613 - RNA, 88 nt, Human
cugagcggcgggaccggaggggaugaggaggaagaguggcucuauggcgguacgaaacuuccugucucugucucucggguucucucag

SEQ ID NO: 4614 - RNA, 90 nt, Human
cugagcuggauggaaagacagcaaagauguacagggguggcuuuggacuagcucaucucauggcucuggggcuggguccauggcuggcag

SEQ ID NO: 4615 - RNA, 105 nt, Human
cugaggcaggagaaauugcuugaacccaggagguagagguugcagugagucaagaucaugccauugcacuccaaccugggcgacaagagcaaaacucugucucag

SEQ ID NO: 4616 - RNA, 61 nt, Human
cugagggaaguauaccuguccugccagccuuggucucuggcagggaagguccuuccaacag

SEQ ID NO: 4617 - RNA, 74 nt, Human
cugaguagcagugaacucaggagcgggacagguccauucacccugaaauuccuccuuggucacugccuucucag

SEQ ID NO: 4618 - RNA, 61 nt, Human
cugauauaagguccagguugauucacuccaaaggguguuaucuuacgaggacagucauuag

SEQ ID NO: 4619 - RNA, 84 nt, Human
cugaugaucauuuuagauagguaaggugaucuccauguaagggagggccaacaucuaccuuagaagcuaaaugugucacaucag

SEQ ID NO: 4620 - RNA, 95 nt, Human
cugauuuaaaaauauggucuuguuuuauaugauuaaaugguuuguuuucauagaugauauguuacucauuguaaagaccacauauuuuuauucag

SEQ ID NO: 4621 - RNA, 85 nt, Human
cugcacaaagaccccuugcugccagggccaggcaccggccuagcuccuugccugccugccugaggcagccguggaaucagggcag

SEQ ID NO: 4622 - RNA, 110 nt, Human
cugcaccgccagccucagcugucuuggagcagauguguauaguuagagauggggaccuuuucacuguaaauacugcucacauguuccuaggcugacuuuacuaugugcag

SEQ ID NO: 4623 - RNA, 95 nt, Human
cugcacuggcuacgagagacgaauggaugauccugguggaacggggcuccggauugugauccaugggcgagauccaucgacugucgggugugcag

SEQ ID NO: 4624 - RNA, 90 nt, Human
cugcagccaaguggaggugacugggugaugaauacaauguggaaagcauugauggucagccaggugccuucaccugcuauuuggaugcag

SEQ ID NO: 4625 - RNA, 98 nt, Human
cugcagcuccaauaaaauugccgagaugauguuuggguuugugcuggacauuccugagaggagccagaggugagucuugauuuuguuggggagagcag

SEQ ID NO: 4626 - RNA, 77 nt, Human
cugcagggcugcugccucaacauuuuagguucugauagcuguauucucaguccuggagugacagguguagccugcag

SEQ ID NO: 4627 - RNA, 78 nt, Human
cugcaguggugauguguugucacuucaggacaccccacuaccugaauugcagcaguguugcgaaucaucacucugcag

SEQ ID NO: 4628 - RNA, 91 nt, Human
cugcaucugccuccugcggggccuggacagggagggggccagaccacagcggacccuccuccggucauugugcgggccucugaggcugugg

SEQ ID NO: 4629 - RNA, 81 nt, Human
cugccauugcccacuuacuacacccugcccaaugccaccguggcuccugaaacgcgggcaguaaucaaguggaugaagcgg

SEQ ID NO: 4630 - RNA, 69 nt, Human
cugcccagcuggcuaaaguucaagaaaauacuauugcuucuuuaagaaaugcugcuagucauggugcag

SEQ ID NO: 4631 - RNA, 77 nt, Human
cugcccuagccaggggcacuggccagccugguuccaggcccacauggccuagucagugccucgaggagcugguucag

SEQ ID NO: 4632 - RNA, 92 nt, Human
cugcccuucgagaugugcccuucucagcccuguacugguucaacuaugagcuggugaagagcuggcucaauggguucaggccgaaggagcag

SEQ ID NO: 4633 - RNA, 82 nt, Human
cugccgcaggugccggagaaccuccugggacagcgagaagcugcugucaucugcagguuccugguaggcaaugaggcggcag

SEQ ID NO: 4634 - RNA, 71 nt, Human
cugccggcacugggcagcugccccacacaaugggaagcagugguggggcugggccaguccaggagccgcag

SEQ ID NO: 4635 - RNA, 81 nt, Human
cugccgugcccggaauuccaccagcucucggaagaagacucugaagucgaagaugggggugucacaguuccgaggcagcag

SEQ ID NO: 4636 - RNA, 69 nt, Human
cugccuagacccuccauugcagacaguucccaaaggaggcuggaagugcaaaugguguguuuggugcag

SEQ ID NO: 4637 - RNA, 84 nt, Human
cugccuaggauacugauggucgugaagauguucaaugauggaucuuugaacagcuucagcguggccuuaaguuucuaaggacag

SEQ ID NO: 4638 - RNA, 72 nt, Human
cugccucugaaauagcugcugcuucgagauccucccuuuuuaaagcacuuucuaaagcccucaggauggcgg

SEQ ID NO: 4639 - RNA, 86 nt, Human
cugccucuggaguccuagagacccggauuuacucagcuaggagagaggauggaucacagggucuaaggguggccauucagagguag

SEQ ID NO: 4640 - RNA, 71 nt, Human
cugccucuuuccuucccuggaagagauuuuaugggaucgcuuccugauagaagaugggaaggagagggcag

SEQ ID NO: 4641 - RNA, 70 nt, Human
cugccuguagaggaugccgcacagagauugacuugauucauagagacaauucacuccaucccuauggcag

SEQ ID NO: 4642 - RNA, 79 nt, Human
cugccuuucauggcuucuucugggccaaaucccccccugaaucagaaaauaaggagcagcucgaggccaggaggcgcag

SEQ ID NO: 4643 - RNA, 70 nt, Human
cugccuuucugugucugguucagagcucuuccuucugggcauguuuucuggacuacaugcacaugggcag

SEQ ID NO: 4644 - RNA, 60 nt, Human
cugcgccggcugcccguugcuagcuauggcaaaugguggcggcggcggcggcggcagcag

SEQ ID NO: 4645 - RNA, 61 nt, Human
cugcgcggggggguacaaauuauggcggacaccacuuccuccaaauaaauuccccgcgcgg

SEQ ID NO: 4646 - RNA, 109 nt, Human
cugcggagcccgcgucgcagcagcccggacaggaagauuggucuggauguggguccggucuuacagucgcgggccaggaugagggcagguugcgacagcgcgcacccgg

SEQ ID NO: 4647 - RNA, 83 nt, Human
cugcggccgggcggcucggcggggccagcagcaggagcaguaagcucagcgccccgcgcggcccugcaagggaagcgccgcag

SEQ ID NO: 4648 - RNA, 85 nt, Human
cugcuacgcuccagccagccccuaacugguccccagaagcggcgcugcuacagggaccaggagcugcugcgaacugcgcuggcgg

SEQ ID NO: 4649 - RNA, 99 nt, Human
cugcuccaaggccuggccacaugcagacaggaggaagcugagcucgacauuaggccucaaggcugccaucugucuuguagggccuggccuugugggcag

SEQ ID NO: 4650 - RNA, 74 nt, Human
cugcuccagcagcuggugcugcaccagcaggagguccugcccccuccacugcugcugcuccagcugaggagaag

SEQ ID NO: 4651 - RNA, 68 nt, Human
cugcucucacaguggccuguaacaauuucuucugggagaacaguugagcagacagccacauugggcag

SEQ ID NO: 4652 - RNA, 60 nt, Human
cugcucugcuucucugcggcgccgccagacauggucgguucgcuggagagaggcgagcgg

SEQ ID NO: 4653 - RNA, 130 nt, Human
cugcugaaagucuacagucugugaauauaccaauuccccuuuacaacugaugcagaucauuaugaaauacuggaaggcauacccuacaauuuaggaauugguguggcugccacugcuaugcucucaauug

SEQ ID NO: 4654 - RNA, 75 nt, Human
cugcugugucuuuccaggugcugaaagagaaaacggaauuucuugcauagacagcugaagaguccuguagagcag

SEQ ID NO: 4655 - RNA, 92 nt, Human
cugcuuuccugaaaaccaugcugcacuuccacaugaaguucucucugacguugagcuugauggaaaaaggaugcagaagucaggaauagcag

SEQ ID NO: 4656 - RNA, 68 nt, Human
cuggaacccgccccgucgggggaccccgaggcuccgccuccaggcccccuccacucggccuucuccag

SEQ ID NO: 4657 - RNA, 83 nt, Human
cuggaagaaggaagcugugauagguuaugugaaagagaugucuccucaucucuaauggcuuaccgagacagcucucgauucag

SEQ ID NO: 4658 - RNA, 64 nt, Human
cuggaagccgccuccgugucguccaagggcuuacccagcccuuacaacaugucuucggcuccgg

SEQ ID NO: 4659 - RNA, 76 nt, Human
cuggagaccucggcucaagucuuugcccugcugccgacgcauugugucaccuugggcaaggacuucgcaucuccag

SEQ ID NO: 4660 - RNA, 77 nt, Human
cuggagaguuccauucacuuccugaaacgugcaccuguuucaggugcauguuuauucagugugcauggauauuuaag

SEQ ID NO: 4661 - RNA, 85 nt, Human
cuggaggagaagagguucugcuggaacaagcugguguagaugcaagugaaagcuuugaagauguaggacacucuucugaugccag

SEQ ID NO: 4662 - RNA, 63 nt, Human
cuggaggagggacgggucugcagguuccaaugggugacagccugacaucugucccuucaacgg

SEQ ID NO: 4663 - RNA, 78 nt, Human
cuggagggcaagucuugcauccacugcuuugcuggcaacccgacugguaagcuucuggaaggcaaggcuugcauccag

SEQ ID NO: 4664 - RNA, 97 nt, Human
cuggagugauguuagcagacccagcuuagaguucuucuuucuuucuuaagcccuuugcucugggaggaagaucuccagcuucagcucacacucacag

SEQ ID NO: 4665 - RNA, 112 nt, Human
cuggaugagagaccuugauuuccuguucacuauuggcuggucuggaccuuggugccugacccaaagcacacagaucagaacuccuugggaaagggagucagucccucucugg

SEQ ID NO: 4666 - RNA, 74 nt, Human
cuggaugugcugcagaugcaucccaauaaucaggguggccucaaaacccugucuguccucuguagcacuuuuag

SEQ ID NO: 4667 - RNA, 106 nt, Human
cuggauuccccaaagcucacaguuuggcacugaaucauauacaaucucguaguuuggauggcugugugugacugcagacugcuagacagcagggcccacaucacag

SEQ ID NO: 4668 - RNA, 65 nt, Human
cuggauucggaaugugcugauuuccauuggacucaaguugaucucacuuauauucugagugccgg

SEQ ID NO: 4669 - RNA, 79 nt, Human
cuggcagcgcuucaagucaugguccccaucaugcaggaucucaggcuccacgaugggcacaaugccauucugcuggcag

SEQ ID NO: 4670 - RNA, 114 nt, Human
cuggcagcugcaugguacauaaagucuccugauaggcugagucuguugcuagggggaauuagcaugaauuuuuccacacacagacucaguggcugaaugauaaaagcugacugg

SEQ ID NO: 4671 - RNA, 76 nt, Human
cuggccgcagggugauauacaaguauggcaaacugucaaagcuggcagagacgcucuaugacaccaccaaggucag

SEQ ID NO: 4672 - RNA, 68 nt, Human
cuggccuccaucuaaaggcgcugcuugauucgugaggauacaacgaugcgagacaaggugguggccag

SEQ ID NO: 4673 - RNA, 77 nt, Human
cugggacccuguacacguauccugaaaacuggagggccuucaaggcucucaucgcugcucaguacagcggggcucag

SEQ ID NO: 4674 - RNA, 82 nt, Human
cugggaggcagagguugcagugaucaggaauugugccacugcacuccaaccugagugacagagcaacacucugucuuaaaag

SEQ ID NO: 4675 - RNA, 94 nt, Human
cugggagggagagaacuuucuggggguagggugcccuccaucugaaacaggccaggugagcaucaugcauaaggccuccauucuguccgcucag

SEQ ID NO: 4676 - RNA, 82 nt, Human
cugggagugcugggggacagguaccccccggugguccuauggcaggaugagaagggagggacuuggcucccccagagcccgg

SEQ ID NO: 4677 - RNA, 69 nt, Human
cugggauggggaccgcggaaguucccaccgaugcggccggcggggcccagccuugguccccagcuccgg

SEQ ID NO: 4678 - RNA, 105 nt, Human
cugggauuacaggcaccugcugccaagucuggcuaauuuuuguauuuuuaauagagacgggguuucgcuauguuggccaggcuggucucgaacuccugaucucag

SEQ ID NO: 4679 - RNA, 94 nt, Human
cugggcacguaggccucccgcagugagaugaggaucgggucggcaucccgcccgcucacccacuccucagccuccagggcugccucgggcccgg

SEQ ID NO: 4680 - RNA, 73 nt, Human
cugggcaugaugguuggcgccuauagucccagcuacuugggaggcugaggcaggagacuggcaugaaccccgg

SEQ ID NO: 4681 - RNA, 71 nt, Human
cugggcaugguggcgcgcgccugcaucucagcuacucaagaggcugaggcaggagaaucacuugaacccgg

SEQ ID NO: 4682 - RNA, 88 nt, Human
cugggcccgggagacaacuuggcgucaccccucagcggucgccacucucuucucuguuguuggguccgcaucguauucccggaaucag

SEQ ID NO: 4683 - RNA, 64 nt, Human
cuggggacggggccuuccgcgagucucccaccucucgggggacugcagggagaggcgucuccag

SEQ ID NO: 4684 - RNA, 71 nt, Human
cuggggaggugugcucugcucucaaccucugcgagucucuccagaagcaccuagcagagcugaaucaccag

SEQ ID NO: 4685 - RNA, 78 nt, Human
cuggggcguuuauggcaagucacuuugacagacauuauuguggcaaauguugucugacuuacuguuucaacaaaccag

SEQ ID NO: 4686 - RNA, 75 nt, Human
cuggggcuguuaaauuacauuuuauuggcauaagguugcacugcaaucugccaguaucacauaaugauaauccag

SEQ ID NO: 4687 - RNA, 80 nt, Human
cugggggaaugcgguggcuuccaggguaaccgucugacccugaacuucagcacguuaagcggccgggggucaucuaacag

SEQ ID NO: 4688 - RNA, 78 nt, Human
cugggguguauauggcaagucacuuugacagacauuauaguggcaaauguugucugacuuacuguuucaacaaaccag

SEQ ID NO: 4689 - RNA, 75 nt, Human
cugggguguuuauggcaagucacuugacagacauuauguggcaaugucgucugacuuacuguuucaacaaaccag

SEQ ID NO: 4690 - RNA, 78 nt, Human
cugggguguuuauggcaagucacuuugacagacauuaucguggcaaaugcugucugacuuacugguucaacaaaccag

SEQ ID NO: 4691 - RNA, 78 nt, Human
cugggguguuuauggcaagucacuuugacagacauuaucguggcaaauguugucugacuuacuguuucaacaaaccag

SEQ ID NO: 4692 - RNA, 81 nt, Human
cugggguguuuauggcaagucacuuugacagacauuaugguggcaaaauguggucugacuuacuuguuucaaacaaaccag

SEQ ID NO: 4693 - RNA, 77 nt, Human
cugggguguuuauggcaagucacuuugacagacauuaugguggcaaugucgucugacuuacuguuucaacaaaccag

SEQ ID NO: 4694 - RNA, 77 nt, Human
cugggguguuuauggcaagucacuuugacagacauuauguggcaaauguugucugacuuacuguuucaacaaaccag

SEQ ID NO: 4695 - RNA, 78 nt, Human
cugggguguuuauggcaagucacuuugacagacauuauuguggcaaaugucgucugacuuacuguuucaacaaaccag

SEQ ID NO: 4696 - RNA, 78 nt, Human
cugggguguuuauggcaagucacuuugacagacauuauuguggcaaauguggucugacuuacuguuucaacaaaccag

SEQ ID NO: 4697 - RNA, 77 nt, Human
cugggguguuuauggcaagucacuuugacagacauuauuguggcaaaugugucugacuuacuguuucaacaaaccag

SEQ ID NO: 4698 - RNA, 78 nt, Human
cugggguguuuauggcaagucacuuugacagacauuauuguggcaaauguuguccgacuuacuguuucaacaaaccag

SEQ ID NO: 4699 - RNA, 81 nt, Human
cugggguguuuauggcaagucacuuugacagacauuauuguggcaaauguuguccugacuuaccuguuuccaacaaaccag

SEQ ID NO: 4700 - RNA, 78 nt, Human
cugggguguuuauggcaagucacuuugacagacauuauuguggcuaauguugucugacuuacuguuucaacaaaccag

SEQ ID NO: 4701 - RNA, 80 nt, Human
cuggguaaacuaaugguuugcguaucacacaauuacacuacaaucugauaggagugguaaaaccagccaauggaauccag

SEQ ID NO: 4702 - RNA, 74 nt, Human
cuggguaucaccagcggaggcugcagagcagcaaugauugcugccuguuguuuccucuggaagcugcgacccag

SEQ ID NO: 4703 - RNA, 72 nt, Human
cuggguucaagccauccucccaccucagccucccaaaaugcugggauuacaggcaugagccacuguacccag

SEQ ID NO: 4704 - RNA, 79 nt, Human
cugguaaccuggcguccgguggggccgcuggggccaccucccuuugcuuugucuacccgcuggacuuugcuaggaccag

SEQ ID NO: 4705 - RNA, 90 nt, Human
cugguacuccucauggggcuugaccauuaucacacagguggggcgcuuggagcugcgcugcacccaggucccgucuuagaggggauauag

SEQ ID NO: 4706 - RNA, 68 nt, Human
cugguagcauucaguguaccauaccuauguggaaagaacuccguaggggacacaugaggugcuggcag

SEQ ID NO: 4707 - RNA, 72 nt, Human
cugguccacgugggcuuguuagcaggcagaggaacccugcuuuccaaaaacugauauaguccagagucacgg

SEQ ID NO: 4708 - RNA, 60 nt, Human
cuggucuccugugaagaacauguggaucucuucccgaaggaaaaggucccaggagaccag

SEQ ID NO: 4709 - RNA, 63 nt, Human
cuggugacggggcccugggcuggggcugucccacacuggacccagcucucccccugcagccag

SEQ ID NO: 4710 - RNA, 83 nt, Human
cuggugcaucaguuguucccggcgcaggcccccguugaucguggcgcuggugcugcugacggagcugcugguucugcugccag

SEQ ID NO: 4711 - RNA, 79 nt, Human
cuggugcucccgaccccugguaggcccauccuccccgugcagacaggggagcaggcgccagcuaagaggagcaguccag

SEQ ID NO: 4712 - RNA, 66 nt, Human
cugguuaacuucuugagcuauuucguggaacuuggaacacagccugccacccagugaaguguccag

SEQ ID NO: 4713 - RNA, 94 nt, Human
cugguuauuguauauacugugucucuaaaagcugacuggucucucccaccagcucacuuucuacuugagacauaccauauugcagugaggcuag

SEQ ID NO: 4714 - RNA, 84 nt, Human
cuguacaaagcagccuuggaccaggagggaaaaccccaaggcucugcagccucccugcuccccuccguuuaaggcuguggucag

SEQ ID NO: 4715 - RNA, 66 nt, Human
cuguacggccccaccaacuuugcccccguggucacccacguggccaggaaugcagcggccgugcag

SEQ ID NO: 4716 - RNA, 77 nt, Human
cuguacuguauuuauguugcuauggggcaaaagagauccacuguugcccaguugggugaagagacuuacagaugcag

SEQ ID NO: 4717 - RNA, 67 nt, Human
cuguagcugguucuguaaagguugguggagaggcagguccaucugucacacuacccugccacuacag

SEQ ID NO: 4718 - RNA, 78 nt, Human
cuguaggaauugugugcauuccauucacacaguauuucuuuagggaugcugugaugauuugaauuacaaauccuacag

SEQ ID NO: 4719 - RNA, 74 nt, Human
cuguaucgauaugguuccuuuuccgucaccacuggacauuguccaggguauugaaagugccugagauccugcag

SEQ ID NO: 4720 - RNA, 84 nt, Human
cugucacauucaggggcuuccccucacugugcugcaccacacugccaauguuaugcagugacuggaaguucuggguguucacag

SEQ ID NO: 4721 - RNA, 75 nt, Human
cugucacccagagucuaggcuggagugcuauggcacgaucauagcucauugcagccucgaacuccuggguucaag

SEQ ID NO: 4722 - RNA, 69 nt, Human
cugucagggcugauggugaaggggucagcacgcggauguugaucuuuucuuucuucagcaguucggcag

SEQ ID NO: 4723 - RNA, 93 nt, Human
cugucauucucuugcuccuuacuugaaauacaaauauugggaaugucacagacaucaagcaacuacugucaagugggaggagagaaugagcag

SEQ ID NO: 4724 - RNA, 77 nt, Human
cuguccaaggccaggaggaauuggaaagaagaugguuucuugaaaucucucuuccauacuucuuuggucuuuugcag

SEQ ID NO: 4725 - RNA, 84 nt, Human
cugucuacugguccaaauagaccaugucaguucacccccugguuugugucuauggguggcugugguauaugggaaaaguagcgg

SEQ ID NO: 4726 - RNA, 86 nt, Human
cugucuuugcccggggaagguauccuccgaugacgagcuguccgacaguacccggaugaaguugucggaguccccaucggaggcag

SEQ ID NO: 4727 - RNA, 73 nt, Human
cugugaagcaugugcugguggucauugguaacagucauguuugucaacaaugucaguccagccagcugcacag

SEQ ID NO: 4728 - RNA, 82 nt, Human
cugugaguuauaugugaugaaaaaguauagcuuucuugaauucaaauaagcaauggcaaagaucacauuuagaauuugacag

SEQ ID NO: 4729 - RNA, 76 nt, Human
cugugaugaauaccuggaccaaacaaaugggauuuccccucauuuauguggaagcugaacagguagaagaugacag

SEQ ID NO: 4730 - RNA, 107 nt, Human
cugugauucauguuucauuaguuaggccaugggacuucugaguacaucacaauauuuuggauacacauagagauuguuccacugagaaaugaaaucaaugguuaggg

SEQ ID NO: 4731 - RNA, 109 nt, Human
cugugcaccucgugguaaaacucuuugggguucgccagcuguagcucauauuucauguuggggucaugccgaacacccaugaaguuguaguuccacgaggacugggcag

SEQ ID NO: 4732 - RNA, 109 nt, Human
cugugcaccucgugguagaacucuuugggguucgccagcuguagcucauauuucauguuggggucaugccgaacacccaugaaguuguaguuccacgaggacugggcag

SEQ ID NO: 4733 - RNA, 86 nt, Human
cugugcaucagccuguagguucuuccucuacccuuccgaagaugccaguauugaggaaagaaaaacugcaggaucugaugacucag

SEQ ID NO: 4734 - RNA, 73 nt, Human
cugugcccugacccuacaagaugccaagagaagaugcucacuucaucuaugguuaccccaagaaggggcacgg

SEQ ID NO: 4735 - RNA, 74 nt, Human
cugugccuuguuuuuuaaaagauaagaugcuagaaauucaaugggauuugguggucuuuccuuugcaagcacag

SEQ ID NO: 4736 - RNA, 89 nt, Human
cugugcucacucugguuuucugcucagggucugaagcagcugcugucucccuccucugcccccauccccuggcucuccccugggcacag

SEQ ID NO: 4737 - RNA, 89 nt, Human
cugugcucccugugcacucucagaccccaccucuucguugucauagagugugaccaugcgcacgugaggcucuguggccagggagccag

SEQ ID NO: 4738 - RNA, 83 nt, Human
cugugcucuugauaacagaguguuugagggacaacuuucacauuugaguuuuuccaaaauuaaagguuguagaagagucacag

SEQ ID NO: 4739 - RNA, 67 nt, Human
cugugcuggguccuguacccaagagguccaggaucgggucugguccucgggugccuuuccaaaacag

SEQ ID NO: 4740 - RNA, 92 nt, Human
cuguggaccuuugggacacaagguggaccuguacugauagagaaacacacucucuaagaagugcuuacucacccuuuuccaaaggagcacag

SEQ ID NO: 4741 - RNA, 74 nt, Human
cuguggauaaugguacuucagccuggggcaagcccauagacaguggucccagcuggggagaaccauuacugcag

SEQ ID NO: 4742 - RNA, 61 nt, Human
cuguggcaggggaggacagaacuuugauccuuaccucccaaccucugucuacucaccacag

SEQ ID NO: 4743 - RNA, 71 nt, Human
cuguggccuaccaggugaauauuggcuuggaaaugauaaaauuagccagcuuaccaggaugggacccacag

SEQ ID NO: 4744 - RNA, 74 nt, Human
cuguggcucaugccuguaauccuagcacuuugggaugccuaggugaguggauugccggagcucaggaguacaag

SEQ ID NO: 4745 - RNA, 93 nt, Human
cugugggccagaaagcaggcaccagggcugaccucaaggccguaucagagggccaagcagaguucuuuuggauaccugcuuuucaucccacag

SEQ ID NO: 4746 - RNA, 81 nt, Human
cugugggcucuggcauauauuagcugugugacugugggugagucacuucacuucauggaggcucaguuuccucgucuguag

SEQ ID NO: 4747 - RNA, 65 nt, Human
cuguggggacaggaugucuggguccccaggcuuugacuguggggacaggugucugggucccccag

SEQ ID NO: 4748 - RNA, 79 nt, Human
cuguggugggacggccaaaagacaggcggggggccuacacuccaaagcuugagaaggaaauggccgcaauuuaccgaag

SEQ ID NO: 4749 - RNA, 78 nt, Human
cuguguaauuuuuggccuaaauagcccugugaaguagauauuauuccaacuuuacagguuagaaaauuugaggcacag

SEQ ID NO: 4750 - RNA, 74 nt, Human
cuguguccagcccuugcagagagcuuuguccucugacaucagcuaccacacaggcucauucucaacuggcacag

SEQ ID NO: 4751 - RNA, 114 nt, Human
cugugucugaagaucaugcugaccccacaaacggaugggccugggggccacuuugcacaggguucuccagagcccugcccauccugccuccaccacuuccuguuuuucccacag

SEQ ID NO: 4752 - RNA, 82 nt, Human
cugugugugccgugcgaggacgcaacgucgagaacaugaagaucuugcgucuaaugcugcuccacaucaaauaccuguacgg

SEQ ID NO: 4753 - RNA, 114 nt, Human
cuguuuccuauaggugcugucagaucagguuccugauuggaguucucuuaucugcucugguuuggagggcugccccauucgggaaucuguuuuguuuugcucaaauacacucag

SEQ ID NO: 4754 - RNA, 89 nt, Human
cuguuuuuguaucuuuaugcuguauuuuaacacuuuguauuacuuagguuauuuugcuuugguuaaaaauggcucaaguagaaaagcag

SEQ ID NO: 4755 - RNA, 76 nt, Human
cuuaaacuuccuccaacuuucuucugcuacaagaauagaccagauuauguuagugaagaagaggaggaugaugaag

SEQ ID NO: 4756 - RNA, 79 nt, Human
cuuaauuauuacgggcacugccuuggagcgauguuaaaaaacauugaugaugcaguucuuucaacagguauuuauugag

SEQ ID NO: 4757 - RNA, 87 nt, Human
cuuauggcucugaggccaucggcugucucugcauuucacuggcuguggaggagagacuccuaggauggcugcugucugagccaugag

SEQ ID NO: 4758 - RNA, 71 nt, Human
cuuauuaggcaaguuaggugcacugaaucuaaccuuuaagguugacaugggcucaaacuuggccuaaaaag

SEQ ID NO: 4759 - RNA, 126 nt, Human
cuuauucugaaacaacuugaaucuuuguuuuuaugcugugauauuaguggcuguggcagugccuagaauuguuuaauugccuaaugcacaaaggugagcacuuugauugauguguauucagagaag

SEQ ID NO: 4760 - RNA, 73 nt, Human
cuuauucuguuuaccuggauuuuuauuucaauuuauaccuuauaugaaaaaauacaaaauucaaaaggauaag

SEQ ID NO: 4761 - RNA, 72 nt, Human
cuuauuguaacugacaacuguuuucaacuccaagagcuaaacuauuggcaguucauguuaaguuacagugag

SEQ ID NO: 4762 - RNA, 70 nt, Human
cuucaauccucugucucucgaggaacuaggcuccaacacggggauccagguuuucaaucagauugugaag

SEQ ID NO: 4763 - RNA, 75 nt, Human
cuucaccaaguugucauuugagcacaguuugaggaguguaagacagucaugcggacuugagggguacaagggaag

SEQ ID NO: 4764 - RNA, 80 nt, Human
cuucacgcuggggcuagcaggacuucucggcgagggaguuuuuaacuuugugagaacuccucaugcacccugugcuggag

SEQ ID NO: 4765 - RNA, 80 nt, Human
cuucauccacuacucagucauccaaacuagugccauuacaaaugcggcacagucgaugaucugucaauguagagaugcag

SEQ ID NO: 4766 - RNA, 73 nt, Human
cuucaucuccacucugcacggcggcugagggcccuuacucugggccugggcacccuuagaggggagaacgaag

SEQ ID NO: 4767 - RNA, 72 nt, Human
cuucaucuccacucugcacggcggcugagggcccuucucugggccugggcacccuuagaggggagaacgaag

SEQ ID NO: 4768 - RNA, 90 nt, Human
cuucaucugguguugagacuucgggguggugcuaagaaaaggaagaagaagucuuacaccacucccaagaagaacaagcauaagaggaag

SEQ ID NO: 4769 - RNA, 103 nt, Human
cuucaugagcucuuccacauuuguguggcccaggaacacauccaaagaggcguugcuuugcgcuucguguuccuugggauacagggugugggcagcugugagg

SEQ ID NO: 4770 - RNA, 85 nt, Human
cuuccagugugggguuccccauucauccgccuuuuggaguagggucugcgcugaggcaggggaaugggagaaguuugaaagggag

SEQ ID NO: 4771 - RNA, 65 nt, Human
cuuccaguuugcaaaagaucuucugugaccaugagugagcccguagaagugaaccaggcugggag

SEQ ID NO: 4772 - RNA, 101 nt, Human
cuucccauaaaaguuugcucucucuuuuugaaggaaauuucugggcaaacaacauuucugagaaagaaauucagauaugggaaaguaaagaucauggggag

SEQ ID NO: 4773 - RNA, 67 nt, Human
cuuccccaguuguccccuggaguuuggcggggacauccccgccucaggcauccuucucaaggggaag

SEQ ID NO: 4774 - RNA, 101 nt, Human
cuuccuauaaaaguuuagcucucucuuuuugaaggaaauuucugggcaaacaacauuuugagaaagaaauucagauaugggaaaguaaagaucauggggag

SEQ ID NO: 4775 - RNA, 100 nt, Human
cuuccuauaaaaguuugcucucucuuuuugaaggaaauuucugggcaaacaacauuuugagaaagaaauucagauaugggaaaguaaagaucauggggag

SEQ ID NO: 4776 - RNA, 100 nt, Human
cuuccuaucaaaguuugcucucucuuugugaaggaaauuucugggcaaacaacauuuugagaaagaaauucagauaugggaaaguaaagaucauggggag

SEQ ID NO: 4777 - RNA, 65 nt, Human
cuuccucgaggaggacggggauggccucccuguuggggugguccuuguggccuuccuugaggagg

SEQ ID NO: 4778 - RNA, 101 nt, Human
cuuccucugugggguaccauccucaaucucgguggggauuugcagguuuucuguggcccuuaaucccccuggguucuuuggaaugguccccaggauggaag

SEQ ID NO: 4779 - RNA, 70 nt, Human
cuuccugggcaucguggcugaggugcuggugcuggucaccaucaucuucaucuacgagaagcgccggaag

SEQ ID NO: 4780 - RNA, 73 nt, Human
cuuccugggccauuguggcuggaggugcuggugcuggucaccaucaucuucaucuacgagaagcgccgggaag

SEQ ID NO: 4781 - RNA, 63 nt, Human
cuuccuuugguuucugccggccucgggcuucugcggcccgauguggcaggcgccgcgagagag

SEQ ID NO: 4782 - RNA, 70 nt, Human
cuucgccugccucucugcccuuguccucaucaccgaccggcaugggcugcaggagccgcggcggguggag

SEQ ID NO: 4783 - RNA, 76 nt, Human
cuucgugcuggccacccuacagcagauugagccugucaacggacaggugacgguccuggucaugugccacacgagg

SEQ ID NO: 4784 - RNA, 73 nt, Human
cuucuaaaagacuuucuucgaaaccucaaagaaccucuucugaccuuucgccuuaacagagccuuuauggaag

SEQ ID NO: 4785 - RNA, 83 nt, Human
cuucuaccacugugguauauuuucaccaugucucuguauauaaauaacauacuuagauauuugauauaccuuucguguaguag

SEQ ID NO: 4786 - RNA, 86 nt, Human
cuucuaggcaucaaaggcaaaccagauacaacauuaagaugaugggcauuaaaaagaugagguaggggucaaaaugagccuagagg

SEQ ID NO: 4787 - RNA, 67 nt, Human
cuucucccuggaccagcccgguggcacccuggaucugacccugauccgugcccgccuccaggagaag

SEQ ID NO: 4788 - RNA, 105 nt, Human
cuucucccuugucuggagcugccaccgccauuuaaaaguguuggacgcuguuuauucccagcuucucaaccucagugugugugggaaaggccugaaagagagagg

SEQ ID NO: 4789 - RNA, 64 nt, Human
cuucuucagcagcccaagcugucaggaucucuuaaguuuuugggacauuuauaugcugcagaag

SEQ ID NO: 4790 - RNA, 81 nt, Human
cuucuucagugagacgggcgcuggcaagcacgugccccgggcuguguuuguagacuuggaacccacagucauugauagaag

SEQ ID NO: 4791 - RNA, 63 nt, Human
cuucuucugggguucucuaauggggauaacauuaaucaucuccuaagaugacuauaguagagg

SEQ ID NO: 4792 - RNA, 92 nt, Human
cuucuugcaggcaguguuguuccugauugccccagucuaguuuaucgcaagggaauuucuuugcggggcagugagcucccuuuuggcagaag

SEQ ID NO: 4793 - RNA, 87 nt, Human
cuucuugucuuagguccucacacacagcucugcucaguucaaucacccagaaugcaggcugguuggugaggcaaauuuggacagaag

SEQ ID NO: 4794 - RNA, 83 nt, Human
cuugaaacgcuuugucaugcuucuucaguaccauggauuugaaaugaacucauccuugcugugagcauccaggagcccuugag

SEQ ID NO: 4795 - RNA, 85 nt, Human
cuugaaagggcugcaaauuucccauguucuggcauuaaagggauuucaacccuuuggccaaauugggguaccaguaacccccgag

SEQ ID NO: 4796 - RNA, 119 nt, Human
cuugagaaaagacaacuaguauuugaggaaggugugagaaaugagccuaaagagguagaugagacucaaaggaggcugauaaagauaccacagcuacaaguuuuuguuauauucugaag

SEQ ID NO: 4797 - RNA, 86 nt, Human
cuugagagaagaaaaauuucagauuaauugccucaauuugacuagaauaucaaugaaccaggaaaacugaagcaccuucccuaaag

SEQ ID NO: 4798 - RNA, 92 nt, Human
cuugcccaggcuggaguucagugguaugaucacaacucuccuaagccucaaacaccugggaucaagugauccucuggcuucagccucccaag

SEQ ID NO: 4799 - RNA, 94 nt, Human
cuugccugguucccagccuuuaagguuuuuagucuauaaguucaacguuguuggaaaagugcucugauaccugcagaggugggagaaagguggg

SEQ ID NO: 4800 - RNA, 74 nt, Human
cuugcucugucacccaggcuggagugcaguggugccaucuuggcucacugcaaccuccgccuccccaguucaag

SEQ ID NO: 4801 - RNA, 80 nt, Human
cuugcucuugucaccuaggcuggagugcaguggugcgaucucggcucacugcacccuccucuuggguucaagccagcgag

SEQ ID NO: 4802 - RNA, 75 nt, Human
cuugcugcugcuggucgggcacccaagugcgugaggggcuucagccugucccgggguugccugaggcagagcaag

SEQ ID NO: 4803 - RNA, 81 nt, Human
cuuggacuuccccucccagcucguguacggucucccaccucuggagccccauccccgcgcugguggggggauaauucuagg

SEQ ID NO: 4804 - RNA, 77 nt, Human
cuuggagccaggagccugccaugagguuuugagaacagagugcuguuuuagagcuggcagcagcaucucagcccaag

SEQ ID NO: 4805 - RNA, 97 nt, Human
cuuggagggcgaggggcccuuaggggagucacggcuggacccugggacugagccccuggggacuaccaaguggcucugggaucccacugccccugag

SEQ ID NO: 4806 - RNA, 68 nt, Human
cuuggcucuggggugugcugggagggucaccaggucccuuuuccuuccugugcccucugaaagcuaag

SEQ ID NO: 4807 - RNA, 75 nt, Human
cuuggggcuucacuguggcugacaagaguauuauuacuaccuacaccucguacagcacacaaccagaaccuagag

SEQ ID NO: 4808 - RNA, 71 nt, Human
cuugggggcuauuaaagcaaacauuucgacuaaaggggcgaauccucgaauugugcgaucaagcacccgag

SEQ ID NO: 4809 - RNA, 92 nt, Human
cuuguacccugaaaucuucugcugucccaccuugacugccccaaacuuggacugucucagccuugccaggguuauaguaggcaggucacagg

SEQ ID NO: 4810 - RNA, 86 nt, Human
cuuguauauuuuguauuaccucuuuuuuucaagugauuuaaauaguuaaucauuuaaccaaagaagauguguagugccuuaacaag

SEQ ID NO: 4811 - RNA, 88 nt, Human
cuugugggagagauuaucaagcguuugagcagaaaggauuccgccuuguggucugaaauucaugcaagcuuccgaagaucuucucaag

SEQ ID NO: 4812 - RNA, 86 nt, Human
cuuuaaguugugugggguuuuuuggaggggagggaugggcaauuaccagcaaacuccgccucccccaaaccucaccuaacccgaag

SEQ ID NO: 4813 - RNA, 71 nt, Human
cuuuauaaaaugaucuaacuacuuauauuugugcugcaucgcguuacaucuguuuuuauuucacuaugaag

SEQ ID NO: 4814 - RNA, 74 nt, Human
cuuuauuugugcgcugugagggugaaggcaaucuaucaucaacuuuucuuucccugauaugcuccagaauaaag

SEQ ID NO: 4815 - RNA, 80 nt, Human
cuuucagagcuuuggucccuguaaugcccgucuuuccuguguccaggaauaaccuuugcuacuaggcaguccucugaaag

SEQ ID NO: 4816 - RNA, 71 nt, Human
cuuucaggucuccuggccucagugauggaauuaagaugacuucuaucucugaauccaagggugacugaaag

SEQ ID NO: 4817 - RNA, 71 nt, Human
cuuucccucuccuuuauaaauugcauauauuuuuaacauauauuaacacuuuaaaaccgugggguggaaag

SEQ ID NO: 4818 - RNA, 130 nt, Human
cuuuccucccacuucccucugugcccgucuuaucuguauuuuacugucugcucuuucugacugcuuguaaugagaagacaagugauuuucuugaaaugccugaggcuagaaagggagcuggaacuuaaag

SEQ ID NO: 4819 - RNA, 130 nt, Human
cuuucugugccacucaggaagcaaugggcaugauucagcagaggagaggagaguuuagaacugguuaugcuuccuucuccaacccucccugcaaaaacacuggccagcuccugacaucacaguaagacag

SEQ ID NO: 4820 - RNA, 66 nt, Human
cuuugggaggccaaggcagguggauugccugagcucaggaguucgauacuagccugggcaacagag

SEQ ID NO: 4821 - RNA, 64 nt, Human
cuuuguaagaugcaaagagguuggaucaaguuuaaaugacugugcugccccuuucacaucaaag

SEQ ID NO: 4822 - RNA, 73 nt, Human
cuuuguggcugagaacuuacaaggguucuuagugaagguguucaagcaggaaccugaggaaucagacccaaag

SEQ ID NO: 4823 - RNA, 77 nt, Human
cuuuuaaugggaucggcaugagcaaaagcucccucagaguuacgaccgaguuaaauaucagagaguccacgugaaag

SEQ ID NO: 4824 - RNA, 75 nt, Human
cuuuuacuuuuuaaaaaaucauaaaacggucuguaucugagaagauacuaauaucaaugcuuuaaaaagugagag

SEQ ID NO: 4825 - RNA, 75 nt, Human
cuuuuccgacuuccuuccauccgaguagagugacccugggccggucacucagcgggggacacaggaagggcugag

SEQ ID NO: 4826 - RNA, 77 nt, Human
cuuuucgacugcaggaucaucagguucggaugagucucauguggcugcugcaccuccagauauaugcucucgaacag

SEQ ID NO: 4827 - RNA, 77 nt, Human
cuuuucucaccgaagugaucuggaaugugcuaccguauaugcaaggaagacagguuacaagaucaaggugaaggcag

SEQ ID NO: 4828 - RNA, 64 nt, Human
cuuuucuggggauucaucaucuaugacacacacucacugaugcauaaacuggucaccugaagag

SEQ ID NO: 4829 - RNA, 89 nt, Human
cuuuugcauuuuuaguagagaugggguuucaccauguuggccaggccucuacugcagcaacugggaaugugccaucuuuacugcaacag

SEQ ID NO: 4830 - RNA, 85 nt, Human
cuuuuggaaggugacuuuaucaccuuaaugcauauuccccucuccauagaggagaggaaaagguguaggccugccuuaccgagag

SEQ ID NO: 4831 - RNA, 70 nt, Human
cuuuuggcagagcucccacuauuugcaauggauuuuggauaaacaagaucuguuggaggagcgccaaaag

SEQ ID NO: 4832 - RNA, 114 nt, Human
cuuuuuuggagcuugugcuucuggguuuggggagaugguggaggaccuggaagcacaaaucuuccucuucuaaauacuuccuaacuucagagagcaccagaagacacaagaaag

SEQ ID NO: 4833 - RNA, 85 nt, Human
gaaaaauaucauucacuucuucuuggugcagaaggcauagaccggauuaugcaaucacugagaaguagcuucuggauguguuuuc

SEQ ID NO: 4834 - RNA, 101 nt, Human
gaaaaaugucaagacccuauaaaacugauuuguguucagaauuuucaaaaacaucuuguucucuucccuucacuaaaugucaguauucuugacuccuuuuc

SEQ ID NO: 4835 - RNA, 75 nt, Human
gaaaagcacuuuuacacauauucacauuugaccucacugcccaaagauggccaaauccacuuguguauggguuuc

SEQ ID NO: 4836 - RNA, 60 nt, Human
gaaaagguggugucauguuuuggggagaaucuuacuucucaaauggaaauugcacuuuuu

SEQ ID NO: 4837 - RNA, 76 nt, Human
gaaaauauaagaacauucuagaagguugugagacauaagguacaaaaaccuucuagcauaauuucaaaaaauuuuc

SEQ ID NO: 4838 - RNA, 102 nt, Human
gaaacagacugggccaauguccacaaagaauuccuggucagcaccaccgauguccuaaggugcaauaucaaggaagggcaggcgugauggcuuauuuguuuc

SEQ ID NO: 4839 - RNA, 90 nt, Human
gaaacauagucuugcugucacccaggcuggagugcaguggcgcaaucucugcucacugcaaccucuggguucaagcaauucucaugccuc

SEQ ID NO: 4840 - RNA, 76 nt, Human
gaaaccaagacuacuaugugccacucauuucucucuucuauugggaauuguaaauguauauaggaguguguguuuc

SEQ ID NO: 4841 - RNA, 74 nt, Human
gaaacccuauaaauguccuaucugugagaaaaguuucauucagagaucaaacuuuaauagacaucagaggguuc

SEQ ID NO: 4842 - RNA, 60 nt, Human
gaaaccuacuuugaaguuauccccacuauuauuauggggguuaaggagcuaguagauuuc

SEQ ID NO: 4843 - RNA, 98 nt, Human
gaaagagguuuaauugacucacaguucugcauggcugaggagccugccccaggaaacuuacagucaugacagaaguggaagcaaacacauccuucuuc

SEQ ID NO: 4844 - RNA, 71 nt, Human
gaaaggugcuucauggagaggugauuguagaaaaggaugauuaaaugaucucugcaaacaaggugcuuuuu

SEQ ID NO: 4845 - RNA, 120 nt, Human
gaaagucuacagucugugaauauaccaauuccccuuuacaacugaugcagaucauuaugaaauacuggaaggcauaaccuacaauuuaggaauugguguggcugccacuguuacgcucuc

SEQ ID NO: 4846 - RNA, 99 nt, Human
gaaauggagucuugcuuugucaccgaggcuggagugcaguggcaugaucucugcucacugcaagcuccaccucccggguucacgccauucuccugccuc

SEQ ID NO: 4847 - RNA, 116 nt, Human
gaaauguggagaauuaaaaaggguagugaggcuggcauuuauagaaucuggcuuucuuguauuggguggaaagcuagaugaaaccaguuucucucagccuuuucucuccucagguc

SEQ ID NO: 4848 - RNA, 62 nt, Human
gaacaaacguccuuuucauuuugguuuagaaauagaaacgugguaaaaggaggcgacuguuu

SEQ ID NO: 4849 - RNA, 83 nt, Human
gaaccaucccauccauucacuguucagcuguacugugauuuaguuuuuacaccguuaaaacccugaguggauggcugugguuu

SEQ ID NO: 4850 - RNA, 61 nt, Human
gaacccaggcaaggcguaguucgagggagcccuggggguuccauucggcccuccuggguuu

SEQ ID NO: 4851 - RNA, 90 nt, Human
gaacgaccugaaccucugucuucgaccaacugaagcaacuugggauuaauugcuugauuagcuucacgaagcacagagauaaggucgcuc

SEQ ID NO: 4852 - RNA, 87 nt, Human
gaacuccaggccucaagugaaccucccgccuuugccucccaaaguguugggauuauagguaugagucuccuugccuggccuagauuc

SEQ ID NO: 4853 - RNA, 79 nt, Human
gaacuccaucuuggucauguggccaaaauuuggaaucucccugaguccucucucucgucauaacccugagauggagauc

SEQ ID NO: 4854 - RNA, 72 nt, Human
gaacugaagcuggggcugcagcuguggccuugguuugauccuuggccuuggcucuggccuuggcucuggcuc

SEQ ID NO: 4855 - RNA, 82 nt, Human
gaacuugaagaauugaaacaaauuguucccaaagaaucccucguuuacuucuuaauaggaaagguuuacaagaaguuagguc

SEQ ID NO: 4856 - RNA, 88 nt, Human
gaacuugaguguauucgagagaucaaagagagaguaggcacgucaaaaguuuagguuuuacucagugguggaguagacucaacaguuu

SEQ ID NO: 4857 - RNA, 73 nt, Human
gaagaaaggaccccaggucagagacuggagccauuacuucaagaucaucgaggaccugagggcucagaucuuc

SEQ ID NO: 4858 - RNA, 76 nt, Human
gaagaagaagaauggguuuggugagaggguuccaauauuaacaacccaacuucaagcucauuccucuaaccucuuc

SEQ ID NO: 4859 - RNA, 131 nt, Human
gaagaaguagauugggcugcaaucacacaaugggugcaucaccagugcggacaccuaggcguacagggaaccauggcuuggggaguguaaagaaggauguuaccccaggaugcaguucagacaauuuuauc

SEQ ID NO: 4860 - RNA, 73 nt, Human
gaagaaugaguuuacaguauggauagcuccuccuagauuucaaggggaguaaauuccccccucucauuuuguc

SEQ ID NO: 4861 - RNA, 67 nt, Human
gaagaauguggaucaguuuugauggaacuuggaguacguuuucaucgacuuaucuaugagcaucuuc

SEQ ID NO: 4862 - RNA, 68 nt, Human
gaagacucucugccuccgccaaaauuuaauuaaaugcauugagaaucuggaggagcuacagagucuuc

SEQ ID NO: 4863 - RNA, 68 nt, Human
gaagacucuguagcuccuccagauucucaaugcauuuaauuaaauuuuggcggaggcagagagucuuc

SEQ ID NO: 4864 - RNA, 78 nt, Human
gaagacucuucaguggccuugcagaaccuuucuuagacugcauggcagucugggauguucuaccauaccgcugucuuu

SEQ ID NO: 4865 - RNA, 85 nt, Human
gaagacugguuugugaauaugacaaugaaaucuguguguaucagauuuuuauugaagcauucaucagcagccucaaccaguuuuc

SEQ ID NO: 4866 - RNA, 65 nt, Human
gaagagccuaaacaugguguucaauagucuacuaugaauuaaacaaucguguggagaagcuuuuc

SEQ ID NO: 4867 - RNA, 86 nt, Human
gaagaggaacacuucagugaggaccaguacuugguugcagucaggaaaaauucacaaagucaguucucgaucaagguuaccucuuc

SEQ ID NO: 4868 - RNA, 67 nt, Human
gaagaggcagaccagcuuuauuuuugaacccaaucacugggugcccaacuaugacucugcuaucuuc

SEQ ID NO: 4869 - RNA, 130 nt, Human
gaagaggccuuuacuccuguuuucuuccauucucaccccucuguuucugccagaauugugacagcagggcagaaaaugggcuuuucgugcagaguugacaagauacaggguagugaagacaagaaucuuc

SEQ ID NO: 4870 - RNA, 61 nt, Human
gaagcaaauucagaucacucagcucuucgggguucccgucgugguggcucugaaugucuuc

SEQ ID NO: 4871 - RNA, 85 nt, Human
gaagcaagauuuacuagggacaucuggauagcccaggacaaugacuucugggaacaggaagcucccuagggccagaucgugcugc

SEQ ID NO: 4872 - RNA, 74 nt, Human
gaagcacaauugauugugauaccuagagcagcaucaucauugauauguauaucaccuucagacuuuuguguuuu

SEQ ID NO: 4873 - RNA, 72 nt, Human
gaagcacauuuaaagcacuuuucuguaaaagcuaguuccuuaccugcuuggaaaucuuuuuguuuguucuuc

SEQ ID NO: 4874 - RNA, 90 nt, Human
gaagccaaacugcaggccucugcccuccccuaaauguccuccuaggaugcagucacucgggaggaagaugugccuguuaccaagugcuuc

SEQ ID NO: 4875 - RNA, 74 nt, Human
gaagcccgaggcugcuccuguggaaguggcucugggcaccagccuguggggcuaaagacuugacagcuagcuuc

SEQ ID NO: 4876 - RNA, 68 nt, Human
gaagccuuugaccaggcagggucaggcugaccugguucuuggucaucuccuccugggauugggcuauc

SEQ ID NO: 4877 - RNA, 80 nt, Human
gaagcguaauauuuugguaaaauucggguuaaauuuuuguaaaucagcucaauuuuuaaccaauaggccgaaaucgcuuc

SEQ ID NO: 4878 - RNA, 66 nt, Human
gaagcucugagacaugugagaaggucuaguauucuacuagaacuggaagauugcucuccgaguuuc

SEQ ID NO: 4879 - RNA, 75 nt, Human
gaagcuuuggggaauuaaguucuuuucaaaucuuggaagucaauauucacuugaaggaauucuauccggggcuuu

SEQ ID NO: 4880 - RNA, 72 nt, Human
gaaggcccacugcacgggcgggugcuugugaaauuucuccaggggcaccugcagccccggcgcugggcuuuc

SEQ ID NO: 4881 - RNA, 71 nt, Human
gaaggccuguguuguuaaucuuuaucugugagaggaucucugugagauacgauaugauaaacaggcacuuu

SEQ ID NO: 4882 - RNA, 74 nt, Human
gaaggcgucaucgagaguaacuggaauggagauuguugacagcuuugaugacaugaaccucucggagucccuuc

SEQ ID NO: 4883 - RNA, 67 nt, Human
gaaggcuucgucugccaaacagagacucaagugugccagucuccaaaaauuuggagaaagagcuuuc

SEQ ID NO: 4884 - RNA, 77 nt, Human
gaaggguaccugcuggagaccugugugguuugugggguggguuucuuauaucacugaaucuaaagugggugccuuuc

SEQ ID NO: 4885 - RNA, 74 nt, Human
gaagguauuuguuuuucggucuuugaggaagaaccacaccguuuuccacaacgguugaacuaauuuccacuuuc

SEQ ID NO: 4886 - RNA, 106 nt, Human
gaaggucccacaaaaagcuauucuuuggggcuuauuugcaaagcaggggaacccaugaauuaugcaaaucgagguccaaggaggcguuguuggcuuguccaccuuc

SEQ ID NO: 4887 - RNA, 62 nt, Human
gaaggugcugacuuccuugggagaugccauaaagcaccugggaugaucucaagggcaccuuu

SEQ ID NO: 4888 - RNA, 63 nt, Human
gaaggugcugacuuccuugggagaugccauaaagcaccugggaugaucucaaggggcaccuuu

SEQ ID NO: 4889 - RNA, 112 nt, Human
gaaguacuucacccuggggcuccccacugggaguaccccacuuggcugcuacaagaagcugauugaauacuauaagaauggggaccuguccuuuaaauaugugaagaccuuc

SEQ ID NO: 4890 - RNA, 64 nt, Human
gaaguccugguguacaauaauacauccauuguucaggaugagaucugcucaccgucuggggcuc

SEQ ID NO: 4891 - RNA, 64 nt, Human
gaagucuccuauuugaucagguuauuuccugggacuuggcaaaaaucugauugguggggaucuc

SEQ ID NO: 4892 - RNA, 60 nt, Human
gaagugguaaagccuggggcuucagugaaguuguccugcaaggcuucuggcuacaucuuc

SEQ ID NO: 4893 - RNA, 72 nt, Human
gaaguuccaggcuguagugcacuaugaugaucguacguaugaacagccauugcacuccagccugggcaauuc

SEQ ID NO: 4894 - RNA, 78 nt, Human
gaauauuuccacaaugucugugaacuggaccugguguucaacuucuacaagguuuacacggucguggacgagauguuc

SEQ ID NO: 4895 - RNA, 64 nt, Human
gaaucacgugauguuucccaggcacuguggucccacaaaaucauaagugucuucacagucuuuc

SEQ ID NO: 4896 - RNA, 72 nt, Human
gaauccuucacuccaguuaauggcacugcucacuuccugccucugcugccaccaucacugugugaagcuuuc

SEQ ID NO: 4897 - RNA, 69 nt, Human
gaaucucauuaauccauucaugcgcgucacuaauuagaugacgaggcauuuggcuaccuuaagagaguc

SEQ ID NO: 4898 - RNA, 103 nt, Human
gaaugcaucuauacuugaaacuaaauuaaaaucuuuugcuuuuaguuuguguaagccaaugaauuacugguguuucuuagguuaguuucaaguauuggcauuc

SEQ ID NO: 4899 - RNA, 90 nt, Human
gaaugucucaaagaaaauguccuugauuuaauuaugguccaagguggcugcuuugcacaagcuugucagugacaugaacuugaagacuuc

SEQ ID NO: 4900 - RNA, 101 nt, Human
gaauguggcuucauccuccggccccaugcgcugguggcagucacagaaugaugugaacccugucucucugcagcuggaccuggacaggagauuccagcuuc

SEQ ID NO: 4901 - RNA, 91 nt, Human
gaauucagaauauuguauugaugaugguuauucuuuuauauaauuacaauaauuauccaggaaaauagcaaacagaugcagugcugaauuc

SEQ ID NO: 4902 - RNA, 72 nt, Human
gaauuccugaggcccgagccacacccuaaaccaauuucaucagaaucucugggugggacggagccuggauuc

SEQ ID NO: 4903 - RNA, 70 nt, Human
gaauucuacaagagccucacuaaugacugggaagaccacuuggcagucaagcacuuuucuguagaagguc

SEQ ID NO: 4904 - RNA, 79 nt, Human
gaauugcuuuuauuucgguaugcauccacauuucagcauuuagugguccugaacagcaaguggaaagacgcagcaauuu

SEQ ID NO: 4905 - RNA, 86 nt, Human
gacaaaggauaauggggacguuugacaggacugcauucagauggugacugacauccagacugcuguacggaccaauccacuuuguc

SEQ ID NO: 4906 - RNA, 96 nt, Human
gacaaaugccuucagcuucucugaguccuccuucuuccggucuucagccaaugaggaugaagccaaagcagagaccauccggagcuugaggaaguc

SEQ ID NO: 4907 - RNA, 73 nt, Human
gacaaccugccacucuaugagcuuaagaacaccaucacagugucccccuucucgggcgagagugacaucuguc

SEQ ID NO: 4908 - RNA, 75 nt, Human
gacaagaagcucucucucagacaaccaucucaugggccccauuccaggacacuucugaguacaucauuucauguc

SEQ ID NO: 4909 - RNA, 80 nt, Human
gacaaucucauaacaggaagauuugaacauagcagcugcuuaccauuucaugcuaauuaaaugugauuuccaucauuguc

SEQ ID NO: 4910 - RNA, 83 nt, Human
gacaauuaaggacgugggaugaggcuccgagacaggacgcgguucugccuggggauccugaagauaaaaagcuuugaaaaguc

SEQ ID NO: 4911 - RNA, 72 nt, Human
gacacaaagaugaaaagcuuggccacaaaggagcugacggugccguggcgagagagauccaucuugacgguc

SEQ ID NO: 4912 - RNA, 96 nt, Human
gacacuggcaacauugcggacacccuccaggaagcgagaaugcagaguuuccucugugauaucaagcacuucaggguuguagaugcugccauuguc

SEQ ID NO: 4913 - RNA, 70 nt, Human
gacacuuuaugggggcagaauggaacaagcuccaagaauguagauacugauucuuucuccauaaaguguu

SEQ ID NO: 4914 - RNA, 73 nt, Human
gacagaacucugcuuccagcgcugugugccagcuugcaccaccgagcucuggacgcugaggaggaggccuguc

SEQ ID NO: 4915 - RNA, 78 nt, Human
gacagauggacuaaaaggauuuuauaggggcaugucugcuucauaugcugguauaucagagacuguuauccauuuguu

SEQ ID NO: 4916 - RNA, 67 nt, Human
gacagcuucuauuugggucccaccucuccaagaacgaaacaguucaugggauaggaucagaaagcuc

SEQ ID NO: 4917 - RNA, 84 nt, Human
gacauaguuucagacgccaguauaagccuuugagucucaauagacugcaguaucuuauugauuugggucguguugauccuaguc

SEQ ID NO: 4918 - RNA, 79 nt, Human
gacaucaucauugcagcuggacgacgugguuagcaguacugugacugggccacguguggacggaggccauguacagguc

SEQ ID NO: 4919 - RNA, 77 nt, Human
gacauccaauuuuguucaggucccuuuuaauggcacuuaauaaauauacauucugagaccuggcagaacaggcuguc

SEQ ID NO: 4920 - RNA, 60 nt, Human
gacaucuuuuucugaccuguaugaugacaguccgggcaaccuaaguccaugagggauguc

SEQ ID NO: 4921 - RNA, 128 nt, Human
gacaugaguuugugauggcacaauaugugaaugaauuucaggguaaugaugcaccuguugaacaagaaauuaacagugcagaaacuuacuuuugaaagugccagaguagagugugauacaaacauguc

SEQ ID NO: 4922 - RNA, 67 nt, Human
gacauguacuauacauaguaaggcguccuaugcaucuacgugcauaauagcguguauagugcaucuc

SEQ ID NO: 4923 - RNA, 84 nt, Human
gacaugucaaggcaggagccaucugaucgaccuuagacuuggcaagcugguggcuaaguccagugcucacugccgacaucuguc

SEQ ID NO: 4924 - RNA, 126 nt, Human
gacauuaauaaugaggcaaauggcauuaaaauuggcccucagcaugcugcuaccaaugcaacacaugcaggcaaucagggaggacagcaggcuggggcggcugcuguugagucuguuuuuacuguc

SEQ ID NO: 4925 - RNA, 127 nt, Human
gacauuaauaaugaggcaaauggcauuaaaauuggcccucagcaugcugcuaccaaugcaacacaugcaggcaaucagggaggacagcaggcugggggcggcugcuguugagucuguuuuuacuguc

SEQ ID NO: 4926 - RNA, 60 nt, Human
gacauucugccagguuuucuugggcaaugacaccaagaaguugacagccaggugaauguu

SEQ ID NO: 4927 - RNA, 60 nt, Human
gacauugugccucgauaguggcagcuuucaauugcaaucaaugcccuucgagaauguguc

SEQ ID NO: 4928 - RNA, 86 nt, Human
gaccagcgacauuuuugggucuccggucacugccacuucacgcuuggcacacccaaacaaacccaagucaagguccucggcugguu

SEQ ID NO: 4929 - RNA, 97 nt, Human
gaccaugaagccagagucuccaggacuccucacucaaccucggccauggacgcagguugggugugaggggggucccagccuuucggucuucuauuuc

SEQ ID NO: 4930 - RNA, 78 nt, Human
gacccacucuugugcuaacuagccccuucucugaauaacccauuaaucugagaauggcucaagcacuuccuaaagguc

SEQ ID NO: 4931 - RNA, 96 nt, Human
gacccgggguggggugcacucgccauuuccucacgugcaggacagcucuugauuuggguggaaaacagggugcuaaagccaaccagccuuuggguc

SEQ ID NO: 4932 - RNA, 60 nt, Human
gaccugcgggacaagauucuuggugccaccauugagaacuccaggauuguccugcagauc

SEQ ID NO: 4933 - RNA, 76 nt, Human
gaccuggguucuccccgagcccugaaguggaguaaagauguuuggcccaagaagggcuggggugcaaagccagguc

SEQ ID NO: 4934 - RNA, 85 nt, Human
gaccuguucuguuuuaucuucugucagcuccucuggugcuaugccugugguacugauugagcuaaagaagaaaagagaggagguu

SEQ ID NO: 4935 - RNA, 61 nt, Human
gaccuuaugugguucauuccuucaaucauuucaaacauugaaaguagggccuacauggguc

SEQ ID NO: 4936 - RNA, 87 nt, Human
gaccuuugugaguuccagugguguccuuggcacucagagguucagcugaagucccgacuggugaggacaaguggagccacaaggguc

SEQ ID NO: 4937 - RNA, 67 nt, Human
gaccuuuguuccuuaaagcaauaacugacaauucuuuguaguucucuguggggaguaacaagggcuc

SEQ ID NO: 4938 - RNA, 80 nt, Human
gacgagacuuaauaugguauuuguagcacaauacaucacacagguaaaugugcuccaggaagccucacuagucacucguc

SEQ ID NO: 4939 - RNA, 100 nt, Human
gacgagagcccugaaggcagcgcugccgacgaccucuacagcaugcucgaggaggagaggcagcagaggcaugagcagcgacccgcggcggggcggcguc

SEQ ID NO: 4940 - RNA, 76 nt, Human
gacgcugccagcucgggacucuguuccaccgugguggucugccccuacagugcugcaggcugagcugacauuuguc

SEQ ID NO: 4941 - RNA, 85 nt, Human
gacgggacacaucuggcuauuuugucccagcggucagaggauccccuuggguacugcugcaacgccaguuccagaaguuucuguu

SEQ ID NO: 4942 - RNA, 75 nt, Human
gacggucacacggaagcucacacggacagucacacgcucacacggacggucacagggaugcucacacggacgguc

SEQ ID NO: 4943 - RNA, 74 nt, Human
gacuacaccugcuuuguguuuagugacguggaccucauuccaaugaaugaccauaaugcguacagguguuuuuc

SEQ ID NO: 4944 - RNA, 86 nt, Human
gacucaaugugcaacugacaucugcuagugaugaucugguaauauacaaccuguccaguagccgaacaguuuguuuuuauuguguu

SEQ ID NO: 4945 - RNA, 80 nt, Human
gacuccaccuucucccuggaccagcccgguggcacccuggaucugacccugauccgugcccgccuccaggagaaguuguc

SEQ ID NO: 4946 - RNA, 78 nt, Human
gacucccagccaaauccauccugcucuuccauuucuuccacgauggugcaguguaacgaugcacuuuggaagggaguu

SEQ ID NO: 4947 - RNA, 72 nt, Human
gacuccugccccagccccauccucagcuuccaccuaagaaguagugcaggaaaguggugauaagcagauguc

SEQ ID NO: 4948 - RNA, 61 nt, Human
gacucuucagggaaaaggucagugaaguuuaacaagggcuauacugcucuuagccagaguc

SEQ ID NO: 4949 - RNA, 95 nt, Human
gacugaguuuugcccuguugccuaggcuggagugcaauggcaugaucucggcucacugcaaccucugccuccuggguucaagugauucuccuguc

SEQ ID NO: 4950 - RNA, 78 nt, Human
gacugauacagucuguaagaucucuucgagagagcuguccaauuacagaucuauauacuuuucuucagaaggucaguc

SEQ ID NO: 4951 - RNA, 64 nt, Human
gacugguuugucuacagguaacaugcccaaguacugcacguggaacuucuggaccagcucaguc

SEQ ID NO: 4952 - RNA, 92 nt, Human
gacuguccgucaagcaggcagcggggauguagcucucucugcccugggcaagaauagcacuucccguuaaaagccagcagccggcgucaguc

SEQ ID NO: 4953 - RNA, 73 nt, Human
gacugugaggagggugcuaucgaggaaaucagcuugaaccacagucgcuguaccucugcaccccuggaaaguc

SEQ ID NO: 4954 - RNA, 93 nt, Human
gacuuacauaaugaaaaccaauucauuuuaaauaucagauuauuauuuuguaaguuguggaaaaagcuaauuguaguuuucauuaugaagguu

SEQ ID NO: 4955 - RNA, 69 nt, Human
gacuucccgauggaugcgcacgcuugcccucugaaauuuggcagcuaugcguacccuaauucugaaguc

SEQ ID NO: 4956 - RNA, 78 nt, Human
gacuuccucaugaagagacuccagaaagggguauggggcauagucucuuacccucuuucuuuggagcuaaaggagguu

SEQ ID NO: 4957 - RNA, 64 nt, Human
gacuuguguuugaaucccaguuccaucacuuccugcugugagaucuugggcaaaucacuuaguc

SEQ ID NO: 4958 - RNA, 83 nt, Human
gacuuuuguugaaaaauuugaccuuuaccucuuaugaacgaaagaaauauagagguuucaagcauuuuugccagcacagaguc

SEQ ID NO: 4959 - RNA, 77 nt, Human
gagaaacggaaacuuuuuccaaaguggcugcaucauuuuucauucccaccagccauguaugaggguuuccaguucuc

SEQ ID NO: 4960 - RNA, 74 nt, Human
gagaaagggucuggcuauguugccuagguuggucucaaacuccuggccucaaguaaucugccagucucagucuc

SEQ ID NO: 4961 - RNA, 87 nt, Human
gagaaauacagguagauaugcugguuuaccuauuuguauagucaauuccuguuuauuaugaaacagcguuaucucuuuguguaucuu

SEQ ID NO: 4962 - RNA, 79 nt, Human
gagaacugggauggaggagaauuagaggauggugugguguuucccaagacauccccugaucuugcuaucccagcaucuc

SEQ ID NO: 4963 - RNA, 72 nt, Human
gagaagcagguagcucaguauugcugaugagaguggcuguuccaagcaucaguaggccuggaaucucuucuc

SEQ ID NO: 4964 - RNA, 77 nt, Human
gagaagggaggcugcagugagccaagaucgugccauugcauucaaggccugggugacaagaagcagaauuccaucuc

SEQ ID NO: 4965 - RNA, 86 nt, Human
gagaagggggccacggcuucucacaggguggggcgggccugguguacccuccccgaaagcacuggagaagggggccacggcuucuc

SEQ ID NO: 4966 - RNA, 86 nt, Human
gagaaucacuugaacccaggagguggagguugcagugagccaagaucgugccauugcacuccagccuggguaacagagugggacuc

SEQ ID NO: 4967 - RNA, 69 nt, Human
gagaaugggggaggugugugacagccaugcuggacucagaagcaggugucauaaacugccccagcucuu

SEQ ID NO: 4968 - RNA, 86 nt, Human
gagaauugcuugaacccaggagguggagguugcagugagccgagaucacgcuacugcacuccagccugggugacagagugagacuc

SEQ ID NO: 4969 - RNA, 99 nt, Human
gagacaggagaaucacuugaaccggggagguggaggcugcaaugagccaagaucacgccacugcacuccaaccugggcaacagagugagacuucgucuc

SEQ ID NO: 4970 - RNA, 82 nt, Human
gagacaguuucacuuuuguugcccaggcuggagugcaguggcgcggucucagcucaccgcaacaagagcgaaacuccaucuc

SEQ ID NO: 4971 - RNA, 99 nt, Human
gagacggggaauccucagggccuauuaccaggagaggaaucgagccaugguccuccuuacuccucuucagcuggugaauccuccggaucuccuuuccuc

SEQ ID NO: 4972 - RNA, 76 nt, Human
gagacucuaugucugcccguccaucagugaacucauuaaaacuugugcaguguugcuggagcuggccuggugucuc

SEQ ID NO: 4973 - RNA, 64 nt, Human
gagagaaaaggggaggaugccacuggagucauccucuucaaugccacuauccuucccaucucuc

SEQ ID NO: 4974 - RNA, 87 nt, Human
gagagaacuguugcgugcuugagucugugagccagugucugccuuuuuagaagcagccucauggucucaugcuuaaucuugucucuc

SEQ ID NO: 4975 - RNA, 63 nt, Human
gagagacacucagaauggacgaucuaaaguuccuuccagcuuccaaauucugggcugguuuuc

SEQ ID NO: 4976 - RNA, 91 nt, Human
gagagagaagaaagagaagugaaacgacaguugguggcuuggugggauaggaagcugaaaccaaugguuaagucaaaguuuuguuuuccuu

SEQ ID NO: 4977 - RNA, 67 nt, Human
gagagcauuagacccaagaccauuguggagaagauugacuugacaguguguccagcauaaugcucuc

SEQ ID NO: 4978 - RNA, 61 nt, Human
gagagccucugucguggggagggugucaaacugacaacccguuaggacagaagaggcuuuu

SEQ ID NO: 4979 - RNA, 71 nt, Human
gagagcuucagcuugcauauccuugggcagaaaacccugcuggauuccaguaagcucuuuauugaacucuu

SEQ ID NO: 4980 - RNA, 101 nt, Human
gagaggaaaagucacuugcccaaagucacacagcugaacagugguggaguucaacuuugaccgugggcugucuggccccaagguguaugcuugcuucucuc

SEQ ID NO: 4981 - RNA, 97 nt, Human
gagaggagaaucgcuugaaccugggaguuggagguuacagugagccgagauugcgccacugcauuccagccugggugacagagcgagacuccgucuc

SEQ ID NO: 4982 - RNA, 100 nt, Human
gagaggauguuaucccccauagccagaaaccaggguggcuuccaaaagaaaaggguagcauucggugacucugcuuuaggccuugaggaugaaucuuuuc

SEQ ID NO: 4983 - RNA, 91 nt, Human
gagaggcaccacucacaggcaggcccggcugcacaaguccucccugcugggccuggucacugcagcugccccucccuggcuggcuccucuc

SEQ ID NO: 4984 - RNA, 68 nt, Human
gagaggcguggaguauaaccuauauauaagugugguauaaaacuuauagaguucuccgagugcuuuuc

SEQ ID NO: 4985 - RNA, 81 nt, Human
gagagggcuugccuuuggugcuuccuuaaucccuuuacuuucuuaaacuugaaacagggguuggggaggcagagcuagcuc

SEQ ID NO: 4986 - RNA, 61 nt, Human
gagagucugguauuacacuggaggaucacaaacuguauuuucuuguuauaaauggcuccuc

SEQ ID NO: 4987 - RNA, 78 nt, Human
gagaguugcuugagcccaggaggcggagguuguagucagccagccacuguacucuagccugggcaacagagcucucuc

SEQ ID NO: 4988 - RNA, 72 nt, Human
gagauaggagaagagagagaucgcugucucgggagagaaaucacaagccgucccgauccuucucuaggucuc

SEQ ID NO: 4989 - RNA, 79 nt, Human
gagauauguaaauacgcuguuggggugagagauuuuaagaaaacugucucugcuauugacagauccuggacauaaaauc

SEQ ID NO: 4990 - RNA, 72 nt, Human
gagaugaaauguuuuacuucugacugugggacuaauguguuccuacagguugcaacauaaaacggauuucuc

SEQ ID NO: 4991 - RNA, 69 nt, Human
gagaugcagcagaaguugguggagcugucggcugagaacgagaagcugcaccagcgcguggagcagcuc

SEQ ID NO: 4992 - RNA, 60 nt, Human
gagauggagcgagucagaaccagcauggaguguuacugcugauuucugucccugcaucuc

SEQ ID NO: 4993 - RNA, 85 nt, Human
gagauggugccuuggacacccuugccuggaacucguuagcaacugcgagcagaagcuuuccagucacacaucaaggcgcuugauc

SEQ ID NO: 4994 - RNA, 72 nt, Human
gagcaagcacgcaagaaauccucguugugguuucauguuuuugagcuuuagcaggauucuaaagagcugcuc

SEQ ID NO: 4995 - RNA, 109 nt, Human
gagcaaggacaaguugugaccuucccaguccucucuccauuugcagaucagcaagcuucugucagcaaggagggguggacaaugaaacuggguucagcuugauuuguuu

SEQ ID NO: 4996 - RNA, 82 nt, Human
gagcacgcuucccaagcuuggggugggcaauguaggcaagucgaucgagcuugcggcugacacccuuugggaucuugggcuu

SEQ ID NO: 4997 - RNA, 60 nt, Human
gagcagaggcugguuauaaauuugaacucccucagcccauuugcaacucugccucuguuc

SEQ ID NO: 4998 - RNA, 63 nt, Human
gagcagcuacgaggagcagccgaccgugcgcuuccaacaccaggugcugcucguggccugcuc

SEQ ID NO: 4999 - RNA, 68 nt, Human
gagcaggaagaauguacuucugagauucggcagucacucacugacgagccuccccuguaugccugcuc

SEQ ID NO: 5000 - RNA, 70 nt, Human
gagcaggcuucagacacugccuuuaucuuuacagaaagccaugggaagggaaaugucugagguagagcuc

SEQ ID NO: 5001 - RNA, 75 nt, Human
gagcaguugaguggcacagccuggcaccaugaugcagguccuuguaauggaguuaguguccagucagcugagcuc

SEQ ID NO: 5002 - RNA, 64 nt, Human
gagccaagccgccagcgcugcgaugugggccacgcugccgcugcucugcgccggggccuggcuc

SEQ ID NO: 5003 - RNA, 90 nt, Human
gagccagaagauggagaggaggcugcaaacccuuagcugcucuauaaauauaaucauugaggcuugauugucccuugccaucucuugcuu

SEQ ID NO: 5004 - RNA, 102 nt, Human
gagccagcuggaugcgacaguccguggccuucuaucaggcuauauugaugaugcuuuauggcaaauuguagaagucauggguucuuguuucuaaguuggauc

SEQ ID NO: 5005 - RNA, 96 nt, Human
gagccaguaccuuuacauaaagcguuguaauacacagguuagcccagcagggcauucccaugaccucagauguuuaucaggugaagccaguggcuc

SEQ ID NO: 5006 - RNA, 83 nt, Human
gagccggccagcccugacaguccaaaggguuccucgggagacagagaccgagccuccuguggcccuggccccugguccagcuc

SEQ ID NO: 5007 - RNA, 93 nt, Human
gagccggggcuuccucaagagcguggcccaagggccccacagcccgagauccggcagccccagccaccuucacaugaggaggccccgaagcuc

SEQ ID NO: 5008 - RNA, 63 nt, Human
gagccugccucccucuuggccucucauccauuggcucaugcagggcaggggugaggcagguuu

SEQ ID NO: 5009 - RNA, 66 nt, Human
gagccuuauuuuacaucagaugggaaaagaccuugcaggucauucauugucuuacaugcagagcuc

SEQ ID NO: 5010 - RNA, 101 nt, Human
gagccuuuuaaugacacaguggggccaguuggagcacugauccuggucauuacuccugcacccuggccugcagccuuccucucagugucuuauuugggcuu

SEQ ID NO: 5011 - RNA, 77 nt, Human
gagcgcccugggucuuguuuugguguuucgcuuuucuguaaggauuaagcagauagggagaagggaaaaggggccuc

SEQ ID NO: 5012 - RNA, 76 nt, Human
gagcuaacaaacugcuacaaacugaaggaccuuuucaaaaaagcaaacugaaggaccuuuucaaaaaagcaagcuc

SEQ ID NO: 5013 - RNA, 88 nt, Human
gagcucccacggcuuuucuagaaauuggcacacaaacuccaaagcguguguggaaaugcagaugaccugggagacccaaaacaaccuc

SEQ ID NO: 5014 - RNA, 63 nt, Human
gagcugaucgccagcaguguauucuuaauugucuucauuugagcacugguaaacaaucugcuu

SEQ ID NO: 5015 - RNA, 80 nt, Human
gagcugcccaacauccagaaggucgaaguguacccaguagaacugcugcuuguccggacacgaugaucugggcaaaucuc

SEQ ID NO: 5016 - RNA, 67 nt, Human
gagcuggcuccugggcccacagcugugccugggaauaguccaggcugugccugcagaggagcugcuc

SEQ ID NO: 5017 - RNA, 81 nt, Human
gagcuggggagaggaguuccucccuuaaaagccagcaacugccuuuggggaaugucggggggucucuccuuucuccugcuu

SEQ ID NO: 5018 - RNA, 76 nt, Human
gagcuucaucuccauggaagugccugucaugguaguaaauggcaaggaugauaugcaugauguugaagaugagcuu

SEQ ID NO: 5019 - RNA, 89 nt, Human
gaggaacagccgguaaugcccucauggauggagcaucucagcugaugggagaaaacaggaccaugaccauucacaacggcauguucuuc

SEQ ID NO: 5020 - RNA, 70 nt, Human
gaggaagacaccccuucagauaaugauaguggcaucuguaugagcccagaguccuaucuggggucuccuc

SEQ ID NO: 5021 - RNA, 97 nt, Human
gaggaagggagcuggggcuucgaggggaccugcacauucaguccugugcugggugcuggagacucgucccuccccacugcccccucugcccauccuc

SEQ ID NO: 5022 - RNA, 90 nt, Human
gaggaaggucaggguauuaccauaauggucuaggcagagaaaguauacaucuuuaauagggcaagacaauggaguuagacaccuucauuc

SEQ ID NO: 5023 - RNA, 70 nt, Human
gaggagcaaccucuggagccaucgcgauugauuccucccaucccaagauggcuucuggguuccacuccuu

SEQ ID NO: 5024 - RNA, 71 nt, Human
gaggagcccaguggcgccuuuucagugguucuugggaugcuccgcagccaauuaagccgacugaguuccuu

SEQ ID NO: 5025 - RNA, 71 nt, Human
gaggagcgguagcuuuugggaagcaggacguucucaccaggagagcguccucucgagauuucugcucccuc

SEQ ID NO: 5026 - RNA, 80 nt, Human
gaggagguggcggcgcuggagcuccucccggggaccagcgacccggggagcgagcacgucgcuccgcaccgcucuuccuc

SEQ ID NO: 5027 - RNA, 69 nt, Human
gaggagguuggcuuagucaaaugccucuguccacacugacauggcacuuacccaagcaccgaacuccuc

SEQ ID NO: 5028 - RNA, 88 nt, Human
gaggauuuuauuucaagauaaaacauaacuucuacccauacuauugauuccaaagguuagaaaaaguguuuuuccucaucuuauccuu

SEQ ID NO: 5029 - RNA, 99 nt, Human
gaggcaaggacuugcucuguuacccaggcuaaagugcaguggcgcaaucauagcucacugcagccuugaacuccugggcucaagagcucuucccgccuc

SEQ ID NO: 5030 - RNA, 90 nt, Human
gaggcacaaggaacagcugcuggcugcggagcccgugcgcgccaagcuggacaggcagcgccgcgucuuccagcccucgccccuggccuc

SEQ ID NO: 5031 - RNA, 77 nt, Human
gaggcacucacucuagaaauagccuguguuagcugaugugugaaagcguagccggccagccacacuagagaugccuu

SEQ ID NO: 5032 - RNA, 78 nt, Human
gaggcagaaacuguggaagguaaauauauguuaagaaacuaauaguuucuuguuuguagauuccucuggugcugucuc

SEQ ID NO: 5033 - RNA, 76 nt, Human
gaggcagaagccuuccucaagaaagcuguggugcaguccccgcaggucacagaaguccuuuaagaggguuugccuu

SEQ ID NO: 5034 - RNA, 82 nt, Human
gaggcagaguuggagcucacaguaacugccaguugaauccaaauaacaucugauuagucucuuggcuccuagcaaucucuuc

SEQ ID NO: 5035 - RNA, 77 nt, Human
gaggcagcccuggccaccuucggaacuuucccgucgaccaggccccccgggacucccagggcuccagggcccuccuc

SEQ ID NO: 5036 - RNA, 97 nt, Human
gaggcaggagaaucacuugaacucgggagguggagguugcagugagccaagaucacgccacugcacuccagccugggugacagaaugagacuguauc

SEQ ID NO: 5037 - RNA, 99 nt, Human
gaggcaggagaaucauuugaaccugggaaguggagguugcagugagccaagaucgugucacugcacucuagccuaggugauaaagcgagacucagucuc

SEQ ID NO: 5038 - RNA, 98 nt, Human
gaggcaggagaaucgcuugaacccaggaggcggagguguagugagcugagauggcaccacuguacuccagccugggcaacagcaugagacuccgucuc

SEQ ID NO: 5039 - RNA, 100 nt, Human
gaggcaggagaaucgcuugaacccaggaggcggagguuguggugagcgaagaucgugccauugcacuccagccugggcaacaagagcaaaacucugucuc

SEQ ID NO: 5040 - RNA, 100 nt, Human
gaggcaggagaaucguuugaaccugggaggcggagguuguguugagccgagaucucgccauugcacuccagccuaggcaacaagagcgaaacuccaucuc

SEQ ID NO: 5041 - RNA, 100 nt, Human
gaggcaggagaauugcuugaacccaggaaguggaggcuucagugagcugagaacacgccacugcacuccaguccugggcaacagagcaagacucugucuc

SEQ ID NO: 5042 - RNA, 75 nt, Human
gaggcaggaggccccugaaggcaaggcagguagacgguggagaaucugccuccccugccuuuggacccuguccuc

SEQ ID NO: 5043 - RNA, 66 nt, Human
gaggcaggcggaucaugaagucaggagauugagaccauccuggcuaacauggugaaacccugucuc

SEQ ID NO: 5044 - RNA, 74 nt, Human
gaggccacucccuuuaaaaaugcucaaaguguuggagcuacugugugacaacagcugacauuuaggagggcuuu

SEQ ID NO: 5045 - RNA, 77 nt, Human
gaggccagagcaggguggacagguguccaggcuggugaugugcuucggaacgccauucuauccccaaacuuggucuc

SEQ ID NO: 5046 - RNA, 83 nt, Human
gaggccagcgccccguggccaggcagcagcgugugcaugucgccggcugugccacgcguggcugcggaagcguggauggccuc

SEQ ID NO: 5047 - RNA, 75 nt, Human
gaggcccagaggguuggacauacuaggaauucugucauccccaguggcugauccuuuaaccccuucucaggucuc

SEQ ID NO: 5048 - RNA, 110 nt, Human
gaggccccaagaaguuaaauaacuugcuuaagaucacagagcuaaugaguggcagaacaauuauucuagcucugauuuuaagggauuuacuuaacuuuuacuuggaauuc

SEQ ID NO: 5049 - RNA, 73 nt, Human
gaggcgcgauauuuggcauuuuuaauuuagguuuguuuuauuuaaguuuaauguuaauuccaugcuguguuuc

SEQ ID NO: 5050 - RNA, 68 nt, Human
gaggcggguggaucacucaaggucaggcauuugagaccagccuggccaacauugugaaaccccgucuc

SEQ ID NO: 5051 - RNA, 76 nt, Human
gaggcuaggaaaaucagaggcagccccgaucggaagcaggucuccugacuccuaggcagggcugcuucccagccuc

SEQ ID NO: 5052 - RNA, 85 nt, Human
gaggcuggcuguacaaacggagcgcugcugaucgacgaacagagauccuguacaacacucaaggggucguuguaaagccagacuc

SEQ ID NO: 5053 - RNA, 65 nt, Human
gaggcugguggucuugagcuuuuggccuggaauuccagucugaauuuucaaauauucccugccuc

SEQ ID NO: 5054 - RNA, 76 nt, Human
gaggcugugugugugguuuacaagugcugcagaccagggaagccccacuggcacagguguggccucagccggccuc

SEQ ID NO: 5055 - RNA, 62 nt, Human
gagggaaaaggcacugcuuauuccagugcagccagucaugguaaugcagugcaccagcccuc

SEQ ID NO: 5056 - RNA, 72 nt, Human
gagggaaaggaugaauuauuuaauauauucuaaguuaacuauuuggaaaaaaugggauuagagccuuuccuc

SEQ ID NO: 5057 - RNA, 84 nt, Human
gagggaggacucugcagucuuauccaggcucuccucggcaucgcugccuucaagggucucuccaucuuuaaaggguccucccuc

SEQ ID NO: 5058 - RNA, 79 nt, Human
gagggcaaacgucgaggaccugcgcugcgccaugcccagguccuggcuuuggagcgagugcagguaccgccaggcucuc

SEQ ID NO: 5059 - RNA, 80 nt, Human
gagggcacuggaaaggucgguacuuagaugcccagugaaaaccccucaccccaaucucugcccugccugcaggagcccuc

SEQ ID NO: 5060 - RNA, 61 nt, Human
gagggcccaggauuuuggauccccagcccugugacaaggguuccuguccaguuucccccuc

SEQ ID NO: 5061 - RNA, 96 nt, Human
gagggcuuuagaaaugcugugccagagcugcaccccagaccaacaaaaucagacucuccaggaugcggccaaggcaucaguauguggaaagcuuuc

SEQ ID NO: 5062 - RNA, 89 nt, Human
gaggggaaaggagccccaaagagaagggacgcagggcaaaaaucaugcagccccagcaccccaccucugcgggcuggccaccuccccuc

SEQ ID NO: 5063 - RNA, 92 nt, Human
gaggggaaggggcuagcagguguguaaacagaggguuccaucaggcuggggcaggguggccgccuuccgcacacuugaggaacccuccccuc

SEQ ID NO: 5064 - RNA, 92 nt, Human
gaggggaaggggcuagcagguguguaaacagaggguuccaucaggcuggggcaggguggccgccuuccgcacacuugaggaagccuccccuc

SEQ ID NO: 5065 - RNA, 88 nt, Human
gagggggcaagucacaugggcagagauagccgugugagcagucucagcucaagcugccccccauuucuguaacccuccuagcccccuu

SEQ ID NO: 5066 - RNA, 78 nt, Human
gagggguggccaacaggucggugucagggugagggguggccacaaggcgggccauggcugggaccggccgcucuccuc

SEQ ID NO: 5067 - RNA, 75 nt, Human
gaggguugaagugugcuuuuccaagguuagagguuuuuaaaccuuguggcuuuaaugggaacguaguuugcccuc

SEQ ID NO: 5068 - RNA, 71 nt, Human
gagguagcugugguuguauuucacccaggagagugguccuuugggaugcaaggcaguuguucuaauaccuc

SEQ ID NO: 5069 - RNA, 99 nt, Human
gagguaggagaacugcuugaacucaggaggcgggggcugcaaugagcugagaucaagccacugcacuccagccuaugggauagagugagauuccaucuc

SEQ ID NO: 5070 - RNA, 96 nt, Human
gagguccagcuugcagccgucgugguuuugugcaaagcagcugagugucccucuguuaaugugugcaaaccauggugagagcugagccuggaucuc

SEQ ID NO: 5071 - RNA, 78 nt, Human
gagguccaguuucauucuucugcauguggguuagccaauuuuccuaacaccauuuauugauuaggguguccuuuccuc

SEQ ID NO: 5072 - RNA, 64 nt, Human
gaggucccagcacauguguuuucaagaggccacuaggcauucuucacugagugcugcugacuuc

SEQ ID NO: 5073 - RNA, 71 nt, Human
gaggucgaggugauugggggagcagacaaguaccacuccgugugucggcucugcuacuucaagaaggccuc

SEQ ID NO: 5074 - RNA, 91 nt, Human
gaggugaaggaggguaaauucuuuucuaagcccuacuugccugacaugcauuuagguuuuuagaaaggaaacugaccccacccuuuauuuu

SEQ ID NO: 5075 - RNA, 91 nt, Human
gaggugaaggaggguaaauucuuuucuaagcccuacuugccugacaugcauuuagguuuuuagaaaggaaccugaccccacccuuuauuuu

SEQ ID NO: 5076 - RNA, 114 nt, Human
gaggugacagaggugaaggaggguaaauucuuuucuaagcccuacuugccugacaugcauuuagguuuuuagaaaggaaacugaccccacccuuuauuuucuaucucccacuuc

SEQ ID NO: 5077 - RNA, 114 nt, Human
gaggugacagaggugaaggaggguaaauucuuuucuaagcccuacuugccugacaugcauuuagguuuuuagaaaggaaccugaccccacccuuuauuuucuaucucccacuuc

SEQ ID NO: 5078 - RNA, 97 nt, Human
gaggugauagugugguuuauggacugaggucaaaaucuaagaaguuucgcagaccugacauccaguacccugaugcuacagacgaggacaucaccuc

SEQ ID NO: 5079 - RNA, 78 nt, Human
gagguuaagugacuugcucaaugccacacugaaaauuuagcacaaagccaggucuggagcagagguggcuugaaccuc

SEQ ID NO: 5080 - RNA, 81 nt, Human
gagguuaucuugugguuuauuuuauauucuacuuaacuuuaacauuucugcagguagaauaaauauccuauuuaaagcuuu

SEQ ID NO: 5081 - RNA, 77 nt, Human
gagguucuauuguauccuuggccagaaacugggugaaaagaauaagcagacaauuuuuggagauacugaggaauuuc

SEQ ID NO: 5082 - RNA, 65 nt, Human
gaguaaaggagugucucaagguacuugaucacgugguucuugaaguccuuggauuucucuuucuc

SEQ ID NO: 5083 - RNA, 92 nt, Human
gaguagcuaugacaaugaggaguuuuaagagugagaaaacacaaugucuaugagaacauggacuucucuuuuagaggcuccaugagcuacuc

SEQ ID NO: 5084 - RNA, 79 nt, Human
gaguauugaucugucccagccugugcauugcuccgaggcaguucugaguggaugauguacagaugggauuccucagcuc

SEQ ID NO: 5085 - RNA, 74 nt, Human
gagucaagcccaagagcucccuuggcccuguuccccacucccuccacuggccucugcuguuccugucuuugcuc

SEQ ID NO: 5086 - RNA, 114 nt, Human
gaguccucagguugaugcugcagagccugcgggugaacagaguugggccugaggagcugccuguugugggccagcugcuucgacugcugcuucagcaugcaccccucaggacuc

SEQ ID NO: 5087 - RNA, 84 nt, Human
gagucuaugaacuggccacuuuucagaugaaaccuggugggccagcucuguggggugaugcauuuaaaagggcaguucaugcuc

SEQ ID NO: 5088 - RNA, 99 nt, Human
gagucucgcuuugucgcccaggcuggagugcaguggugcgaucucugcucacugcaagcuccgccucccggguucacgccauucuccugccucagccuc

SEQ ID NO: 5089 - RNA, 86 nt, Human
gagucuugcucugucacccaggcuggagugcaguggcucaaucuuggcucacugcaaccuccgccucccggguucaagugauucuc

SEQ ID NO: 5090 - RNA, 86 nt, Human
gagucuugcucugucgcccaggcugaauugcaguggggccaucucagcucacugcaaccuucaccuuccggguucaagcaguucuc

SEQ ID NO: 5091 - RNA, 68 nt, Human
gagugagggugggagggugugucugagcugggacuuuuuugagcacuggucauaccccccaccugcuc

SEQ ID NO: 5092 - RNA, 60 nt, Human
gaguggagggcuguggaguugggggccccuguucuuccccaacuuggcuuuccuuuucuu

SEQ ID NO: 5093 - RNA, 78 nt, Human
gaguggagugcggguggugggaaucccugggaggauuacgaaauccuuaaagugggauuuaccaaacgcauuccuuuc

SEQ ID NO: 5094 - RNA, 74 nt, Human
gaguggccggcagagcagugggcaucaaccuggcaggggccacccagaugccugcucaguguugugggccauuu

SEQ ID NO: 5095 - RNA, 73 nt, Human
gagugguagcugagcuucaggcugggacgugcuucauuaacaacuauaacgucagcccaguggaguugcccuu

SEQ ID NO: 5096 - RNA, 62 nt, Human
gaguggucggcugggcagagugcacgcugcuuggcgccgcaggcugaucccgccguccacuc

SEQ ID NO: 5097 - RNA, 84 nt, Human
gaguuaaugggugcagcacaccaacauggcacauguauacauauguaacaaagcugcauguugugcacauguacccuagaacuu

SEQ ID NO: 5098 - RNA, 80 nt, Human
gaguuagcaucaugaauuugcuuuucuccucuaaaaugcaaagguuagauucaaauuaucaugauugucagcugucacuc

SEQ ID NO: 5099 - RNA, 98 nt, Human
gaguuggagaaucccuuaaagggcccagaauauucacuaguugaucauucagcagguauuuauugagccccuguuaucuuucaggcacucuucuacuu

SEQ ID NO: 5100 - RNA, 90 nt, Human
gaguuuaacuguguaauuuuuggccuaaauagcccugugaaguagauauuauuccaacuuuacagguuagggcaauuuggacuuggauuc

SEQ ID NO: 5101 - RNA, 85 nt, Human
gaguuuagcucuuguugcccaggcuggagugcagugguacgaucucggcucacugcaacuucucccuccugguuucaagcaacuc

SEQ ID NO: 5102 - RNA, 124 nt, Human
gauaacauggaguuaugauagcaguggaggcaggcaggggaaaagggcccaugagauauggauggcagcacucucccccauucccugccauccccacugcacauguauaagcuaaguaaauauu

SEQ ID NO: 5103 - RNA, 97 nt, Human
gauaauguggacuuagauaauuacagguuuaauugggaacaagguguuuggacuuauuucucuucccguggagcagaauuauaaaacccaccuuuuc

SEQ ID NO: 5104 - RNA, 60 nt, Human
gauacaucaucugaaaucuaggacuauccuuggguacuaugacuagaugccuuguguauc

SEQ ID NO: 5105 - RNA, 127 nt, Human
gauaucagugucucucacaucaacacagaaauagggcacuucucaacauuaauuuuggaauuauucaccauuuaaaaauugucacugcucuuuuucauuacuguagauaacugagaguuagcuguuc

SEQ ID NO: 5106 - RNA, 88 nt, Human
gauaugguauugggagaaguagaucggugagcaggggagcaggguuugauccaccccugcuaucagacuucuucuguggagccauguu

SEQ ID NO: 5107 - RNA, 87 nt, Human
gaucaaagacugagccuaggaaguggguuuuuugaggcugcauauacucaaggcaauucuucagaaccacagagggcucauuggauc

SEQ ID NO: 5108 - RNA, 68 nt, Human
gaucacaagggcaacccaccaaacuagcguacuaccaguauggccugggcaaucuuggcccugugauc

SEQ ID NO: 5109 - RNA, 101 nt, Human
gaucacuacucuuggaaucaaagauaaauccaaauacugcauaucagaaacaacaggcaaguaguuguuuaucuuuaauuugaaagacuucaucugugauc

SEQ ID NO: 5110 - RNA, 75 nt, Human
gaucaguuugucucggugaaaaguaaacuuugaaagcuuuccagaguguugaaucuuccaccagaaaacuugauc

SEQ ID NO: 5111 - RNA, 98 nt, Human
gaucauuugagaccagaaguuccaggcuguagugcacuaugaugaucguacguaugaacagccauugcacuccagccugggcaauucagcaagacauc

SEQ ID NO: 5112 - RNA, 111 nt, Human
gauccagauagaugauauguuucuacuagugguugauggccucuuucagcuccaucgcuauggaggcgagguucaucaauaacucagagaaacuuguguccagaguugguc

SEQ ID NO: 5113 - RNA, 87 nt, Human
gauccauuuucacuuauuggagagagcacgauuuauuguggugacaauucaguguggagucgugcugcuccagaguguaaagugguc

SEQ ID NO: 5114 - RNA, 74 nt, Human
gauccgacauuuuuuguauucuuuaagauuuuacaccuaaaaaaucucuccuaucccaaaaauaaugugggauc

SEQ ID NO: 5115 - RNA, 79 nt, Human
gauccuuuuaguuacuugacacuuccauugcccaugaaaaaagaacgcaccuuggaaguuuacuuaguuagaauggauc

SEQ ID NO: 5116 - RNA, 72 nt, Human
gaucgccgggugcaauuuggcauugaaaguggaaagcuccguggcuuccuccguguuggagaccuggugauu

SEQ ID NO: 5117 - RNA, 76 nt, Human
gaucgcguggccgccaaaagaugaggaccccgccaacugaucauggcagcaaaucauaggcaagcggccgcggauc

SEQ ID NO: 5118 - RNA, 89 nt, Human
gaucgcucaaaaagaauacaaggaaaggggugucauuccaccaaaaacuaagggaaaagcacugucccuuuauuuuuaaggagcguauu

SEQ ID NO: 5119 - RNA, 73 nt, Human
gaucgguugcacgcagcugagcaggagagccucaagcgcuccaagguagcucaaccuggugcuggacgagauc

SEQ ID NO: 5120 - RNA, 94 nt, Human
gaucucugggcuuagcuggaaauagcagaaggacagguuccucggcggaccugcugaguuauguuucuucugcaggagcaggugccgagagguu

SEQ ID NO: 5121 - RNA, 64 nt, Human
gaucuugugucuagaggcuccagagccuugcgauaggcuucuugaguacauauaucacgacuuc

SEQ ID NO: 5122 - RNA, 64 nt, Human
gaugaacgcuaccgacauuuaggauucucuguugaugaccuuggaugcuguaaagugauucguc

SEQ ID NO: 5123 - RNA, 78 nt, Human
gaugacccagaucauaguaaugaugaccguucaacaaccccgagccauguacguugcuauccagugacugugucuauc

SEQ ID NO: 5124 - RNA, 67 nt, Human
gaugaccuuucagaugcuuucucuggaacugaaccagagguucacaaaacaaguguaguagguuguu

SEQ ID NO: 5125 - RNA, 84 nt, Human
gaugagaaaagucccaggcuaauggcagaaauuugcacuuugaacauguguguuuuuguguuguggaaccugagauuccuuauu

SEQ ID NO: 5126 - RNA, 76 nt, Human
gaugagaugcaccaaagcucagggaaggcaugaggagggaagguggcucaguagccugggguuggugcagagcguc

SEQ ID NO: 5127 - RNA, 71 nt, Human
gaugaggcagauaggaugauugacaugggcuugagccagauguccagaagauccuggagcacaugccuguc

SEQ ID NO: 5128 - RNA, 84 nt, Human
gaugauuauguguucaguuguuuuaccuauuagacuguaaacuccuuauaaucuaguaaaggcauagauuauauuuuauucauc

SEQ ID NO: 5129 - RNA, 105 nt, Human
gaugcacugguauaauucacuggcuugcccaguugguacucucuuagccauggcuauuccugaugacuaacuggcaguaaaagccaggaaauuauggaggucuac

SEQ ID NO: 5130 - RNA, 65 nt, Human
gaugcuccacagauaauccuaagagguuuucauuacauuuagccuaaucuggaagaucuggcauu

SEQ ID NO: 5131 - RNA, 74 nt, Human
gaugcucccaaacauccuauaugcauccauggaaauuuaaagauccuggaauagcgucuuccaugugggacauc

SEQ ID NO: 5132 - RNA, 92 nt, Human
gaugcuggugcucaguacgggaaagucauagaccgaagagugagggaacuguucgugcagucugaaauuuuccccuuggaaacaccagcauu

SEQ ID NO: 5133 - RNA, 92 nt, Human
gaugcuuuggaagacucauuauucagagcugcagcuggacugccuuagacaucugcauuucucuaucucugaaauaagggacuccgagcauc

SEQ ID NO: 5134 - RNA, 72 nt, Human
gauggaauaguucagaaggaaugguaccaguuccuccuuguaccucugguagaauucggcugugaauccauc

SEQ ID NO: 5135 - RNA, 63 nt, Human
gauggacucauuuccugguccuuaaagaugcagccucuuaagggcuccuugauggaugccauc

SEQ ID NO: 5136 - RNA, 73 nt, Human
gaugggaggccuggggcccugcccgcuggacagcacuaucucuaccagcggugguuccggccuucugauaauc

SEQ ID NO: 5137 - RNA, 70 nt, Human
gaugggcuggguagagagcaggacuggagcuucccucacaggguucugccucuggcccgaucuccccauc

SEQ ID NO: 5138 - RNA, 71 nt, Human
gauggggcaacggcugagggugggggcaguguguaaggcaccuuuugcggucagcccagccacacuccauc

SEQ ID NO: 5139 - RNA, 82 nt, Human
gauggguguaaugccugagauugcacaagcuguggaagagauggauuggcuccucccaacugauauccaggcugaaucuauc

SEQ ID NO: 5140 - RNA, 79 nt, Human
gauggucucauaacugaauauauuaaaaacuuaaauuguauacuuuaaguuggugauuguaugauauaugaguuuuauc

SEQ ID NO: 5141 - RNA, 60 nt, Human
gauguaaacacaaaagaaagugucucagcagggcugagcccuccuucucgugucugcauu

SEQ ID NO: 5142 - RNA, 85 nt, Human
gaugucaaugcugccauugccaccaucaaaacaagcgcagcauccaguuuguggauuggugccccacuggcuucaagguggcauc

SEQ ID NO: 5143 - RNA, 86 nt, Human
gaugucaaugcugccauugccaccaucaaaaccaagcgcacauccaguuuguggauuggugccccacuggcuucaagguuggcauc

SEQ ID NO: 5144 - RNA, 78 nt, Human
gaugugaucgccaaccagccugucgugaucgacaacggauccggugugauuaaagcugguuuugcuggugaucagauc

SEQ ID NO: 5145 - RNA, 61 nt, Human
gauguuucacagccaggcaguuuaugauauuaacagacuagacuccacagguguaaacguc

SEQ ID NO: 5146 - RNA, 90 nt, Human
gauucaguaaaaagugcugaaaaagaaaucagccuaugguuuaagccugaagaacugguugacuacaagucuugugcucaugacuggguc

SEQ ID NO: 5147 - RNA, 74 nt, Human
gauuccucuauugccacugauuggagcugaaaauaaaacugaaauucagcuagaaaaaaaggagcauaugaguc

SEQ ID NO: 5148 - RNA, 82 nt, Human
gauucucugaccgggcugacuuauuucuagguuucuuucaaggggaaacuccugaguagcucuggaauaagagccagagauc

SEQ ID NO: 5149 - RNA, 78 nt, Human
gauuucauaggugucuguuuucuuguacuguuagcagauucugacagaugugaugagaagaagaaugcauuggagauc

SEQ ID NO: 5150 - RNA, 74 nt, Human
gauuugcuuuuaauuacaaauacugugcaugacgaugccuucuucugcaaaaccaauaaauacaagaacaaauu

SEQ ID NO: 5151 - RNA, 75 nt, Human
gauuuugcccagcuaaaggccaacguuaaguguucagaacacauuuaagauaggcuaggcuaagcugggauguuc

SEQ ID NO: 5152 - RNA, 77 nt, Human
gauuuugucccaguccagccuuuaucaucuccacaguguaacuuuuccagugacuuagguucuaaugggacaaauuc

SEQ ID NO: 5153 - RNA, 73 nt, Human
gauuuuucuccaggcuguagaaccugccagacuguaguacaguggcaggcaacuuacaucccuuggaaaaguu

SEQ ID NO: 5154 - RNA, 85 nt, Human
gcaaaauucaaacuuauagugguaaagaaacagguuguucacuugcugaggugcaaaaauucuuaagacuucuguuugaaauugc

SEQ ID NO: 5155 - RNA, 77 nt, Human
gcaaagcaaguggcuuggagagauagugauuuagcucaagagggagugagaugugacuguugccacauguuaaaugc

SEQ ID NO: 5156 - RNA, 89 nt, Human
gcaaauaaaguagacauggucuggauaguugguggcaguucuguuuauaaggaagccaugaaucacccaggccaucuuaaacuauuugu

SEQ ID NO: 5157 - RNA, 65 nt, Human
gcaacuggggaagguauuuauugauccacaccauuuucuuggauuuucuauccuccccagggggc

SEQ ID NO: 5158 - RNA, 61 nt, Human
gcaagaaagagaugcaacccacacacccaauccgccuggggcuugcucuuaacuuuucugu

SEQ ID NO: 5159 - RNA, 72 nt, Human
gcaagcggcgccgcaaccuucugcguaacccguguggggaagaggacuuggaaggcuggugugacguggagc

SEQ ID NO: 5160 - RNA, 89 nt, Human
gcaaggucaucccuugagcugaacgggaagucaaugggauuggcuaccgggucccaauggccaacgugcagcggggggacugaccaugc

SEQ ID NO: 5161 - RNA, 69 nt, Human
gcaaggugugggcaaggucaucccugagcugacgggaagcucaauggauggccuuccggucccaacugc

SEQ ID NO: 5162 - RNA, 82 nt, Human
gcaauaauggaagaacagaguauuuuaauuuuuaucuucaaagaaaaucguacaaugacacugauuuuucuguuaaaacugc

SEQ ID NO: 5163 - RNA, 103 nt, Human
gcaauacucccaccccagccucucgaguagcugggauuacaggcgugugccaccaugccuggcuaauuuuuguauuuguagagaugggguuuugccauguugc

SEQ ID NO: 5164 - RNA, 81 nt, Human
gcaauaggcgggugggugcgugcuuccucccugccccagggcuucucccugaggcugguaggugggccccucgcuuucugc

SEQ ID NO: 5165 - RNA, 96 nt, Human
gcaauccccccacggggcauucuagaucaguccgauguggacuucgacaaggagucucuaucauaugguuucaccauccucagguugggggagugc

SEQ ID NO: 5166 - RNA, 94 nt, Human
gcaaugguuuguguagcaggcuuccugcagacuguauagacugcacaacaaauuucuccuguaccuaugggaagccugucacuuuugacugugc

SEQ ID NO: 5167 - RNA, 78 nt, Human
gcaauucaacuuugaguuaucuuuuaaauaugucuuguauaguucauauucauggcugaaacuugaccacacuauugc

SEQ ID NO: 5168 - RNA, 66 nt, Human
gcacaacugcuagugcccccuucuguggcuggucaugaggcccagagugguaacuggcagucuugu

SEQ ID NO: 5169 - RNA, 83 nt, Human
gcacagcacaggaaccugggcaggcaguccacccucagggccugccugugaccacugcuaaccugugcggaacaaacaugugc

SEQ ID NO: 5170 - RNA, 60 nt, Human
gcacagcagagcuuuccagaggaagccucaccaagccucugcaaugagguucuucugugc

SEQ ID NO: 5171 - RNA, 64 nt, Human
gcacagucucagaugggcaguuagucauuacuuucuuggucaaugccuugugacuagacugugc

SEQ ID NO: 5172 - RNA, 78 nt, Human
gcacauguuggaggagagagccuugggagccacugccacuccaguccugccaccacccuugucuuccucugcaagugc

SEQ ID NO: 5173 - RNA, 99 nt, Human
gcaccacuaugugacugaauuucaggguaaugaugcaccuguggaacaagaaauuaacagugcagaaacuuacuuugaaaagugcagaguagagugugc

SEQ ID NO: 5174 - RNA, 78 nt, Human
gcaccaguaagaaagacugucgcuagcauuuuuauuucaucaucaacaacaaacaugcaguuucuuucucugaugugc

SEQ ID NO: 5175 - RNA, 91 nt, Human
gcacccugugagguaggugcuuuaacugugugcacccugugagguaggugcuuuaacugugugcacauugugagguaggugcugaaacugc

SEQ ID NO: 5176 - RNA, 104 nt, Human
gcaccgaggggccaguaccuucuggauaccuccacaugguccgagugcacugaaccaaaccacauguggcaaugggaugauucucugguacuauccuuuggucc

SEQ ID NO: 5177 - RNA, 80 nt, Human
gcaccucuuggacugaaucguuugucuagacuacauguauuacaaagucucuuuggcaagauugcagcaagaucaugugc

SEQ ID NO: 5178 - RNA, 84 nt, Human
gcacgccaagcggggcuggggugcauccugggcaggggacugaaauguaccugucaggguuugccucagaagugccuggugagc

SEQ ID NO: 5179 - RNA, 83 nt, Human
gcacgcucggggcggccggccagccaggcgcgcagcggcacaaggcggcagucgcagcgccagggguuggcgcccaggugugc

SEQ ID NO: 5180 - RNA, 71 nt, Human
gcacuagauuguaaagacugggguggaccucuuucuuaauguccaauguccuuugucuuaagauuuggugc

SEQ ID NO: 5181 - RNA, 91 nt, Human
gcacucuguguccagacuuuaacuaaaggcggauuucccgagacuacgggugugcuguuagaaggguucugggucugugcacuaaagaggu

SEQ ID NO: 5182 - RNA, 69 nt, Human
gcacugagcuuggaggagguacagguggaccagaugacggcucugccugugaaauccaaauuccagugu

SEQ ID NO: 5183 - RNA, 108 nt, Human
gcacugcucuggcauaggaauacuugaauagcuugguuaaaugaagggauggccaggagauguuacuuuuccaagcuauucaggcacuccuuaugucagagacagcgu

SEQ ID NO: 5184 - RNA, 61 nt, Human
gcacuucccacacuaaaauaacccaguuuuucucaaucuuuugguauuuuuggagaggugu

SEQ ID NO: 5185 - RNA, 64 nt, Human
gcagaagaacauagacaaauaugucgcucuugggacacaaggugcugacauguauacuugcugc

SEQ ID NO: 5186 - RNA, 61 nt, Human
gcagaauacuuuguggccugaaguucaaaaacuauaugggcacgguuaugaaauauuuugu

SEQ ID NO: 5187 - RNA, 85 nt, Human
gcagaauauaagucuuuagccuucccaaguuucuuggcaaaugcaacagcuugaaacucaaaucugcggcuuaggacuguuaggc

SEQ ID NO: 5188 - RNA, 77 nt, Human
gcagaaugcccagagucuucccugguagaugcagguuccauagcgacguucuccugcaaugcacgcugguauucugc

SEQ ID NO: 5189 - RNA, 111 nt, Human
gcagaauucuaaagugaccuuuccccaggugugaucucauccuuugaaccucggcagguccugugaagaugaugagauaucacucugucacuauaguaaaggaaguuuugc

SEQ ID NO: 5190 - RNA, 80 nt, Human
gcagaauugaagaugggaaguucauugggacugugucuuggaaaagcaccaaguucgucucaguuguuccuguuuuuugc

SEQ ID NO: 5191 - RNA, 78 nt, Human
gcagagacuaugauguggaauggggcuaugcuuuugaugugcaucucaaugcuuuuuauccacuccuggucauuuugc

SEQ ID NO: 5192 - RNA, 94 nt, Human
gcagagcuuguguaggaagaaugaaaucugcaauuugacuuuuaggagugucguuuuccgggucaggcagauugguauucagcgcuggcucugc

SEQ ID NO: 5193 - RNA, 71 nt, Human
gcagagguacugagccauaacagagaggcgacuacgcuguugcuuccuguauuggcugcaagucucucugc

SEQ ID NO: 5194 - RNA, 64 nt, Human
gcagaugaauauuaacgaaacccaaaccuuucgggugaccgugaucuuguucgucuuuuuuugc

SEQ ID NO: 5195 - RNA, 106 nt, Human
gcagauguguacagaugcuaaacuguugggaaaaugcugcuuaugagacaucucugcuucuugagaccugaaucugcaaauguugagcacuguaccuuacaaaagc

SEQ ID NO: 5196 - RNA, 79 nt, Human
gcagauguugaacgaugggcuggauuguuuuggaaccuuguuccagcagagcccauguguucaugaagaaaacauuugc

SEQ ID NO: 5197 - RNA, 106 nt, Human
gcagauuccuuuuuguuaaaugcugacuguguccuugguuucccauucaccugggaaguagaagaauaaaaaucauuccauaguuccauccaaggagggcagcugc

SEQ ID NO: 5198 - RNA, 63 nt, Human
gcagcaagaugcaagggggucaaagagccuuuuguuugggcauugauaucugcaucaugcugc

SEQ ID NO: 5199 - RNA, 71 nt, Human
gcagcacaaaggcggcgcggugcacgucggaguuguaguacuucagcugcaucugcgccaccugcugcugu

SEQ ID NO: 5200 - RNA, 80 nt, Human
gcagcacccaccuccaaccucgggccagugucuucaggcuuuacuggggaccugcgagcuggccuaaugugguggccugc

SEQ ID NO: 5201 - RNA, 72 nt, Human
gcagcagaaaggcaguauuguguguggucauggagagcauccgaaccacacgacagugcucacugucugugc

SEQ ID NO: 5202 - RNA, 68 nt, Human
gcagcagcagcuccagcagcagcaauugcagcagcagcaguuacugcagcuccagcagcugcuccagc

SEQ ID NO: 5203 - RNA, 78 nt, Human
gcagcauaaaucccaaaccacuccucugcucuccacacuguauggauggaggugcugaggaaguuggagaggugaggc

SEQ ID NO: 5204 - RNA, 77 nt, Human
gcagcccgaacaagaucacucaaggugaaggauaaucuacuaauaccagcacuuugaaugaaaauuuguuucucugc

SEQ ID NO: 5205 - RNA, 72 nt, Human
gcagcccugaagaaaucagguaaauuccgcuccagagacggcagagcugguggcgccauucuucagggcagc

SEQ ID NO: 5206 - RNA, 71 nt, Human
gcagccgggccugaggcugagagcauguaccagaucaaguaugaggagcugcagagccugggcugggaagc

SEQ ID NO: 5207 - RNA, 94 nt, Human
gcagccggggccuucucaacgccucaguaccucggcgggaccgccaugguucugcugcacgugaagcggggcgacgagagccaguuccugcugc

SEQ ID NO: 5208 - RNA, 94 nt, Human
gcagccggggccuucucaacgccucaguaccucggcgggaccgccaugguucugcugcacgugaagcggggcggcgagagccaguuccugcugc

SEQ ID NO: 5209 - RNA, 91 nt, Human
gcagccucccugagguagauguguucuccugucacuuaaagaaccagcuucuccuggucugaguaguaagaggcgcauuugcuguugcugc

SEQ ID NO: 5210 - RNA, 79 nt, Human
gcagccuccugagguagguaaccuuguuuacugauggggaacaaggcaguguucuuuaccaaaucucagggcggguagc

SEQ ID NO: 5211 - RNA, 76 nt, Human
gcagccuugcucuguggcuuuucccaacacaaucagugcuagugcuggggaggaacagucaagagcagucaguugc

SEQ ID NO: 5212 - RNA, 81 nt, Human
gcagcgacgcugaguuucaagaaagccaagauggcugaguccacaggcucacccacgggugcguuuagacugggaugcugc

SEQ ID NO: 5213 - RNA, 99 nt, Human
gcagcggcgccacgcggguccacugguugcacugcgggcuguaggccuccacgcccagcacgucgaagcgcuccauggacucgauguugucaucgcugc

SEQ ID NO: 5214 - RNA, 64 nt, Human
gcagcuaucuagcauggcauugucaccaacucccuucgcauggugaugcgauuaagguagcagc

SEQ ID NO: 5215 - RNA, 73 nt, Human
gcagcuccagcgucaaauuugucuccaccagcuccuccucccggaagagcuucaagagcuaagaaccugcugc

SEQ ID NO: 5216 - RNA, 82 nt, Human
gcagcuccaguaucccaaacuuucuaguccugcugauccucccagcaacgggguggaaacuggagggcagugucuggucugu

SEQ ID NO: 5217 - RNA, 75 nt, Human
gcagcuggaucgggccucagagcaggcggcaggcguugcccacgcugucagcugaggugucaaggucauggcugu

SEQ ID NO: 5218 - RNA, 69 nt, Human
gcagcuguaccuccaggcuuuggagaaagagggcagccucuugucaaagcaggaagaguccaaagcugc

SEQ ID NO: 5219 - RNA, 68 nt, Human
gcaggaacccggaaaagaugcuguuggcacccuccaugcccaguagugaguucuugucgggggccugc

SEQ ID NO: 5220 - RNA, 89 nt, Human
gcaggaccuucacagggagguuauuuugucucucugucucgguuucucugagccacugagacagauggcuguccgcuuugaggcucugc

SEQ ID NO: 5221 - RNA, 97 nt, Human
gcaggacuggagcuuccucaccaggguucugccucuggccccgaucuccccauccacacagcggagccaggccacuggaaaggacagccaguccagc

SEQ ID NO: 5222 - RNA, 70 nt, Human
gcaggagagcauacuuggcaaggaugagaauaccugugugauaaacacagcaucugcacauauuuccugc

SEQ ID NO: 5223 - RNA, 60 nt, Human
gcaggaucuccaacuauaaugcuucuguccuuaaaagcagguggaguugguugaaucugu

SEQ ID NO: 5224 - RNA, 118 nt, Human
gcaggcagaucugggagcuguuugauuucuuucugcuuugcaucaaauucuacucccauuuacugcugaagagaagcagagcuuucugaacuauccaaaaguuuccauuguugucugc

SEQ ID NO: 5225 - RNA, 105 nt, Human
gcaggccccgcuggugcacugaagagccacccuguggcaucgauaaacaccgguguuuaucgaugccaccccuggccuucuuuugcccgaccagggguggcuggc

SEQ ID NO: 5226 - RNA, 79 nt, Human
gcaggccggccagcuggcccggcgccucugggaggccucccguaucccccugcucuaggccaagguggccgcagucugc

SEQ ID NO: 5227 - RNA, 69 nt, Human
gcaggccuggcacagccuuggcuuccacgccugagcgugagagcacgaguuaguuguaguccggcuugc

SEQ ID NO: 5228 - RNA, 76 nt, Human
gcaggcuuuuccauucaaacuuugucauuuguuucuuuaaguucaagaaagacaaaaucuacacugaaauccuugu

SEQ ID NO: 5229 - RNA, 89 nt, Human
gcagggagacuggagagaaagcgaagauguagcccaaagccauagugcuuugugugcccugcaacugagcuuucccugcagcuuucugu

SEQ ID NO: 5230 - RNA, 66 nt, Human
gcaggggcuggcacugaugggcgaggggaggaagugccucccuuagaaacuugggccaaacccugu

SEQ ID NO: 5231 - RNA, 88 nt, Human
gcaggguucucagcagugaugggagggcaggggaagagauguaaaggcuuugagacuggguucccaucgcuggaaaagaaggcucugu

SEQ ID NO: 5232 - RNA, 74 nt, Human
gcagguucuggagaacacuucagugccagcauuaaccgauuagcugcugggcuguggggaguuuccagagaggc

SEQ ID NO: 5233 - RNA, 99 nt, Human
gcagguugguacuacuucugauuaggcagaaaacaccaggauuccuuaagugauccuugaaaugguuauuguuuucugccuugucacauuugccacugu

SEQ ID NO: 5234 - RNA, 109 nt, Human
gcagguuuuuucuucuucaaaaccauucuaccucauuagcauucaagcgagcuguggcucugaugaucauguagcagagugugagggcacugaggagggcaaaacuggc

SEQ ID NO: 5235 - RNA, 77 nt, Human
gcagucaaggcuccaagaaagugagacuucagcacuuuuucacuccugagaaguccacagucaugagccuggcuugc

SEQ ID NO: 5236 - RNA, 73 nt, Human
gcaguccgucuucaagguccagauaacaugagaaaugaagcuucucacaucguuguuggggaugacggacugu

SEQ ID NO: 5237 - RNA, 60 nt, Human
gcagucgcgucgccggcugcucgggccccagccccggccgcuguggugacuccgacgugc

SEQ ID NO: 5238 - RNA, 77 nt, Human
gcagucuuuuuaaaugauacagaaauacguuuauagaugcagaaagacauuuaugauauaucguuaagcagaaaagc

SEQ ID NO: 5239 - RNA, 104 nt, Human
gcaguggaggcucaagaggaaaguuuguuaguggaggcagugguagaggucgucauguacgcuccuuuacacgauaaaaauccuuuugggaacaucuuaacugu

SEQ ID NO: 5240 - RNA, 74 nt, Human
gcaguggagggggcaggaccuccugcuggugcagcaccagcugcugugagcagguccaccggccccuacacugc

SEQ ID NO: 5241 - RNA, 72 nt, Human
gcaguggagggggcaggaccuccugcuggugcagcaccagugcuggagcagguccaccggccccuacauugc

SEQ ID NO: 5242 - RNA, 112 nt, Human
gcagugggcaaaaagugagaaaguaagacugugggaggugacuguuacagaucggaaaacucugauugaaccauucacuuuauuagccaguaaacuuucucaaccccagagc

SEQ ID NO: 5243 - RNA, 114 nt, Human
gcaguguugggagugcuguuggaaagcugagccugagagacagauugaggaaggagauuuacucgguguuuguuucugugucacagcuuuccguccauuuaacucuugaucugu

SEQ ID NO: 5244 - RNA, 77 nt, Human
gcaguguuggggauccagagccaugucggaccugcuacuacugggccugauugggggccugacucucuuacugcugc

SEQ ID NO: 5245 - RNA, 73 nt, Human
gcaguucagagaaggcugcagucagcuaccuugaccuaggggcugaagccuuaacuucccacucugauucugc

SEQ ID NO: 5246 - RNA, 95 nt, Human
gcaguucuugugcuaugggugggagucuucuuccucaaguuucggcagcugugcugcugcuggaugggcugcuccucccagggcucaagggcugu

SEQ ID NO: 5247 - RNA, 72 nt, Human
gcauauagaaaggcaguccugggaccuccuguucuucagaauauacaggucuuuaaacuguaaucagguagc

SEQ ID NO: 5248 - RNA, 62 nt, Human
gcaucccacaguucugagacaagcuuuagucuuuccucuagcagcuucuucugugcagaugc

SEQ ID NO: 5249 - RNA, 60 nt, Human
gcaucgaccgcgggcgcuacgggcuugacucccccaaggccgagguccgcggccaggugc

SEQ ID NO: 5250 - RNA, 111 nt, Human
gcaugauugugugugugugaaugugugcauguaugugugcaugugugaauuaugauuugguguguacacauguauaccugugugggugugcgugcauaugcauaguugugc

SEQ ID NO: 5251 - RNA, 92 nt, Human
gcaugcccacugagagccugaaggaggagcuggcuaccugaagaagaacccgaggaggagcauggaaugccugagaggccagugggcggagc

SEQ ID NO: 5252 - RNA, 75 nt, Human
gcaugccgacuacagcugguaccaggcgggcagugcccgcucagggccuguuacagucuaccccuacaugcaugc

SEQ ID NO: 5253 - RNA, 73 nt, Human
gcaugcugacgagguuuggagaaucgaaacuggcuccgugggcaguuuccuaaaaugugccuccucgaguugc

SEQ ID NO: 5254 - RNA, 76 nt, Human
gcaugcugguggucauccuggcagcugguggguggccugguaugcugcccacucagcuugagacucacccucaugc

SEQ ID NO: 5255 - RNA, 73 nt, Human
gcauggaagaggagcucgggaggacaggguuggggccuccagggucugacaccaccccacuccucuuccuagc

SEQ ID NO: 5256 - RNA, 93 nt, Human
gcaugugcuccugcggcguggggguuuguagacuuggaaaacccuguuggcagaaaguuaagagcucccaggccugaaggcaggacacagugc

SEQ ID NO: 5257 - RNA, 100 nt, Human
gcaugugggcaacucuguguuccugucaguccacggguugagcaguauuggaagccccauccgugggcagcacugagguccaacgggauugcccaggugc

SEQ ID NO: 5258 - RNA, 87 nt, Human
gcauuagauugucauaggagugcaaauccuguugugcacugugcaugcaaggaucuagguggugcacuccuuaugagaaucuaaugc

SEQ ID NO: 5259 - RNA, 72 nt, Human
gcauugcccggaagaucaagucgugcuccuggcaggcgcgccccuggaggaugaggccacucugggcagugc

SEQ ID NO: 5260 - RNA, 71 nt, Human
gcauugcccggaagaucaagucgugcuccuggcaggcgcgcccuggaggaugaggccacucugggcagugc

SEQ ID NO: 5261 - RNA, 78 nt, Human
gcauugcuggggccaugcagggccuagcucuccaccaagggaaagugcugauuuuccuugucaugguccuggccuugc

SEQ ID NO: 5262 - RNA, 77 nt, Human
gcauugggcaagaagauggaugcagggaggaccaugaagcugcuaguuuucccggacaucgacugaggcccaguugc

SEQ ID NO: 5263 - RNA, 85 nt, Human
gcauuuacugcuaagaacauuaaagaauuccuauguuugacuagaaauuuuuuagauuaguguuucuuaaacuugaguaauaugc

SEQ ID NO: 5264 - RNA, 63 nt, Human
gcauuucucugauaaccagugaugaugagcauuuuuucauaugucugcuggcugcauaaaugu

SEQ ID NO: 5265 - RNA, 94 nt, Human
gcauuugguuuuaaaauuuuuaugcuaauauaaaugcucaaguaauuuaaaauauugaaagcaucccuguugguauaaauuucugaguaaaugc

SEQ ID NO: 5266 - RNA, 77 nt, Human
gccaaauugagacaauuucagcaaaucuguaagcaguuuguauguuuaguugggguaaugaaguauuucaguuuugu

SEQ ID NO: 5267 - RNA, 75 nt, Human
gccaacaucgaccaggagaccuaccgcugugaacucauucaaggauggaacauuacuguggaccuggucauuggc

SEQ ID NO: 5268 - RNA, 88 nt, Human
gccaaggaaacaggaugcugauagucuccagcagggccuggacaugugggcugguguguggaacugcugcaacuuucuuccugguggc

SEQ ID NO: 5269 - RNA, 111 nt, Human
gccaaggaugguggcgggcaccuguaaucucagcuacucaggaagcugagacaggagaaucacuugaaccugggaggcggagguugcauuuagccgagaucacaccauugc

SEQ ID NO: 5270 - RNA, 84 nt, Human
gccaagugcagggaugcagguaugaagugcuugugaaauaacagaauucccacaguaauuucuucccuggcuuccugcacuggu

SEQ ID NO: 5271 - RNA, 75 nt, Human
gccaauagguuccaugauucugaugcaguauagaucauuuuucuauccaagauuauaugggaucuaaaaauuggc

SEQ ID NO: 5272 - RNA, 95 nt, Human
gccaauggaauccagguaaaguacaaaaacgccaccuuuuauuguccugucuuauuucucgggaaggaggguucuacuuuacacauuucaugagc

SEQ ID NO: 5273 - RNA, 71 nt, Human
gccaauguccacaaagaauuccuggucagcaccaccgauguccaaaggugcaauaucaaggaagggcaggc

SEQ ID NO: 5274 - RNA, 72 nt, Human
gccaauguccacaaagaauuccuggucagcaccaccgauguccaaagguggcaauaucaaggaagggcaggc

SEQ ID NO: 5275 - RNA, 74 nt, Human
gccacagcccuuaggggaguccagggccagcuggucgaaagugaggaucuugcccccugcccugaggaugcggc

SEQ ID NO: 5276 - RNA, 105 nt, Human
gccacccuauuugcaguuuuucuaaguaacuugguagguugaaagauccaaggucaaaagaacuuauccaguguagcaaauaacaguaaaauaagauaaaguggc

SEQ ID NO: 5277 - RNA, 71 nt, Human
gccaccugcugggcccgcuccaccaccugcaccugcacccgcugcuccucaaucugcugcuuagucuuggc

SEQ ID NO: 5278 - RNA, 89 nt, Human
gccacgguucauuucacccuugacaggcucauugaggauggcauaagcgugugucauucuggaugucuugcaccgggcauagccguggu

SEQ ID NO: 5279 - RNA, 77 nt, Human
gccacguggggaacuaugagggacugggagccaggcaagaagugccugagcaacguccggcaggaguaccggcgggc

SEQ ID NO: 5280 - RNA, 70 nt, Human
gccacucuuccaagccucuuggugcacaguaaccuauugcugaaagcuuuugaacagcugagaaaguggc

SEQ ID NO: 5281 - RNA, 73 nt, Human
gccacugauuguccaaacgcaauucuuguacgagucugcggccaaccgagaauuguggcuggacaucuguggc

SEQ ID NO: 5282 - RNA, 90 nt, Human
gccagagcagacuacuaaagcuuuaccugugagguuuuuguuuacagauuacaauagacuguccaguguagguggagaaacuucucuggc

SEQ ID NO: 5283 - RNA, 63 nt, Human
gccagagcgauauauucaucuggagaaccuuuuggccaggucuuacuuugauccucgugaggc

SEQ ID NO: 5284 - RNA, 112 nt, Human
gccagcaaagcuccuaugccugcuaaacccuagcaccugagagccaaagagguuuuguagagaaccuggucucuuagugauggggacaugguaccuuaggaguccagugagc

SEQ ID NO: 5285 - RNA, 72 nt, Human
gccagcacgccaaguacacuugcucuuucuguggcaaaaccaagaugaagagacgagcugcguggaucuggc

SEQ ID NO: 5286 - RNA, 101 nt, Human
gccagccucagcugucuuggagcagauguguauaguuagagauggggaccuuuucacuguaaauacugcucacauguuccuaggcugacuuuacuaugugc

SEQ ID NO: 5287 - RNA, 76 nt, Human
gccagcggaacuguaccaucgccguccacauugcucacagggacugggaaggcgaugccugucgggagcugcuggu

SEQ ID NO: 5288 - RNA, 75 nt, Human
gccagcucagccuuggcuuuuaacucaauauuccaguccauaggggugguuaaaaguugcugcaaggcugcaggc

SEQ ID NO: 5289 - RNA, 64 nt, Human
gccaggcccagccucauaagccacaacuugggaacaacgugcacaugggauccaugggcuuggc

SEQ ID NO: 5290 - RNA, 60 nt, Human
gccaggccccugcgcgccaagcccugguuggcagccggggaggacgucaggaggcccugc

SEQ ID NO: 5291 - RNA, 94 nt, Human
gccagggcucauggucacucgugacuuacuaguuugauaggcucucacuguggagcuagaaguuccuuggcuguccaauggagccugcaguggc

SEQ ID NO: 5292 - RNA, 85 nt, Human
gccaggguuccagcuucaccaggaccaggcucuucuccuugggccucccagcugacagguccugcccgaagcccagguagauggu

SEQ ID NO: 5293 - RNA, 62 nt, Human
gccaguaacugggaacacacuugggagcaguccuaugucucagugccccuuuaauuucuggc

SEQ ID NO: 5294 - RNA, 79 nt, Human
gccaguggcgcccagccggaauggcauggucugugaagccccacuuccacaaggacugcagcggcgcgugccacguggu

SEQ ID NO: 5295 - RNA, 93 nt, Human
gccauaugagccacuucucagccaccaugucuuuaaauucaucgacauugaacuuggugaagccccauuucuuugagaaguggaucgucuggc

SEQ ID NO: 5296 - RNA, 77 nt, Human
gccaucaaugucaaugacuccgucaccaagagcaguuugacaaccucuauggcugccgggagucccucauagauggc

SEQ ID NO: 5297 - RNA, 60 nt, Human
gccaucagcuccuugggacugaugaacagagucagaagcccaaaggaauugcacuguggc

SEQ ID NO: 5298 - RNA, 75 nt, Human
gccauccagcacccagacuccagcaccggcgaggacccccacuccggcugcaggacccugucccagcgagaccgc

SEQ ID NO: 5299 - RNA, 79 nt, Human
gccauccagugccauccucgucgcugcagcgacacacgcucucgccgccgccaugacugagcagaugacccuucguggc

SEQ ID NO: 5300 - RNA, 86 nt, Human
gccauccugucggugaacggcaccgaccugcgccaggccacccacgaccaggccgugcaggcgcugaagcgcgcgggcaaggaggu

SEQ ID NO: 5301 - RNA, 62 nt, Human
gccaucugcggguccagauccaacaguaauugacuauugaaggcuugcgggcccacaguggu

SEQ ID NO: 5302 - RNA, 73 nt, Human
gccauggcagugacagcgacggcucccagaguccccgcucucugccccccuccagcccugucaggcccauggc

SEQ ID NO: 5303 - RNA, 74 nt, Human
gccauggcggccaugaguuguugcggcggguuucgguuacugcgguggcagcucugucuggccggccccuuggc

SEQ ID NO: 5304 - RNA, 103 nt, Human
gccauucauuguacaguugcaggaaugagagugauuuuaugaugugguacauugggaccauguucuaaaaccuuggguuucugagucugcuuuuugaguaggu

SEQ ID NO: 5305 - RNA, 65 nt, Human
gccauucauuuucauuaacacauauauucuguccugcaauacuggagagguggaaugugucuggc

SEQ ID NO: 5306 - RNA, 69 nt, Human
gccauugagucacuccacccuggggccuaggccaucccgcccuggcccugagaugaugugcuaaauggc

SEQ ID NO: 5307 - RNA, 86 nt, Human
gccauuggccaggccaccagggguccccaugauaaugcacagcuaguugcuugagcaugguuauggugauucgugcccccaacagc

SEQ ID NO: 5308 - RNA, 77 nt, Human
gcccaaagacaaauauugggcaggaaaucaguucucacugagcccgguuuccauguaaaaucucuguuguggugggc

SEQ ID NO: 5309 - RNA, 60 nt, Human
gcccaagaauuugauaaugcuggaugccuugcagacaucauucaguuucuaauauugggc

SEQ ID NO: 5310 - RNA, 91 nt, Human
gcccaagaugugcagcuuccuggaguggagggaccucaaaguugucuauaagagauaugccagccucuacuucugcugcgccaucgagggc

SEQ ID NO: 5311 - RNA, 79 nt, Human
gcccaagcacggaguccccagaggaacacacacgcccaccacaaugcauuucucaggaggugauucaggaacuuagggc

SEQ ID NO: 5312 - RNA, 66 nt, Human
gcccacacuacaggccagggcugcggggcuggcgcaaucccagcccccuuccccgggccacggggc

SEQ ID NO: 5313 - RNA, 63 nt, Human
gcccaccuggcacgggccagcucggauaucgugucccuggcagggcccagugcugggccgggc

SEQ ID NO: 5314 - RNA, 76 nt, Human
gcccacugccauggaguccugcuguggaugggcacgggcaauagcugccaugacccacaggaacccaugaaacggc

SEQ ID NO: 5315 - RNA, 76 nt, Human
gcccacugugacaaugucaccgaucuggacgucccugaagcagggggacagguguacagacauguucuuguggcgc

SEQ ID NO: 5316 - RNA, 77 nt, Human
gcccacugugacgaugucaccgaucuggacgucccugaagcagggggacagguguacagacauguuucuuguggcgc

SEQ ID NO: 5317 - RNA, 72 nt, Human
gcccagagccuguguggccccgagcacagugcuguuccugacucccugcgcuggcucugccacccccugggc

SEQ ID NO: 5318 - RNA, 67 nt, Human
gcccagaggacucccaacccuggcuuggugucaagaaacagccagcaagaguuaggggccuuagggc

SEQ ID NO: 5319 - RNA, 77 nt, Human
gcccagcccauggcugccaugggaggccugaaggugcuucugcacugggcugguccaggcggcggggagcccugggu

SEQ ID NO: 5320 - RNA, 82 nt, Human
gcccagccccuggcagcacccacgaugcgggaccugccucucaccagccuggcccuaguggggucugcccugggggcucugc

SEQ ID NO: 5321 - RNA, 98 nt, Human
gcccaggcuuggaguugcggguggcguugaccuucaguuucacgugcaaagccuccggccuucacaggguucaccgccauuucuuccgugccucgggc

SEQ ID NO: 5322 - RNA, 87 nt, Human
gcccagggagaaccccuuggauaucgccaggaugauccuagcuaucguucuuuucacucugguggauauggccaggaugccuugggu

SEQ ID NO: 5323 - RNA, 65 nt, Human
gcccagguucacaagugugcaucuuuuggcuucggcgacccuuugcgcaaacacaccaccugggc

SEQ ID NO: 5324 - RNA, 76 nt, Human
gcccagguuccaaggagcucacuacaccccuggucaaucaauggcccucacugggaacgcuuaauggggccgaggc

SEQ ID NO: 5325 - RNA, 86 nt, Human
gcccaguucacuucuuugcagagccuuuuaccccugcacaguuuagaacagagggaccaaaugcuucuaggagucaacuggcuggc

SEQ ID NO: 5326 - RNA, 71 nt, Human
gcccauccgcgaacucacccagaacugggauguggaccuggcggccccacugggcgaguaucuggaggagc

SEQ ID NO: 5327 - RNA, 61 nt, Human
gcccauuaacuucugaauuuugggaaagacacaagaaagagcccaaaguuuucagauaggc

SEQ ID NO: 5328 - RNA, 71 nt, Human
gcccauuggcagggguaccaaagugauccuccaucuuaaagaagaucagacagaguaccuagaagagaggc

SEQ ID NO: 5329 - RNA, 87 nt, Human
gccccaacgucuguucauggcugugguuuuaaaagagucccucaacagaugcucuauuuaauaaccaguuuguuccucagauguggc

SEQ ID NO: 5330 - RNA, 71 nt, Human
gccccacuuuuaaaaaccuggcuccuuacucuggcugggucccggggaagagauauuuuuaaaacaagggc

SEQ ID NO: 5331 - RNA, 60 nt, Human
gccccagcagccccugcagccuccaggcccucucgccgggccacagcguagggcuggggu

SEQ ID NO: 5332 - RNA, 86 nt, Human
gccccagggcagccucgugcgugugauccagcgagcgggccugguguuccccaacauggaagcauaugccggucucucccuggcgc

SEQ ID NO: 5333 - RNA, 73 nt, Human
gccccauucuuaccguuuuuguuacuucgaaaucauuugacgauuuuggguggaccuggacugaggcgugggc

SEQ ID NO: 5334 - RNA, 96 nt, Human
gccccccuacuuccgcuuccugacacucauggccuuccacgucuuccuccaagagaagguggaccuggcagugguggaggugggcauuggcggggc

SEQ ID NO: 5335 - RNA, 96 nt, Human
gcccccucccgaggaggucgagccgggcagugggguccgcaucgugguggaguacugugaacccugcggcuucgaggcgaccuaccuggagcuggc

SEQ ID NO: 5336 - RNA, 69 nt, Human
gccccgcggggagcccgcgggcucgucaccacacacaacgugcgcucgagcacacgggcuacacggggc

SEQ ID NO: 5337 - RNA, 73 nt, Human
gccccggggucuggcggaugaugaagauugagagcccucucuuagagcagaggaugaucggguuccccggggu

SEQ ID NO: 5338 - RNA, 77 nt, Human
gccccuauggggcccacaugggugguaacagcagcaggacaccuuuuccaaagcuguccaccagccccacuaggggc

SEQ ID NO: 5339 - RNA, 80 nt, Human
gccccucacccaaguggcggcaucuuaacggcauugguggaagcuggggucagaaaagagaaaugaccauuuggaggggc

SEQ ID NO: 5340 - RNA, 84 nt, Human
gcccggccgugcacccagccugcggcagagagggcggcgucccccacaaagccugccaggcugagcccuugcaauggccguggc

SEQ ID NO: 5341 - RNA, 92 nt, Human
gcccggugcucgguuuguaggcagugucauuagcugauuguacuguggugguuacaaucacuaacuccacugccaucaaaacaaggcacagc

SEQ ID NO: 5342 - RNA, 77 nt, Human
gcccucaaccggcggccgcgccaugcugcgggguaacacccgcggggcgguauggagagcggcacacgccggggggc

SEQ ID NO: 5343 - RNA, 87 nt, Human
gcccucaccugcuugcuccuaaaugugauccugcuuacuguaacuucuuaagacacuaucagugcguuguuccaugaaggcgagggc

SEQ ID NO: 5344 - RNA, 76 nt, Human
gcccucagggaacuuuguggccugugggggguuggacaacaucugcuccaucuacagccucaagacccgcgagggc

SEQ ID NO: 5345 - RNA, 84 nt, Human
gcccucugccugccccuaacgcccaacuccaugccugccucagucaugguuuguuuuugcuucuggaagggguagauggagggu

SEQ ID NO: 5346 - RNA, 79 nt, Human
gcccugagcaggaagaugugccacuuccuagcaggcgcaaggccugugcggaagaaacgccgcucccugccaccagggc

SEQ ID NO: 5347 - RNA, 78 nt, Human
gcccugagucaaggugcagcaggaucccguugagcugccccauccguagggcguaggggccugcaccgcccucagagc

SEQ ID NO: 5348 - RNA, 90 nt, Human
gcccugcaguucuacgaggcguucccaagggccaggcuaucagagcgacaggcacgggcacugggccugcugagcgccguggagcggggu

SEQ ID NO: 5349 - RNA, 76 nt, Human
gcccugccaagcacagcguagaucuggaaagagcagaaugcuuuccuuuucagauguggcuggucauggaaggggc

SEQ ID NO: 5350 - RNA, 78 nt, Human
gcccugcuggcugaugagcucaucacugucuacagccugccuggcauggacccugacuggcucauuggcgagagaggc

SEQ ID NO: 5351 - RNA, 72 nt, Human
gcccugcuggcugcagagcggcuucagauacggcugucauccaagccaggggagccuuugagccagugcugc

SEQ ID NO: 5352 - RNA, 86 nt, Human
gcccuggugugacuucaagaguucauguuaacuacuuuucuggaaacuuacuuuucuuaguugaugaauucuugaagagccugggc

SEQ ID NO: 5353 - RNA, 83 nt, Human
gcccuuuucccacuuuuuuugcuuguuuaauuuuagagugacaaaacucagauccagcuuguggaugcucuuggggaaacagc

SEQ ID NO: 5354 - RNA, 74 nt, Human
gccgacccuccaaguuagcugacuucugggggaacaacaacgagauccucagugggcuggacauggaggaaggc

SEQ ID NO: 5355 - RNA, 73 nt, Human
gccgcaccaggucuuguagcagcgccuccucgagaagccaacagagcaguaagcgcagcagccggaguguggc

SEQ ID NO: 5356 - RNA, 109 nt, Human
gccgcaccucccccagcccugugcucaccucccuaaacagacucuggaguucaagauccaguguccaaugcaccaugggugaauucacagcagugguggaggcagcagc

SEQ ID NO: 5357 - RNA, 62 nt, Human
gccgcaggagggcucggccgugcugcgggaaaugcucucggucggccuaggcuuucugcugc

SEQ ID NO: 5358 - RNA, 79 nt, Human
gccgcccucagugucuggggccccagggcagagagucaccauccccugcacugggagcagcuccaacauuggggcaggu

SEQ ID NO: 5359 - RNA, 60 nt, Human
gccgccgccgcccggcuccgcucgcggccccucugucugcaggcgugccccggcggcggc

SEQ ID NO: 5360 - RNA, 64 nt, Human
gccgcgccauguccugcuuggcccgcugcagggcggccuccagcucggacaacuaggcguuggc

SEQ ID NO: 5361 - RNA, 76 nt, Human
gccgcgcuguugccgcggcuuguuauucuuaaaauggcgccgcuagaccuggacaaguauguggaaauagcgcggc

SEQ ID NO: 5362 - RNA, 83 nt, Human
gccgcguugcgggccgcccggcuucggcaccaggagcuuguccggcugcucgggaucaaggcccagguggcccuguagcuggc

SEQ ID NO: 5363 - RNA, 80 nt, Human
gccgcugggagccuugagagccaugugcaagaggacagauccuguuccugucaccauugcucucgauucacucagcuggc

SEQ ID NO: 5364 - RNA, 74 nt, Human
gccggagcgcgcggggccggaagaggcgggcggccaguggagguccgcagaguuugggcgccaggcgagacggc

SEQ ID NO: 5365 - RNA, 61 nt, Human
gccggcgcccgggcuguguucccuguggaacccacggggccuucucguacccuggcccggc

SEQ ID NO: 5366 - RNA, 78 nt, Human
gccggcgcuugcgcuccugcucgaucuucugcugcuucuccagcuucucagugaugcgggccucgcgcagggacuggc

SEQ ID NO: 5367 - RNA, 61 nt, Human
gccggcggggcgcgggcgcggcggccccggaggaugcugcugagccccggcacugccuggc

SEQ ID NO: 5368 - RNA, 78 nt, Human
gccggguggaggcgaugcgccuagggccgggcuggagccacucgugccacgccaugcuguacgccgccaacccugggc

SEQ ID NO: 5369 - RNA, 63 nt, Human
gccggguugggaccgcugcgggcccgccugccuuuggcgucgccggccguucccguucccggc

SEQ ID NO: 5370 - RNA, 63 nt, Human
gccgguuuggcaccauuugcucuuuauccaccuccuucugaaguuguaaugccaauaaccugu

SEQ ID NO: 5371 - RNA, 75 nt, Human
gccgucggaguccagcacgggaggcguggucuuguaguuguucuccggcuacccauugcucucccacuccacggc

SEQ ID NO: 5372 - RNA, 75 nt, Human
gccgucggaguccagcacgggaggcguggucuuguaguuguucuccggcugcccauugcucucccacuccacggc

SEQ ID NO: 5373 - RNA, 75 nt, Human
gccgucggaguccaucaugggagguguggucuuguaguuguucuccggcugcccauugcucucccacuccacggc

SEQ ID NO: 5374 - RNA, 75 nt, Human
gccgucuccccugcucccggugcucugcgagaucuccccugaccagaucuccacagcccggacccgggggcuggc

SEQ ID NO: 5375 - RNA, 93 nt, Human
gccguggagugggagagcagcgggcagccggagaacaacuacaacaccacgccucccaugcuggacuccgacggcuccuucuuccucuacagc

SEQ ID NO: 5376 - RNA, 86 nt, Human
gccguggcucuuccaggcguccgugugaggguucgugaccaggagacaaugcaggucucgggccucgguggugccugggucucggc

SEQ ID NO: 5377 - RNA, 101 nt, Human
gccguguggacaggggacaacacugccgagugggaccauuugaagaucucuauuccuaugugucucagcuuggggcuggugggacuuuccuucuguggggc

SEQ ID NO: 5378 - RNA, 93 nt, Human
gccuaaauacauuuuugcuuacuagcuauuuaaaauaaauucuuaaucagaggaggccuuuggguuuuauuggucaaaucuuuguaagcuggc

SEQ ID NO: 5379 - RNA, 80 nt, Human
gccuaacucagcuucuaguccuuggaaauuaagcagcucauugaaaauucaagaguuccagccagaagcuacagcuaggc

SEQ ID NO: 5380 - RNA, 105 nt, Human
gccuacugacuuaauaaauuucagaggcagaagagaagcugcagagcucaguccuugacacugaacuuucucacugcuucuaaggguggaagaggucaguuuggu

SEQ ID NO: 5381 - RNA, 72 nt, Human
gccuacugagcagagagugguccagguauugaauggacucaauauccuagaaggacucacauucuagcaggc

SEQ ID NO: 5382 - RNA, 74 nt, Human
gccuagagugaugugccgccugcaggaccagggccucauccuguaccaccagcaccagcacagcugcugugagu

SEQ ID NO: 5383 - RNA, 79 nt, Human
gccuaggaacuuggugacuaucauuugaacaacuaggcagccauacugcagucaguugucauggggucauucccuaggc

SEQ ID NO: 5384 - RNA, 63 nt, Human
gccuagucuuuuccauaaaaugaauaagaaguacauuugguggaguuugagaccagccugggc

SEQ ID NO: 5385 - RNA, 76 nt, Human
gccucacuggcuggguucaaaaagggaggggccaggcacaguggcucacgccuguaaucccggcacuuugggaggc

SEQ ID NO: 5386 - RNA, 92 nt, Human
gccucagagggaaacagggucuacauuucucugggagaaaaagccugcacacagguccccaaggagcagugggcuuugaaucuugauggggu

SEQ ID NO: 5387 - RNA, 82 nt, Human
gccucagccucucaaguagcugggacuacaggcaugugccaacacacccagcuaauuuuugcacuuucaguagagauggggu

SEQ ID NO: 5388 - RNA, 89 nt, Human
gccucaguggaagcaagcaugguagugaguggaagauggcaucagagugucauguucuaccucuuauucuagaugcugguuccuuaggc

SEQ ID NO: 5389 - RNA, 71 nt, Human
gccucccaaacuggugagauuacaggcaugagcaccacaacuggccugaaauucuuaaaggaugggagugu

SEQ ID NO: 5390 - RNA, 74 nt, Human
gccucccggauccaggcguccgggaucugcgccaccagaaccuagccuccugcagaccuccgccaucugggggc

SEQ ID NO: 5391 - RNA, 128 nt, Human
gccuccuguaacagucgccuuuuguguucugcuggcauuuguuugaacacaguccacagguucagugguugcaucucuaaucagcugccaguccccaucccagacauucuuugcaucuaagcugaggu

SEQ ID NO: 5392 - RNA, 60 nt, Human
gccuccuucucaaaacucaaauacucuuuauucaucuaagggucugggagagucgggggu

SEQ ID NO: 5393 - RNA, 71 nt, Human
gccucuauacaaaauugagauggggguugggggcaggggcucaugccugcaaucccagcacuuagggaggc

SEQ ID NO: 5394 - RNA, 61 nt, Human
gccucuccuggggccacuguugggggugggagugagcccaccacagaggccacaggcaggc

SEQ ID NO: 5395 - RNA, 74 nt, Human
gccucuggcuuuaccauugaaauuuaagaacuagaacgauuucuuaaaguaagugugggucaagguccuaaggc

SEQ ID NO: 5396 - RNA, 67 nt, Human
gccucuuacccacugggauaggaaccaaaauguguucacugucccuguuuagccaaggguagguggc

SEQ ID NO: 5397 - RNA, 88 nt, Human
gccucuucugaaggaaaagacaguguaguccugcaaaacaucuugaggacuacuguucgaagauuuuuggaagaauacugagaacggc

SEQ ID NO: 5398 - RNA, 103 nt, Human
gccucuuguggucggaagcaccgagugugcuacuucuauccguggucguaccuugauggagcggaaggcagauuagacaucgaggcuuccggaaaacaaaggc

SEQ ID NO: 5399 - RNA, 89 nt, Human
gccugaagacguacacuggccacaagaaugagaaauacugcauauuugccaauuucucuguuacuggugggaaguggauugugucuggc

SEQ ID NO: 5400 - RNA, 60 nt, Human
gccugacaggacauuugaaauuaagauuggacagcccacuguuuccuacuuccugaaggc

SEQ ID NO: 5401 - RNA, 76 nt, Human
gccugaccuugacucuugugcuggucuuugaaagacaccagaagaaggccaacaccaacacggaccugaggcuggc

SEQ ID NO: 5402 - RNA, 80 nt, Human
gccugaugguauacuacugcuuugcggaauugcauacaacugugcauuacaaaguuaauaugguaauuauggucuggggu

SEQ ID NO: 5403 - RNA, 80 nt, Human
gccuggaauaaaagaggagaaaaaagcuguaagccacaaaaaagugacuaagcuuucucaacuacuuuucuucauaaugc

SEQ ID NO: 5404 - RNA, 70 nt, Human
gccugggacgugcccauuuuuacuguaaauuaugauuccguaacugacuuguaguaagcagguuucuggc

SEQ ID NO: 5405 - RNA, 90 nt, Human
gccugggccgggagugggccacguggggacuacuguguggagcugaccgcacuccccagcaugcuggcauccagcuccccaagggccagc

SEQ ID NO: 5406 - RNA, 87 nt, Human
gccugggcugcccccacuucucccauaauucccugcccuagagcagcaccuccagagcuaggagaaggagagggggccacccaaggc

SEQ ID NO: 5407 - RNA, 69 nt, Human
gccuguccaaucagaggauccauuuuaugguugaugcgaauacaacgguaacccgaucccuugcauggc

SEQ ID NO: 5408 - RNA, 63 nt, Human
gccuguggcuuugacccagugggcuuggccugguuggcaggcccaucgucggaggguucaggc

SEQ ID NO: 5409 - RNA, 82 nt, Human
gccuguguugcccaggcuguuuucaaacuugggcccaagcaguccugcugccucagccuccagaauagcugggauuacaggc

SEQ ID NO: 5410 - RNA, 81 nt, Human
gccuuaagaaaauagcuuccugucucaggcuuucuaggaagucacaaacuaggugucugggaggcaguuuuagguaagugc

SEQ ID NO: 5411 - RNA, 66 nt, Human
gccuuaguucuguucaaauagagaccugaaucaaauauuguaguuuagguucaaacagaguauggc

SEQ ID NO: 5412 - RNA, 76 nt, Human
gccuuccgggcuuuugggcuauuuuacaacauuguagcugauugcaaugcaaaaauagcccggccccuagacaggu

SEQ ID NO: 5413 - RNA, 76 nt, Human
gccuuccuccagcagcagggaggggaggacuggcugucucagaaucuuuuaaaagcccugcugucugaggaccugc

SEQ ID NO: 5414 - RNA, 94 nt, Human
gccuucucagaguacggcucaggcuugggggccggcugcuuggggguccgguugagguggaccccaagccugagccguccuucucagaguacgc

SEQ ID NO: 5415 - RNA, 74 nt, Human
gccuucucucuccuggugcaaaauggcaacucuuaaggagaaaacucauugcaccagcuugcggaagaagaggc

SEQ ID NO: 5416 - RNA, 78 nt, Human
gccuugaaccugagggggauuccacagcuguuuggaggcaucugcuguugauacugcuggaauccagaguggugaggc

SEQ ID NO: 5417 - RNA, 66 nt, Human
gccuugcacacucauuacauuuguaagguuucucuccaguaugaauuuuccgaugucgugcaaggu

SEQ ID NO: 5418 - RNA, 69 nt, Human
gccuuggcgcugccggucccaacuugauccaaggagccuugagaaggagaugagauucaguaccagggc

SEQ ID NO: 5419 - RNA, 86 nt, Human
gccuuguccugaguuucucacuuggcuucaggaaggccccagguaggauuccagaaaccagugaagauguggccacaggaggaggu

SEQ ID NO: 5420 - RNA, 75 nt, Human
gccuugugcauuagaaaccugcagcuuggcaagaacaacaaaaaaggugaaggugucacagucagugcacucagc

SEQ ID NO: 5421 - RNA, 79 nt, Human
gccuuuugcuuuugauuuuaauauaaauacuuauuuuagcuuuauaaguuauugaauguuugauacaaaggauggaggc

SEQ ID NO: 5422 - RNA, 102 nt, Human
gcgaacguugggaacauuuuaggguuuaaugaacuuugucauaaguaacagacgauacguucuuaaagcacaguucuuggauccaccaauacaacguucagc

SEQ ID NO: 5423 - RNA, 77 nt, Human
gcgaagaagggaccccaggucagagacuggagccauuacuucaagaucaucgaggaccugagggcucagaucuucgc

SEQ ID NO: 5424 - RNA, 85 nt, Human
gcgaccacaacuaccaagagcuacauccuuagagcgcucgggcagcugaugcucuuuguggauggaaugcugggggugguggcgc

SEQ ID NO: 5425 - RNA, 65 nt, Human
gcgacccccuccgagaucugcuuauguucccaauggaagauauaucuaucucggugauaggucgu

SEQ ID NO: 5426 - RNA, 61 nt, Human
gcgacgggcaggacgccccguucgccuagcgcgugcucaggaguugguguccugccugcgc

SEQ ID NO: 5427 - RNA, 71 nt, Human
gcgagcuacagcuucaccaccacggcgagcgggaaaucgugcgcgacaucacaggggaagcugugguacgu

SEQ ID NO: 5428 - RNA, 73 nt, Human
gcgaggagcugaggaggggcacaguucuauugccaccaccaccagggcugugccccuggccgccagugggugc

SEQ ID NO: 5429 - RNA, 70 nt, Human
gcgagucgcgcgagaggguggccgacagcggaggcaaacguugugcgcgcgcacaugagcgcgugcucgu

SEQ ID NO: 5430 - RNA, 103 nt, Human
gcgaugacuucuguuucuuccagaugcucaugggugggggugugugucgcacagugacacucaacuucaacaugccaggcgccuuugugcaugaagucauggu

SEQ ID NO: 5431 - RNA, 72 nt, Human
gcgaugcaacagagaagaauaaggaguuucucccgcguuuaggagcuacuauugaacauaucucagucucgc

SEQ ID NO: 5432 - RNA, 83 nt, Human
gcgauggcugcgacgcgugcagggccuugcgcccgcgagaucuucaccucgcuggaguacggaccggugccggagagccacgc

SEQ ID NO: 5433 - RNA, 62 nt, Human
gcgcagcgagcgccggaagcggaggaguaccgacucuuccagcgucucgggcuccuugcagc

SEQ ID NO: 5434 - RNA, 88 nt, Human
gcgcaggucgguagugaggggaucgugcuggaucgucuggugcagcaucagggccagcaaucccgcgcgguuugucaugguugugcgc

SEQ ID NO: 5435 - RNA, 74 nt, Human
gcgcaugugcacguagacgcgcaaugcgggugacgugcuugaccucgcauacaggcuauacguggauaaugcgc

SEQ ID NO: 5436 - RNA, 81 nt, Human
gcgccacugucagcuuagaaggggccuuagggaaccuggcaggaggagucccugaggccaacucuuccugauuuauuuugc

SEQ ID NO: 5437 - RNA, 77 nt, Human
gcgcccccuuggcgccggguguccugccgcugcuugcgcagcggcccuuguuucuucuuacccguuguuaggggcgc

SEQ ID NO: 5438 - RNA, 63 nt, Human
gcgccggagggcuggcacugcugggggacccauuacacccuccgcagccgcuggcccaggugc

SEQ ID NO: 5439 - RNA, 65 nt, Human
gcgccggccgaucccgccuggggacacacucuccugggacuggucccuggcacacucgugggcgc

SEQ ID NO: 5440 - RNA, 83 nt, Human
gcgcgagaaggaaaaauggagugucauuugcagaugucucuggaguggccaauucuauucucauaucauuuccggucucucgc

SEQ ID NO: 5441 - RNA, 95 nt, Human
gcgcgcgggucuugcgaacgaccgccggcucccugacaucuccgucccaccccgccccggagaugauugugugugcggucggcuagccgcgcugc

SEQ ID NO: 5442 - RNA, 76 nt, Human
gcgcgcucgcguccccucgugcgggcuccagccgcagccuuagcuucggcucccggcuuggguggcgcggccgugc

SEQ ID NO: 5443 - RNA, 111 nt, Human
gcgcgcugcuggcucugugcggggcacuggcugccugcggguggcuccugggcgccgaagcccaggagcccggggcgcccgcggcgggcaugaggcggcgccggcggcugc

SEQ ID NO: 5444 - RNA, 87 nt, Human
gcgcggucugcgcguucccauuuuccacaggaggcgccgauuuuuuuucgaaccaccucccgcaagaaaaugguguugucgccgugc

SEQ ID NO: 5445 - RNA, 87 nt, Human
gcgcgucugugauucuuccuucuugacuuuuugcugccuucucuccccgcagcggacuuuaggggauuacaggaugauaggcugcgu

SEQ ID NO: 5446 - RNA, 71 nt, Human
gcgcguggguucccucguggagcccacagguuucuccuggggccaccaagcggggggacaaaacuccgcgc

SEQ ID NO: 5447 - RNA, 82 nt, Human
gcgcucgccuugcagcgguugcgccgagaccauuuccgagaggaaggcuucggacucuuugucaccgugcaaaauguugcgc

SEQ ID NO: 5448 - RNA, 89 nt, Human
gcggagcucgggugguaacgccagcgacggggaguggcuauaaauacagaugaagcuucgcuggcuugccggccccuaaccugcugugc

SEQ ID NO: 5449 - RNA, 65 nt, Human
gcggagcuuaugauacaccaacaauaguagagggguaucauugagaggugauuaggggacucugc

SEQ ID NO: 5450 - RNA, 75 nt, Human
gcggagggcgaggcggcguggacagcggccccggcacccagcgccccgccgcccgcaagccgcgcgcccguccgc

SEQ ID NO: 5451 - RNA, 74 nt, Human
gcggaggugacccugagaguguggcuggggaguaugggcggcacucccucuacaaaaugcuugguuacuucagc

SEQ ID NO: 5452 - RNA, 73 nt, Human
gcggagucucggcgugcccuggggcggcgcgggcgcaggggcgcgugcgcggcgggcugucguuggcuggagc

SEQ ID NO: 5453 - RNA, 89 nt, Human
gcggaguggccgggcccgagugcacgugucugaggagggcacugagcccgaggcgaugcuccaggugcugggccccaagccggcucugc

SEQ ID NO: 5454 - RNA, 89 nt, Human
gcggaguggccgggcccgagugcacgugucugaggagggcacugagcccgaugcgaugcuccaggugcugggccccaagccggcucugc

SEQ ID NO: 5455 - RNA, 71 nt, Human
gcggcaacauucagguccuggaugccagcgacgcuuaucaguuguugcuggcaaucaaacccgacacccgc

SEQ ID NO: 5456 - RNA, 66 nt, Human
gcggcagggcauggugugccucgggcucuauagagccgagcccgcuggguacccgcccgguaccgc

SEQ ID NO: 5457 - RNA, 89 nt, Human
gcggccgcgggccaggcugucacucagguuccugucaaggucaggacauucagcagaaccugugucaggccgcugaggccccgcgcagc

SEQ ID NO: 5458 - RNA, 103 nt, Human
gcggccucauuugcugucaagcuuuucaaagcauggauggcagaaaacagaugccaacucugucacucgucuaugagaaaagccaacuuagacaagaggcugc

SEQ ID NO: 5459 - RNA, 60 nt, Human
gcggccuccuucccaggcucuggggcagcgcaagagggguaggcugggaggggcugccgc

SEQ ID NO: 5460 - RNA, 60 nt, Human
gcggccuccuucccaggcucuggggcagcgcaggagggguaggcugggaggggcugccgc

SEQ ID NO: 5461 - RNA, 65 nt, Human
gcggccucgcugccgcaucccaggcuaagcgcugcgcgcaaagccgugcggagauuggaggccgc

SEQ ID NO: 5462 - RNA, 93 nt, Human
gcggcgaacuucugcacacagcuccaguguuugcucuggaucucgaugacuuucucuagcguggccacugcguugauguugggcuuuugcugc

SEQ ID NO: 5463 - RNA, 89 nt, Human
gcggcucugggcgcuguuguuuggucuuuaggccugcggaggggcguuaucuggagggccgcgggugcaggccgcagugacagggccgc

SEQ ID NO: 5464 - RNA, 97 nt, Human
gcggcugcuagggcagcggugaugaacagugagagauucccacugugaagcauaguggauggauaggaauacuucaucacggcucagccagcguugc

SEQ ID NO: 5465 - RNA, 61 nt, Human
gcggcugcuccggcuucuggccccuggcgggcuucuuguccgcgcgccgggagccggccgc

SEQ ID NO: 5466 - RNA, 87 nt, Human
gcggcugggacccuguacacguauccugaaaacuggagggccuucaaggcucucaucgcugcucaguacagcggggcucagguccgc

SEQ ID NO: 5467 - RNA, 81 nt, Human
gcggcugggguggcagggccgguguuucugugcugauuucaggguacaggacacuguuggcuuuagagaccaccaggcugu

SEQ ID NO: 5468 - RNA, 60 nt, Human
gcggcuguccccugccggggccgcccuacucuggggcuuccugcuccagcugacagccgc

SEQ ID NO: 5469 - RNA, 77 nt, Human
gcgggaggcgugcugggcgcggggcugcggugcccagaggcugcggcauuaggggcucggcgcccccgaccuuccgc

SEQ ID NO: 5470 - RNA, 85 nt, Human
gcgggccgcccacggccacgccgcaguggaagagcaccggcucgccgucguucacgcuguagaacacgcggccguggcggucggc

SEQ ID NO: 5471 - RNA, 73 nt, Human
gcgggccgcugccaugacgaccgccaucuuggagcgccugagcacccugucggucagcgggcagcagcugcgc

SEQ ID NO: 5472 - RNA, 86 nt, Human
gcgggcucucucacgccgcggccucacccggcggugcuucggcaggcggccggcgcggggcgcaggcggcgcggccaugggcucgc

SEQ ID NO: 5473 - RNA, 83 nt, Human
gcgggcugccaucuaguuggacgcggauucucuggcccacaauuucgcuggggaagaccaaguccucaaggauggcaucgugc

SEQ ID NO: 5474 - RNA, 70 nt, Human
gcgggcuuuugucucuggauucgauggcucugcgggcacagccaucaucacagaagagcaugcagccagu

SEQ ID NO: 5475 - RNA, 85 nt, Human
gcggggaacaccaauggcgggguacuugaagcugguguguguuuccuuucagcgucaaggguuccacacuguugggagucgcugc

SEQ ID NO: 5476 - RNA, 87 nt, Human
gcggggaugguccucuguggacaccaagagcuggccuccuaccugggguggccggacauccgcgucugcagagcggggcccacccgc

SEQ ID NO: 5477 - RNA, 72 nt, Human
gcggggccggucguaaccgcgccgcgggccggacgaugcccaagaagcugcugcuguugcccccggccucgc

SEQ ID NO: 5478 - RNA, 96 nt, Human
gcggggcggaggcacucgcgcgggggguaauucggggucuggguucuggugccgcgcagcuuuccccgauggcccacugcgugaccuugguucagc

SEQ ID NO: 5479 - RNA, 63 nt, Human
gcgggggguugcugcgccguccuccacuacuggcuacuggcgcugcagccaugcagcccccgc

SEQ ID NO: 5480 - RNA, 72 nt, Human
gcggggguuaggcgcugagacggauuuggcggugagaucgcuguggccaggcugcagcugaaugggccucgu

SEQ ID NO: 5481 - RNA, 91 nt, Human
gcggucaggacgccgccguagccgccggcguagccccccgaggaggacgaggacacaaagcgggcggaggacacggauacgccgcggccgc

SEQ ID NO: 5482 - RNA, 87 nt, Human
gcgguccgagguggaagaaguggauuuugccggcugguuguguaaaacccugcggcugaaccagcccggcacacccacgcgcaccgc

SEQ ID NO: 5483 - RNA, 71 nt, Human
gcgguucugcgcgccgccgaucuugccgaugcugugcaggcugcagagcgcgcacggcucgcuggagccgc

SEQ ID NO: 5484 - RNA, 80 nt, Human
gcguccgggggaccacgccccacacccgggggacagaacuuagccccgaccccgggugcgcggcguccccccgugggcgc

SEQ ID NO: 5485 - RNA, 92 nt, Human
gcguccuccugcgcugaaccgggagcgcucgggugggacucagggagccuugaucacuucccgccugcgucccggacccgguggaggagcgc

SEQ ID NO: 5486 - RNA, 89 nt, Human
gcgucgccgcgaaugguguuguuggagagcgagcaguuccugacggagcugaccagacuuuuccagaagugccggacgucgggcagcgu

SEQ ID NO: 5487 - RNA, 62 nt, Human
gcgucgccgcgccgcagggccagcaucacgcucuggcucugcaucucgcggcgccgcgacgc

SEQ ID NO: 5488 - RNA, 74 nt, Human
gcgucggacaccugggguggcacacacacgcaaaaugucacgccguguaagacacacccgagggaucaugucgc

SEQ ID NO: 5489 - RNA, 71 nt, Human
gcgucuauagagcaacucacagcauugaagcuagcuucauuaaacaagcuuucacugugaguuacugaugc

SEQ ID NO: 5490 - RNA, 74 nt, Human
gcgugccaagcucgacccccuccgcggccacuacuuccucuucgacugcccaggccagguggagcucugcacgc

SEQ ID NO: 5491 - RNA, 85 nt, Human
gcgugggucucuaccucugucuccacccgcaagugcuggagaucuuuggcuuugagggggcugaugcggaggacgugaucuacgu

SEQ ID NO: 5492 - RNA, 76 nt, Human
gcguucugacgcuuuguacgcucugcguucccaugggccaggaacgcggaugggagacaacacagccucgggaugc

SEQ ID NO: 5493 - RNA, 101 nt, Human
aggccugccgucaugucuaagucagagucuccuaaagagcccgaacagcuaaggaagcucuucauuggaggguugagcuuugaaacaacugaugacagccu

SEQ ID NO: 5494 - RNA, 79 nt, Human
aggccugcucucggggaggguaccgugcauccuugcagauggaaacgccuucaugcuggaccaggccgagggcaggccu

SEQ ID NO: 5495 - RNA, 85 nt, Human
aggcgcugguccccuucaaaagggcagggggaccgcaugggggcgucuuuuucuuaaccuuauugcaagggaauaccgugugccu

SEQ ID NO: 5496 - RNA, 74 nt, Human
aggcuggagcaguggugcgcucucggcacugcaaccucugucugccaguuucaaguaguucuccugcccagccu

SEQ ID NO: 5497 - RNA, 89 nt, Human
agggacauugccuuauuucugcuagaucaaaguagaaguccaguuccucuacuuggcaucuguugauaucuggaaagggugguguuccu

SEQ ID NO: 5498 - RNA, 63 nt, Human
agggagcaucuucucucggacucgggaccugguucgggccggggugcugaaggagaagccccu

SEQ ID NO: 5499 - RNA, 72 nt, Human
agggagccucaaauggcacgguagaaaucucagcuucuaaagggauuaugacauugugcccuguggcuuccu

SEQ ID NO: 5500 - RNA, 75 nt, Human
agggaguaaagauaaucugggcugcuccauaagacagaacaggguagcgggguacuaggcagauuuuagcaaccu

SEQ ID NO: 5501 - RNA, 72 nt, Human
agggccgcgauggcuugcgcccagucgggcaccccagguccgguguuuguggagcugccguugacgugcuuu

SEQ ID NO: 5502 - RNA, 75 nt, Human
agggcugacauggugugagugugugggugugugauaagcuucucaucccugcauagaugcaguauucuuagccuu

SEQ ID NO: 5503 - RNA, 87 nt, Human
agggcugcuaaggaagcaaaaaaggcuaagcaagcaucuaaaaagacugcaauggcugcugcuaaggcaccuacaaaggcagcaccu

SEQ ID NO: 5504 - RNA, 78 nt, Human
aggggaugagggggaagaggagcugccuuuuggaggcccccuucaccugcagcuaugaugcccuuccccuucuccccu

SEQ ID NO: 5505 - RNA, 106 nt, Human
aggggcacauggcauggagaguaaauggcagaaucagaauguggacacaaauuuguuugggucugaauccuguguucuuuucauuauaucgagugucuggccuccu

SEQ ID NO: 5506 - RNA, 76 nt, Human
agggucauggcuaagucauuugauucaguagaaaagagauuauaaauacaugaagggcuacuuaacucaugucccu

SEQ ID NO: 5507 - RNA, 63 nt, Human
aggguuuguucauuauugcugauuuggggccugggucucagggcggggagcacugcaggcccu

SEQ ID NO: 5508 - RNA, 64 nt, Human
agguacguaggauaauucacgucgcuacuagccacaaggaguucuccuuauuuuuaauguaccu

SEQ ID NO: 5509 - RNA, 63 nt, Human
aggucaaauuguguccuccaucacugcuucccugagauuugauggagcccugaauguugaccu

SEQ ID NO: 5510 - RNA, 77 nt, Human
agguccgcgcugugucccguguuuucugcgugagaggaaaagaugcuagaaccacaggagaauggcgugauugaccu

SEQ ID NO: 5511 - RNA, 89 nt, Human
agguccuccuuuccuuuuaauuaaaugaauuaaguacauuaauuuuacuaagugauacgauucaauuuucauugaggaaguguggacuu

SEQ ID NO: 5512 - RNA, 77 nt, Human
aggucuagugcaucuuuuaaccagccgaauggaguccuuuacaaacugccgacuuggcucaacaaacugcauuaccu

SEQ ID NO: 5513 - RNA, 79 nt, Human
aggucucguaaucuuggcuuuugaaguguuuaaaccuucuaucaaacaguuucuuaaauaucauuucuucccggguccu

SEQ ID NO: 5514 - RNA, 81 nt, Human
aggucuggaggggccauggggcaguccugggugugggacaccgucgggguuugacccaggguugucuccccuccagagccu

SEQ ID NO: 5515 - RNA, 93 nt, Human
aggugcacccuguggaauuuggcagaaaaggcccaaucgcccuuuagagggugaacugaagccuguuccugcaauguucuaaggagugccccu

SEQ ID NO: 5516 - RNA, 69 nt, Human
aggugcugaggaguuccggaaccccaaggcauccuugcgugugcggcucugugaccuccugagccaccu

SEQ ID NO: 5517 - RNA, 80 nt, Human
agguggcagagaggcaauaucaauccuucugcaucacacagugggaaaaguuugucucauugcaguucucuuccaagccu

SEQ ID NO: 5518 - RNA, 66 nt, Human
agguggguggaucaccugaggucaggagcucgagaccagccuggccaacauggugaaaccccaucu

SEQ ID NO: 5519 - RNA, 113 nt, Human
aggugugucucaggaaggugguucugugcaugccugggugugguuaaggcguggccagaaggcuucccuggugcucucaguccaggcaaagcccagagcaucugagcacgucu

SEQ ID NO: 5520 - RNA, 60 nt, Human
aguaaaacagguuugaacuucuuaacuuccagaagauaggaggaugggaccugugauacu

SEQ ID NO: 5521 - RNA, 77 nt, Human
aguaccaccugcccagagcaaaucugauggacugacuuccgaucaauagguuugauggccuuagcagguucuguacu

SEQ ID NO: 5522 - RNA, 88 nt, Human
aguacuuguuuuucucugauaagacucaggaauucugaaaugugaaauugucucaauucuuucucuuguagcaugaaucaaauguauu

SEQ ID NO: 5523 - RNA, 76 nt, Human
aguagaggugggguuucaucauaguggucagguugggcuugaacuccugaccucaggugaucugccugccucggcu

SEQ ID NO: 5524 - RNA, 79 nt, Human
aguauacuuuuggacaaucugcagcuauaaaaauauacacauacaaaaguacagcuacagauuguccacacaguauacu

SEQ ID NO: 5525 - RNA, 63 nt, Human
aguauugagggggcaucagaauuggguguacagcugagcauucucuccugacucuucuaugcu

SEQ ID NO: 5526 - RNA, 73 nt, Human
aguauugccuauuugcaugggagaaaugauuucugaaguccgucuccugaaacaugcccuuaugcucuuugcu

SEQ ID NO: 5527 - RNA, 84 nt, Human
aguccaccgacucacugcccgcgcacgcgaccgagucuucgcuauugcugaccuacgucugugcugcgguguguccagggggcu

SEQ ID NO: 5528 - RNA, 68 nt, Human
agucccugcuguguacuagaacgacugagcgugagaguugagagucccugcuguguacuagaacgacu

SEQ ID NO: 5529 - RNA, 75 nt, Human
aguccuagcccugcugagugugacaugcaaagcuucgacccacagcaggaagucucacaguucugggcuaggacu

SEQ ID NO: 5530 - RNA, 111 nt, Human
aguccucagagcaagagaugaccuuaucacagaccuacuaaaugaagcaaaacagagacucagcaaggugguaaaagauacaaccagguaccaagugcugcuggauggacu

SEQ ID NO: 5531 - RNA, 72 nt, Human
agucggaaugguacauugguuuuccuuuaugacggacugcgguuuaaaggcccaacuugaacugcuuggauu

SEQ ID NO: 5532 - RNA, 80 nt, Human
agucuaauauagagauuacuggcuuuaacagugaacuggaauaaugagggcuucacugguaaaaugcuucugaauugacu

SEQ ID NO: 5533 - RNA, 82 nt, Human
agucucacucugucacccaggcuggagugcaguggcaugaucuugguucacugcaaccucugcuucugggauucaagagauu

SEQ ID NO: 5534 - RNA, 62 nt, Human
agucucauguggcugcugcaccuccagauauaugcucucaaacaguguggccugaugaaacu

SEQ ID NO: 5535 - RNA, 66 nt, Human
agucuguauagcaauaugcuuggagaggagaauacuuaucucuggcgcacaucaccuauauuggcu

SEQ ID NO: 5536 - RNA, 83 nt, Human
agucuuacuauguugcccaggcugguccugaacucuuggccucgagagauccugcugccucaaccucccaaguagcuaagauu

SEQ ID NO: 5537 - RNA, 82 nt, Human
agucuugcucugucacccaggcuggagugcaguggugccaucuuggcucacugcaaccuccgccuccccaguucaagugauu

SEQ ID NO: 5538 - RNA, 75 nt, Human
agugaaaguauauugaauuaagagccuauauaguucaccuugccauucgauauaggcucuuaauucaaucucacu

SEQ ID NO: 5539 - RNA, 88 nt, Human
agugagaaaugggacccugccuuacugccaaccuacuguuugaggagccagaaguugacaugaaguugcaaggucaccuuuucaagcu

SEQ ID NO: 5540 - RNA, 73 nt, Human
agugaggggcaggaugaaaucaccuaggguagguauuuagagggagggcgccgugcaaaauaaaauccucacu

SEQ ID NO: 5541 - RNA, 66 nt, Human
agugauggucaguauuucuuugaaauucuacaaggaacuucaggcacauggugcugaugaguuauu

SEQ ID NO: 5542 - RNA, 75 nt, Human
agugccaucuagaugagauaccagggcauuucugaggauguuuuugccccgggccaccucacucuccguggcacu

SEQ ID NO: 5543 - RNA, 73 nt, Human
agugccucuucccucccccugcgaacgcuagaauccgaaccaagugagcccagaacgaaggaacacgggcgcu

SEQ ID NO: 5544 - RNA, 76 nt, Human
aguggcguucagccacccgagauugagcaauaacaggucugugaugcccuuagauguccggggcugcacgcgcgcu

SEQ ID NO: 5545 - RNA, 82 nt, Human
agugguucuucuuaucuccauccccaucggcuuccucuuuaagaaagccgguccugggcugaagagauggggagcagccgcu

SEQ ID NO: 5546 - RNA, 77 nt, Human
aguguaguacuccuuugggggcucuaagggagaauccauuuuccuuccuuugcaagcuccuagaggcuacuugcauu

SEQ ID NO: 5547 - RNA, 96 nt, Human
agugucguggacucuucuguggcaggacuuggaggcugucccuagcgcacagggggcaucaggaaacuuggccacagaagaccuggucuacaugcu

SEQ ID NO: 5548 - RNA, 70 nt, Human
agugugugcauguguguaugugugcgugugcauguaugugugcauaugugugugcauaugugcaugugcu

SEQ ID NO: 5549 - RNA, 105 nt, Human
aguguguuaguaacuugucuaauugaacuaauguuguguccuaauuguuuacauggaaauacuguugagaagaccauuuuguucacuuggcaguuucuucacacu

SEQ ID NO: 5550 - RNA, 98 nt, Human
aguguugcauuacuuugaggcagaucguugucuauuucuucugaaaagucagucugaguugcagaaguaauagugugccuuggaguagcagcagcauu

SEQ ID NO: 5551 - RNA, 75 nt, Human
aguguuuucauccuucuucauggccuccuucccacaaauaucaggaaaaugggaacugaugaggagaguaacauu

SEQ ID NO: 5552 - RNA, 80 nt, Human
aguuaauauagagaauuacuggcuuuaacagugaacuggaauaaugagggcuucacugguaaaaugcuucugaauugacu

SEQ ID NO: 5553 - RNA, 94 nt, Human
aguucaaggcugccuccucucugucuucauuaugugaauugaauguggucacacaucuguguuggagcagaggcaggggcugcagcuuucagcu

SEQ ID NO: 5554 - RNA, 97 nt, Human
aguucauagagaauucuucgcuucauuuuugauggcuggcucugcaaagcaccauguggaguggcagguggagggagcgaggaaccaugaaugaacu

SEQ ID NO: 5555 - RNA, 85 nt, Human
aguuccuaugugccccacaggaaagcgcccuuaaccacugaugaguguugauguuuuucugcacuagaaggcacuauguugaacu

SEQ ID NO: 5556 - RNA, 82 nt, Human
aguucuaggguacaugugcacaacaugcagguuuguuacauagguauacaugugcuauguuggugugcugcacccauuaacu

SEQ ID NO: 5557 - RNA, 76 nt, Human
aguucugaggcuagucuuucuggguuaacugauggucccaagaccucgguuugaccugaccaugaugcccaggacu

SEQ ID NO: 5558 - RNA, 86 nt, Human
aguucugcagggcugcugccucaacauuuuagguucugauagcuguauucucaguccuggagugacagguguagccugcaguuacu

SEQ ID NO: 5559 - RNA, 64 nt, Human
aguugaggacuuugaaucugggacagaacugcaucaccucacucccagagaaaguuggucagcu

SEQ ID NO: 5560 - RNA, 106 nt, Human
aguugaggguauuaagcgcauacugugugacuccaccgggaaaggacucugggacaccgcaccggguuuccgcgggacuucacaccaugugccuuuugccuuugcu

SEQ ID NO: 5561 - RNA, 73 nt, Human
aguuggagcggaaggcaggaugggaccaugaucaccacuggauucguccagcuuuucgcaaaucauuccgacu

SEQ ID NO: 5562 - RNA, 78 nt, Human
aguugugugcguucaacacgauaauaccuguugccacuggaggaacagauggguacgucgugucuggaagugccagcu

SEQ ID NO: 5563 - RNA, 101 nt, Human
aguuuaaggaugucgcaaagucuggguggccuucaguccaugaaagagaacacaucuguucuaucucaggcugaggucaucugcauccucaucaauaagcu

SEQ ID NO: 5564 - RNA, 61 nt, Human
aguuuaguggcaaguucuuuagccuuugccuuuucgagcuuggcgauacgagccacagacu

SEQ ID NO: 5565 - RNA, 79 nt, Human
aguuuaucacucauggugauuugguuuacucuggagaguaaaauauccggugugucaggcaugacaugaaugguggucu

SEQ ID NO: 5566 - RNA, 73 nt, Human
aguuuauccacguuacaaaagcauauuugucucuccucugaguaagaaugcuguguuccuucgcuggacaacu

SEQ ID NO: 5567 - RNA, 91 nt, Human
aguuuaucuagccaauguuugucaauuuuauugauguuuuuaagugauuaacuuuugauuucauugauuuucaccauugguuuucuauucu

SEQ ID NO: 5568 - RNA, 79 nt, Human
aguuucucuggaguauuugcgcuggaaguuucuaaucaaaaccauuagacuuugaguuucacaaacuccucuugaagcu

SEQ ID NO: 5569 - RNA, 80 nt, Human
aguuucuuccuccugggggggucguggucucgcuggcuuuaggagugaagcugcagaccuucgccaagaggauuacaacu

SEQ ID NO: 5570 - RNA, 81 nt, Human
aguuugucccaccccuccccaaagugcuguaagauaccccugcgcuuguggcaauugggaagggugugucagugagaagcu

SEQ ID NO: 5571 - RNA, 61 nt, Human
aguuuguccucuccuuuuauccaagcaggaagauucuauauccugaugguagagacagacu

SEQ ID NO: 5572 - RNA, 82 nt, Human
aguuuuaggguacauguacacaacgugcagguuuguuacauauguauacaugugccauguuggugugcugcacccauuaacu

SEQ ID NO: 5573 - RNA, 74 nt, Human
aguuuugcaccugagacagauagccucacucgccucacccuaguccugguggcauuugucucaggugcaaaauu

SEQ ID NO: 5574 - RNA, 91 nt, Human
auaaaacucugucaaaaaucaaaugacauuucuauucaucauuucacaugugaugaagagaauguauuugcugcaguuggaagggguuuau

SEQ ID NO: 5575 - RNA, 93 nt, Human
auaaacugcuguccagauuguuaauuucauuuauauuuauuuuaauuaauuugucaugaauauggacaaaaccuuuucugggguguggggugu

SEQ ID NO: 5576 - RNA, 80 nt, Human
auacagcuuuuggcuuuuugagcacaccuacgaucuuggaaauacuggaaaaugugauacuuagaauacuuuggcugugu

SEQ ID NO: 5577 - RNA, 63 nt, Human
auacuuacuagcauauuauauagcucuaagaguguagaguuauaugaugugcuagugaagugu

SEQ ID NO: 5578 - RNA, 78 nt, Human
auacuuuaauagaaccaaaguugcagauauuggaauguauggaaguaucucagucucugcauaagaggauuaaaguau

SEQ ID NO: 5579 - RNA, 60 nt, Human
auagcaacgucauggugaagguggccacucagccggcugacaauccccuugacguucuau

SEQ ID NO: 5580 - RNA, 61 nt, Human
auagccuccuugggugucauggaucccagaccgauuaucauguaguaccggaggagacuau

SEQ ID NO: 5581 - RNA, 83 nt, Human
auaggcacguuuccauaacucccuguucccaagguuuggauaaccuaugcucauuuagcaggaacacuacacuacgugcuugu

SEQ ID NO: 5582 - RNA, 88 nt, Human
gcguugcugguguuguuggcguuagcggcagcggcggcggguucgggccgccuuuccugccggaugugugggcggcggcggcggcagc

SEQ ID NO: 5583 - RNA, 66 nt, Human
gcguuuggagaacaucuucuugcuccuuuuccggaaacgagauaauggacacagagucccagacgu

SEQ ID NO: 5584 - RNA, 85 nt, Human
gcuaaaaaagugcaugauggugagagcccaaguuaucuuucccucuucgguguucuucuucucuucucugcaaugcuucuguagc

SEQ ID NO: 5585 - RNA, 68 nt, Human
gcuaagaauucagaugucaggaagucugugaaucuugauggauuuucugagaaaccugacucaauggc

SEQ ID NO: 5586 - RNA, 69 nt, Human
gcuaagugacacgugaaugauaaugugauagccggcuaucacauuaucaugguggagcugucaucuggu

SEQ ID NO: 5587 - RNA, 93 nt, Human
gcuaaguggggcugaaaucaacaaaaggucuuggacuguuggcucagaaaucauccuagaaagcccgcccuguugauaucugucaugcuuagc

SEQ ID NO: 5588 - RNA, 66 nt, Human
gcuacagagcugucugaugcaauacuugaaggauaccccaagagcaagaagcaguucuuuguaagu

SEQ ID NO: 5589 - RNA, 84 nt, Human
gcuacccgccuucgucuccgaguuugcgacucgcggaccggguccccggcgcgaagaggcuggacucggauucguugccugagc

SEQ ID NO: 5590 - RNA, 76 nt, Human
gcuaccggaccugccugggagccagugaagggcgagucagggcacgcguccuggaggcugccagcguccuuguagc

SEQ ID NO: 5591 - RNA, 112 nt, Human
gcuaccugccaaaaauucaugcugagccugaacuuccaagugacagcagaacugaaaaugguaugucugcacaaaugccaaggcuaagugagugacacaggcauguuacagc

SEQ ID NO: 5592 - RNA, 96 nt, Human
gcuacuucuaugugucccaugguacugccacagaagagucucagcucucuccaggauucaguucuaaggucagugccuaagauaaaaauggagugu

SEQ ID NO: 5593 - RNA, 79 nt, Human
gcuagaaggggccugggaggcggggcuggaccuuccugcaagucgcagcuccaccccucacuaacuguuggcccucagc

SEQ ID NO: 5594 - RNA, 61 nt, Human
gcuagagcugagcgaagcgaugccuaaaucaaaggaacuuguuucuucaagcucuucuggc

SEQ ID NO: 5595 - RNA, 93 nt, Human
gcuagagcugccaacagggcuccagggagcuuggcuucuguagaaguucuaaggaagcgguacgaacuccacggcgggugggcgcuaacuagc

SEQ ID NO: 5596 - RNA, 65 nt, Human
gcuagaggccuuugcuagcugcuacagguagguccacacugucgcaggcugcucugucucuuagc

SEQ ID NO: 5597 - RNA, 84 nt, Human
gcuagcuaucugaugagucgcugugccauagcuugaucuauguuucuaucaaauaugguaaguauaaacuucauucauacuggc

SEQ ID NO: 5598 - RNA, 99 nt, Human
gcuaggauuacagguaugagccaccacacccagcuaguuguuuucuuucguuguuguuaauucuuaaaguuggggggggucucaauuuguuauccuggc

SEQ ID NO: 5599 - RNA, 91 nt, Human
gcuaggauugcaccacugcacuccaaccuggacaacagagcaagacccugucucuaggccaggugcaguggcucacaccuguaaucccagc

SEQ ID NO: 5600 - RNA, 61 nt, Human
gcuaguugaccuuugccauuuuccccacaccccuggagaaaagagccaggaucagccaggc

SEQ ID NO: 5601 - RNA, 86 nt, Human
gcuaucuggggccgagagcugcccccugagcuagaacucccauugguggaauuggaguucugcucgcucucagucuccaugauagu

SEQ ID NO: 5602 - RNA, 126 nt, Human
gcuaugggaacgagggguuguggguaggacgcaauuucacuggcagguucucugggccggggcaccuuaguguccagagggaggaagggugggcaagaauccuagauaacccgaaguuucuaaggc

SEQ ID NO: 5603 - RNA, 84 nt, Human
gcucaaacuucccaaaaaauucaccuuugggcuuaaaauaaaaccagaaagcccaaaaggagaauucuuuggaaaguuacaagc

SEQ ID NO: 5604 - RNA, 68 nt, Human
gcucaaccucuuuguucaguauguguaaccuugaagcuaauugguacuacuggauaucugacuggagc

SEQ ID NO: 5605 - RNA, 71 nt, Human
gcucacaaucgagcacacgcgugugcacacacaugugcacagaucagugucagaagcaucgaccugcgagc

SEQ ID NO: 5606 - RNA, 123 nt, Human
gcucacacagcaagucuuugucaaagcuuaggaauggaaguagguuguccccuccuagucaugggaucucuccaacucacuagacaaucuugcuuuacgugcugaugaacaugcucugugagc

SEQ ID NO: 5607 - RNA, 74 nt, Human
gcucaccaacuauaaguaggaauacuggcugaucuugguaggacucagcggguauccaguguaaauuguugagc

SEQ ID NO: 5608 - RNA, 63 nt, Human
gcucagccccucacaguggccucaagugugaugccuuacaaaagcaccacucagaugggcagc

SEQ ID NO: 5609 - RNA, 73 nt, Human
gcucagccuuugccagcagcaacucauugugggggaaagaaucuacagguugccugauggacagcaggugggu

SEQ ID NO: 5610 - RNA, 81 nt, Human
gcucagcgccgcacccggaagaugaggcucgccgugggagcccugacuggucugcgccgucaacuggggcugggucugggc

SEQ ID NO: 5611 - RNA, 88 nt, Human
gcucagcgucgccgcgaugguguuguuggagagcgagcaguuccugacggagcugaccagacuuuuccagaagugccggacgucgggc

SEQ ID NO: 5612 - RNA, 131 nt, Human
gcuccaaagaaccaagagugcaaaucaguccauuucacuuucacugucugagauagggucucuaagacccaggauacaaggguggaauguagcuauauggacucgauuugcuuccggaccuuuuccagagc

SEQ ID NO: 5613 - RNA, 88 nt, Human
gcuccaaggccaccuaguacuuugagaaaguuauacagacaaccaagucaggcuuccucaaucuagcagucuauugccaaaaaggagc

SEQ ID NO: 5614 - RNA, 108 nt, Human
gcucccgucugcagcucccagcaagaucaauccagaaggcaggugauuucugcauuuccaacagagguaccuggcucaucucauugggacugguuagacagugggugc

SEQ ID NO: 5615 - RNA, 76 nt, Human
gcuccgaaaccuuacguucgcugucccuuguaaagacccuagaggcagugauggggaacgccaaggagaaaggggc

SEQ ID NO: 5616 - RNA, 80 nt, Human
gcuccgcaagggggagcugcgcucggcggaccugcccgcgaucaucucaacauggcaggagcugaggcagcugcaggagc

SEQ ID NO: 5617 - RNA, 80 nt, Human
gcuccgccuuuucuggguacuuacgguccugagucucaaguucgucuucgagaugcuguugugccagaagcuggcggagc

SEQ ID NO: 5618 - RNA, 68 nt, Human
gcuccuggcuccuagggcagcgccuagagcacagugugauugcaucaggcgcccuuugaggccagggc

SEQ ID NO: 5619 - RNA, 60 nt, Human
gcucgcugggaaaguccuugcugugaaaucgaagauugaggacuacuuuccagaauuugc

SEQ ID NO: 5620 - RNA, 75 nt, Human
gcucggaacugccgacccgagugcuucccgcagagggcugguggugggagcggagugggucgggcggggccgagc

SEQ ID NO: 5621 - RNA, 61 nt, Human
gcucgucgggccgaaucgccaagacgccggcaaugucggcucgugccgauucggcacgagc

SEQ ID NO: 5622 - RNA, 89 nt, Human
gcucguguggggucuccgguccagggcgcggcaugggcguccuggccgcagcggcgcgcugccugguccggggugcggaccgaaugagc

SEQ ID NO: 5623 - RNA, 113 nt, Human
gcucguugcccaggcuggagugcaauggcgugaucuuggcucaccacaaccuccacuucccagguucaagcgauucucaugccuuagccucccaaguagcugggauuacaggc

SEQ ID NO: 5624 - RNA, 83 nt, Human
gcucucagccuuaguaaggaagcacguggaggagggacggaggagguucccuugcugggcaugcuucguagagggccaggagc

SEQ ID NO: 5625 - RNA, 84 nt, Human
gcucucuuuaucuuucucucucacucauguaugcauacaugcacagagaugcauacacaggugccuaugcaaguacauuuaagc

SEQ ID NO: 5626 - RNA, 86 nt, Human
gcucugcagacacaaagaugaaaagcuuggccacaaaggagcugacggugccguggcgagagagauccaucuugacggucaggagc

SEQ ID NO: 5627 - RNA, 105 nt, Human
gcucugucacccaggcugagugcaggggcaugaucauggcucacugaacuccaccucaugggucagcgaucuccugacucaagcucaaguacuggauuacagggc

SEQ ID NO: 5628 - RNA, 91 nt, Human
gcucugucgcccaggcuggagugcaguggcgcaaucuuggcucaauggcgcgaugacggcucacugcaaccuccaccuccuggguucaagc

SEQ ID NO: 5629 - RNA, 72 nt, Human
gcucuguuacccaggcuggaaugcaguggcacaaucucggcucacugcaaccuccaccucccggguucaagc

SEQ ID NO: 5630 - RNA, 98 nt, Human
gcucuguucacuuauuuucagucuuuuucucucuaugcuucauuuucaauggcuucuguggcuuagucuuuaaguuuacugaucuuuuucugcagugu

SEQ ID NO: 5631 - RNA, 81 nt, Human
gcucuguuucccaggugccagaugugacauccagaugacccagucuccauccucacugucugcaucuguaggagacagagu

SEQ ID NO: 5632 - RNA, 76 nt, Human
gcucuuguugcccaggcuggagugcaguggcaugaucucagcucacugcaaccucugccaccuggguucaagcugu

SEQ ID NO: 5633 - RNA, 89 nt, Human
gcucuuucagauuuuuugauguaggcauuuaaggcuauguacuuuccacuuagcuucaccuuugccauaucccagauguuuugauaggu

SEQ ID NO: 5634 - RNA, 83 nt, Human
gcugaacuguguuuacuggaaaaauucagaggccuaaaguuuaaaauaaaauuuacuucugauguuuuaauuaaaauguuugc

SEQ ID NO: 5635 - RNA, 60 nt, Human
gcugaagguaccuuaacauggggaaucuucuuaaaguuuugacaugcacagaccuugagc

SEQ ID NO: 5636 - RNA, 93 nt, Human
gcugaauuugagccagaucuauaugcuccaucaucacucuccuggggaaaagagccuagauguguucuaucugcauuccugcuuagauucugc

SEQ ID NO: 5637 - RNA, 85 nt, Human
gcugacacgauggagaagguaugugcaggggacuccuggagggggacgagguuuucagcacagccuucauguucucgugcucagc

SEQ ID NO: 5638 - RNA, 63 nt, Human
gcugacuagcauucaagagcuuuugguuuaaaagaucaaaacaucccagcaguguugaucagu

SEQ ID NO: 5639 - RNA, 70 nt, Human
gcugagaagcagugacccgcagaugccggcugaauggacugcuccggucuuggagucacugcuacucagc

SEQ ID NO: 5640 - RNA, 78 nt, Human
gcugagaaggagcuggggauccccgcucuccuggaccccaaugacauggucuccaugagcgucccugacugccucagc

SEQ ID NO: 5641 - RNA, 70 nt, Human
gcugagaucuguaucuguggaccugaauguugaucccucgcuucagauugacauaccugaugcgcucagu

SEQ ID NO: 5642 - RNA, 74 nt, Human
gcugagguucuggaguggcacaggaacaggaggagcaaaugacacugggucuuugugcugaggcaggacacagc

SEQ ID NO: 5643 - RNA, 97 nt, Human
gcugagugaacugcacugugacaagcugcauguggauccugagaacuucaagcuccugggaaaugugcuggugaccguuuuggcaauccauuucggc

SEQ ID NO: 5644 - RNA, 81 nt, Human
gcugagugagccuccgccauccagcaugacaaacuguggccgaccgcagcugugccguggcacgauggcgaggaagccagc

SEQ ID NO: 5645 - RNA, 79 nt, Human
gcugaucuccugccugauguuucugucucagagccaaggccaagaggcccagacagaguugccccaggcccggaucagc

SEQ ID NO: 5646 - RNA, 77 nt, Human
gcugauguggacuucucuuuucuugggcaauggagucuuacucugcuuuuauucucaagaaugguaugcacgucagc

SEQ ID NO: 5647 - RNA, 88 nt, Human
gcugcaaaucucguggccggcggcgaccauggcgcggaucacauccggaugccgcugggcggccauggccacggcgaagauggucagc

SEQ ID NO: 5648 - RNA, 90 nt, Human
gcugcaguggaaaggaguuugugacauugacauugacagcaugaaaaugggucuugccagugcaugugagacugccucccaacacucagc

SEQ ID NO: 5649 - RNA, 62 nt, Human
gcugccagcccaacugcuccagugauaguuuuccaccacuucaccgagagccugggcucagc

SEQ ID NO: 5650 - RNA, 63 nt, Human
gcugccaggaacugccccacuacuguguugcggggguggcaacuuuaggggguuccaggcagc

SEQ ID NO: 5651 - RNA, 62 nt, Human
gcugccgcguggcggacacgccagaaggaggaggccuggggcauggccgcguguguggcagc

SEQ ID NO: 5652 - RNA, 63 nt, Human
gcugccucucugcaaaguugaggcgguggagaacuacugaggacuucugagcagagagguggu

SEQ ID NO: 5653 - RNA, 97 nt, Human
gcugccugcugggucccugggguucgcugggcccugauugcugccguuuccccgcugcagagcucgccgugcgccccgacgggccccgugaugcagc

SEQ ID NO: 5654 - RNA, 73 nt, Human
gcugcggcugcagaaguaccgccugcggaguaacugcaaagaugcuguccgugcgcguugcugcggccguggu

SEQ ID NO: 5655 - RNA, 61 nt, Human
gcugcgguaucccaaggugguccaugcauggcacacggauucaccuugcucacacugcagu

SEQ ID NO: 5656 - RNA, 62 nt, Human
gcugcucacaauaguugauaccccaggauuggagaugcagggauaauaguaauuguggcagc

SEQ ID NO: 5657 - RNA, 80 nt, Human
gcugcucaucgccaguggcgccaaucuccuggcggucaacaccgacgggaacaugcccuaugaccugugugaugaugagc

SEQ ID NO: 5658 - RNA, 83 nt, Human
gcugcuccugcaaacacauuauguguuccuuuucccugagaaauauccuugauguguuugguggcaguaucuacagaagcggc

SEQ ID NO: 5659 - RNA, 95 nt, Human
gcugcugcugauggacugccggccgcaggagcuauacgagucgucgcacaucgagucggccaucaacguggccaucccgggcaucaugcugcggc

SEQ ID NO: 5660 - RNA, 88 nt, Human
gcugcuggagcagcugccuucaggcccugcgccgccuccggaguccauggccggcacgcgcuggguacucggggcgcugcuccggggc

SEQ ID NO: 5661 - RNA, 82 nt, Human
gcugcugguguuagagcaguuccugagccauccugccccaggagaucagagcagggugcaggagcugcauccggagagcggc

SEQ ID NO: 5662 - RNA, 87 nt, Human
gcuggagcccagcaugcuggggagugcggucagcuccacacaguaguccccacguggcccacucccggcccaggcugcuuuccgugu

SEQ ID NO: 5663 - RNA, 91 nt, Human
gcuggagccugcagccgcagcugguaguccaucugugcgucgauuccugcagagaugcagcgccgggcugugugggugcugugguaccagc

SEQ ID NO: 5664 - RNA, 75 nt, Human
gcuggagcgcaguggugugaucacagcucaguguaaccucaaacauugggguucaagccauucuccugccucagc

SEQ ID NO: 5665 - RNA, 94 nt, Human
gcuggagugcacucgcgcgggggguaauucggggucuggguucuggugccugcgcagcuuuccccgauggcccacugcgugaccuugguucagc

SEQ ID NO: 5666 - RNA, 102 nt, Human
gcuggaugaugaauccuuguuuuucagguggcuccaaaaagaauguugcauguguucagaccauccugagcagagccaccaaauuuagugacagugucuagc

SEQ ID NO: 5667 - RNA, 73 nt, Human
gcuggcaaaauuuuguucugacagacuacuuuauucuugucaaggaaaguuugucaguggaaacuaugucagu

SEQ ID NO: 5668 - RNA, 107 nt, Human
gcuggccaagggaguuaggggugcuaugugaaccuaguccagucaagauccaucccuuggcaccggacacgguggcucacgccuguaaucccaccacuuuggcaggc

SEQ ID NO: 5669 - RNA, 64 nt, Human
gcuggccgagguguguuugguggccggggccgaggugggaucccgggcacaggcagaggccagc

SEQ ID NO: 5670 - RNA, 100 nt, Human
gcuggcgcgcgagaacgccgccaugcgccuggagcucgacgcgcugcgcggcaagugcgaggcgcugcagggcuucgcgcgcuccguggccgccgcccgc

SEQ ID NO: 5671 - RNA, 75 nt, Human
gcugggaagugguuaagugugcccacccguguucuccuccaaaugcuugucgggcaagauuagcuccuuucaugc

SEQ ID NO: 5672 - RNA, 73 nt, Human
gcugggagccuugagagccaugugcaagaggacagauccuguuccugucaccauugcucucgauucacucagc

SEQ ID NO: 5673 - RNA, 71 nt, Human
gcuggggagggaguuuacauguuuucuaauggagccauuaucuguuggaggcauucauuccccucaccagc

SEQ ID NO: 5674 - RNA, 69 nt, Human
gcuggggucccauaggauguccucauaugggcuuagaacugggcccgacagccauccuugagccccagu

SEQ ID NO: 5675 - RNA, 70 nt, Human
gcuggggugcuaggacuuggugcauguguucuuucuaguccuuacgauguucccaccuggaugccccagc

SEQ ID NO: 5676 - RNA, 62 nt, Human
gcugguaacugauaagggggcaccgcugaggggcgggcccccucaaggcgggaguugccggc

SEQ ID NO: 5677 - RNA, 87 nt, Human
gcugguacgaucaauaccauaugaccagagcccaggcccaaagcaucuugcuuugguugcuacauucugguguugaugggugccagu

SEQ ID NO: 5678 - RNA, 74 nt, Human
gcuggugaugaccuugaagcuguagccaaauuucuggacucuacaggcucaagauuagauuaucgucgcuaugc

SEQ ID NO: 5679 - RNA, 89 nt, Human
gcuggugggggauaaucugcagucuuacuuuuaaguuagaaacaccaauaaauuuaguauacagacgacagugaacuuucacuuacagc

SEQ ID NO: 5680 - RNA, 61 nt, Human
gcugguggugggcggggacggccgguucuacaugaaggaggccauccagcucaucgcucgc

SEQ ID NO: 5681 - RNA, 71 nt, Human
gcugguuuccuggccgaggcggagcugcugaaccugaggaagaucagcuccgacuuggacgggcacccggu

SEQ ID NO: 5682 - RNA, 71 nt, Human
gcuguaaaacacucuacacaauuucacaagacgcauugcaggggaaaaagugacugagauggaucaacagu

SEQ ID NO: 5683 - RNA, 85 nt, Human
gcugucagaucagguuccugauuggaguucucuuaucugcucugguuuggagggcugccccauucgggaaucuguuuuguuuugc

SEQ ID NO: 5684 - RNA, 89 nt, Human
gcugucggugccgguugcgucaucuuccugcucaucaucaucuuccugacgguccuacuacugaagcuacgcaggcggcaccgaaaggc

SEQ ID NO: 5685 - RNA, 84 nt, Human
gcuguucagagccaugcaguugcugaagaggaagccagaaaagcccaccaacucuggcuuucaguggaggcauuaaaguacagc

SEQ ID NO: 5686 - RNA, 93 nt, Human
gcuguugggucguguaguugaugcccuugguaaugcuauugauggaaaggguccaauugguuccaagacgcguaggcgaguuggucugaaagc

SEQ ID NO: 5687 - RNA, 70 nt, Human
gcuguugguggaucuaccauucugguguuuggaggacaguggcccucuucucacagaucuacuaggcagu

SEQ ID NO: 5688 - RNA, 81 nt, Human
gcuuaaugauccugaagggauuucuucugaugguagcuuuuguauuaucaaguaagauucuauuuucaguuguguguaagc

SEQ ID NO: 5689 - RNA, 109 nt, Human
gcuuacaauugcugguaccugguagcauuuauuuucccucaaguaccuaguaaccuuaugaagguagggaggguagaugcucuaccacauuccuucagcuguauugagu

SEQ ID NO: 5690 - RNA, 77 nt, Human
gcuuacauggaagaguauauaugggaaaauagcucaucagaaagaaauauccuggaaacgcuucuccagaugaaagc

SEQ ID NO: 5691 - RNA, 72 nt, Human
gcuuaccaggaagcauuugaaauuaguaagaaagaaaauugcagcuacacacccaauucgucuuggucuggc

SEQ ID NO: 5692 - RNA, 76 nt, Human
gcuuacuuaaacugcaucauucucauuuauauuauacagaccauuuuggauaauaugcucaaaaauggaggaaagc

SEQ ID NO: 5693 - RNA, 67 nt, Human
gcuucaaccugaguucugcguuauaaagccuggagaaagcuaagcuuagaacauaacuugcugaagu

SEQ ID NO: 5694 - RNA, 78 nt, Human
gcuucaguucagaaauuuaguaaugggccaggugugguggcucaugccuacaaucccagcaauuuaggaggcugaggc

SEQ ID NO: 5695 - RNA, 74 nt, Human
gcuucauccuguuccacaauccugaguauaacaagaacaccucgaaguuugaugggacaagacucuaugaaagc

SEQ ID NO: 5696 - RNA, 73 nt, Human
gcuucauuacugaaguagcuacauuagcgaaaacaguguuauuuuuguugcaguuacaaagcuaccaggaagc

SEQ ID NO: 5697 - RNA, 69 nt, Human
gcuuccaauuuguuaucaggugacucuggaguaugccaguuugagugaaccuagagacaaaugcucugc

SEQ ID NO: 5698 - RNA, 77 nt, Human
gcuuccccuccagucccccugggggcaggugguggcuccguguccccugcuagacggagggcccucgagggugaggc

SEQ ID NO: 5699 - RNA, 101 nt, Human
gcuuccuaucucagcgcccugccgccgccgccgcggccagcgagcggcccuguaugcaggccaucaagugugugguggugggagacggagcuguaggguac

SEQ ID NO: 5700 - RNA, 74 nt, Human
gcuuccucaccaccuugugcacugcugcucccacaccacagugacuagcagcacauaaugguuugaauuaaagc

SEQ ID NO: 5701 - RNA, 71 nt, Human
gcuucuacuucugguguuuuugguggcuuguuuuaucaacaggaaaugccagaaacagaggaagaagaagc

SEQ ID NO: 5702 - RNA, 81 nt, Human
gcuucugacacaggacggucguggagaagaugcccuggaggagccacuugggcuuguuuuuccaccagaccccgaagaagu

SEQ ID NO: 5703 - RNA, 70 nt, Human
gcuugaacccgggaggcagagguugcagugagcugagauggcacuacugcacugcagccugguacaaagc

SEQ ID NO: 5704 - RNA, 77 nt, Human
gcuugaagucagcgucuuccauuccagaaagacccccauucuuccuuuggggguaugauguggaagcugguuucagc

SEQ ID NO: 5705 - RNA, 77 nt, Human
gcuugcuggguuuacagauggcaaagaucuggcaaauuaaaaauagccuuaggccaaagaucaaacccaaggugggc

SEQ ID NO: 5706 - RNA, 73 nt, Human
gcuuggaggugaaacuugugcuuguauccccagccacgaagagcuggaccagcuucaaguacauguccacagc

SEQ ID NO: 5707 - RNA, 79 nt, Human
gcuugggugacagagugaaagccccaucucuaaauaaauaaauaaagagagguccugauucaguuuaucaaucccaugu

SEQ ID NO: 5708 - RNA, 77 nt, Human
gcuuguaacuacugaucuugagcucauaaaauaccuaaauaaugugguggaacaacugaaagauugguuauacaagu

SEQ ID NO: 5709 - RNA, 95 nt, Human
gcuugucucaugccucgccguggagcugcagugcuggugcgccuggggugaccugggacucgccugcugcucuguggccuucgugcgcgacaagc

SEQ ID NO: 5710 - RNA, 72 nt, Human
gcuuuaacccuucuacagacacgggcccucuccucggugaggagggaccucgggcauguguggggugguggu

SEQ ID NO: 5711 - RNA, 75 nt, Human
gcuuucagugcaguuucaaacauuuucacaacaggcaauaguccaugagaauuuggaaugacaguauagaauggc

SEQ ID NO: 5712 - RNA, 80 nt, Human
gcuuucaucaucacagggcagacaauauacacgaaaaguggauauugaagguacuggucugugcugguagcuuggggggc

SEQ ID NO: 5713 - RNA, 60 nt, Human
gcuuucccaaccuucuugguauaaagguaaacaauucuauuaccagggguucgggacagc

SEQ ID NO: 5714 - RNA, 62 nt, Human
gcuuuccuuuccaagaggaauccucggcagauaaacguggacuguccucuacagaaggaagc

SEQ ID NO: 5715 - RNA, 78 nt, Human
gcuuugaaagagauguggugugugaagacgaagaugccuuuuguuugucuuuggagaauauugcaacacuacaaaagu

SEQ ID NO: 5716 - RNA, 130 nt, Human
gcuuugagaauuuaauaccacugggaagaaguaugguagugguggaugaaggguggauauuuuaaauugugcaguuacaguuuacuguccuauuaccucugcucguuuaaccaguuuguuauaucacugu

SEQ ID NO: 5717 - RNA, 104 nt, Human
gcuuuggaaaagauuauguaacuccuugagagcauacucuuucucuagcccaaaggcagugagagaguuuucuuguucaggauugcuuaacuuuccauuuaagc

SEQ ID NO: 5718 - RNA, 92 nt, Human
gcuuugggcgggacaagguaaccuuuuccuuugaggcaggccgucgcugcgucucuggagagggcaacuuugaguucgaaacccggcaaggc

SEQ ID NO: 5719 - RNA, 61 nt, Human
gcuuugugcucaggcaucacauagcaggcagccugcagccuuucuugccugagagaagagu

SEQ ID NO: 5720 - RNA, 79 nt, Human
gcuuuucuaguuugcaacuucuaaucugcugugagucaggaaaacauauggcagaguuaaauugugcuuuugguuaggu

SEQ ID NO: 5721 - RNA, 74 nt, Human
gcuuuucuugaucacuguggcuggggacccgcuagcgcguuaucauccugugucgcaguggcauuuagucuggc

SEQ ID NO: 5722 - RNA, 75 nt, Human
gcuuuucuuggaaugaaugcauuuuugaagucucagggggauuucuucugacuucuaaugcugucacagagaggc

SEQ ID NO: 5723 - RNA, 68 nt, Human
gcuuuuggaauaccuaucagaguauauacacaugagguaguaacacucugguacagaucuccagaagu

SEQ ID NO: 5724 - RNA, 91 nt, Human
gcuuuugggaagugaugagucauuuugcaccagguaauaggggaaaauugugugaccuccagcaaacacaugaaugguuauuuccuggagc

SEQ ID NO: 5725 - RNA, 113 nt, Human
gcuuuuucuccccuuugccgauucagaaugcugcuuugucaauuugugugccugcuguaggaacugguccguuuuccaagugugacagugcaggcagagaaggguggaugagc

SEQ ID NO: 5726 - RNA, 71 nt, Human
ggaaaaauggagaaaucaggagugaggcacuuaaaaaagauggcuaaaauuuucuggacuucaucaaagcc

SEQ ID NO: 5727 - RNA, 97 nt, Human
ggaaaaccauuguguaaaacaguaggcggaucuuucagagacuccaaaucauugacaauucagaaggaucuugucgcugcauuugacaacggagacc

SEQ ID NO: 5728 - RNA, 104 nt, Human
ggaaaagcaagccaggaggugcuugcggccgcuucuaguaguuuccaggcgcugccgggcggcuggcacuaagcgguccugagcgcuguggcuacggcugcucc

SEQ ID NO: 5729 - RNA, 86 nt, Human
ggaaaaucuaaagcuugucuuguagguucgaaccgggggaaauucccgggacccgguaaccgugcaaggcgguaccaagcuuuucc

SEQ ID NO: 5730 - RNA, 77 nt, Human
ggaaaaugaguggaagaccuggcucccucucuucucucccguuaggcacaagacgguguaaauccuggucuuccucc

SEQ ID NO: 5731 - RNA, 71 nt, Human
ggaaacagaccucaagcagcacucccugggggcaggacccugccauucugugcuguuugggggcaguuucu

SEQ ID NO: 5732 - RNA, 94 nt, Human
ggaaaccgccggccugggaggacaagccgaguucuuguuuugccgagagcaaaacucuaggcucccacuuccuucucccaguccgugcguuucc

SEQ ID NO: 5733 - RNA, 102 nt, Human
ggaaacuucaguuuuuauaaucuuccuaaauugauccuuuauguugauaaacagugucgauauuaaggagcucauuaauuuuggaagauccauaucugaucc

SEQ ID NO: 5734 - RNA, 81 nt, Human
ggaaagaauaaaggcuuggacucagccuagguucaaguacugcaucuugaccuggccuguaggcaagucuuuucacuucuc

SEQ ID NO: 5735 - RNA, 60 nt, Human
ggaaaggaugucugugucaggcauguuaacuucaaacaaaaucugagaucggcuuuuucc

SEQ ID NO: 5736 - RNA, 98 nt, Human
ggaaaguacucaccaggagucuuguucgucugagagguuucagaguucgauuccagaauuuacagacaugaacgcaaccggaacugugaguaucuucc

SEQ ID NO: 5737 - RNA, 102 nt, Human
ggaaaugggagaaacucccaggcaggaacaccuuuugcugugauggccgcgucaugauggcccggcaaaagggcauuuucuaccugacccuuuuccucaucc

SEQ ID NO: 5738 - RNA, 118 nt, Human
ggaaauguggagaauuaaaaaggguagugaggcuggcauuuauagaaucuggcuuucuuguauuggguggaaagcuagaugaaaccaguuucucucagccuuuucucuccucaggucu

SEQ ID NO: 5739 - RNA, 72 nt, Human
ggaacaagguguuaacaggccugggaaucuagaaaaucccaucagcuucaccauuuuguuuucauuuugucu

SEQ ID NO: 5740 - RNA, 72 nt, Human
ggaacacgauggcuggacuaugucagggcucgucuucgaaagugcagugacauuucaguauucgugacaucc

SEQ ID NO: 5741 - RNA, 71 nt, Human
ggaacagggagggccugugucuggccaggcugagguuccagaucuguugccaucauggccccuucaggucc

SEQ ID NO: 5742 - RNA, 72 nt, Human
ggaacagggagggccugugucuggccaggcugagguuccagaucuguugccaucauggccccuucaggugcc

SEQ ID NO: 5743 - RNA, 65 nt, Human
ggaacauuagucugaacugcaguuggaccuccugaccaagcacugcguucucacacuagugugcc

SEQ ID NO: 5744 - RNA, 80 nt, Human
ggaacucugcuuugccucacaucauaucauuauggcucagaaugaacugcugagcuuuacuaugagugaaagaagcagcc

SEQ ID NO: 5745 - RNA, 82 nt, Human
ggaagagagcgaugacaccccugcgccggaguccgacuccaagcggaccccagcgucucgguccaucccagcgucucggucc

SEQ ID NO: 5746 - RNA, 71 nt, Human
ggaagagguauaccugucucuaaaggaagcgcacgucaguuuccaaacagaagcaagagguggaacccucc

SEQ ID NO: 5747 - RNA, 93 nt, Human
ggaagaguauuaaagaccauuucuggcugggcagggcacucucagcagcucaacugcccagcgugaccaguggccaccucugcagugucuucc

SEQ ID NO: 5748 - RNA, 96 nt, Human
ggaagaguugcuaaaugaauucagugaagguuggaguacaguggcaggaauuuggucacugcagccuugacuuccugggcucaagcgaucuuuucc

SEQ ID NO: 5749 - RNA, 73 nt, Human
ggaagaucacucugcucugauuauggaaaagucuucaagggcugcuucaaacucaaacacagagagaaacucu

SEQ ID NO: 5750 - RNA, 89 nt, Human
ggaagauuguuucagggugucucagggucccucuguaccaucugcuguggaaugcaggacccucugugacauucuuuaucccuucuucc

SEQ ID NO: 5751 - RNA, 76 nt, Human
ggaagcaaagaugacuuccucauauaugauagauguggccgucugguauaucaucuggguugccuuuuugccuucc

SEQ ID NO: 5752 - RNA, 109 nt, Human
ggaagcacauacucagaccuguuuuguuaacuagaauucuuuaaaagcugaugccaaacaucuuuacagaggaacuguaguucacauccaccugucugacauugucccc

SEQ ID NO: 5753 - RNA, 127 nt, Human
ggaagcaucccugcugcggacgcuuucacuucuaaagagucuugucugcuaauaagagugcccauggcccaggguggcagcagggggauuuagaaagggcaugaugauggcacuagcggcugcuuuc

SEQ ID NO: 5754 - RNA, 127 nt, Human
ggaagccgucagccaagucgccacauuucucugcaaaaugucauagcuuauauuaauguacaguauuccaugguaugcugccuuccguuguaaguagcagaucucuccgugacuugacacggcuacu

SEQ ID NO: 5755 - RNA, 98 nt, Human
ggaagcugugaugggaaaggaggccugcacuuggaccuugaaccucaagccucaagcuccaguggggaccuuguuaaaugcuccugucaagagcucuc

SEQ ID NO: 5756 - RNA, 89 nt, Human
ggaaggaaugaucuaaaggagaggagucauugggauaaggccagccucucauauucuucaacuuuucuccucuggucccuguucuuucc

SEQ ID NO: 5757 - RNA, 71 nt, Human
ggaaggacuuucuguuauugcaaaguugguaaauaaagaugccaagguuacuaacaucacgaauuuccucc

SEQ ID NO: 5758 - RNA, 109 nt, Human
ggaaggagcuauucaccaaaaucugcaaauguaaacugaaggacaucgcauguuuaaaaugugggaacuuuguaguuuaucaugugauuguuccauguaguuccugucu

SEQ ID NO: 5759 - RNA, 73 nt, Human
ggaaggagggcggugucggcaggagccagggguguccucuggcuucccaaagcuagggccguucccuccuucc

SEQ ID NO: 5760 - RNA, 69 nt, Human
ggaagggguaaacccagguuccucuucuugagucaaucuccagaaugggacauggguucaucuccaucc

SEQ ID NO: 5761 - RNA, 105 nt, Human
ggaaggugcaacguaagagcagacacaaccugagaugcccuugagauuuaggagaacaggagggcgcccuuucuguugugaccugacucuuaaaagaaaucuucu

SEQ ID NO: 5762 - RNA, 74 nt, Human
ggaagugggcagcaagaucuacguggaugaugggcuuauuucucuccaggugaagcagaaaggugccgacuucc

SEQ ID NO: 5763 - RNA, 68 nt, Human
ggaauaggcuaaauugcuagagaugugcuguggaauuaucuguauuucuagcuaugaucuuagcuucc

SEQ ID NO: 5764 - RNA, 69 nt, Human
ggaauaggcuaaauuugcuagagaugugcuguggaauuaucuguauuucuagcuaugaucuuagcuucc

SEQ ID NO: 5765 - RNA, 68 nt, Human
ggaauccagggagaacuggagccuguuuuaugcuggcauggaacuuggccucaguacgucuggguucu

SEQ ID NO: 5766 - RNA, 88 nt, Human
ggaaucuugcucugucacccaggcuggagugcaguggugcaaucucggcucacugcaaccuccaacuccuggguucaagcaauucucc

SEQ ID NO: 5767 - RNA, 69 nt, Human
ggaaugaaacuggggucuucaaaguggguugugacaaucuggcaaccuuugaaacccuuugcuuauucc

SEQ ID NO: 5768 - RNA, 64 nt, Human
ggaauggguauugugggaauugggagaauaugaugucaaguauccagccuugauacccauuacc

SEQ ID NO: 5769 - RNA, 71 nt, Human
ggaauggugacaacaugcuuggagccaagugcuaacaugccuugguuccagggauggcaagucaccguaac

SEQ ID NO: 5770 - RNA, 86 nt, Human
ggaauguaaguaagugacaaugcuuauggaaagccaguuaguuagaauuggaaaucugucuugucauuuuacaagcauuagauucc

SEQ ID NO: 5771 - RNA, 87 nt, Human
ggaauugaaaaguaaaaacaaagugugcauuuuccuuacuacguuuagucaggaauaugcggucauuuuauugguuacuggguuucc

SEQ ID NO: 5772 - RNA, 83 nt, Human
ggacagacaugaugacuuugagcucugaggcaaaggugauaauggcaacgcucacauugaucucaaagcugaagauccugucc

SEQ ID NO: 5773 - RNA, 79 nt, Human
ggacauaguggaagugagcuacaacguuauacgugucguguaguacgaugucuagugaugaguuugcuaauacaaugcc

SEQ ID NO: 5774 - RNA, 74 nt, Human
ggacaugguaaccugguccacggagggcggccgccacccucgcguagcuuuccugugguuuuccaggacugucc

SEQ ID NO: 5775 - RNA, 68 nt, Human
ggaccaacugauaccucgcuauguagcuuuacuccuuuauccucuagguggcguauuagaauggugcc

SEQ ID NO: 5776 - RNA, 71 nt, Human
ggaccaagcaagucaggaguguggccauguuuucugagcaggcugcccagagggcccacacucuacugucc

SEQ ID NO: 5777 - RNA, 85 nt, Human
ggaccagacuauugugacauggagaauguagaggaauuauucaauguucaggaucaacaugaucuccucacucuaggauggaucc

SEQ ID NO: 5778 - RNA, 75 nt, Human
ggaccaguuggggcggaaagggaaaaccgccuggccggccaguugcaaaggccuuuucgccgcgaauaagggucc

SEQ ID NO: 5779 - RNA, 107 nt, Human
ggaccccagggagcaaaaucaucccuuuuuaacuugagaaucuugaggggcuuuuaagaggagacucucuugauugguaagucuuaagguugcuuuugcccuguucc

SEQ ID NO: 5780 - RNA, 66 nt, Human
ggacccucccuggccuccauucagggagaaacucuccuucacgugugagacgggccaagagggucc

SEQ ID NO: 5781 - RNA, 89 nt, Human
ggacccuuguggcuccacuuguccucaccagucgggacuucagcugaaccucugagugccaaggacaccacuggaacucacaaaggucu

SEQ ID NO: 5782 - RNA, 103 nt, Human
ggaccguuauaugagcgggcgcgagcugaggagcugcaacacagccguguaccacugaccacugcugaguuggggccuuauaguggggcugcccgcacggccc

SEQ ID NO: 5783 - RNA, 66 nt, Human
ggaccuuguugcaccucguggcugcuuuguucacccgcagggcggccugugggcaccccgggguuc

SEQ ID NO: 5784 - RNA, 72 nt, Human
ggacgaauccuuaguacuguggaaaagagcagacagaaauauaaccagcuucucucacaguggaauucgucc

SEQ ID NO: 5785 - RNA, 90 nt, Human
ggacgagagagccgaggacaagggggauccguuuggacgugaccgucaucguccagcuggucaccuuucuccucucaugugccuuuguuc

SEQ ID NO: 5786 - RNA, 82 nt, Human
ggacgaggagaugaaccgcaugcaugagagcaugaagcuauucgauagcaucugcaacaacaagugguucacagacacgucc

SEQ ID NO: 5787 - RNA, 73 nt, Human
ggacggaggcaauaaauacugauggccaagcggggcuccuggcugggcccaaguggggugggugaggcugucc

SEQ ID NO: 5788 - RNA, 84 nt, Human
ggacgugacgggcggcuacguuucucacaggcugccaaggcaagauggacgagcaacguggacacguuaugaacgaucgggucc

SEQ ID NO: 5789 - RNA, 101 nt, Human
ggacuacaggcacaugcaaccacaucuggcuaauuuucuugaguuuuaguagagacugggucucauuauguuguccaggcuggucccaagcuccugaguuc

SEQ ID NO: 5790 - RNA, 92 nt, Human
ggacucauagugguagauagcuuauuggucaggguagauagagauauguuuucuguguaacugucuaguuuuuguccuaccauucggagacu

SEQ ID NO: 5791 - RNA, 107 nt, Human
ggacucguguguaagaaaaacuaggacugugugguguaaauaacuacaauucucuuaacuccguagcaguugccaacucaguccuuguacuucguuaacacgaaucu

SEQ ID NO: 5792 - RNA, 93 nt, Human
ggacugcauccuaccaccaacucguccaacugacaagcccuugcggcugccucuccaggaugucuacgaaauuggugguauuggaacuguucc

SEQ ID NO: 5793 - RNA, 79 nt, Human
ggacuggugauucauuuguguaacucacugaagccaaaauacuaucuuuuaagaugucccacauggaagacgcuauucc

SEQ ID NO: 5794 - RNA, 68 nt, Human
ggacuuagaaguaguauguuauuccugguuaagcaggcaugcuugcccuggagcagcuauuuuaagcc

SEQ ID NO: 5795 - RNA, 93 nt, Human
ggacuucuuuccuagguuucuuuacagaacggguuggggucgagaaagauuccgaagaucaguuacgcuguuuuaaaaccuaggugggaguuu

SEQ ID NO: 5796 - RNA, 106 nt, Human
ggacuuggccaagcccagcuugaagacacugggucugcagcgucucucuaagaaauccucuaucuucaggcccaggauguaauccagcuucaucuugcccucaucc

SEQ ID NO: 5797 - RNA, 78 nt, Human
ggacuuuuauuuccaccuguugacaggacagcaggaggacugccugcccuuccuggucugacgguugcuguguuguuc

SEQ ID NO: 5798 - RNA, 79 nt, Human
ggacuuuuccuuuccugcuuuucacuugaagguucccugugcaaccgacggaaagaucggggaaacuccggaaguauuc

SEQ ID NO: 5799 - RNA, 88 nt, Human
ggagaaccgcuugaacccaggagacagagguugcugugagccgaaauagugcuacugcagucgagcuugggcgacagagugagaaucc

SEQ ID NO: 5800 - RNA, 77 nt, Human
ggagaacuuuugugucuagcucagggauuguuaacgcaccaaucagcacccugucaaaacggaccaaucaacucucu

SEQ ID NO: 5801 - RNA, 93 nt, Human
ggagaagaggucuugcauaccagcacaguggauggggaauggugugaccucugucccugcucucuucucugcuggcuuaagggucuauucucc

SEQ ID NO: 5802 - RNA, 88 nt, Human
ggagaaucacuugaaccagggagguggagguugcagugagcugagauugcaccauugcacuccagccugggugaaaaagcgagacucc

SEQ ID NO: 5803 - RNA, 88 nt, Human
ggagaaucacuugaacccaggaggcagagguugcagugagcugagauggugccacugcacuacagccugggcaacagagugagacucc

SEQ ID NO: 5804 - RNA, 88 nt, Human
ggagaaucacuugaacccaggagguggagguugcagugagccaagaucgugccacugcacuccagccugggugauagagcaagacucc

SEQ ID NO: 5805 - RNA, 88 nt, Human
ggagaaucacuugaacccaggagguggagguugcagugagcugagauugcaccacugcacuccagccugggugacagaaugagacucu

SEQ ID NO: 5806 - RNA, 88 nt, Human
ggagaaucacuugaaccugggaagugcggguugcagugagccaagauugugccacugcacuccaucgugggugacagagugggacucc

SEQ ID NO: 5807 - RNA, 77 nt, Human
ggagaauccccaaaauuuucagauaguggccuaaaaaaauuuuauuugcucacugguugucauucuggguauucccc

SEQ ID NO: 5808 - RNA, 88 nt, Human
ggagaaucgcuugaacccggggggcagagguugcagugagcugaguuugcgccacugcacucuagccugggggagaaagugaaacucc

SEQ ID NO: 5809 - RNA, 85 nt, Human
ggagaaucgcuugaaucugggaggcggagguugcagugagcugagaucgcaccacugcacuccagccuguugacagcgagauucc

SEQ ID NO: 5810 - RNA, 89 nt, Human
ggagaauugcuugaacccuggagguggagguugcagugagccgagauugcaccauugcacuccacccuaggcaacaagagcaaaacucu

SEQ ID NO: 5811 - RNA, 88 nt, Human
ggagaauugcuugaauccaggaggcagagguugcagugagcugagaucaugccacugcacuccagccugggugacagagugacacucc

SEQ ID NO: 5812 - RNA, 106 nt, Human
ggagacgaacacauacacagaagauucagacacacuugcaauguauugcuggggauucuccagcauuggcaugauggagaggguggagaaucauuugaccgccucc

SEQ ID NO: 5813 - RNA, 87 nt, Human
ggagagagagagcagacaggccuggguucaaauuugggcucucuaguuugucagguuugcaaccucgggcaaauucucuagcuuccc

SEQ ID NO: 5814 - RNA, 64 nt, Human
ggagagcccgucgcgggagugcaaggagcuggacggccucuggagcuuccgcgccgacuucucu

SEQ ID NO: 5815 - RNA, 82 nt, Human
ggagagccuggugguggacauaggccugacaguaguaacaccaggcugacaggucgauguagcugaggaccaacgggugucc

SEQ ID NO: 5816 - RNA, 73 nt, Human
ggagagggguggaagacagaaaccacacacauauaccugcaaaugugacuuggucuguuuuuuucccccauuu

SEQ ID NO: 5817 - RNA, 76 nt, Human
ggagagugcagauucacuugaugggaacagcuacagcuccagcgaugaaaaacugaauucugcaacagacucuacc

SEQ ID NO: 5818 - RNA, 101 nt, Human
ggagauggaccugugaucugggauuaccauguuguuuugcuucauguuucaaguggaggacagaacuucauuuaugaucucgauacugucuugccauuucc

SEQ ID NO: 5819 - RNA, 65 nt, Human
ggagauugaugucaggucagaauauuggaguuauacaucuauuucugaguugaauacucagcucc

SEQ ID NO: 5820 - RNA, 81 nt, Human
ggagauuuuaaaaauuacagccauuuugaugagugagcauuggaguugauauuuucacugugguuuuaauuugcauucucu

SEQ ID NO: 5821 - RNA, 71 nt, Human
ggagauuuuauaggaugguuccugggcugauugauaaugccaaggcagcagggagcugaccugcauucuuc

SEQ ID NO: 5822 - RNA, 81 nt, Human
ggagcaaccuggcuucagauacuuucaaacauguggagacagcacuucaaaguuagaauuuauaaagaagacucagugucc

SEQ ID NO: 5823 - RNA, 75 nt, Human
ggagccagacuuccuggguucauauccugguucuaccaauuuaccagcugugugaacuuaggaaaauuccucucc

SEQ ID NO: 5824 - RNA, 95 nt, Human
ggagccauuguggacguuccaguuggugaggagcuguugggucguguaguugaugcccuugguaauguauugauggaaaggguccaauugguucc

SEQ ID NO: 5825 - RNA, 78 nt, Human
ggagcccuugauguccugcaaaugaaggaggaggauguccuuaaguuccuugcagcaggaacccacuuagguggcacc

SEQ ID NO: 5826 - RNA, 77 nt, Human
ggagccucagucccucauccgugaaauggggauacaaagauguaccucgcccacacuggccagcagaccaaggcucc

SEQ ID NO: 5827 - RNA, 72 nt, Human
ggagccugaaagugcucccauagccauuugcuccuuuggcuuugggguuaagcgucaucuuuuuuaggcucc

SEQ ID NO: 5828 - RNA, 62 nt, Human
ggagcgcggcuugaggagggcggggccgccccgcaggcccgccaguguccucagcugccucc

SEQ ID NO: 5829 - RNA, 88 nt, Human
ggagcgcucgggugcccagcagcgggcucgcucguacuuggucauguaugguguggugauucgcuucugguuggccugcggucgcucc

SEQ ID NO: 5830 - RNA, 86 nt, Human
ggagcucaugcuggaggagguggaggucuucaaggauccagcacccgucaagaccaugaccaucucuucuaagaggcaacaacucu

SEQ ID NO: 5831 - RNA, 98 nt, Human
ggagcuggaggaccuggagcaccugcagcuggacuucuggcgggggccugcccacccuggcucccccaucgacguccgagugcccuuccccagcaucc

SEQ ID NO: 5832 - RNA, 83 nt, Human
ggagcuggaguucaggaggagucagaagaggcuuucagccuggucggggcugggccucaaggcuaaaguuuuacuuaggcucc

SEQ ID NO: 5833 - RNA, 71 nt, Human
ggagcugggguuuaaucggccgaggagggagucuggggccauucugacuugguugacuuaggccaggcucc

SEQ ID NO: 5834 - RNA, 86 nt, Human
ggagcugugugagguagacgaggauggugacuccuggcugcagguaacccgcaggcuccccauccuacacaccuccucaccacucu

SEQ ID NO: 5835 - RNA, 84 nt, Human
ggaggagggggucgggccuccgaggaaggccuagccgcugcugcugccaggaauuccagguuggaggggcggcaaccuccugcc

SEQ ID NO: 5836 - RNA, 66 nt, Human
ggaggaguugcgcgcgcugugccgugugcaagcgcugcggcagggcuccgagaccucggcuccucc

SEQ ID NO: 5837 - RNA, 74 nt, Human
ggaggcaguccaggcucuuuagcaugguguuggaagcccuuaaugaucugcuacagccugggccuccagccucc

SEQ ID NO: 5838 - RNA, 72 nt, Human
ggaggccaagguggaucaccugaggucaggaguucgagaccagccugaccaacauggugaaaccccgucucu

SEQ ID NO: 5839 - RNA, 79 nt, Human
ggaggccgguggccguguggucccagacagcugcugcaagacggugguggcucuuuguggacagcgagaccaugccucc

SEQ ID NO: 5840 - RNA, 74 nt, Human
ggaggcgcggugaggagucaggcuuaaaacuuguuggaggggaguaaccaggccugcuccucucgcucuccucc

SEQ ID NO: 5841 - RNA, 74 nt, Human
ggaggcucagcccacccuccagcuuuuccucaggguguccugagguccaagauucuggagcaaucugacccuuc

SEQ ID NO: 5842 - RNA, 79 nt, Human
ggaggcuguucugugcauuguuggauauuuagcagcgucccugaccucaguccaauagaugccaguaacaacucccucc

SEQ ID NO: 5843 - RNA, 84 nt, Human
ggagggaguagaauuagucaccaggcaaagcccccacuggggggguuccuguuauuuaauagucugcauuuaccuguucccuuc

SEQ ID NO: 5844 - RNA, 79 nt, Human
ggagggcgggggagagacgagcggcucuggccccuuaauuguacuucgggcucguauugucucuccuuucgccaccucc

SEQ ID NO: 5845 - RNA, 71 nt, Human
ggaggggacuggaggaaacccccuuguuggaagagauuccaagagaagcacgguuuucucuuucccuugcc

SEQ ID NO: 5846 - RNA, 86 nt, Human
ggaggggaggauacaagaggaaugauaaauggcaaggaaaaccacucacucuuaaugcuuuuugucauacucauguccucuugucc

SEQ ID NO: 5847 - RNA, 85 nt, Human
ggagguagagaagaggaagaaguucaagauugaugaccagagaaggacccacaacuacgaugaguucaucugcaccuuuaucucc

SEQ ID NO: 5848 - RNA, 92 nt, Human
ggaggucagcuaccaggaagauccaugaucugggcauuggcagaugccugccaucacagccaggaagaugccucugaccugggugcaucucc

SEQ ID NO: 5849 - RNA, 60 nt, Human
ggagguggcuccugggagcuuggcuccugccagcccuguucccaggagcccucagcuucc

SEQ ID NO: 5850 - RNA, 114 nt, Human
ggagguggguuggaguugauuauaugggugcaggccuuguccacaagcgaaugggaaacuucuuccguccuccuagcuggccugcccaaagcccuuagcacagaucccauuucu

SEQ ID NO: 5851 - RNA, 96 nt, Human
ggaggugguggaggcugugaccauuguagagacaacaaccauggugguagugggcauugugggcuacguggaaacccucgaggccuccggaccuuc

SEQ ID NO: 5852 - RNA, 72 nt, Human
ggagguuucgaaauacaccaguuacgagcugcaugacaaguuuggcugggugaaagggaauggaaugccucc

SEQ ID NO: 5853 - RNA, 62 nt, Human
ggaguccccagaagcccugugcccacgaaccccugugggcggaggagagaggcggggacucc

SEQ ID NO: 5854 - RNA, 88 nt, Human
ggagucucacccuguugcccaggcuagagugcaguggugcaaucucagcucacugcaaccucugccucccggguucaagugauucucc

SEQ ID NO: 5855 - RNA, 87 nt, Human
ggagucucacucuguugcccaggcuggaauggaguggcgcgaucucagcucacugcacuccagccugggggaacagagugagacuuc

SEQ ID NO: 5856 - RNA, 88 nt, Human
ggagucucccucugucacccaggcuggagugcaguggcaugaucucagcucacugcaaccucugccucccggguucaagcaauucucc

SEQ ID NO: 5857 - RNA, 87 nt, Human
ggagucucgcucuuguugcccaagcuggagugcaauggcacaauauuggcucaccgcaaccuccacuuccuggguucaagcgacucc

SEQ ID NO: 5858 - RNA, 89 nt, Human
ggagucucgcucuuguugcccaggcuggagugcaguggcaugaucucagcucacugcaaccucugccaccuggguucaagcuguucucc

SEQ ID NO: 5859 - RNA, 75 nt, Human
ggagucuggccucaccugugccuggucuccugcaggggcuucagcgugacgucuggugggcaaagccggaucuuc

SEQ ID NO: 5860 - RNA, 67 nt, Human
ggagucugugucgggggagggcugccgucgagcccgccgucgccucgccccugaacuguuagacucc

SEQ ID NO: 5861 - RNA, 73 nt, Human
ggagugcaguggcacaaucucagcucacuacaaccuccgccucccagguucaagcgauucugccuuagccucc

SEQ ID NO: 5862 - RNA, 76 nt, Human
ggagugcaguggcguggucucggcucgcugcaaccucugccucccagguucuagcgggucucaugccucggccucc

SEQ ID NO: 5863 - RNA, 63 nt, Human
ggaguggagggggcugcccacccucgcuguacacagcugggcccagauggccccuucugaucc

SEQ ID NO: 5864 - RNA, 71 nt, Human
ggaguggcagggucuugcuguguugcccagggugggcuugaauuccugggcucaagugauccucccacuuu

SEQ ID NO: 5865 - RNA, 95 nt, Human
ggaguggggugcagugaguggccucaaaguugugcagaugcuuccgagccagaaacaaagccagcugccgccguccaucugcacucauguccucc

SEQ ID NO: 5866 - RNA, 74 nt, Human
ggagugugcauggugagggauaguucuugggcacugagccuggaagaggcuggcacucacuccaugggcacucc

SEQ ID NO: 5867 - RNA, 75 nt, Human
ggaguuaaacauuaugaggcugaugaauuugagauggcuaucaggcacuucgaacaagccuuaagagaauauuuc

SEQ ID NO: 5868 - RNA, 89 nt, Human
ggaguuuugcucuugcugccgaggcuggagugcaguggugugaucucgacucacugcaaccuccgccucccaaguucaagcaauuaucc

SEQ ID NO: 5869 - RNA, 89 nt, Human
ggaguuuuguucuuguugcccaggcuggagugcaauggcacaauccuggcucacugcaaccuccgccuccuggguucaagcaauucucc

SEQ ID NO: 5870 - RNA, 76 nt, Human
ggauagcagaagguugauguuuuuagugggacccaaggccuugaauuucccaguaauaaaauuagguuuccuuucc

SEQ ID NO: 5871 - RNA, 85 nt, Human
ggaucaugaacacguauaguaguggugccuucgcccaaagugucagacacagugguggagcccuacaacgccacccucucagucc

SEQ ID NO: 5872 - RNA, 83 nt, Human
ggaucaugggugguggugaacagcagaaagggauuauggaugaaucugcauuguucuagcugcuccccaugccacccgucucc

SEQ ID NO: 5873 - RNA, 91 nt, Human
ggauccggcugccagccugaggccaagcacggcuggagacccacgaccuggccugccguugcccugagcugcagccucggccccaggaucc

SEQ ID NO: 5874 - RNA, 80 nt, Human
ggauccggguccccgaccaaaggccgacacccgagaggugcgcucggacccggccggucccccgaggguggcucggaucc

SEQ ID NO: 5875 - RNA, 72 nt, Human
ggaucguggcgcgcauggcccuggugccgcgcacccuggaggcgcgcggacuggacgccacgccgcugaucc

SEQ ID NO: 5876 - RNA, 82 nt, Human
ggaucuugcuguugccuaggcuggagugcaguggcacaaucauagcucacugcagcuucgaacuccugggcucaagcaaucc

SEQ ID NO: 5877 - RNA, 74 nt, Human
ggaucuugguuuaaaagggauuuggaucuccccuaggguucauguuggaaauucagauccccagaacaagauuu

SEQ ID NO: 5878 - RNA, 94 nt, Human
ggaugaacaauagucugcaauuuccccuaagccaggccuugggauuuggacuuuugaggaccuggguaguaguuaguugacaugcuauuuaucu

SEQ ID NO: 5879 - RNA, 72 nt, Human
ggaugaagccucugugggaucuuugggcuuggggcugaauuucucaggcauaaauaccuaauggccuugucu

SEQ ID NO: 5880 - RNA, 85 nt, Human
ggaugacauccagagggcagaaugcaugcugcagcaggcggagaggcugggcugccggcaguugucacagccacagauguugucc

SEQ ID NO: 5881 - RNA, 71 nt, Human
ggaugaccagcucgucuucggucgugugauuacaucucauggcccguguguggggacuugcuuugucauuu

SEQ ID NO: 5882 - RNA, 75 nt, Human
ggaugagggccgcgguggcugccagcgugggguugagcgaggggccugcuggcucccggagcggucgccucuucc

SEQ ID NO: 5883 - RNA, 95 nt, Human
ggaugcuggugcucaguacgggaaagucauagaccgaagagugagggaacuguucgugcagucugcaaauuuuccccuuggaaacaccagcauuu

SEQ ID NO: 5884 - RNA, 86 nt, Human
ggaugggcuugugguuagcaguuuuugccaggaucauaggcugcuucacuuagaguaguggcaaagaugcugaccuacauucuucc

SEQ ID NO: 5885 - RNA, 60 nt, Human
ggauggggagguugggggggcaggagcuucugucccccacauuccaugcaccuccccucu

SEQ ID NO: 5886 - RNA, 60 nt, Human
ggauguaggcaucuugguggugcuuggcaaaguacagcauguuguccagagccaacaucc

SEQ ID NO: 5887 - RNA, 63 nt, Human
ggauguuucacagccaggcaguuuaugauauuaacagacuagacuccacagguguaaacgucc

SEQ ID NO: 5888 - RNA, 71 nt, Human
ggauguuuggaagauaagcuuaaaggagaaaugauggaucugcagcaugggagcuuauuucuucagacacc

SEQ ID NO: 5889 - RNA, 85 nt, Human
ggauuagcuuggugggacaaccugugaauuggacgaccaucuuuugacaagacaccacguuuagggggaccaaacaagcugguuu

SEQ ID NO: 5890 - RNA, 85 nt, Human
ggauuaguucuggagagagcagguugcuaagaagaaucuggcuucuucagucagcgcucuugcuuccuaucucuccaugugaucu

SEQ ID NO: 5891 - RNA, 90 nt, Human
ggauucugcauacgccaucucugagagccauggagggagccacaccccuggugacuucauggugcuggaugggagacgcuagcggcaucc

SEQ ID NO: 5892 - RNA, 63 nt, Human
ggauugaaacugucucaggaccuugaugaucuugcuauucucuaccuggccacaguucaagcc

SEQ ID NO: 5893 - RNA, 64 nt, Human
ggauugguauaacaaggcacaagauuuggaauuuacccuuuacagacuggcuuuuauaacaccc

SEQ ID NO: 5894 - RNA, 82 nt, Human
ggauuguauccuagauacucugaaugaagcauuguaaagacuuagauuguguuaucuucuucuuagaguacugauacuuucc

SEQ ID NO: 5895 - RNA, 64 nt, Human
ggauuuggcaaagaaggcaguacaguuaauccuggcugcaacugcuggaaaauuugcuacaccc

SEQ ID NO: 5896 - RNA, 73 nt, Human
ggcaaacagacuugaccaucuucagacccacugcauucucaagcugaaguggucugcucauaguuugugugcc

SEQ ID NO: 5897 - RNA, 88 nt, Human
ggcaaauacuuuugaccucuugugaugaggucaggaacuaggaacuuuaauucuuugacuuuucacauuuuuuaaaagguguauugcu

SEQ ID NO: 5898 - RNA, 82 nt, Human
ggcaaauguccaggcaccugccuggcccuaaaaagagucacaguccugacccucgugggggcagggcaggugucccgaggcc

SEQ ID NO: 5899 - RNA, 69 nt, Human
ggcaagacagggacuagcagccagagccaguaaugccuuccugguuugcucugagggguccugucuucc

SEQ ID NO: 5900 - RNA, 68 nt, Human
ggcaagggcuggguuuguacuucuaaaugcuuuugugguagaggcauacaccacagaaaucuuuggcc

SEQ ID NO: 5901 - RNA, 89 nt, Human
ggcaagucaguggcuuguuucuguuucauggaaucuucuagcuauggagagcucagguaucagacuucagaaguagagcuuggcuugcc

SEQ ID NO: 5902 - RNA, 110 nt, Human
ggcaaguguugucaugguaguacaggaggcaaaaccauuuauauuuugaacacuuacugcacugauaggauguuuugugguugagcugauuuuaguacuguagauagguc

SEQ ID NO: 5903 - RNA, 65 nt, Human
ggcaauacuuccuccugucaucucaggugggucuccauccugaguacagagaggaccuagaagcc

SEQ ID NO: 5904 - RNA, 78 nt, Human
ggcaaugucuugaccuggguuggaagguagggugggucuggaaaagcuuugguccaggguucaagauuugagagugcc

SEQ ID NO: 5905 - RNA, 102 nt, Human
ggcacacuuccugucaaacaaguuggugacauugacuaggcauggcuucugggaaaaugucauguaagcuuuguuaccaucugagcaaaauggagauguucc

SEQ ID NO: 5906 - RNA, 79 nt, Human
ggcacauugauuauaacacacagcugaggucucgaucacacuagaugucuccagucagucguguggaaaucgaugugcu

SEQ ID NO: 5907 - RNA, 99 nt, Human
ggcaccucuagaaguauacgugugugucuccaaccaggugucagaagccagauauguuugacaaccacucugucuggaggccugcacacuuaugguguc

SEQ ID NO: 5908 - RNA, 86 nt, Human
ggcacugcaggucaggccaguuaggaggugcugcuccuccuccguggguggagggcuuuccuccuggcgauguccuccucaguguc

SEQ ID NO: 5909 - RNA, 69 nt, Human
ggcacuucugguuggccucggggcgcgcuggcucggcucuuccuccgcccucgaggcccccgcaguccc

SEQ ID NO: 5910 - RNA, 106 nt, Human
ggcacuuggaaccgucuuggggaauauagcuugguaauugaacugcuuaagcuuauuauuaauauuuaagcuauaguuccaggcccauuccagaggucccccagcc

SEQ ID NO: 5911 - RNA, 83 nt, Human
ggcagaaaaucgauucagaugaagcacgaggauucgagggaaucuuuguacugucaacuuuuugguacuucgaguuuucugcc

SEQ ID NO: 5912 - RNA, 85 nt, Human
ggcagaacacacagcaaggaaagguccuuucuggggaucaccccauuggcugaagaugagaccauucuuccucuuguguuuugcc

SEQ ID NO: 5913 - RNA, 69 nt, Human
ggcagaccccgauccugcugcgccgccuucaagggggaccgccggccgcgagccagguugggauuugcu

SEQ ID NO: 5914 - RNA, 87 nt, Human
ggcagagggcucucaggguccacgucaaggguccagcagucgucaccauugcucccuacgucacacuccggagggugucucaaugcc

SEQ ID NO: 5915 - RNA, 70 nt, Human
ggcagcacaaaggcggcgcggugcacgucggaguuguaguacuucagcugcaucugcgccaccugcugcu

SEQ ID NO: 5916 - RNA, 64 nt, Human
ggcagcccugggccuugguuugauuaccuccccugggggaugcuggucagacccagagguuguc

SEQ ID NO: 5917 - RNA, 66 nt, Human
ggcagcgaguccucagggcgcccgggagccaccagucugcucucgggcucuacucagacuagcgcc

SEQ ID NO: 5918 - RNA, 81 nt, Human
ggcagcguggcgggaacggcugcuucuccucugcccagggcccuguucuuggugggacucggcugccccuccucugcugcc

SEQ ID NO: 5919 - RNA, 73 nt, Human
ggcagcucccaagaccacccgcccccaggugcagccaccuacaccccggggaagggggaagagcaggagcucc

SEQ ID NO: 5920 - RNA, 67 nt, Human
ggcagcucuucggccgcauccccaugcgcuucucggugcugaugcagaugcguuucgacgggcugcu

SEQ ID NO: 5921 - RNA, 73 nt, Human
ggcagcugugccccuugugcggaugggacggacuucccccagcugugucaacuguguccaggguguggcuguc

SEQ ID NO: 5922 - RNA, 88 nt, Human
ggcaggcacucagcccuuggaggugcuggaggcugugcagcgcagccuggugcugcagcgaccacagaccugggcugacugcgugacc

SEQ ID NO: 5923 - RNA, 83 nt, Human
ggcaggcagcuggugccggggcggucaccuccugcucagagaugucaaaucccagccucugaagcugccccaccagcucugcc

SEQ ID NO: 5924 - RNA, 76 nt, Human
ggcaggcauucacccucaggaccaggcaagugcagagucagcaguccuguuccuggguauggaguccuguccugcc

SEQ ID NO: 5925 - RNA, 81 nt, Human
ggcaggcccccaccaccccaugcugacuuggagaaccccagaucucuggggcccagccaagcaaggguguggggggcagcu

SEQ ID NO: 5926 - RNA, 80 nt, Human
ggcaggcuuuggugacucuagauuaccucgggccgauugcacgccccccguggugacuaggaccccuucaaacgucugcc

SEQ ID NO: 5927 - RNA, 130 nt, Human
ggcagggaggugacgagguaggggcagagcggauggaagccggagaucccagguucccggaauacuccggcuggggccuucgggcuucuccuguccccucccuacccccgugccucggguuucucccucc

SEQ ID NO: 5928 - RNA, 110 nt, Human
ggcaggguguacaccuguggcucucggggcugcccuuuggcuuuggagaugguuuucucgauggaggacgggaggccuuuguuggagaccuugcacuuguacuccuugcc

SEQ ID NO: 5929 - RNA, 105 nt, Human
ggcagguggaggugcaucaagagcccggggcagcggugcccagaggccaggaggccccugaaggcaaggccacgggagacugguggagaaucugccuccccugcc

SEQ ID NO: 5930 - RNA, 67 nt, Human
ggcagguguuugaggaggcccugcacagggucccaggacugcaccagggccucaucagcaaccugcu

SEQ ID NO: 5931 - RNA, 83 nt, Human
ggcagguugcuguguugugcuuccuucuacagccaauaugaaaaggccuaaguuaaagaaagcaaguaaacgcaugaccugcc

SEQ ID NO: 5932 - RNA, 62 nt, Human
ggcaguagagccuagcgcccaggcccuugagcugcagggucuggguguggacgucuaugacc

SEQ ID NO: 5933 - RNA, 75 nt, Human
ggcaguagaggccgcuauggcgaacguuccgugggcagaggucugcgagaaauuccaggcggcgcucgcucuguc

SEQ ID NO: 5934 - RNA, 71 nt, Human
ggcagugaaaacccugugucugauaagucucagagacaaacugcuacuuagaauuacagggguucacuguu

SEQ ID NO: 5935 - RNA, 106 nt, Human
ggcaguuaccugcuggaccucucgagccuggcggaacguauggauaaaagauucaugcuucuaucuccaguugcucuucugaggagguucagccuuuaacucugcu

SEQ ID NO: 5936 - RNA, 61 nt, Human
ggcaucagcaguccuuaaaggccugagcuugcaacacucaggcaggacucggcugagggcc

SEQ ID NO: 5937 - RNA, 88 nt, Human
ggcaugcaguaacuguucaaauaauguuuguuuaauugacggguuuuaagcucgauaacuuagcuaagcccuuugcacagucuaagcc

SEQ ID NO: 5938 - RNA, 93 nt, Human
ggcauggaggacgccuucaacaagggacgggccaauuucucagggaugucggagaggaaugaccuguuucuuucugaaguguuccaccaagcc

SEQ ID NO: 5939 - RNA, 83 nt, Human
ggcaugggguuggcuucuguccacuugcugagcaacuuguuuuccuuuucacaguggauaugaccuuggaugccgacacagcc

SEQ ID NO: 5940 - RNA, 85 nt, Human
ggcauguggcugggcagguggauuacaaggcuggucuugaguccugaccucaagugauccaccugccucugccucccaaagugcu

SEQ ID NO: 5941 - RNA, 93 nt, Human
ggccaagcccagcuugaauaccugggucugcaggcgucucucuaagaaauccucuaucuucaggcccaggauguaauccagcuucaucuugcc

SEQ ID NO: 5942 - RNA, 79 nt, Human
ggccaauacaaucuacaucuagacacaauauuguaaaauuuuggaauauuaaggauagaaggaagauauuaaaguggcc

SEQ ID NO: 5943 - RNA, 75 nt, Human
ggccaccaacacauggcccagccagugcugcugggcucugguuucuguguucuggugaggccaugggguggggcc

SEQ ID NO: 5944 - RNA, 81 nt, Human
ggccacuuccaccuuccagggcauaggugaccccuguggaaaacaaguaccccuggaacauccuagaaguggagguggacc

SEQ ID NO: 5945 - RNA, 63 nt, Human
ggccagcugggggcuggcgggggaggcugugucugucaaaccguugugcccccaguguggguc

SEQ ID NO: 5946 - RNA, 85 nt, Human
ggccaggacucuugcagaacugagaccugggagcuccucccucaccaggaagggacccgaggcaggcggcgggggucucugagcc

SEQ ID NO: 5947 - RNA, 64 nt, Human
ggccagggaagcccgacgugguggggcgcugccucccgcuccguggccuccuuccucccuggcc

SEQ ID NO: 5948 - RNA, 93 nt, Human
ggccagugaggugcccguuggugggugugagaguuuguugccagaucagcugaggaagcgucuuaccccucagcgcggugcgaucucacgguu

SEQ ID NO: 5949 - RNA, 87 nt, Human
ggccagugcauugaaaggucuccaggccuagagaaucuuagauaaaaggcacuggaaccagaucaaagcccaucuuuucagcuggcu

SEQ ID NO: 5950 - RNA, 75 nt, Human
ggccaugggcgccaaccaugcuggagaccagagcaacacaugccuggacacggcgacggaacgcaccacgaggcc

SEQ ID NO: 5951 - RNA, 91 nt, Human
ggcccaaggaaugaagagaaccaaugguauguacugguggcagauaacaagcuuugcacugggcugaccaacuguuuuuuauuaaauggcu

SEQ ID NO: 5952 - RNA, 86 nt, Human
ggcccacgugccggucaugcccauuccgcggugggugcgcuccuuccacggcccgcacaccaccugcugcaugcggcuguugggcc

SEQ ID NO: 5953 - RNA, 79 nt, Human
ggcccagcggccucuuuccuacguaccucggacugacggggcggucugacaagugccguggguugggcuucgccgggcu

SEQ ID NO: 5954 - RNA, 82 nt, Human
ggcccaggaucggcagggcugcuggcagaggaaucccagcugggguucccaugccccaggcuccugcaggacuugcugggcc

SEQ ID NO: 5955 - RNA, 99 nt, Human
ggcccaggcugcccguuccucuccuucuccgccagucugcgcugcggcugccacggcucacaccagagggaugggguaggaggcgcaggcagccaggcc

SEQ ID NO: 5956 - RNA, 84 nt, Human
ggccccaggacgccaggguggccggcugcugggccacgugcuguccguggugagcccugccgcugucccauggcccagggagcc

SEQ ID NO: 5957 - RNA, 65 nt, Human
ggcccccucaaaaguggucucaacgggggguucgccggccccgggagaaacacgccagggggacc

SEQ ID NO: 5958 - RNA, 67 nt, Human
ggcccggcccgcagcccgagcaggaagcgccggcgcuaggcuggccccugcgcugccagcuggagcc

SEQ ID NO: 5959 - RNA, 83 nt, Human
ggccgaguuguuugggggcgcugugcccacggggcccgggggcuccgccccggguuucaauggcguugccccucuacuuugcu

SEQ ID NO: 5960 - RNA, 84 nt, Human
ggccgcccggaacaccuucaccuucugcugcacgaaaugcuucuucuuggucuuggaggcgaagccgaaaccugggccggggcc

SEQ ID NO: 5961 - RNA, 79 nt, Human
ggccgcgaugucccccgccugucugcgaaugcugcguagcggguagacauggagggcuuucggcaucgucagaguggcc

SEQ ID NO: 5962 - RNA, 68 nt, Human
ggccgcucuagaggauccaagcuuacguacgcgugcaugcgacgucauagcucuucuauagugucacc

SEQ ID NO: 5963 - RNA, 75 nt, Human
ggccggaagauggauguggcugacuucgagugggugaugugguucaccuccuuucgcaacgucaucaucuuugcc

SEQ ID NO: 5964 - RNA, 88 nt, Human
ggccggcugugaacguaguuccugagagauagcaaacaugcccaacagugagcccgcaucucugcuggagcuguucaacagcaucgcc

SEQ ID NO: 5965 - RNA, 95 nt, Human
ggccgggcaugguggcucacaccuauaaucccagcacuuugggaagccgaggugaguggaucaucugaggucaggaguuugagaccagccuggcc

SEQ ID NO: 5966 - RNA, 75 nt, Human
ggccgggcgcgguggcucacgccuguaauuccagcacuuugggaggauuacaggcaugagucaccauacccggcc

SEQ ID NO: 5967 - RNA, 104 nt, Human
ggccgucuccggagucgcaguguccucggccgccgaagagugggugaagugcggaacuuccuccuuuuguggcuguggacaccuuccacaccggcuuccuggcc

SEQ ID NO: 5968 - RNA, 111 nt, Human
ggccguuaugggauauuucagggauaggaguugugaaagagcccuuggcuggacguuucuagccuuaaucuuuggcaagccauuucauuucccugagccucaguuuccgcc

SEQ ID NO: 5969 - RNA, 80 nt, Human
ggccucugcaacuuacuagcuguguguccuugggaaagaacuucaaggacuucuuugcagguaucugauuaguggagguc

SEQ ID NO: 5970 - RNA, 75 nt, Human
ggccugagaacaugguucgcaucgcuuugcagcuggacgauggcucgagguugcaggacucuuucuguucaggcc

SEQ ID NO: 5971 - RNA, 67 nt, Human
ggccugccuccgggcacacccggcuccccggacgccucgccggccgcuggggcuggaggcacgggcc

SEQ ID NO: 5972 - RNA, 80 nt, Human
ggccugcugaggucccuccuugagucucauguucaagcagucuuuguccaugaaacugggaggcgaccguguuagcugcc

SEQ ID NO: 5973 - RNA, 78 nt, Human
ggccuggugcggcuucggggcaaggaggaucccuggaacucuaucaccaguggagcauugaccggggcugugcuggcu

SEQ ID NO: 5974 - RNA, 79 nt, Human
ggccugugaggucccuccuugagucucauguucaagcagucuuuguccaugaaacugggaggcgaccguguuagcugcc

SEQ ID NO: 5975 - RNA, 83 nt, Human
ggccuucuauccugggcugcaacauccuucgaguugaauauuccuuacugaucuauguuagcguuccuggauccaagaagguc

SEQ ID NO: 5976 - RNA, 66 nt, Human
ggccuugcugguggcuuugggggcccuggcuucccugugugccccccuggaggcauccaagagguc

SEQ ID NO: 5977 - RNA, 71 nt, Human
ggccuugguguggaggggcuguacucugagcccaagugagucagcuauaggaagaggccauaccuagagcc

SEQ ID NO: 5978 - RNA, 75 nt, Human
ggccuuuguccccgaggccgcgccgggagcucccaagcgcacuccugggccggaccucggcgcgggacaaaagcc

SEQ ID NO: 5979 - RNA, 66 nt, Human
ggcgaaccugaaaaguuaggucaggcguugacugaagucuaugccaaggccaauagcuucaccguc

SEQ ID NO: 5980 - RNA, 64 nt, Human
ggcgaagccgggagugugggcgcggcugggguccugggcccgcgcgcugcuccgggacuacgcc

SEQ ID NO: 5981 - RNA, 74 nt, Human
ggcgacaggugcagaacaaaaacagcaggacaaacccacgaguuugaauguuggaaagacacugacaaaucgcc

SEQ ID NO: 5982 - RNA, 78 nt, Human
ggcgacgugcccuguccaggccucacuucccgcgucgcaaaacgggguggacaacgcagccuaaggcagagccgcgcc

SEQ ID NO: 5983 - RNA, 76 nt, Human
ggcgaucggcaucgaccugggcaccaccuacuccugcguggggguguuccaacacggcaagguggagaucaucgcc

SEQ ID NO: 5984 - RNA, 79 nt, Human
ggcgcagcccggccuccgacagccaugggaacuugugcuucaaguuguuguagggcugcuuccggaggcuguacuggcc

SEQ ID NO: 5985 - RNA, 105 nt, Human
ggcgcgggagggagcgaagcagcgcgggcagcgagcgagaugcagcaccgaggcuuccuccuccucacccuccucgcccugcuggcgcucaccuccgcggucgcc

SEQ ID NO: 5986 - RNA, 95 nt, Human
ggcgcucuaccgacugaugacuaccuggaccagcccugccuugagacgucaacggaucaaguguacagugaguccuggccgguauggaagagccc

SEQ ID NO: 5987 - RNA, 65 nt, Human
ggcggcaagcgggcugggacugcucggccgccuccugcccggcgagcagcucagaccaugucgcc

SEQ ID NO: 5988 - RNA, 88 nt, Human
ggcggcgaaaggaccggcuuaaugccagaccgggaguuggagguguccgaucucgaguggggauccagcaaggccuucucagccaguc

SEQ ID NO: 5989 - RNA, 82 nt, Human
ggcggcggcugaaccggggccugcggcggaagcagcacucccugcugaagcgccugcgcaaggccaagaaggaggcgccgcc

SEQ ID NO: 5990 - RNA, 72 nt, Human
ggcgggccgguuagcggcgacggggagggugggcucguggugcccccccuuuuguugugguuaacgcucgcc

SEQ ID NO: 5991 - RNA, 81 nt, Human
ggcggggcgcguugugcugaaaggucucggcuccugggucgcgcccauaggagccucuucucggcgcugcggggauccguc

SEQ ID NO: 5992 - RNA, 82 nt, Human
ggcggggucauugcaugacagcaagaaggcacgagguccccucaucuguccuuucccagcucgcaggccuuggaaccccgcc

SEQ ID NO: 5993 - RNA, 71 nt, Human
ggcggugagccccugugcaccguggacgugugagggagguggcacgggccagggcgcgggggccgccagcc

SEQ ID NO: 5994 - RNA, 96 nt, Human
ggcguaucagguuucagaggaugcggcugggaacgggaguagaggugaggggucguugcaucugucgcgguguguaucuuuuggggguucagcgcc

SEQ ID NO: 5995 - RNA, 73 nt, Human
ggcgucacugcccugaugggcgguugggaaggcaaaaccugcccugaaaagccuuuggguagugauucuagcc

SEQ ID NO: 5996 - RNA, 65 nt, Human
ggcgucggaggggccccucaaggccuccugggguacacugagcaccacgggguuccucugacuuc

SEQ ID NO: 5997 - RNA, 64 nt, Human
ggcgucgucgggccgccgcagcccgccgaaggcgcgggugaguggcagacccuugggccccgcc

SEQ ID NO: 5998 - RNA, 74 nt, Human
ggcgucguuuuucuucuuccagggcucguuuuuuggcuuccauuucccguucccuggauucgagcagccgcguc

SEQ ID NO: 5999 - RNA, 94 nt, Human
ggcgugucacaaccacugcaacacaaaaaaucuugcaaucucaugcuuguuuuauaaaugugaucccaugguuugaaguaguggguuacaugcu

SEQ ID NO: 6000 - RNA, 76 nt, Human
ggcguucagcagagucagggauggguccauuauaugauccaugaaccagaaccucacaucuugcuguuccggcgcc

SEQ ID NO: 6001 - RNA, 71 nt, Human
ggcguugcacugcaugggccccaggaggggggucgacgcggccacucaccgcaagggccuggcagugugcc

SEQ ID NO: 6002 - RNA, 106 nt, Human
ggcuaagaguaacaggugcuggagccagacuuccuggguucauauccugguucuaccaauuuaccagcugugugaacuuaggaaaauuccucuccgccucuuaguu

SEQ ID NO: 6003 - RNA, 71 nt, Human
ggcuaagugccagcuccucuuugcccucaaggugcuccacaugaugcccgaggagaagcugguugagggcc

SEQ ID NO: 6004 - RNA, 76 nt, Human
ggcuaauuuuuuguguuuuuaguagagacgggggucaaacacugauccugccuuuccacuguaccacuaaguagcc

SEQ ID NO: 6005 - RNA, 77 nt, Human
ggcuagaaaagccaaggccaaaggcuggaggggagaggacagucagcauguccagccuggggucuggguguaggguu

SEQ ID NO: 6006 - RNA, 67 nt, Human
ggcuagaaagaugcuaaggggaugcuacagcuguuuguccccugacagagauuccaucuaucuaacc

SEQ ID NO: 6007 - RNA, 81 nt, Human
ggcuagagaagcggcaaagucuauggccuuuccaaugcuccaucgguggcaaaagaacauugguuugcucuucucuuugcu

SEQ ID NO: 6008 - RNA, 93 nt, Human
ggcuaggcuggucuugaacuccugaccucgugauccacccgccuuggccucccaaagugcugggauuacaggcaugagccaccgcaccuggcc

SEQ ID NO: 6009 - RNA, 73 nt, Human
ggcucaacucggggaggccgccgggccggccuccgagacuccggcgggcaccgagucgccucacucgagcgcc

SEQ ID NO: 6010 - RNA, 63 nt, Human
ggcucaggacccuguggaucugggaguguggcaucacugccaagggcugcggggaucugugcc

SEQ ID NO: 6011 - RNA, 77 nt, Human
ggcucaggcaguggguggggaaggggacaaaagccggguuggagcugcuucuuuuaagccaaacccaagcaggggcc

SEQ ID NO: 6012 - RNA, 83 nt, Human
ggcucagucaaagcugcuccugcucagguccggcccccauccccgggaacauccgccugucagagggaagucaaaguggagcu

SEQ ID NO: 6013 - RNA, 86 nt, Human
ggcuccacagugugcacagaugaacgaaguuauggcagaguuagcuaacagaacucccucaaguuucauuugugaaguuggaagcu

SEQ ID NO: 6014 - RNA, 66 nt, Human
ggcuccuccgaauggcuggcuguggauggguuggucagucccuccaacaacagcaaggaggaugcc

SEQ ID NO: 6015 - RNA, 62 nt, Human
ggcuccuuacugcuuauuaaucuguauguacacaugaugaaaugaagcagaagcugggaguc

SEQ ID NO: 6016 - RNA, 72 nt, Human
ggcucgucccggagucagaaaaggcaggucaacuacccaaggcggccaaaggcccuuccugucuccagagcc

SEQ ID NO: 6017 - RNA, 62 nt, Human
ggcucuccauucccaggcucagugcaggauccaggccugcauguguggcggguggagaagcu

SEQ ID NO: 6018 - RNA, 81 nt, Human
ggcucugaagucagcgguuguaugaagcugugggcacaguacgugggacacagcauggaggacugugacugaugcagagcu

SEQ ID NO: 6019 - RNA, 70 nt, Human
ggcugaacugagucaggcuccugcugaggggcccgauuggugcccgcagccugggcagcugaccacagcc

SEQ ID NO: 6020 - RNA, 72 nt, Human
ggcugaaggcuaaguucccuuccaacuuugagauuucugcucaaagaugguaaacauacaguagucucugcc

SEQ ID NO: 6021 - RNA, 67 nt, Human
ggcugacauggcuuuagauccuguuuaugauuugguaucuuauugucacaaaguuguuccgucaguc

SEQ ID NO: 6022 - RNA, 85 nt, Human
ggcugcaggucuuggaaggaaugugggcaagguuuugaacuugauuguucuugaagcuaucagaccacaucgaggcucagcaguc

SEQ ID NO: 6023 - RNA, 87 nt, Human
ggcugcaucaaaggcugccaggaagccccgugccacuccagugcccaggguaccagaagggcuccaccaggcagucccccaccaguc

SEQ ID NO: 6024 - RNA, 75 nt, Human
ggcugcggcugcagaaguaccgccugcggaguaacugcaaagaugcuguccgugcgcguugcugcggccgugguc

SEQ ID NO: 6025 - RNA, 85 nt, Human
ggcugcugccuuaugggucagugguaugggugugaggacaucugauggaguucucuuccaaccacugccuacaauugguggugcc

SEQ ID NO: 6026 - RNA, 113 nt, Human
ggcugcugggugcacccccggggccugggggugaacccccgcugaugggggaggauggaccccuggggcuggugggugaaccccuaggggcugguggguggacuccgggggcu

SEQ ID NO: 6027 - RNA, 82 nt, Human
ggcugcuguaggacgguugcuccgagcgucgguugcccgacaugugagugccauuccuuggggcauuucugccacugcagcc

SEQ ID NO: 6028 - RNA, 62 nt, Human
ggcuggagcuugacacgguugagaaucccugaugcucaacccguauuuucuggcuaccaguu

SEQ ID NO: 6029 - RNA, 76 nt, Human
ggcuggagugcauucgcuugucccggcuuacugcagccuccgccucccggguucaagugauuuuugugcuucagcc

SEQ ID NO: 6030 - RNA, 99 nt, Human
ggcuggccuggcugacggcagcugccaaggggaugccgcacugcaggaggaccugggguggugcuauaccuucacagcagcaggcaaaagaggucagcu

SEQ ID NO: 6031 - RNA, 61 nt, Human
ggcugggccugagacaugggcuggccuccagguggagggguccagcaggcagguacaagcc

SEQ ID NO: 6032 - RNA, 76 nt, Human
ggcuggguggcugcaucggaggcguucagcugcuucaagaugaagcugaacaucuccuucccagccacuggcugcc

SEQ ID NO: 6033 - RNA, 88 nt, Human
ggcuggucuuaaacuccugaccucgugaucugcccacuuuggccucccaaagugcugggauuacaggcaugagccaccgcacccagcc

SEQ ID NO: 6034 - RNA, 81 nt, Human
ggcugguuccccaucuuauucgaacucuccugcaucauuaauagaugcaaguuagauguacgaacaaggggacucacaguc

SEQ ID NO: 6035 - RNA, 90 nt, Human
ggcugugggaagcgauuugcgauguucaccuccacgauauuugcugugguuggauucuugggagcuggauacucguuuaucaucucagcc

SEQ ID NO: 6036 - RNA, 80 nt, Human
ggcuguggugguugaaaguaauuaauuuaugacauaguaucugagacuuaaauuugcuguguccuuuuggcuuuucagcc

SEQ ID NO: 6037 - RNA, 66 nt, Human
ggcuguuugaggaaucuugagccaaguccuagucauuauuuuugccauccucgaacuugaacaguc

SEQ ID NO: 6038 - RNA, 77 nt, Human
ggcuuagcugugagaagugguucucuuccucuggucccuucuggggacucuguuuccccauuucuugcugcuguguc

SEQ ID NO: 6039 - RNA, 75 nt, Human
ggcuucaccagcgcuucucuguuugucucgucccuggauuucuaacaguugccucgagaugcucugguucugguc

SEQ ID NO: 6040 - RNA, 61 nt, Human
ggcuucaugauauacaccaauuccaaaauaaaacaaucaaaugguccagguguagaaugcc

SEQ ID NO: 6041 - RNA, 74 nt, Human
ggcuuccgugauggucuacgaugacaccaguaagaaauggguaccaaucaaaccuggccagcagggauucagcc

SEQ ID NO: 6042 - RNA, 76 nt, Human
ggcuuccucaccaccuugugcacugcugcucccacaccacagugacuagcagcacauaaugguuugaauuaaagcu

SEQ ID NO: 6043 - RNA, 71 nt, Human
ggcuuggccauggcggcuggugcugauaaccauuucuuggcagaagugccgccaaagcuguggcccuaguc

SEQ ID NO: 6044 - RNA, 72 nt, Human
ggcuuggugagggccaccaccccacuguggggggcuaacuuuccggguggugaaaaagcccuccucauugcc

SEQ ID NO: 6045 - RNA, 65 nt, Human
ggcuuguggaccaguaacugucaauggcuaaaaccaccgaauaggagccaaugacuccacaaguc

SEQ ID NO: 6046 - RNA, 86 nt, Human
ggcuuuaggaaucgccuggcucuacccucucacuucauggcuacagauacuugugcccugagagagcaagugaauuucccaaagcc

SEQ ID NO: 6047 - RNA, 81 nt, Human
ggcuuuaucucuugccuugaccuccuacauuaucaacaaagugagaguuuaagaucuccugggcaggagauuucagaagcc

SEQ ID NO: 6048 - RNA, 65 nt, Human
ggcuuucugagaaaucgaguucaggcugccaaguauccucucuuagucgcuucaucucagaaguu

SEQ ID NO: 6049 - RNA, 60 nt, Human
ggcuuucuguucauccguacuuucaaagauuuagugaucaaguacuaugugucaggaacc

SEQ ID NO: 6050 - RNA, 83 nt, Human
ggcuuugccucguucauugcuguguccuggcacuucucagucucucacggaaugugccuuggauaaaugagugaagcaaaguc

SEQ ID NO: 6051 - RNA, 90 nt, Human
ggcuuugcuggcccagcaagccugauaagcaugaagcucuuaucuuugguggcuguggucggguguuugcuggugcccccagcugaagcc

SEQ ID NO: 6052 - RNA, 93 nt, Human
ggcuuuuagugcuacuggugcucuugaaggacagauguuccggaaaacugggaggcuuaucucacugagugagcagaaucugguagcacugcu

SEQ ID NO: 6053 - RNA, 82 nt, Human
ggcuuuuccuaaucucuuuggucuuuggaagugggcaggguuucucaaaccaagugucuuccaugggccauuggcaaaggcu

SEQ ID NO: 6054 - RNA, 79 nt, Human
ggcuuuuuagcuugagacucuauccugagauuuugaugugguaggucuagggugaggcauaggcauuuuuuaaaaagcu

SEQ ID NO: 6055 - RNA, 81 nt, Human
ggcuuuuucuuagugccucugugcauuugggugauguucuauuuacauggccuguguaaaucuccauugggaagucaugcc

SEQ ID NO: 6056 - RNA, 82 nt, Human
gggaaacacguauucaggccggcgcggguugguacauccuagggcauaccaggggacucuggucgguuacugauacggcacc

SEQ ID NO: 6057 - RNA, 80 nt, Human
gggaaaccuuggcaagcaguuccaguccgagcagccccagaccgcugccgcccgaagcuaagccugccucuggccuuccc

SEQ ID NO: 6058 - RNA, 70 nt, Human
gggaaacuccgaggacagagggcuaaauccaugaaguuguggauggccugaugauccacagcggagaccc

SEQ ID NO: 6059 - RNA, 71 nt, Human
gggaaacuccgaggacagagggcuaaauccaugaaguuuguggauggccugaugauccacagcggagaccc

SEQ ID NO: 6060 - RNA, 72 nt, Human
gggaaacuccgaggacagagggcuaaauccaugaaguuuguggauggccugaugauccacagcuggagaccc

SEQ ID NO: 6061 - RNA, 82 nt, Human
gggaaagaaugccaagaugguauuuucuuuuggcaagaugcuuugguugugcagucauugaagauacuuggcacuauuuucu

SEQ ID NO: 6062 - RNA, 59 nt, Human
gggaaauggcucaaacacaauccagggaagcucucuaugauauguguuugacauccccc

SEQ ID NO: 6063 - RNA, 78 nt, Human
gggaaauuugccuuuaccacugaagauuaugacauguuugaaguguguuuugagagcaagggaacagggcggauaccu

SEQ ID NO: 6064 - RNA, 82 nt, Human
gggaacacaagggcuggccggacucugagaagcugagggacaaagaauggaccccaagcaccucacgcccagcucccauccu

SEQ ID NO: 6065 - RNA, 78 nt, Human
gggaacuucuggauacaaguggggccaugcucccuggcccugacuccaggcugggguauccugaacuguauccaaccc

SEQ ID NO: 6066 - RNA, 76 nt, Human
gggaaggagcuccccccacugcccauccugcccgcuuuguggcggguagagucagugacagggaggcagcccuccu

SEQ ID NO: 6067 - RNA, 78 nt, Human
gggaaggcaguagguuguauaguuaucuuccgaggggcaacaucacugcccugaaaccacacaaccuacuaccucacc

SEQ ID NO: 6068 - RNA, 66 nt, Human
gggaaguaguuucucuuugggcaugcugacagcaguuuuucauagccucacggaugagcccuuucu

SEQ ID NO: 6069 - RNA, 84 nt, Human
gggaauuuugauaugaaaagaaacuagucauuuauuuauacaauaggcuuggcucaaaaguguuuuucagaccucgguauuccu

SEQ ID NO: 6070 - RNA, 88 nt, Human
gggacaguuuggugcugcagugaauuaauuacguaggcaaucgagacucuaauaaggauauuuugcuccagcaauuccugauuguccc

SEQ ID NO: 6071 - RNA, 129 nt, Human
gggacaucaaagaauaaauaagcugcucuaauugccaagaauucacaugugguuguaugcagcauuacugggaaauugaaguguaucugcaugugauucugcugugauggacacuuguaaguuuguucc

SEQ ID NO: 6072 - RNA, 77 nt, Human
gggacccucaagagagcauggagaguguggggugugccuggauaggcccccuuugcaggcagucuuuugagagucuc

SEQ ID NO: 6073 - RNA, 96 nt, Human
cggagccguguacagauucaucaccacgaucugugccaucauugggggaccuucaacgucgccggauccuggacucaugcaucuucacaggcucug

SEQ ID NO: 6074 - RNA, 90 nt, Human
cggagcucgcuucuuugcccagguuggagugcaauggcacaaucuuggcucacugcaaccuccgccucccggguucaagcaauucuccug

SEQ ID NO: 6075 - RNA, 73 nt, Human
cggagggcgaggcggcguggacagcggccccggcacccagcgccccgccgcccgcaagccgcgcgcccguccg

SEQ ID NO: 6076 - RNA, 65 nt, Human
cggagggucugggaaggguggcguuggcccguucugacagaggccucccuggccagguccauccg

SEQ ID NO: 6077 - RNA, 90 nt, Human
cggagucucacucuguugccuaggcuggagugcaguggcgcgaucuuggcucacugcaaccucugccucccagguucaagcgauucucug

SEQ ID NO: 6078 - RNA, 64 nt, Human
cggauaucugugucuuucuaccacgucaaaaacaacgggaagauugaacucaucaagauguucg

SEQ ID NO: 6079 - RNA, 84 nt, Human
cggaucuagaugccaguuccguucuggcuacuuugaugagagguauguauuggccucuagagucagaacuggccgaagcauccg

SEQ ID NO: 6080 - RNA, 81 nt, Human
cggauggagcuugagcaacgccccgcccuuuguugagauuccccaacccugcuagccuuguaaacuccugagccuucaccg

SEQ ID NO: 6081 - RNA, 106 nt, Human
cggauuauccccauaccccacccauucccgauacaccuuacuuacuguguguuggcccagccagagugaggaaggaguuuggccacauuggagauggcgguagcug

SEQ ID NO: 6082 - RNA, 61 nt, Human
cggcaccaucacgugcuuggggacggguucucucccggggcgucuucgugcaguggugccg

SEQ ID NO: 6083 - RNA, 79 nt, Human
cggccagagggcacaggcugcuuggggggugaggguccccauuccugccaccucucacagaccaugacccacagggcug

SEQ ID NO: 6084 - RNA, 76 nt, Human
cggccgcucaaaucugccgguagcccagcccgccccgcgugcgggggcuguggcgguuacacggccgggcgcgccg

SEQ ID NO: 6085 - RNA, 94 nt, Human
cggccgucgggugugagcugcgccgaccgcucugaggguucguggcccaccgcuccuucgcggucccugccgccaccguacacgcucagcgucg

SEQ ID NO: 6086 - RNA, 79 nt, Human
cggcgcggcuaccugccccguuuucccugugaguugaccugcuccgggccgcgggccgccaauggcaggggccgcuccg

SEQ ID NO: 6087 - RNA, 74 nt, Human
cggcgcuuccgcaaguuccugguguuuguggcaaacuucgaugagaaugaccccaagaccuuugaggggcguug

SEQ ID NO: 6088 - RNA, 96 nt, Human
cggcgugcccugguggcuggaaggaggcguguggcgugaugcggccguggacgcggacugagugcgcgggagccccugugaggagccgggcagccg

SEQ ID NO: 6089 - RNA, 80 nt, Human
cggcuccgagagcagguucuucgugaguuccucgcagggccggucggagcuacacauugagaaccugaacauggaggccg

SEQ ID NO: 6090 - RNA, 66 nt, Human
cggcugcccaggcccugccuuggcaugugugucuccagagcgugcccggccaggccaucccagccg

SEQ ID NO: 6091 - RNA, 101 nt, Human
cggcugcgcgggucgcggugcugugaggucugcgggcgcuggcaaauccggcccaggauguagagcuggcagugccugacggcgcgucugacgcggaguug

SEQ ID NO: 6092 - RNA, 77 nt, Human
cggcugggagcuugaacuugccuggguuggcuuccacuauaccgauggucucuuccagguccucgaggucccacucg

SEQ ID NO: 6093 - RNA, 72 nt, Human
cgggagcgcuggcggcagcagaacguuaacggcgccuucgccgagcugaggaagcugcugccgacgcacccg

SEQ ID NO: 6094 - RNA, 62 nt, Human
cgggagcuggaagaaugggggcaaaaaccccaggcccccauucuccaacccccaagcucuug

SEQ ID NO: 6095 - RNA, 74 nt, Human
cgggauaauggggucucaaaagguuuuggaaguaguagauaccucuaaaagccaaggagcagcccuaguucucg

SEQ ID NO: 6096 - RNA, 73 nt, Human
cgggccacccgggucaagcgcgcuccgccgggaaacuucugcgggcgccgggcugaagcuccgggcagggcug

SEQ ID NO: 6097 - RNA, 72 nt, Human
cgggccacggcccggaaccggccccaggcgggucuccaaaaaccgggcccgcuugcacccgggucuggcccg

SEQ ID NO: 6098 - RNA, 100 nt, Human
cgggccuucgggagcugggaagagcacccugcugaagaggcugcuccaggagcacagcggcaucuuuggcuucagcgugucccauaccacgaggaacccg

SEQ ID NO: 6099 - RNA, 81 nt, Human
cgggcgcaggguguccgagccgcugccugugcuuccgcaccaccgugcgcugcaugcaucugcugcuggaggccgugcccg

SEQ ID NO: 6100 - RNA, 73 nt, Human
cgggcugcgcgcacagcucagaccucguaacgcgacgggccccccacugccgacaucugcgccccgccgaccg

SEQ ID NO: 6101 - RNA, 104 nt, Human
cggggacuacaauggccacgucggucuggguguuaagugcuccaaggagguggccaccgccauccguggggccaucauccuggccaagcucuccaucguccccg

SEQ ID NO: 6102 - RNA, 102 nt, Human
cggggagcuauuugcuuuuaugcuaaaugaccuuagaccacuuauaaaaugcauaugagugcuuuaaauguuauuuugugugugugugguguugccucccug

SEQ ID NO: 6103 - RNA, 69 nt, Human
cggggcccgucuggggcgccggcgggugcguuugaaucugguccgagcgcgggaaacggcggguccccg

SEQ ID NO: 6104 - RNA, 63 nt, Human
cgggggagaggggcaaaugccuccgggacugacacuccaggcagcuuugccuucucuccccug

SEQ ID NO: 6105 - RNA, 72 nt, Human
cgggggcaauggcaucgugggagcgcagguagucaaggacgaggauugugugcugcuuuagauuuggcccug

SEQ ID NO: 6106 - RNA, 67 nt, Human
cggggggagccgagauuagagcaucagccugagagaagcggugcuucugguucuccgcuccgccucg

SEQ ID NO: 6107 - RNA, 71 nt, Human
cggggguucggggggaugcccaggcccggugagcucgcucuccgccugggcacuugggcuccgggcccuug

SEQ ID NO: 6108 - RNA, 72 nt, Human
cggggucggcacacaggcuuugagacaaccaggaugcggagacaaucacaaagaguguguaggccagccccg

SEQ ID NO: 6109 - RNA, 80 nt, Human
cgggucacccgcugcgaugcuggcggucacucucuguaccuugccguguagccgaagccagcgggccgguugguggccug

SEQ ID NO: 6110 - RNA, 68 nt, Human
cgggugguaaaguggcaacgcgaauuuggguaucuggucucccaaaaguacuugccgcucuaccccug

SEQ ID NO: 6111 - RNA, 100 nt, Human
cgguacaugcagagcgaacgcugucgcagagucaucuguuuggugggagcuggaaucuccacauccgcaggcauccccgacuuucgcucuccauccaccg

SEQ ID NO: 6112 - RNA, 111 nt, Human
cgguaucauuccucgaauuucagugcgggaaccaaugcagacuggcauuaaggcuguggauagcuuggugccaauuggucguggucagcgugaacugauuauuggugaccg

SEQ ID NO: 6113 - RNA, 65 nt, Human
cggucagcuccccgauggccugggugagggcaggcuggcugcucugacaccauggggagcugcug

SEQ ID NO: 6114 - RNA, 71 nt, Human
cggucucaccaaacgccccaaacucuccuccacacccccucugagugcccuggggcgccuggcugaggcug

SEQ ID NO: 6115 - RNA, 72 nt, Human
cggugcuggggaagucggaggagugggcggacaaccaccugccccuuacggaugccgaacuggcccgcaucg

SEQ ID NO: 6116 - RNA, 61 nt, Human
cgguuucugcgggccaagcacggugcgcaaagagcgcguggugcggcccgacucggagcug

SEQ ID NO: 6117 - RNA, 77 nt, Human
cguaguuuaauuucucuguguuuuuuauauaaccaucuuugucgacaguaaagggcacgucuggagugaugauuucg

SEQ ID NO: 6118 - RNA, 79 nt, Human
cguauaucuguucucgguacuauagggcaccagaguugaucuuuggagccacugauuauaccucuaguauagauguaug

SEQ ID NO: 6119 - RNA, 61 nt, Human
cguaucgagcguggucaagcugcugcugcaguguccagcacagccagacaacgcacgaucg

SEQ ID NO: 6120 - RNA, 84 nt, Human
cgucaugucuaagucagagucuccuaaagagcccgaacagcugaggaagcucuucauggaggguugagcuugaaacaacugaug

SEQ ID NO: 6121 - RNA, 67 nt, Human
cgucccaaaggccggcaagaugguguccuggaugaucugucgccugguggugcugguguuugggaug

SEQ ID NO: 6122 - RNA, 80 nt, Human
cgucgucggcgcugggcaggcacacggcggacacugucugggagaagcggacagguguggccagcuccagcagggggaug

SEQ ID NO: 6123 - RNA, 70 nt, Human
cgugcagucuuugguguucagagcacagccgcaggccugugggcucugcugggggacccugugcugcaug

SEQ ID NO: 6124 - RNA, 80 nt, Human
cgugcucgcgcugcucucccaccgccgggcucugaagcagaagaucuggccuggcaucccgagcccagagagcgaguuug

SEQ ID NO: 6125 - RNA, 89 nt, Human
cguggaggcggugaaggaggaggcagcggcuguggcagcccggcaggagacggacucuaucccgcugguggacgacauccgcuuccacg

SEQ ID NO: 6126 - RNA, 101 nt, Human
cguggagguguagagggaucgcggucuggucgugugauuuugggaguuguuuggggugcggguucugugucgggugggagcguuuguuguggaccuccgcg

SEQ ID NO: 6127 - RNA, 65 nt, Human
cguggccgccuucgguuugaggugggcuuggagcacccgaacgccucgcgccgccuggggccacg

SEQ ID NO: 6128 - RNA, 89 nt, Human
cguggugugcucuguggggcaggaguaggugccaaaucuggacucuugucacuucuugcuuccugcuuugcagcuuucuuagcuucaug

SEQ ID NO: 6129 - RNA, 70 nt, Human
cgugucugugcaggguaugaucaucuaccgagccgccuacuucgguaucuaugacacugcacagggaaug

SEQ ID NO: 6130 - RNA, 81 nt, Human
cguguggcugugacgccgggucgcgaugugacauugugaaggugacagucauggagcgaccaacggcauuguaggcaugcg

SEQ ID NO: 6131 - RNA, 71 nt, Human
cguguuaggcgccgaugcgacgcucaucagacccagaaagguguguugauaagacagcagacgguggcaug

SEQ ID NO: 6132 - RNA, 73 nt, Human
cguuccuucccagccucagcccacggcaggggugcagccccaucuuucugcuguaggcugggcuacagggacg

SEQ ID NO: 6133 - RNA, 66 nt, Human
cguuucuaguaagaacuuggcaucaagucuaagaagaagggcuuuaccaaguacugcgcagaaaug

SEQ ID NO: 6134 - RNA, 72 nt, Human
guuuuucaucugcacugccaagacugagugguuggauggcaagcaugugguguuggcaaagugaaagaaggc

SEQ ID NO: 6135 - RNA, 77 nt, Human
uaaagcugaugauccaacaaugggggagggcccagacaaggcacgcucccagcuccugauccuggaucgaggcuuug

SEQ ID NO: 6136 - RNA, 72 nt, Human
uaaauaggcccagagugaagacuugagagcaaaaugccugaacacaugcaccuuauuuuuuggggcuguuua

SEQ ID NO: 6137 - RNA, 122 nt, Human
uaaaucugggcugagggaaagcauguccacaccaggugcccagacaucugguuggcuuuggcugauuuguccugcaggcaccugccuugucuggauuugcacacuuuccaaguugcccauua

SEQ ID NO: 6138 - RNA, 78 nt, Human
uaaauuggaaugacagaagaugagagcuaggaagugguauauuuaauuucuagauuucagggcuggagugguggagua

SEQ ID NO: 6139 - RNA, 80 nt, Human
uaacaacgaggccaggagggauuuuuacacagacccgagugaguggggggacaauauuuucccuccuaguuguguuguug

SEQ ID NO: 6140 - RNA, 92 nt, Human
uaacagcauucacucagucaggaggacagggcccucauggccugaccagcucuugaaggcccugccucuuaauacuguuacaauggcuauua

SEQ ID NO: 6141 - RNA, 74 nt, Human
uaacugcagcaauuuccuugaacugucuguagaaauucuggaaugcagauauuuauucaaugguacugcaguua

SEQ ID NO: 6142 - RNA, 107 nt, Human
uaacuguaagaaggaguguagugucccagcccugacaacgaguaccgccagggaccuaccaucuaacaccaucugggaacacuauuuuuucucaguccuuccaguug

SEQ ID NO: 6143 - RNA, 104 nt, Human
uaagacugcucucgaaguuuaucaggauguucacaugacaaaacuggacccaggcuacuuuaguuuuguugggauauuguaagcuaaauuuuucuguaaccuua

SEQ ID NO: 6144 - RNA, 78 nt, Human
uaagaguggcagggcggacuaacaggaggcaggccagcuacaggcaggcaggccuaaagggugcgauugccaaucuug

SEQ ID NO: 6145 - RNA, 63 nt, Human
uaagauuacaggcaugagccaccacaccugggcgcaaugugguccauuccuuuaauguccuua

SEQ ID NO: 6146 - RNA, 78 nt, Human
uaagauucugcugaggagcccccgcuggucccucugggcaugcugugcucggacggaaagcggggcugcggguccuug

SEQ ID NO: 6147 - RNA, 73 nt, Human
uaaggaagucagcacuuacauuacgaaaauuggguacaaccccgacaaaguagcauuuugugccauuuucuug

SEQ ID NO: 6148 - RNA, 103 nt, Human
uaagggauccuccugcucaggcucuggacuagcugggauuacaggugugugccaccacaccuugcuuucccacuaauucuguuccugcuaguuucuucccuua

SEQ ID NO: 6149 - RNA, 68 nt, Human
uaagguagcuggaacuagaaucaccaaggcuuuuucagcccuuggguucuuugguucucucucucuua

SEQ ID NO: 6150 - RNA, 61 nt, Human
uaagguuaugucuguguaugucauucacacuuaggcaagcauacacaggcacauggcuuua

SEQ ID NO: 6151 - RNA, 78 nt, Human
uaaguacuuucccuucucucacaccugugguugcgugggcuugccuuaugaccaacugaaagagugggaaaaagcuug

SEQ ID NO: 6152 - RNA, 86 nt, Human
uaaguuuuaggguacaugugcacaacaugcagguuuguuacauagguauacaugugccauguuggugugcugcacccaguaacuug

SEQ ID NO: 6153 - RNA, 130 nt, Human
uaaucuuaacauucucaacuaugauuaccaaagcagaaaaauaaaacacauuaaaucacaugcuggcuuaugaaagccuccaucuuuaagugacaugugcacucucguucauaguucauuggccaaagaa

SEQ ID NO: 6154 - RNA, 66 nt, Human
uaauggucuuaugccaauccaugcagaaaaauaagacacaaugcaggagucagaugaggaccauua

SEQ ID NO: 6155 - RNA, 72 nt, Human
uaauuuagugaggugaacgacuucagauuucauuacuggauuggauauuugagguaaaauuucauuugguua

SEQ ID NO: 6156 - RNA, 75 nt, Human
uaauuuauguuuauuauuuauacguuauauucgguuuauuuauuguguugguguguaaaauguagguguuuauug

SEQ ID NO: 6157 - RNA, 90 nt, Human
uacaaguaaacuuaaaaggagugucaaguuaucagacuuuguaaagauguugaaguuuuaaaugggaaagcccuuuugagcuuugcugua

SEQ ID NO: 6158 - RNA, 85 nt, Human
uacacauugaagagaacaaacagugggaguguuuauuccuuaagagagaauaaacugcagagauuaaaaguuuccuucgagugua

SEQ ID NO: 6159 - RNA, 77 nt, Human
uacacccagcucucuuuuucuaauguaaauguuguguacaauaguuuuauuugauuaagcuucaggacuguuuugua

SEQ ID NO: 6160 - RNA, 80 nt, Human
uacagaaacagauggguacaagaacuaagaaaacggcuaagaaaguguuuugguccugacuacuaccauuucgcucugug

SEQ ID NO: 6161 - RNA, 105 nt, Human
uacagauauucugaaaacuuuaaguucaguaauaugccagggguucccaagaccacuugagaccugguaauuuauuggaagucucuaagggaaucagaagcugua

SEQ ID NO: 6162 - RNA, 66 nt, Human
uacagugaaaccccaugucugcuaaaauuacaaaaaauuagcugggcgugguggugcacgccugua

SEQ ID NO: 6163 - RNA, 83 nt, Human
uacaucugacuuuauucccaguccucuuauccugugaaggcugguacacuagggaaaggggauauuuaaaaaugucaagugug

SEQ ID NO: 6164 - RNA, 62 nt, Human
uacaucugcugccuacauuccugcucacacauacgcuugcagcuuugaggcaggagagggua

SEQ ID NO: 6165 - RNA, 78 nt, Human
uacauguagauaugaucagauuuaccauuuuuagggggaagagggaaaaaaagguguuuuuaucaucaacuacaugug

SEQ ID NO: 6166 - RNA, 65 nt, Human
uacauuuauugaaauggcuguacauguaagcagguaacuacacagcagacguggcaauaugugug

SEQ ID NO: 6167 - RNA, 101 nt, Human
uaccagaaucuuuuauuugcaaagagaaacuaggggaaaauguagccaacauauacaaagaucuucagaaacucucucgccucuuuaaagaccagcuggug

SEQ ID NO: 6168 - RNA, 75 nt, Human
uaccagagcauacauauaucaacaguaagauguaauuuuucauuacaucacugcuagaauauuuagcuuugugua

SEQ ID NO: 6169 - RNA, 64 nt, Human
uaccucaagcagagagagggcuucaggccaccccacuucuggcucuuuccaguccuagcaggua

SEQ ID NO: 6170 - RNA, 60 nt, Human
uaccucuucaggauuuauugggucagggaagggccuggccagagaaucuguccugaggug

SEQ ID NO: 6171 - RNA, 75 nt, Human
uaccuggaggccauucacaacuucguggaggucuuaaacgaauauuuccacaaugucugugaacuggaccuggug

SEQ ID NO: 6172 - RNA, 70 nt, Human
uaccuggauaauacacccguuuugccucgugccgaauucggcacgagaacauauggguuaaaucucggua

SEQ ID NO: 6173 - RNA, 98 nt, Human
uacgacucacuauagggaaagcugguacgccugcagguaccgguccggaauucccgggucgacccacgcguccgaaacugucccccauagagguugua

SEQ ID NO: 6174 - RNA, 120 nt, Human
uacgcaaauuauccauguuagcacauuuggaacaaauguauaaauguacuuucugaauaaagucaaaagucuaacuuguuuuuaguuccauaauguuuuaauguuuaauuauauugugua

SEQ ID NO: 6175 - RNA, 87 nt, Human
uacuaaacagauacaccucuaaggauuuuuguaaaucucguucuuuuuagaguaguaacagcauuuuuagaggaauccauuuuauua

SEQ ID NO: 6176 - RNA, 71 nt, Human
uacuaagucugaagaugggcauuaugcaagaacagauuaugcagagaaugcuaacaaauuagaagaaagug

SEQ ID NO: 6177 - RNA, 109 nt, Human
uacuauuucuagcaucugagauccaggucaguugugauuaauuuuucucuguauuaugcaauguauuuuccugcuuuucaugccucucuacuggaugcuagacauugua

SEQ ID NO: 6178 - RNA, 64 nt, Human
uacugagcaaggccccagauccuucucucuggaggaagagggaagcccagggguccuguuugua

SEQ ID NO: 6179 - RNA, 75 nt, Human
uacugauacaaguuugauacaugcaauuguugggaggaaagauuccucagaaggcacaaagagcuguauugugua

SEQ ID NO: 6180 - RNA, 63 nt, Human
uacuuagaguaguaugagcaagcaugggcgccccaaacuuccauacuucacgcuaucuaagug

SEQ ID NO: 6181 - RNA, 110 nt, Human
uagaaauuuaccagagauagcaccuucugacccagugcagauuggacgguuaauugguagguuggaguugagucucacguugaaacagaaugaagugcuuccuggagcua

SEQ ID NO: 6182 - RNA, 63 nt, Human
uagaagagaggaggcaugucagugacuugaaauugcaaugaaaugcuacacaccucuugucua

SEQ ID NO: 6183 - RNA, 62 nt, Human
uagacuccaggcuuggucuucugggcacagccaucaccccaggagacaacuccuuggagcug

SEQ ID NO: 6184 - RNA, 72 nt, Human
uagagacaggguuuugccauguugcucaggcuagucuugaaugcccgggcucaagugauccaccccccucug

SEQ ID NO: 6185 - RNA, 114 nt, Human
uagagcaagugcagccauaagugguaagaaaugaaugaguauggcuguguuccaauuacaauuauuauggauggauauacucguauuuccuaugucagauggaaucuugcucug

SEQ ID NO: 6186 - RNA, 61 nt, Human
uagaggccagccuuugucuuguucagaugacuguugcacaggaaagacugcuggcugacua

SEQ ID NO: 6187 - RNA, 71 nt, Human
uagaguacagugucuuaaaauauucauguuuuacuuggauaucuagaagauaaaaggcauucuguauuuua

SEQ ID NO: 6188 - RNA, 61 nt, Human
uagcaaguucauaaguuuccaaaaaggaagcccauacauaacaguggagguguuuugucua

SEQ ID NO: 6189 - RNA, 89 nt, Human
uagcaccccuugcccugugucuguggaacagaagcagcuuccuucagagaagacugcagcucccaaggacacaagcuguugggaugcua

SEQ ID NO: 6190 - RNA, 79 nt, Human
uagcagcuucucgauguuaucagucaacaacaugccagcucugccuugcuuguugcugcaugauugcgagauggcucua

SEQ ID NO: 6191 - RNA, 89 nt, Human
uagcauccuugcugugcuucugaggcuacugcuguuagaaagcuuuagaaagcuuuuugccauggcacuggugagcuuguaaggggcua

SEQ ID NO: 6192 - RNA, 79 nt, Human
uagcaugaggugugugcauuugccaggggcaaauuucuauucucaauuaacccaugcagcaaaugcuacgcaucugcug

SEQ ID NO: 6193 - RNA, 110 nt, Human
uagcaugccaggaauauacaguaaagaacaagguggaucuucuucacggagguuacugugugagacgaaagacaguucacuguucaucacuggaaauacuguacgugcua

SEQ ID NO: 6194 - RNA, 77 nt, Human
uagccgugauguccgggggccguguacaucauguuaccgugggguggggucugcauuggcugcugggcauauggcug

SEQ ID NO: 6195 - RNA, 89 nt, Human
uagcuaggacuacaggggcaagcuaccaugucuggcuaauuuuuaaaacuuuuuuguagagacagggucuugcuauguuucccaggcua

SEQ ID NO: 6196 - RNA, 87 nt, Human
uagcuggcaugggacugguagugcaggcuggcucuuggaaaggaguauguauuccaggcugguuggcugcuguuccacugggagcug

SEQ ID NO: 6197 - RNA, 113 nt, Human
uagcugggauuacaggcaugcaccaccacgcccggcuaauuuuuuuguauuuuuaguggagacagcguuucuccauguuggucaggcugguuuugaacuuuugaccccaggug

SEQ ID NO: 6198 - RNA, 73 nt, Human
uagcuugcugcuuucacacaggucagaaggaucuaugccggauuugagcccaggucuuucugauugcaagcug

SEQ ID NO: 6199 - RNA, 122 nt, Human
uagcuuugaccaacacucuguguaaaccaaggucuguaacaucacauuucuccaucaauguuauguugccuguuucuuggucgauugcaaacagaucucuuguguuuccuccuacaaugcug

SEQ ID NO: 6200 - RNA, 76 nt, Human
uaggaaaggcaagagaaaugcuuguuucuuuuauauauccagcuuuuuaagaaauacguguuugccagucauccua

SEQ ID NO: 6201 - RNA, 88 nt, Human
uaggaaguaauguagaagagauagugauuaauaauacacguuuccuaaugugggauauugguggccaagaaucucuucguucuuccug

SEQ ID NO: 6202 - RNA, 62 nt, Human
uaggagugucgguuguuaagaacuagagcuuauuccuauuccaaaucuaucuugcgcuccug

SEQ ID NO: 6203 - RNA, 75 nt, Human
uaggaucugguguggcuuuuggggagccagugugcuguguggugaccucauuggccuccugaacccuagaaccug

SEQ ID NO: 6204 - RNA, 77 nt, Human
uaggcaugugauuucagguuuuucguacugaaaacauugaaauuucaguuggaaaacccccugaaauuuuaugagua

SEQ ID NO: 6205 - RNA, 79 nt, Human
uaggcgccgggugccgaugacugggccuucuugcucucggucggcuucuuggucucggcgugccccauucccggcccug

SEQ ID NO: 6206 - RNA, 89 nt, Human
uaggcuguaugcuguuaaugcuaaucgugauagggguuuuugccuccaacugacuccuacauauuagcauuaacaguguaugaugccug

SEQ ID NO: 6207 - RNA, 73 nt, Human
uagggaagaucuaggagaagaggaagaacaguaagccacugcuucuuggaaaaucuucugggggucugaccug

SEQ ID NO: 6208 - RNA, 68 nt, Human
uaggggagggaagagaacuaagaugauacuaacaaaugcuaucacugguuuuguggcugccucccuua

SEQ ID NO: 6209 - RNA, 75 nt, Human
uaggggucuguaccgggcuggccugugccuaucaccucuuaugcaaaccuucccaccccuguauucccaccccug

SEQ ID NO: 6210 - RNA, 62 nt, Human
uagggguuugcaaacaauacguagccaauuuccuuaaaagggaaauucuugugugucuccua

SEQ ID NO: 6211 - RNA, 102 nt, Human
uaggucccaacaguuuguguuuuccuuacugucccaguuuuauaucauuauucuuaguacuaaacagagugacaacagggagugacauuuguugaggaccua

SEQ ID NO: 6212 - RNA, 88 nt, Human
uaggugugaggauuaaaugacaaccuccuuagugugaugcuuuuacaaaguaaacacugaaagaguagguuuaaugguuaucacccua

SEQ ID NO: 6213 - RNA, 63 nt, Human
uagguugagaaaagacagacuugggguagagcuaggccgagucgcccucccuuucucuuuuua

SEQ ID NO: 6214 - RNA, 73 nt, Human
uaguacauaaaguggguccagggcacucagggcugugaaggcccugagcucugggagcccacacuauuuauug

SEQ ID NO: 6215 - RNA, 74 nt, Human
uaguacugcauucuguguauguaugugcauguauauuuguguguguguguaugcaagcucacagcugucugcug

SEQ ID NO: 6216 - RNA, 71 nt, Human
uaguagacugaugagcuggauugcuuagauugauaacauuuacaaauaggaguccaguugacaugcuauua

SEQ ID NO: 6217 - RNA, 74 nt, Human
uaguaguuguguugggauaagcaggagucuauaacuuucccucaucaaagauccuucuggucucaagggcucug

SEQ ID NO: 6218 - RNA, 105 nt, Human
uaguaucacagccuuucuauccugaacguuuuguuccuuagaugccagagaaauguuuagcauuggaauucugaaggcuugaggagugaaagaggugacaugcug

SEQ ID NO: 6219 - RNA, 87 nt, Human
uaguauuuccugaaauaacaaguuuagugcuuuaacuauggcuacaugugcuuaaggaauuugagccacuuauuuuugaagaugcug

SEQ ID NO: 6220 - RNA, 108 nt, Human
uagucagcauauagcgauccuggaaugagccucuguaucaucuggucacggaaguacgugguaugcaagaagccccggaggcuauccuauccaaagcuguagagauug

SEQ ID NO: 6221 - RNA, 96 nt, Human
uagucucauccagguaugacaugugccacugugucugaaauuccugagcaccgagggccgcuucaggcaccaggcacuuugccaaccugagagcug

SEQ ID NO: 6222 - RNA, 123 nt, Human
uagugagaugaacccgguaccucagauggaaauggagaaaucgccugucuucugcgucucucacgcugggagcuguagaccggagcuguuccuauuuggccaucuuggcuccucucuccucug

SEQ ID NO: 6223 - RNA, 67 nt, Human
uagugauuguuucucuucacccccaacauuuccguuuaccaaggucgaguuggagagaaauucauug

SEQ ID NO: 6224 - RNA, 89 nt, Human
uagugcugacuuuuuguuugaaauuaaacagauggguaaccuaauugguggccuccugacuuuuuaaggaaaaacgugugcagccauua

SEQ ID NO: 6225 - RNA, 64 nt, Human
uaguguccuguagaaacuguuccagcucagggaaaggggagaugcugcggauauacaggaucug

SEQ ID NO: 6226 - RNA, 130 nt, Human
uaguguucacauguugcucaguuuugcuaacugauaaaucauuuaauccucuucuucauauguaugaguacuaucuuauaucuguggucaagagugagguaagcaagcuccaacagacccugagaaccua

SEQ ID NO: 6227 - RNA, 62 nt, Human
uaguguuucagucggugacgucacucacucugagacggugacgucacucacucugagaccua

SEQ ID NO: 6228 - RNA, 85 nt, Human
uaguuacugcugagauaccauuucuucucuuugcaaggauacacauauucaacauacacaagagaggaauguaaagaagugccua

SEQ ID NO: 6229 - RNA, 131 nt, Human
uaguuaucagucaccaccagaccauuauuggcgguuagaauuccagaaacggugaauagaaguucaucuucuauuuugucuucauggaauauaucacucugguaaacagcugguucuaaauaugaugguua

SEQ ID NO: 6230 - RNA, 61 nt, Human
uaguuaucgaagcuuucaccagacuaccauaccugugugaaggcgacauguauaaugacua

SEQ ID NO: 6231 - RNA, 76 nt, Human
uaguucccaauccccaagguuuuguuugguuucuuuucuuuucaugucacacacucuccuugggugauuucaucua

SEQ ID NO: 6232 - RNA, 81 nt, Human
uaguucuauuuauauuuuugcaaaugucaggaucucauucuuuuuuaugccugaacaguacugcauuguguauauggacua

SEQ ID NO: 6233 - RNA, 105 nt, Human
uaguucuccccauacauaccccaagucacccuucucuuuccucgaaggcucaagguuuucgugaucuuuucagcuguacuuuauggaguauguucuugaguucug

SEQ ID NO: 6234 - RNA, 72 nt, Human
uaguugcuccccuaccuucugucggaauaggauuauucccaugcaccucuggguagguauagguaguagcua

SEQ ID NO: 6235 - RNA, 86 nt, Human
uauaaucuagccacaguguggcuauaaugaggcacggcuuauugcagcuggaaaucaauuauccucacgcugagguggggauucua

SEQ ID NO: 6236 - RNA, 83 nt, Human
uauagaacccagcucagaugugacuuccagagaggguccaggcauucaaacccacucucugccaugucacuuaguguucugug

SEQ ID NO: 6237 - RNA, 79 nt, Human
uauauagguaaagcucuaagacuccugagccaacuuuuauguaacuggcuuccuaggcuugggagcuugaacuacugua

SEQ ID NO: 6238 - RNA, 117 nt, Human
uauaugcacuugaaaguauucaaaagucuucccggacaaaaugaggacuugguacuuacuggauaccagguugacaaaaacaaggaugacgagcugacgggcuuuuagcagcaugua

SEQ ID NO: 6239 - RNA, 102 nt, Human
uauaugccugauucauaguaaaauaccucuaauaaacauuguuuuauagaaaaccugacuucagugaauauuuugguauuuuacagugggccaguuuauaua

SEQ ID NO: 6240 - RNA, 83 nt, Human
uauccugggcuacuguauggagaauauguuguagagacaggcaaaagucuagguaggacauaaugguagcuuagacuaggaua

SEQ ID NO: 6241 - RNA, 103 nt, Human
uaucgcagugugggaacaagacuuuucauugccuuuugcucaguaagauugucuacacaaacugccacgggaggaaugacaagcaguugacccacuggugaua

SEQ ID NO: 6242 - RNA, 129 nt, Human
uaucuggacagcaggaagggccacauaaccuucugugacuguagucgucuguccaguacuuucucugugccacacaccugcacuacaguaaccccgagguagagugccaguaucuucccuuuucagaua

SEQ ID NO: 6243 - RNA, 91 nt, Human
uaucuucccuuccaaccuggugucagcagccuuucgcucauacucuaccaccuaugaagagaggaauaucaccggaaccagggugaaggug

SEQ ID NO: 6244 - RNA, 78 nt, Human
uaucuucuuucauuauggagggagguuuggcagauggagaaccugaucgaacuucgcuucuuggugauagcaaagaug

SEQ ID NO: 6245 - RNA, 74 nt, Human
uaugaaaggugugaacuugcaauguccuccugucuuaaacccaaguugacagugcccucucaaaacuuuucaua

SEQ ID NO: 6246 - RNA, 71 nt, Human
uauggcauucuguuuaauacacgaaagguuuccacuugauauacauuguguuaaaacagaagauagccaua

SEQ ID NO: 6247 - RNA, 87 nt, Human
uauggccacccgaaagcgcuccuccagcagggacagcucacugaugaggucggugauggcguugguaaaggcuuccugggggcugua

SEQ ID NO: 6248 - RNA, 81 nt, Human
uauguccagauucugugaccacuaguuacuguaucagaacucaucagguacccacuuauaaauagcacugaucuggcugua

SEQ ID NO: 6249 - RNA, 94 nt, Human
uauuacguugaaugagaguagugagagugggcauccuugucuugucaaaguucucaaggagaaugcuuccaguuuuuacucauucagcaugaug

SEQ ID NO: 6250 - RNA, 74 nt, Human
uauuaucacaguguuauucuucuucauaucuguggcaugacagguguaucugaaagagaaacgaccgugaaaua

SEQ ID NO: 6251 - RNA, 114 nt, Human
uauuauugggcaccuguuaugugagacacuguccuaggcacugugggauaacaacagcaaacacuucacacaacagccuggccuuccuguguuuuacaacagcuccuaaagaua

SEQ ID NO: 6252 - RNA, 74 nt, Human
uauucuaaguauuccaaauaaguugacucauacaguguuuauucuuuuaugucuggcuuauuucacuuagcgua

SEQ ID NO: 6253 - RNA, 75 nt, Human
uauuggcuagcuugugcccucaaguguuuggaauguaucuaguaaagcuugcuguggccauggugcuggcuggug

SEQ ID NO: 6254 - RNA, 76 nt, Human
uauuggugccuucuuucaucaugccuuuuaaaucuaaggguuacugguauaugcuuuuagaagaauugugucaaua

SEQ ID NO: 6255 - RNA, 74 nt, Human
uauuguuuauguauugucuauggcugcuuuugugcuucauacagcaguguugacaaguuaugacagagacagua

SEQ ID NO: 6256 - RNA, 71 nt, Human
uauuuaagaaaugucuuugaccccauguguuaggaccccaucuaauuccuugucuccuuguuuccuaagug

SEQ ID NO: 6257 - RNA, 73 nt, Human
uauuucugaucgauauuuuuguguaauaagcauggaaaugaacuuuauacacaccacuguguugucagagaua

SEQ ID NO: 6258 - RNA, 94 nt, Human
uauuugaaauaauauuuugguugacuuaaguuuugagagacaauucuaaaauugaucuagagacucauucaauagcaaugugaccuuuuaaaua

SEQ ID NO: 6259 - RNA, 78 nt, Human
uauuuguauuuuacuaugauaguugagaaauuuagccucuuagucauuuuuagcuguuauuguggaagaccucaaaua

SEQ ID NO: 6260 - RNA, 79 nt, Human
uauuuugcauccuaguuuguauuaugaagucaucauauauauauuugaaauaguauaagcuaauuacuguugcagaaug

SEQ ID NO: 6261 - RNA, 98 nt, Human
uauuuugcauucuuugugugccuuaucauguguuaaguaccaugaggguacacccaggcuuagcacaaugcauuugguauacaaaaccauguaaaaug

SEQ ID NO: 6262 - RNA, 90 nt, Human
ucaaagcugaggcuuggagcaggugugaguugccuuccauugauugguuaggugaccuccgcccaccccugcuccaacuuccauaguuga

SEQ ID NO: 6263 - RNA, 76 nt, Human
ucaacagcuuaggaugugucccuuucaacucagacuuuucauuuuagagaauggggcagauggggcaaaucguuga

SEQ ID NO: 6264 - RNA, 76 nt, Human
ucaacgcagugaaagauguagccaaagcccugugagaccucaucagugcaacgaaggcugcagcuggcaaaguugg

SEQ ID NO: 6265 - RNA, 87 nt, Human
ucaaggccccaaggugaggcaaaucccuggaaggcuugaacccugcaguucagucucccgggguaaucacuccccaauaagcaguga

SEQ ID NO: 6266 - RNA, 73 nt, Human
ucaagucauaggcuucuuucagucuuuaugucaccucaggagacuuauuugagaggaagccuucuguacuuga

SEQ ID NO: 6267 - RNA, 71 nt, Human
ucacaaauggcagaacaguauguaaagcugguaacaccucgguuucagugcaccauguguuugcuuuguga

SEQ ID NO: 6268 - RNA, 73 nt, Human
ucacaauuuuuuucucuggcuccuuuaaaacaaacgaaaaauguuucugugugcuuugguauucuagcuguga

SEQ ID NO: 6269 - RNA, 61 nt, Human
ucacagacaacagccugguggcagcgggccacgacugcuucccggugcuguucaccuauga

SEQ ID NO: 6270 - RNA, 113 nt, Human
ucacagggaguuaaugaggggugaggaaggccgaccaggcaagaagcucaagaaggugaagcuucggaaguuggagaggccuccagaaacgccaacaguugauccaacaguga

SEQ ID NO: 6271 - RNA, 72 nt, Human
ucaccaccacagagagccagcaaggccuucaggaagucuccggaggugucacccucaauggcuugguggaga

SEQ ID NO: 6272 - RNA, 76 nt, Human
ucaccagcuuccuggagcugcacugccuugagagccccacagagcugucucagagcagcgacagugaggccgguga

SEQ ID NO: 6273 - RNA, 114 nt, Human
ucaccauguuggccaggauggucucgaucucuugaccuuguguuccacccgccuuggccucccaaagugcuggaauuacaggcaugagccaccgcgccuggccuguauauguga

SEQ ID NO: 6274 - RNA, 124 nt, Human
ucacccagugguucucucagcaacagacauguccaguggaccguaguguugugacggucgcccaucugcgcccaguaccucggaucaugcggaacauguugucaaagcugcagauugccuguga

SEQ ID NO: 6275 - RNA, 73 nt, Human
ucacccgcuuugugaaauggccccgcuauaucagguugcagcggcagagagccauuccucuauaagcggguga

SEQ ID NO: 6276 - RNA, 64 nt, Human
ucacccugucgcacuucaccguggggauaacggggucuaccauggucuagaagugcacugguga

SEQ ID NO: 6277 - RNA, 81 nt, Human
ucaccucaacuggauucggaaugugcugauuuccauuggacucaaguugaucucacuuauauucugagugccgggagguga

SEQ ID NO: 6278 - RNA, 82 nt, Human
ucacgaggacggagggccauguguugggucagcaccaucagcuucauggcggcugaagagaugcauuggccugucccuauga

SEQ ID NO: 6279 - RNA, 70 nt, Human
ucacggaacaaugcuucaacacguuagaacgaucagaaauguugcuucuacuuuugaggcgcuucccuga

SEQ ID NO: 6280 - RNA, 104 nt, Human
ucacguccuaggagccgcauguucaugauugagaucgcaggcgugaagcuuuuguacacuggugauuucucaagacaagaacguuggcacuuaauuggagguga

SEQ ID NO: 6281 - RNA, 130 nt, Human
ucacgucucugcaaaguagcaagugguuauguucauaucauuuugaaagcugaguggauagauuuaaauagcaagagcuuuguucggaaugauguguggaacccagaaucacagacccugcgauacauga

SEQ ID NO: 6282 - RNA, 84 nt, Human
ucacuaaguucaucuguggggcuggaaggggaggguuggcagaaagucagccccacccaguccacgugguugcuauacauggga

SEQ ID NO: 6283 - RNA, 91 nt, Human
ucacuauaaagcgaugaaguccauaguacaauaguauaucugcuaauguaaaguuauacccuguaagguagacuuuaucuucaagauauga

SEQ ID NO: 6284 - RNA, 76 nt, Human
ucacucuguugcccaggcuggagugcaguggcacuaucuugacucacugcaaccuccaccuccuggguuccaguga

SEQ ID NO: 6285 - RNA, 71 nt, Human
ucacugcugcccacugcagggucccugaggugaaguaaacgccggcgcugggcuuggccagucggcaguga

SEQ ID NO: 6286 - RNA, 76 nt, Human
ucacugugucgcccagguuggagugcaguggcgcgaucuccaccuacugcaaccucugccucccggguucaaguga

SEQ ID NO: 6287 - RNA, 76 nt, Human
ucacuugagcccaggagaucgaggcuguaaugagcuaugauugggccacugcacccuagccugggcgauagaguga

SEQ ID NO: 6288 - RNA, 76 nt, Human
ucacuuuggugauaucaugggaagguguacuuccggugaugccuagaggucacguccugugaugucauuaggcuga

SEQ ID NO: 6289 - RNA, 113 nt, Human
ucagaagggguuuuuaucaaaaauauguagauucuacuacaauauuuuagcuaaagaagaagaaguaguaguagcaguaguagucaguauuuuugacccugacccaacucuga

SEQ ID NO: 6290 - RNA, 105 nt, Human
ucagaaggucacgcaacagaugcuguguuaggagcaugaggguagauauaugggccauuugugauguucaggauacggcugauuugauucuugguguccaucuga

SEQ ID NO: 6291 - RNA, 84 nt, Human
ucagacaucaguuucauagaacuauauaaauguaaaguagcacugcuaugacacaggauggguucuucagaggaagcuuuuugg

SEQ ID NO: 6292 - RNA, 76 nt, Human
ucagacuugcauuucaccaggcauucuuuagcugccugcggugcuaaagaauggguggcugggcugugugagauga

SEQ ID NO: 6293 - RNA, 87 nt, Human
ucagagacaccucucauuucuccucaaugccacugcacugaugucaacugacuuagggcaggcaugagagaacugagguuuacaugg

SEQ ID NO: 6294 - RNA, 62 nt, Human
ucagagucuccuaaagagcccgaacagcugaggaagcucuucauuggaggguugagcuuuga

SEQ ID NO: 6295 - RNA, 81 nt, Human
ucagcauuccuuacuaugugauaaaauacauauagaauauaagauauacuauauacauuuuguccauaaacguuaugcuga

SEQ ID NO: 6296 - RNA, 74 nt, Human
ucagccccagagagucgaugggggacacugacaaaccaaucacaaaguuaggugccauuagcucuuagggagga

SEQ ID NO: 6297 - RNA, 90 nt, Human
ucagccugcugaacaguuccuuuuucagagacauagauaccauccaaaaauuuccugauauccuuguuuuuaacuguuguggcuggcuga

SEQ ID NO: 6298 - RNA, 86 nt, Human
ucagcuaauguccucaaagacacacccaucagacacacugacugacucucuaaugugugugugagugugcgugagauaagaguuga

SEQ ID NO: 6299 - RNA, 118 nt, Human
ucagcugacauuguauagcuaagaaauaguaaagcagggauuugaacuccacaucugacccuacagccuguauucauaacaacucugcucugugucuuggcuccaaagucuucucuga

SEQ ID NO: 6300 - RNA, 84 nt, Human
ucagcuggugcagcuggaguuugucucaggcaaggcuccugacuuccuucuugccggcucaacuucuccgacucuaccagcuga

SEQ ID NO: 6301 - RNA, 85 nt, Human
ucaggaccccaagggggagcugcagggccagaaugugcugaccguccgguacucgcuggagcugacugcugcccgcuuggcuugg

SEQ ID NO: 6302 - RNA, 71 nt, Human
ucaggauguuguuugaucuucucaaacaucuaguucccugcuugaugggaggauccuaaugaaauaccuga

SEQ ID NO: 6303 - RNA, 70 nt, Human
ucaggccaucugggcguauacgugcaagucacagggaaugcgauggcuuggcuugggcucagaggccuga

SEQ ID NO: 6304 - RNA, 99 nt, Human
ucagggaagugaaggaaguccagucuggugagaguguuaagucugagagaaagacuagauagaacgaggcucggaggucuccuaauuuucauccccuga

SEQ ID NO: 6305 - RNA, 72 nt, Human
ucaggugucacauuccaagcagauuggcccucaucccucagaauguggaucugccgaauugaagaggccuga

SEQ ID NO: 6306 - RNA, 72 nt, Human
ucaggugucacauuccaagcggauuggcccucauccuucagaauguggaucugccgaauugaagaggccuga

SEQ ID NO: 6307 - RNA, 63 nt, Human
ucagguugagagugagcugcugugagccagugacaacuacugcuacaacuugcuguuacuuga

SEQ ID NO: 6308 - RNA, 86 nt, Human
ucagucugccugcgggcucuguuggcaucccuugcccugacacugggcaccuuguggccccuagcaggcccaccuuggcacaccga

SEQ ID NO: 6309 - RNA, 80 nt, Human
ucagucuuugaccaacugggaucauacagagggacaaaagcuccucuagaggauuauacagaugaugauuuaagcacuga

SEQ ID NO: 6310 - RNA, 79 nt, Human
ucagugcgggaaccaaugcagacuggcauuaagcuguggauagcuuggugccaauuggucguggucagccgugaacuga

SEQ ID NO: 6311 - RNA, 74 nt, Human
ucaguggcuacgggaugaacuggccaacacgcagcagaaacugcagaagagugagcagucuguggcucaacugg

SEQ ID NO: 6312 - RNA, 113 nt, Human
ucagugugcaucagauugacugggaucuuguuagaaugcagauucugcagaucuaggguggggccagcuuuucugcauuuuuaacaagcuccagaugauaaugaugcuucugg

SEQ ID NO: 6313 - RNA, 72 nt, Human
ucaguuauucaggaguuucuguauggggcacaaauuagcucuucuuagcagcagacuaaucugaagaaauga

SEQ ID NO: 6314 - RNA, 82 nt, Human
ucaguuucuggccccgauaugaguagggggagcgcagaguacggugaccccaacugcuuuuuguccuggguugguacauugg

SEQ ID NO: 6315 - RNA, 104 nt, Human
ucauaguggcaaugaaugacgagcauugagccaucaugaggugccaggcacugcuucggaaaccaaaggaccaugcugaagagcucugucguucuccacucuga

SEQ ID NO: 6316 - RNA, 76 nt, Human
ucauaucagugaauauuugcuaagaacaggaaagagaagucuuccuuucaaauagcuuauuguucauugggaauga

SEQ ID NO: 6317 - RNA, 64 nt, Human
ucaucccgucguccuguuccucaugauguugggagcgcugacacggggggcaggguggggguga

SEQ ID NO: 6318 - RNA, 72 nt, Human
ucaucgguggcggagucuuccaggccaucaaggguuuccgcaaugccccuguuggaauucggcaccgguuga

SEQ ID NO: 6319 - RNA, 123 nt, Human
ucaucuauccccuaggccagauuaucuuaucagcuacugacccaguuagcuuuccuacuucacaacagguuucuaaugcuuuaugucagugugagagaaauggcaaguugggaaaauuuguga

SEQ ID NO: 6320 - RNA, 71 nt, Human
ucaucucaucagcgacaggucucccucccagaaccccaucaggacaggagaaaaggcagcaagagaggugg

SEQ ID NO: 6321 - RNA, 76 nt, Human
ucaucuguuaaucccagguguccucauguugcugaaauauuuagauagcuaaaauaucccuuaauuucacagauga

SEQ ID NO: 6322 - RNA, 73 nt, Human
ucaucuuuguccuuaaauuaaccuuugcucuugagagcaaaagagggaaagacaggggaacaucaaagcauga

SEQ ID NO: 6323 - RNA, 73 nt, Human
ucaugaccacaguccaugccaucacugccacccagaagacuguggauggccccuccgggaaacuguggcguga

SEQ ID NO: 6324 - RNA, 64 nt, Human
ucaugauaucaagugccucauuaaauuuguccuugacagauggaugugccagcacuuggucuga

SEQ ID NO: 6325 - RNA, 84 nt, Human
ucaugccucgcagguauucgaguugcagguuugccugacugguccggugagccugaagaguguucgcguugugcguaggcaaga

SEQ ID NO: 6326 - RNA, 91 nt, Human
ucaugcgagaccuggcugcuguagcugcugcgggacuaccacugauaggucgucaggcucagguagcugcuggccgcguacuuguugguga

SEQ ID NO: 6327 - RNA, 74 nt, Human
ucauggagauacaauaacaccacuuaucagugaaucucaauucaagauguuauggaggaauagauuugcuuuga

SEQ ID NO: 6328 - RNA, 90 nt, Human
ucauggucucagcgaauagcggcccuuagggcuggccccuuacaugugugagugcccagggcugaggguggcuggccaccugaguccuga

SEQ ID NO: 6329 - RNA, 84 nt, Human
ucauguacaagaguucacaccugaugaauguagacacauuccuagagaacauuuaucaaugugaaaauuucuuuaauacacuga

SEQ ID NO: 6330 - RNA, 74 nt, Human
ucaugugauagugcaacaguuuggcuuugcggaaaaauuuuaaacaguccacaacuuugcaucuaaacuuaugg

SEQ ID NO: 6331 - RNA, 94 nt, Human
ucauguguuuugcacugacuaguacugaauaauacaaccacucuuauuuaauguuaguauuauuuauuugacaacucagugucuaacagcuuga

SEQ ID NO: 6332 - RNA, 71 nt, Human
ucauguuaauacauuagcauucuagccgcauggugucugcuggcacuuucugagaugauugauugacauga

SEQ ID NO: 6333 - RNA, 65 nt, Human
ucauguuccccgugacaggugggccugaggggucggcgugaccccuccccagcaugguagcauga

SEQ ID NO: 6334 - RNA, 84 nt, Human
ucauuccucuuaaucuucacuaaaauggacaaguauucauugagcaccuaaugcguguucaguauggugggagaugagggauga

SEQ ID NO: 6335 - RNA, 100 nt, Human
ucauugcugcaaggaacuuccaugccucuaacacucaucuucaaaagacugggacugcugagauguccucuauucuugaagagcguauucuuggagcuga

SEQ ID NO: 6336 - RNA, 76 nt, Human
ucauuggguauguguaucugcguguguguguguguauguguauguauauacauacauauauauacauauguaauga

SEQ ID NO: 6337 - RNA, 72 nt, Human
uccaaauauguuauauuaaaaccuuguuccuuggcaauuucacuaagcagcuggauguaaucuguauuugga

SEQ ID NO: 6338 - RNA, 93 nt, Human
uccaaggcccuggugagaagauguugcuuugggagucccaguuguguaagacuccugacucucuuguaaaggagcaagguuuuuaggcuugga

SEQ ID NO: 6339 - RNA, 101 nt, Human
uccacaguuugaucucuucucuguucccuccacacucuucuuuugcuccucuuccuguauuucagagugguuaagaucauggaagucagacaagcuauggg

SEQ ID NO: 6340 - RNA, 89 nt, Human
uccacgccgucauucucuucaucuguauaaacuguggcugguucacuuuaacccugagcaggagcugccuaugaaagaggauggcugga

SEQ ID NO: 6341 - RNA, 71 nt, Human
uccagaaggaccucaucucugcaccucuuacuugaggagcaagaggagggaagggagaaagggauguagga

SEQ ID NO: 6342 - RNA, 88 nt, Human
uccagacacuuucuuccuucaguucagggaacccucaauacacaguaagaaugaagagguugcaggucugagcuugaggaggacugga

SEQ ID NO: 6343 - RNA, 76 nt, Human
uccagagacuuuggagacuuuucguuuuuuagauuucucauuuuaaaacacacauaauacaaguuuucuuucugga

SEQ ID NO: 6344 - RNA, 127 nt, Human
uccagcagccuucuuguccacugcuuugaugacacccaccgcaacugucugucucauaucacgaacagcaaagcgacccaaagguggauagucugagaagcucucaacacacaugggcuugccagga

SEQ ID NO: 6345 - RNA, 73 nt, Human
uccagcuauguaaccugcuacaaauguuacaaccagcugcucuggcuuugaacauucacugcggggcuuagga

SEQ ID NO: 6346 - RNA, 76 nt, Human
uccaggaccucaaugaccgcuucgccagcuucaucgagcgcgugcacgagcuggagcagcagaacaagguccugga

SEQ ID NO: 6347 - RNA, 88 nt, Human
uccaggccgugcgcacccaggagaaggagcagaucaagacccucaacaacaaguuugccuccuucauagacaagguacgguuccugga

SEQ ID NO: 6348 - RNA, 70 nt, Human
uccaggguuaguuuuuguagccucggcuggcccgucggccucuggcacgcucgaacuuccggcccuugga

SEQ ID NO: 6349 - RNA, 75 nt, Human
uccaguccauggcaggcggguacaaggggagguaagaugggagcuccacuccuuggaccaccagcugguucugga

SEQ ID NO: 6350 - RNA, 70 nt, Human
uccaguggaugucucuuuucagugcacuggguggucaaugcccacucgcucugaaaucaucugacuguga

SEQ ID NO: 6351 - RNA, 86 nt, Human
uccaguugcuauggcaacaggccauucugggccagccacgucucugcauggcagugcccaaugguggaguugcuaugggcaacgga

SEQ ID NO: 6352 - RNA, 73 nt, Human
uccauaaucugcuaguuuugcauguacuuauaugaacaacagugcaguaaguugaaaacucaguaucuaugga

SEQ ID NO: 6353 - RNA, 90 nt, Human
uccauagaagucucucagcaaaugcucuuuuuuugaaaugcuuuaaauguauacuuugagacggagguuugagcugaguacugcugugga

SEQ ID NO: 6354 - RNA, 70 nt, Human
uccaucccgggugugcagggcauucuagcuucaagagggagucaguugcacugugccuggaaauagugga

SEQ ID NO: 6355 - RNA, 65 nt, Human
uccaucgggcagccagaggccagcgucuccgaugacacugagcaccuggugaauggccggaugga

SEQ ID NO: 6356 - RNA, 66 nt, Human
uccaucgggcagccagaggcccagcgucuccgaugacacugagcaccuggugaauggccggaugga

SEQ ID NO: 6357 - RNA, 80 nt, Human
uccaugcguauaucggacguggucucauacgcguugcugcagugcuguugcacgcggacaugaccaugcacgacguagga

SEQ ID NO: 6358 - RNA, 88 nt, Human
uccaugugacugucggcgggcuuugucucuggauucgauggcucugcgggcacagccaucaucacagaagagcaugcagccaugugga

SEQ ID NO: 6359 - RNA, 74 nt, Human
uccauucuuaaaaucaagcacaaaaucugacaaugaaacauauccagggguuguguguccccaucugaucugga

SEQ ID NO: 6360 - RNA, 70 nt, Human
ucccaaccuccccuuccuguggcugccccagagccugugagggaugcugcaguacaggggagcauaggga

SEQ ID NO: 6361 - RNA, 66 nt, Human
ucccaagaguucugcugcaucagccagugaggacaagaguucuucagugcgguucagcucaaggga

SEQ ID NO: 6362 - RNA, 63 nt, Human
ucccaauggcauuucagaagugagcaguggaauuuuccugccauccuaauaagagcccuggga

SEQ ID NO: 6363 - RNA, 75 nt, Human
ucccacagucgggaggaaaagaaagaagacucuguuguucauuguuuuuaucuuuuucuccagaugccuguggga

SEQ ID NO: 6364 - RNA, 65 nt, Human
ucccaccccaggaagcuacaagagacaggcuguccuguccccacaacucucccuggguccuggga

SEQ ID NO: 6365 - RNA, 77 nt, Human
ucccacguuuguuccagaggaauuuaacuuucuguauuuuuccaacauuaaaauccacaucaauagcacacguguga

SEQ ID NO: 6366 - RNA, 71 nt, Human
ucccacugaacuuuuucuccaauucgcguacuagccggacuuggauuuucuggaaagauuucaguugagga

SEQ ID NO: 6367 - RNA, 96 nt, Human
ucccagauucuuccugguggaggcauucggagagcaacacccuggccuuaacacacuacauaucuuugaauuucacacgggggcagccuucuggga

SEQ ID NO: 6368 - RNA, 73 nt, Human
ucccagcucacucagcuggagcugaaggggaacugcuuggaccgccugccagcccagcugggccagugucgga

SEQ ID NO: 6369 - RNA, 73 nt, Human
ucccaguugcuacccugcauagcggccuccuucccaggcucugguggcagcgcauggagggguagugcuggga

SEQ ID NO: 6370 - RNA, 70 nt, Human
ucccccgaccuaugggcauaccuuuaagaauuagaaaagucuuuuccgugguagaucaaacgcgagggga

SEQ ID NO: 6371 - RNA, 80 nt, Human
uccccgacagguguccucucccggaaucggggucugaaccccgccaagcucugcaggggaggaagcaccugggucgggga

SEQ ID NO: 6372 - RNA, 106 nt, Human
uccccuaggccagauuaucuuaucagcuacugacccaguuagcuuuccuacuucacaacagguuucuaaugcuuuaugucagugugagagaaauggcaaguuggga

SEQ ID NO: 6373 - RNA, 66 nt, Human
uccccugguuucuugucgucugugcuugauucuugaacagguaaccacuugagaggaugccggcga

SEQ ID NO: 6374 - RNA, 61 nt, Human
ucccgaguuagcgugggauacacgggugcacgcaccccccacgcccagcuuaauuugcgga

SEQ ID NO: 6375 - RNA, 110 nt, Human
ucccggaguuuauggucuggugagaagaucccugcucugagucacugccaagcucuagcuaugugacuuugaacagggaauuucugucccuaucuauaaaauaaacgggg

SEQ ID NO: 6376 - RNA, 70 nt, Human
ucccggaugaagaggugagcuccccuucgcccccucagcgagcccagcguggggaccacucuucccggga

SEQ ID NO: 6377 - RNA, 64 nt, Human
ucccguggaggcucgcgccgacggcggcggggacgagacugccgagcggacggaggcuccggga

SEQ ID NO: 6378 - RNA, 81 nt, Human
ucccuacaguugugccaugcauuuaagcgagugguauugcaggaaguccauucuggcucugguggauggacagccuuggga

SEQ ID NO: 6379 - RNA, 78 nt, Human
ucccucucccaccugucugcauagaaaggcagaauuagacauagcaugcuuuggaaaagcaaauaggaauuguuggga

SEQ ID NO: 6380 - RNA, 111 nt, Human
ucccucugcuagugaguacaaaugaagucugugggccaacaaggagcgaggagcaguuuccuggaagcccugggcugguguuugacuugcuuugagauagaauaaauggga

SEQ ID NO: 6381 - RNA, 63 nt, Human
ucccucugcuggaccugaaugguacugaugcuguugagagccaucugguccucagacauggga

SEQ ID NO: 6382 - RNA, 73 nt, Human
ucccucuugcgcuguaugacaucguccucaaaccacucggccugauuggaaacccagaacauagccacaggga

SEQ ID NO: 6383 - RNA, 94 nt, Human
ucccugaccacaccuuuacucagaagucuaaggaacagacuguuuaaccuguuuccagugguuucagggacuucuguauuggguguagcaagga

SEQ ID NO: 6384 - RNA, 105 nt, Human
ucccugcagggcagagcucccggcuuuggugcguccuucccagcgcgcuccauggucugggaugggcgguggcggcccgggccggccugcuacuugaggcaggga

SEQ ID NO: 6385 - RNA, 70 nt, Human
ucccuggagguucuggaugaaggcugaacacaggcuuguuaaugucagucugugcugaggaccucaggga

SEQ ID NO: 6386 - RNA, 73 nt, Human
ucccuucagagcccauggguuucccauucccuccugucagcccuggccaugaaauccuggggaucuggaggga

SEQ ID NO: 6387 - RNA, 71 nt, Human
ucccuuguggaugcaaugaauggaaaggaagguguuguggaauguuccuucguuaagucacaggaaacgga

SEQ ID NO: 6388 - RNA, 94 nt, Human
ucccuuuuauuaaccaucuucccuuucucgaguauacacaaguagaaaagaaacagugaaguaccccgauagggaggguggggagaggauggga

SEQ ID NO: 6389 - RNA, 63 nt, Human
uccgaguucccaaacaaaacacagguaccuaagggcuucaucuguaggccuugggaacuugga

SEQ ID NO: 6390 - RNA, 71 nt, Human
uccgauucuucucaaagugcacuguguuaagccuaguguaagguagcauaauagaaaaguggagaauucga

SEQ ID NO: 6391 - RNA, 76 nt, Human
uccgcagugugagaaguagauaggguuacugguuacgucaguaaaaccgaggcucaguuuaaucuugagaugcggg

SEQ ID NO: 6392 - RNA, 87 nt, Human
uccgccggucccaguccaggucucgcuggcgcuuuucuuccuggagccucagcuucuccuggauuugcugcuucuggacuaggcgga

SEQ ID NO: 6393 - RNA, 64 nt, Human
uccgcuccagacuuuagucacuagguucuaggagugagcuggggccugcugagguggggguggg

SEQ ID NO: 6394 - RNA, 81 nt, Human
uccggaaccugugcucagaugacacccccauggugcggcgggccgcagccuccaagcugggggaguuugccaggugcugga

SEQ ID NO: 6395 - RNA, 65 nt, Human
uccggaugucuauaagacuuuguaucuuccuuuauuuguugguugguaugaauuuugcagccgga

SEQ ID NO: 6396 - RNA, 85 nt, Human
uccuaaauacuccaucuguuuaguacuguauuguggaauauuugaguucuauuuccauacuugaaaacauggaggauuuuagaga

SEQ ID NO: 6397 - RNA, 98 nt, Human
uccuagaaccugaacauuuggcuuggcaggugcgaaacguaucuagaagcuuuacuggagccagcacucgacgcaaaauguccuuuaggucccuagga

SEQ ID NO: 6398 - RNA, 73 nt, Human
uccuaguggugcgggcacacacacccugcacgccacacaccaccuacaggguggccgugagccgcacccagga

SEQ ID NO: 6399 - RNA, 71 nt, Human
uccuauggaagcugguagcaguauuaucuuguuuauggauaaaaauugcugcgaaaagagcuuuccaggga

SEQ ID NO: 6400 - RNA, 85 nt, Human
uccucaaauacuacacauuuaaaggaacuguuaaacugaaaaagacuugacaauuuuugguaaauccguagcacagaaaugagga

SEQ ID NO: 6401 - RNA, 81 nt, Human
uccucaucggcaaggggggcggaaaauucgcaaggugcgcgacagcacuggagccacgugucaucuucccugcggugagga

SEQ ID NO: 6402 - RNA, 74 nt, Human
uccuccaaggaagugauaauaguggcaacauuuaaaagauaaaaugggaguuauuaggagaugauuggugagga

SEQ ID NO: 6403 - RNA, 85 nt, Human
uccuccgaaccagcauccccaccaucaacauggagaacaagaccacgugguucucuguggacauugacucggagcugguggagga

SEQ ID NO: 6404 - RNA, 72 nt, Human
uccuccgcagaagguuggugggggguccagucugugauccuuggugcugugugccccacuccaaccugggga

SEQ ID NO: 6405 - RNA, 71 nt, Human
uccucuucacucugcucucaggagaucuggcugugaggcccucaggccagggauacaaagcggggagaggg

SEQ ID NO: 6406 - RNA, 74 nt, Human
uccucuuccagcucagcuucucuacucugggcaagguaagcagggggcugaaagguauagagaugggaagggga

SEQ ID NO: 6407 - RNA, 69 nt, Human
uccugaacgcagccugcugaggucgacuugagaaaguucagggccuggagagaaggcugugaggcagga

SEQ ID NO: 6408 - RNA, 87 nt, Human
uccugcgaguuccccuaaguucuuagaggacugcuuugccuuuugaucugagaguugcaaaguucccuaaagaauggcccuugugga

SEQ ID NO: 6409 - RNA, 94 nt, Human
uccugcgucuggaccuggcuggccgggacugaccgacuaccucaugaagauccucacugagcgagguacaguucaccaccacggccgagcggga

SEQ ID NO: 6410 - RNA, 79 nt, Human
uccugcuacaacaccucccuuugcauuucguugagcauacugugcaacaacucgagacaacagagaccaaagagcaggg

SEQ ID NO: 6411 - RNA, 79 nt, Human
uccuggaagauggcuuuggcguacugaugcaagaggcggcucauguaccagugcugccacgggagcagcccuuccagga

SEQ ID NO: 6412 - RNA, 87 nt, Human
uccuggacagauuuccacccgacagcuucgugcacaugugucaggaccugcgugugcucaaugcuguucgggacuaucacaucggga

SEQ ID NO: 6413 - RNA, 91 nt, Human
uccuggaucuggcugacaacgcggaucgugacaacaagaagacgcucauuauucaucgucaccuccagcuagucauccguaacgaccagga

SEQ ID NO: 6414 - RNA, 75 nt, Human
uccuggcuccagguggacagagcauggggauggaggcagaacguucucagacagcaguggccuccugggccggga

SEQ ID NO: 6415 - RNA, 74 nt, Human
uccuguacgauuggggauauaacgggcuucacuaacuuucccuaggcauugaaacuucccccaaaucugaugga

SEQ ID NO: 6416 - RNA, 72 nt, Human
uccuguggccuucaauugucuucagagguggaugagaaaaagacaccauuugugaggggguguggcacggga

SEQ ID NO: 6417 - RNA, 61 nt, Human
uccugugguuuguugguuucugcuuccucaccaaccagugggcagucaccaacccgaagga

SEQ ID NO: 6418 - RNA, 82 nt, Human
uccuguuuuauuggcuguuuagcaagaccuucuuagggcaagugcugcugaagagguauuuaaauauuuuguauuggcagga

SEQ ID NO: 6419 - RNA, 80 nt, Human
uccuuaaccuaguccaacccuuuuauuuuacaguuagggaaaccuaagcugagagaggagauggaaaccugguuguagga

SEQ ID NO: 6420 - RNA, 92 nt, Human
uccuuccucuuccagcucagcuucucuacucugggcaagguaagcagggggcugaaagguauagagaugggaaggggaaagcaaguuguggg

SEQ ID NO: 6421 - RNA, 72 nt, Human
uccuucuguaaauacccguuaccauauuuauccauuuguaauuaaauuaugguauuaacuugcuacagagga

SEQ ID NO: 6422 - RNA, 84 nt, Human
uccuugaacuuggaaccugacaauguugguguugucguguuggaaaugauaaacuaauuaaggaaggagauauagugaagagga

SEQ ID NO: 6423 - RNA, 75 nt, Human
uccuugugagaauuccgacugcacaacccugcacuucagcuguguguaaugaaaaggguugggaugaaucaggga

SEQ ID NO: 6424 - RNA, 65 nt, Human
uccuugugggagcagcuauggcaaguccaccuccuugcauugucauaggucacauuccacaagga

SEQ ID NO: 6425 - RNA, 68 nt, Human
uccuuguuuacuuggagaagaccugugacuggcuuccgaaaccugaacaugucugcuucaugcaagga

SEQ ID NO: 6426 - RNA, 78 nt, Human
uccuuugcccagcuuaacggguccaaagucuacuuuaaaugcaggcuucaaaaauguuaggauuggggggcaacagga

SEQ ID NO: 6427 - RNA, 65 nt, Human
ucgacggagacucuccuaaccccuaugguguucuuacacauggagguuagggagagcccuggaga

SEQ ID NO: 6428 - RNA, 81 nt, Human
ucgagauggcauccuccuugccacaggucuucacgugcaccgcaacucagcccauucagcaggaguaggagccaucuuuga

SEQ ID NO: 6429 - RNA, 88 nt, Human
ucgagugcuggaaggaugaaggauuccugcaucacugugauggccauggcgcugcugucuggguucuuuuucuucgcgccggccucga

SEQ ID NO: 6430 - RNA, 90 nt, Human
ucgcagucagacguuuggcaacagcaguggaagaggcaacuggugcuuuucagcuaggccuugaaaaauugcuucagagguugauuucga

SEQ ID NO: 6431 - RNA, 74 nt, Human
ucgccaaugauucucuuauaugcaacugucucauagucacuccaagauagucucagaauagagguucuugguga

SEQ ID NO: 6432 - RNA, 88 nt, Human
ucgcccgucccuuaccuacauuguuccaacaugccagaggcuguuaaccuuggagaccugcugcggauauggguacggcccggcgcga

SEQ ID NO: 6433 - RNA, 69 nt, Human
ucgcgcgggggguaauucggggucuggguucuggugccgcgcagcuuuccccgauggcccacugcguga

SEQ ID NO: 6434 - RNA, 77 nt, Human
ucgcggagaugucagugccugauggaguggccggggcgggugccuucacgucagcuccagaaucacugucagggcga

SEQ ID NO: 6435 - RNA, 80 nt, Human
ucgcgugcgggauguuuugugagggcaaggcccggcaugguugcugcgguaucccaaucacagacacaggccggaugggg

SEQ ID NO: 6436 - RNA, 73 nt, Human
ucgcuguagggcaggcugaagggguagaggggucuguaacgugaguccugccagagcagcuuguccuccagga

SEQ ID NO: 6437 - RNA, 82 nt, Human
ucgcuguggggcggcacgugcuccggcaugggcacguugcucaucagcaaggugcgugaggaguaugccgaccgcaucauga

SEQ ID NO: 6438 - RNA, 76 nt, Human
ucgcuugaacccgggaggcagagguaguagugagcugaagucccgccacugcacuccagccugggcaacagagcga

SEQ ID NO: 6439 - RNA, 77 nt, Human
ucgcuugaacccuggagguggagguugcagugagcugagaucguagccacugcacuccagucugggugacagaguga

SEQ ID NO: 6440 - RNA, 76 nt, Human
ucgcuugaacgcaggagguggagauugcagugagcugaggucaugccacugcacucuggccugccugacagagcga

SEQ ID NO: 6441 - RNA, 78 nt, Human
ucggaagcacaucaugggccagaauguugcagaauacaugcgcuacuuaauggaagaagaugaagaugcuuacaaaga

SEQ ID NO: 6442 - RNA, 79 nt, Human
ucggagaccccaccaaguuugccacauuuguuuucaacgucuuugaugaaaacaaggacgggcgaauugaguucuccga

SEQ ID NO: 6443 - RNA, 90 nt, Human
ucggauauauaucaauucuacagaguuuagauuauauauagguauuacaggugauaugauaugauagauuuuuguauugauguauuacga

SEQ ID NO: 6444 - RNA, 78 nt, Human
ucggcaggucugcagugggaaccuguggagacaaaagugacuucuucuuggaugccacuccccuguguugacuuucga

SEQ ID NO: 6445 - RNA, 80 nt, Human
ucggccaugacuguguaugcucuggugguggugucuuacuuccucaucaccggaggaauaauuuaugauguuauuguuga

SEQ ID NO: 6446 - RNA, 64 nt, Human
ucggcuccaagucugacccacucugcguccuuuuacaggaugugggagggggcagcugggcuga

SEQ ID NO: 6447 - RNA, 70 nt, Human
ucgggauucuccuguaccucuuaucagauuuauucuuucuugcaacaaagggguagaggcuggaugccga

SEQ ID NO: 6448 - RNA, 64 nt, Human
ucguaggccuucucgaugcacccagcgaucucaucccugauagugucgagcaggaugucaauga

SEQ ID NO: 6449 - RNA, 86 nt, Human
ucguucuuaaaugugcauagauuuuuuuaaguaaacauguucccuacauacuuuagcuuacuaacuuccacaaacagcagaacuga

SEQ ID NO: 6450 - RNA, 64 nt, Human
ucguuuuggaucacuuuggacccagcggugauggugaacuugaagugcuucccauucugaacga

SEQ ID NO: 6451 - RNA, 86 nt, Human
ucuaaggaagaaauggguugagaagcaauuggugagguccuuaggggaucugaggugcccgucagcuugcuuguuucuucuuugga

SEQ ID NO: 6452 - RNA, 113 nt, Human
ucuauaugagacuaacuaagguauuugccccuuggagcuuuuauagucuuuaaaaugagauaaugucugugaaaugcuuuuaggacacugccuggcauaaacacucaugaaga

SEQ ID NO: 6453 - RNA, 100 nt, Human
ucuauccaacuacgcguaguccacaagucgcagcuucgaacucuccaauauagagagcuaucgaauucuggaccugagcucagccauaguucuacauaga

SEQ ID NO: 6454 - RNA, 103 nt, Human
ucucacucuccuacuagacuuuucauugaaaaguuaggcaggaaaaaggaaaggaaucccaauuugcugccagcucugaugagagaucagguggggggagaga

SEQ ID NO: 6455 - RNA, 66 nt, Human
ucucccaaaguguugggauuacaggugugaggcacugcaccuggccuaauccacaaacugucuaga

SEQ ID NO: 6456 - RNA, 71 nt, Human
ucucccaggcaauauuccaggauaggcugccaguuggacuaaggaagccacuccugcggaacccugggaga

SEQ ID NO: 6457 - RNA, 112 nt, Human
ucuccccagcaugauucauaccuguaaucuuacccauucuugauuuagaugagauuuggauuucgaguugaugcuagaauggguuaauacuuuugaggauguuggguuggga

SEQ ID NO: 6458 - RNA, 70 nt, Human
ucuccccgcaguccuacccagccuuuuaaccugcuaaaggagaggcugugguuuuagcaccuuggggaga

SEQ ID NO: 6459 - RNA, 63 nt, Human
ucucguucauccauucaugcgcgucacuaauuagaugacgaggcauuuggcuaccuuaagaga

SEQ ID NO: 6460 - RNA, 89 nt, Human
ucucuaacaaggugcagagcuuagcugauuggugaacagugauugguuuccgcuuuguucacaguggcuaaguucugcaccugaagaga

SEQ ID NO: 6461 - RNA, 85 nt, Human
ucucucucagguuuuaaauguugcaaauguaauuguggcucaucaaugcagcuaucaaugcaacuuuauauuccuugaggggaga

SEQ ID NO: 6462 - RNA, 71 nt, Human
ucucugguuucaauggguacgauuauuguaagcaggauccauucaauaaucggacccauuuaaaccggaga

SEQ ID NO: 6463 - RNA, 65 nt, Human
ucucuguccuucuacaggagguguuccgcuuugccuacuacaagcugcuucacgaaggcagauga

SEQ ID NO: 6464 - RNA, 76 nt, Human
ucucugucuaggggucacaaauugaaauggcuccuguaucacauacggaggucuuguguaucuguggcaacaggga

SEQ ID NO: 6465 - RNA, 86 nt, Human
ucucuuacacaggcugaccgauuucuccugguguucagagucuguuuuugucuagcaccauuugaaaucgguuaugauguaggggg

SEQ ID NO: 6466 - RNA, 83 nt, Human
ucucuugcaacgugugagcugccucuugccaagagugaguggcaaaagaaacuaaccccggagcaguucuacgucacaagaga

SEQ ID NO: 6467 - RNA, 104 nt, Human
ucucuugcccucugucauccuagcaguguggaugguugguugggaucuucgugucccgucucagcacacucgagcucugaagugacagugaggaagggcaggga

SEQ ID NO: 6468 - RNA, 104 nt, Human
ucucuuguaauugucauuugucuguuuuucaaauaacccaaggauuucuaucagugcauuugaaaggaaccuggggauagcuaucaaguggaaagagagagaga

SEQ ID NO: 6469 - RNA, 77 nt, Human
ucugaauuauccuggcugucuuuaguugcuaucgguccuggucuuggcuacuaacaucauccagccagguguucaga

SEQ ID NO: 6470 - RNA, 67 nt, Human
ucugagagaggcaggcucgcugcagaugggaacagggcuccucucacaguaugccugggcucuugga

SEQ ID NO: 6471 - RNA, 107 nt, Human
ucugagccuccuucuggccccuggaaggggacagcaucaccauggaauggugugucccguugccuguuggaucugucuccaucuucacucagacagaaggcuauaga

SEQ ID NO: 6472 - RNA, 80 nt, Human
ucugagucacuagaugaggaggaggaagaugaugaugauuuaugccuuuucuuuucuucuuucuuaacuuuagauuuggg

SEQ ID NO: 6473 - RNA, 89 nt, Human
ucugaugcacugcguguuuaaacacagaucaguccuuuuuucuggugcuacuguggaagaagauugucuuugggcaugcugacagcaga

SEQ ID NO: 6474 - RNA, 60 nt, Human
ucugaugcugucaguuugaccgagcugguuuugcuuauggucaugcugcaauuuguuaga

SEQ ID NO: 6475 - RNA, 87 nt, Human
ucugcaauggcugccaggcggaucacuccuccacuggagccaucccgcuccauggccaaagcgagagcauuggcagugaauugcaga

SEQ ID NO: 6476 - RNA, 112 nt, Human
ucugcaccgccagccucagcugucuuggagcagauguguauaguuagagauggggaccuuuucacuguaaauacugcucacauguuccuaggcugacuuuacuaugugcaga

SEQ ID NO: 6477 - RNA, 76 nt, Human
ucugcaccucccagccuggagaggagccugugacuugcccuguuccuuggcuccucaggcugggguaagguguggg

SEQ ID NO: 6478 - RNA, 98 nt, Human
ucugcccugcauguaccuggugguguuugucuguggucugguggggaacucucuggugcuggucauauccaucuucuaccauaaguugcagagccuga

SEQ ID NO: 6479 - RNA, 73 nt, Human
ucugccgcaugggccauucuuccucucuugcucuuagugauggcagcaguagguggcuacuugauguggcgga

SEQ ID NO: 6480 - RNA, 79 nt, Human
ucugccuccagugucaaucccaaaccccgaacaaccaucuuuguuuagugggcaagugagggaccacauugauuucaga

SEQ ID NO: 6481 - RNA, 63 nt, Human
ucugcgcaguccgcgcaaacaugcaggugcuugaagagcgagcggugcgugcggaagcgcagg

SEQ ID NO: 6482 - RNA, 72 nt, Human
ucugcggaggcugccgugacguaggguaugggccuaaauaggccauugugagucaugagcuuggucuguaga

SEQ ID NO: 6483 - RNA, 76 nt, Human
ucugcgggguccuggccgggcagggacagggcagaggacucugagcgccccacccaugccugccuggccugguaga

SEQ ID NO: 6484 - RNA, 110 nt, Human
ucugcucaugauuacugggccaauaccacugcaaugacugucagaacaauucuugugaaaguuguuuuuauaagccuuguaguuuguugaaguugagguucaagggcaga

SEQ ID NO: 6485 - RNA, 76 nt, Human
ucuggaguccuaaggcugguuggcgagaacuagcaggguccugcaaguuauagguuauucagcccaggauacuggg

SEQ ID NO: 6486 - RNA, 72 nt, Human
ucuggaguuugggaauccaggaucaagccugcgcauuucaguggcuggugagggcugcucuccgcuuccaga

SEQ ID NO: 6487 - RNA, 128 nt, Human
ucuggccugauuccuagaggugaccagaauuuaaugucagggccuaaauagucauugaguagauugcauuccuauuggugcccucgaagaccucacuugugcaccugugggaccccugccggggcaga

SEQ ID NO: 6488 - RNA, 87 nt, Human
ucugggauguggcggauuaugugauaccagcucaggaggaaaacucccucuucgucaugaccaacgugauccucaccaugaaccaga

SEQ ID NO: 6489 - RNA, 103 nt, Human
ucugguauaaugaucuaugaugccaacauuacucaaagcagguaccacuguuuacuuugguguagucaauggcagaccuuauaaaucaaauacaacaaccagg

SEQ ID NO: 6490 - RNA, 91 nt, Human
ucugucagccuuacuauauacugagcuacuccuuucccaccucccccugaacacugugacaagaggaagcuagguugaaaucacugauaga

SEQ ID NO: 6491 - RNA, 67 nt, Human
ucuguccgaaccgagauacgucuacucagagcgccgcugagucuguguaggcgugggaauggacagg

SEQ ID NO: 6492 - RNA, 79 nt, Human
ucugugugagacuucgugguggugcuaagaaaaggaacgaagaagucuuacaccacucccaagaagaauaagcacaaga

SEQ ID NO: 6493 - RNA, 83 nt, Human
ucuguguguggagacuucgugguggugcuaagaaaaggaagaagaagucuuacaccauucccaagaagaauaagcacaagaga

SEQ ID NO: 6494 - RNA, 96 nt, Human
ucuguuauaacaucucaacuuaccuguugccacuuggaauauauaucgauacauuauggugccgagugguaacaugggaguguuugauccaacaga

SEQ ID NO: 6495 - RNA, 76 nt, Human
ucuguuccugagagaaggcucaugguucugguggguaguuuuguaucugcugaugagccugauccucauaaacaga

SEQ ID NO: 6496 - RNA, 78 nt, Human
ucuguugcaggcugcggcccaggcacucaauccgcuaggcccuucugcgauguuuuaccuggcugcggcugugucaga

SEQ ID NO: 6497 - RNA, 75 nt, Human
ucuguuuacaguuagcuccugguauuauacagguaccaaaaugcuaccuggaauacuagugguucugugagauga

SEQ ID NO: 6498 - RNA, 78 nt, Human
ucuuaaaucaguuuguguacugacagccaaaaaugaauuccauuuuggugauuccaccucauggacugaguucuggga

SEQ ID NO: 6499 - RNA, 77 nt, Human
ucuuaagucacauggcuucugucuuggaaauuuuaccuuuaaaagauuauuuaagacaggaaccaggaggcuuggga

SEQ ID NO: 6500 - RNA, 73 nt, Human
ucuuacaugguaugcuaaggagucaguacuuuacucauaaggaggcaaaauuggcaaggcauacagaaaaaga

SEQ ID NO: 6501 - RNA, 68 nt, Human
ucuuaguauaguguuaggucagacacggcuaccaacgauuccaccuguccugacccauuucuauagga

SEQ ID NO: 6502 - RNA, 73 nt, Human
ucuuauaccccaaaagucauacagugucagaacaaaggcugggauggguaugauguacagugggaauguaaga

SEQ ID NO: 6503 - RNA, 98 nt, Human
ucuuaucaaaugcccuaaaauuauuaccacccaagagaaacaggaaaaagguuacauguuuuuguuuacugagaguaagaucaccugcaucuggaaga

SEQ ID NO: 6504 - RNA, 61 nt, Human
ucuucagucaagugauuucauuggcagcaaugggccaguaugagaacuugaaagcugcaga

SEQ ID NO: 6505 - RNA, 94 nt, Human
ucuuccgccguaucaggacgcugaaagggaaacuggccaggcagcacccagaggccuucagccauaucccagaggcauccuuccuggaggaaga

SEQ ID NO: 6506 - RNA, 94 nt, Human
ucuuccucuaauauugccuuuucuuguacaaggcagaccagguaucuuuuuaugcuguuuuuccuuuacuaagaaaaguauugcaucuugaaga

SEQ ID NO: 6507 - RNA, 80 nt, Human
ucuucgcggaccccaacgccaagcagcgagcccugagccgacagccggaugcugccgggcacuuggcgggccucgacgga

SEQ ID NO: 6508 - RNA, 83 nt, Human
ucuucucaugcugaacaguucuccauccacagccaaagacacucuagacaauggcgauuauggagaaccagacuaugacugga

SEQ ID NO: 6509 - RNA, 65 nt, Human
ucuucucuguaguggauguacuacagcucccaaauaaaugcuguagaugcaaauggcaaagaaga

SEQ ID NO: 6510 - RNA, 76 nt, Human
ucuugacacuacuagugucauuuaggagcuuagcucaaaguucagcuaaccuuugacacugcuagugcguucaaga

SEQ ID NO: 6511 - RNA, 70 nt, Human
ucuugcuagcucccauauggccaagagguggcaaaaauugggcuuuaugguggugcuggaguuggcaaga

SEQ ID NO: 6512 - RNA, 67 nt, Human
ucuuggcgcgcggcacugggagccgcgggccgagccugucaagccccgcagcagcagcgcgucagga

SEQ ID NO: 6513 - RNA, 63 nt, Human
ucuugggcagugcugguaguaggguguaugaauuaucuauugccaaaacaacacugcccgaga

SEQ ID NO: 6514 - RNA, 76 nt, Human
ucuugggcaugaauuuacugguuauguucaacacguaaaauaugcaaugacaugaauaauagcugccaugccaaga

SEQ ID NO: 6515 - RNA, 72 nt, Human
ucuuguggcuggguggaacugagucuuuuuuggugaaauguacacaguaguucuguucccccaguuacauga

SEQ ID NO: 6516 - RNA, 79 nt, Human
ucuugugugagacuucgugguggugcuaagaaaaggaagaagaagucuuacaccacucccaagaagaauaagcacaaga

SEQ ID NO: 6517 - RNA, 80 nt, Human
ucuuguguggagacuucgugguggugcuaagaaaaggaagaagaagucuuacaccacucccaagaagaauaagcacaaga

SEQ ID NO: 6518 - RNA, 80 nt, Human
ucuuguguugagacuucgggguggugcuaagaaaaggaagaagaagucuuacaccacucccaagaagaauaagcacaaga

SEQ ID NO: 6519 - RNA, 81 nt, Human
ucuuguguugagacuucgugguggugcuaagaaaaggaacgaagaagucuuacaccacucccaagaagaauaagcacaaga

SEQ ID NO: 6520 - RNA, 81 nt, Human
ucuuguguugagacuucgugguggugcuaagaaaaggaagaagaaagucuuacaccacucccaagaagaauaagcacaaga

SEQ ID NO: 6521 - RNA, 80 nt, Human
ucuuguguugagacuucgugguggugcuaagaaaaggaagaagaaaucuuacaccacucccaagaagaauaagcacaaga

SEQ ID NO: 6522 - RNA, 80 nt, Human
ucuuguguugagacuucgugguggugcuaagaaaaggaagaagaagucuuacaccacucccaagaagaauaagcacaaga

SEQ ID NO: 6523 - RNA, 80 nt, Human
ucuuguguugagacuucgugguggugcuaagaaaaggaagaagaagucuuacaccacucccaagaagaauaagcacauga

SEQ ID NO: 6524 - RNA, 81 nt, Human
ucuuguguugagacuucgugguggugcuaagaacaaggaagaagaagucuuacaccacucccaagaagaauaagcacaaga

SEQ ID NO: 6525 - RNA, 81 nt, Human
ucuuguguuugagacuucgugguggugcuaagaaaaggaagaagaagucuuacaccacucccaagaagaauaagcacaaga

SEQ ID NO: 6526 - RNA, 81 nt, Human
ucuuguuccuggccguggagaggggccuggggcacugguuccggcugugucugguggucuggcugcggggaaggggcaaga

SEQ ID NO: 6527 - RNA, 72 nt, Human
ucuuuauagcaguaugagaaugaacuaacacaguaaauugguacugcggagaguagaguauugcuauaaaga

SEQ ID NO: 6528 - RNA, 98 nt, Human
ucuuuccuggguuuugaauuugcaguaacaggugugagcauucuagcagcaguuugaugaucauguaugauacugcaaacaggaccuacguuuaaaga

SEQ ID NO: 6529 - RNA, 65 nt, Human
ucuuugagucucgacagaacgcuguucuauaugaagccaaacuaauugcuguggagauuuacaga

SEQ ID NO: 6530 - RNA, 63 nt, Human
ucuuugcuuuaaauaauacuacugggcugauuacaguucagagguccuuagauagagaggaga

SEQ ID NO: 6531 - RNA, 86 nt, Human
ucuuuucaguaauuucauccucuuuaucuaccuguucuauuuugcguuuuuuagaacagguuggaaguguggagucaccagaagga

SEQ ID NO: 6532 - RNA, 72 nt, Human
ucuuuuucggcgcuugcacucaggcauuuaacaacacuggacacggugcaaggugacagcagucgguuggga

SEQ ID NO: 6533 - RNA, 80 nt, Human
ucuuuuugggggaaaaccccgauaggguugugcacugguaaagaacaccugaaucuuaucucgguucucccuccaaagga

SEQ ID NO: 6534 - RNA, 71 nt, Human
ugaaaaaaaagcacacccuuuuaagacuacuuuaugaggcacuugugguuguagagagugaugcugcuuca

SEQ ID NO: 6535 - RNA, 71 nt, Human
ugaaauauauaugaugaaaagaauugagaaguucuaaauuaagacauuucaguuaagcucauaaaauuuca

SEQ ID NO: 6536 - RNA, 71 nt, Human
ugaaauuuuauuguguaaaguuuauagaaguaugacuaguauuccuuuguacaaaguacacaacgguuuua

SEQ ID NO: 6537 - RNA, 104 nt, Human
ugaacuuuuuuccuaguacccauucuagcuguaacacgaagggcuccgacuggugaucccaaagcccccucuaguucgaaaacugacuaguacggaagagucca

SEQ ID NO: 6538 - RNA, 70 nt, Human
ugaagacucucugccuccgccaaaauuuaauuaaaugcauugagaaucuggaggagcuacagagucuucg

SEQ ID NO: 6539 - RNA, 102 nt, Human
ugaagauauaccaaauguagcaguuuauccucauaaugggaaugauagacuuaaaauauuucccauauuauggggaaaaaacugcauguugggguaucuaca

SEQ ID NO: 6540 - RNA, 101 nt, Human
ugaagauccucacugagcgaggcuacagcuucaccaccacggccgagcgggaaaucgugcgcgacaucaggagaagcugugcuacgucgcccuggacuucg

SEQ ID NO: 6541 - RNA, 110 nt, Human
ugaauacacaacaaaggagguuuaccggaagaacuucuucaaugacuggcgaaaggaaauggcgguggaagaagagggaagucaucaagagccuggacaagugugauuca

SEQ ID NO: 6542 - RNA, 82 nt, Human
ugaauaccaacaauaucacugagcuagugacuauugggaaaugaacuaguuuugaugaagcuuagucugauaacugauuuca

SEQ ID NO: 6543 - RNA, 109 nt, Human
ugaaucacuguggaaaacaucaguaauucaacaaccuugcugcugaccucuuauucaguuaaaugagagcaaguguugaaacagcugguggugguucacaucaaaauca

SEQ ID NO: 6544 - RNA, 76 nt, Human
ugaaugccgugcagcacgcuguugugaaaauggaugcgguuaaaucucaaacagacggacucugcaaggcauugca

SEQ ID NO: 6545 - RNA, 91 nt, Human
ugaauggccgcucgccgagugcuguuugcaaacuuaggaacccccucgcgcggggccuagcggggguacguggcgcaugcgguaacacuca

SEQ ID NO: 6546 - RNA, 96 nt, Human
ugaaugucaauuuugaaauggagggagacagugaaguaauuauggaaagcaagcaaaauccagucucugucccaccauaaaaugaaaugacuauca

SEQ ID NO: 6547 - RNA, 62 nt, Human
ugacaaaauguguuucauggucaaaaaauggcagacaaugauugaagcucacguugauguca

SEQ ID NO: 6548 - RNA, 113 nt, Human
ugacacuuucuguaaacgccaucugugcuuuucucccauuuguacugcccuguauauccccguucagcauugccaguguuuccagccaccucuuaaagcauucugaaguuuca

SEQ ID NO: 6549 - RNA, 92 nt, Human
ugacaugaggaguuguauuauuauauaugugccgagauguaauacgauuucuucgcccuccauaucaugauauuacuuucugccuuacauca

SEQ ID NO: 6550 - RNA, 79 nt, Human
ugaccauccugcaggccccgagcccggcccccuccaccaucccugggaccccggcggggcuccgguccugagaucuuca

SEQ ID NO: 6551 - RNA, 72 nt, Human
ugacgcgcacgccccugcuauggacuaucggaguuugggauuucgggaaugccuggcagaaguugcgcguua

SEQ ID NO: 6552 - RNA, 90 nt, Human
ugacucccaugaagacguaccgugcggacgaguggaaggagaaauuuggccauuacaaagacacaggaauauguuaagaagugaggggca

SEQ ID NO: 6553 - RNA, 72 nt, Human
ugacuccugcugccaucucaaggacauuuuccuaaggacaguccugguguccugauggagugaaagggauca

SEQ ID NO: 6554 - RNA, 76 nt, Human
ugacugcagugcacaugauccggaaggucccugaacucuccagugucuuccucccacccugugcccaacugcuuca

SEQ ID NO: 6555 - RNA, 73 nt, Human
ugacuuuugguuuuugucuuuguuuuuaaucauggucccaaaggcagaaggcaguauuuuaucuacuaaguca

SEQ ID NO: 6556 - RNA, 61 nt, Human
ugacuuuuuacaagucugacacuugaagcuuuugggccucagggagcagcuugauaaguca

SEQ ID NO: 6557 - RNA, 87 nt, Human
ugagaaaguaagacugugggaggugacuguuacagaucggaaaacucugauugaaccauucacuuuauuagccaguaaacuuucuca

SEQ ID NO: 6558 - RNA, 81 nt, Human
ugagaaaugccaggcaaucaaugaggaugcucaguuuagcaucuccuauuugaguagauuuacaguuguguggaauucuua

SEQ ID NO: 6559 - RNA, 77 nt, Human
ugagaaggcaaacauguucagaagucaaguaacuggaaaaauaaaccuccuuggccugauagaaaugaucuuacuca

SEQ ID NO: 6560 - RNA, 107 nt, Human
ugagaagguagaccugugcccuaggaucaugucacauauacagauaaugccauuuccuugugugugugauguguguuuugaugaccuccacaggccuuacuguauca

SEQ ID NO: 6561 - RNA, 100 nt, Human
ugagacagaguuucacucguuucccaggcuggagugcagugguacgcacuuggcucacugcaaccucugccucccagguucaagugauucuccugccuca

SEQ ID NO: 6562 - RNA, 102 nt, Human
ugagacagaguuucgcucuugaccccgaggcuggagugcaguggccugaucuuggcucacugcaaccucugccucccggauucaagcgauucuccugccuca

SEQ ID NO: 6563 - RNA, 101 nt, Human
ugagacggagucucgcucugucacccaggcuggagugcaguggugcgaucuuggcucacugcaacuuccaccuccuguguucaagcaauuuuccugucuca

SEQ ID NO: 6564 - RNA, 65 nt, Human
ugagcaagaguauaaugcaacaguggccaggaugaagccacacugggccaucugcacucugcuca

SEQ ID NO: 6565 - RNA, 117 nt, Human
ugaggagcuguugggucguguaguugaugcccuugguaaugcuauugauggaaaggguccaauugguuccaagacgcguaggcgaguuggucugaaagcccccgguaucauuccucg

SEQ ID NO: 6566 - RNA, 73 nt, Human
ugaggauuccaaucugauacccaaagagauucucuggcgaccaaaagaagccuucagugauggaauaacuuca

SEQ ID NO: 6567 - RNA, 100 nt, Human
ugaggcaggagaaucacuugaaccugggaggcaagagguugcagugagcugagaucauaccacugcacucuggccuggguaacagagcgagacugucuca

SEQ ID NO: 6568 - RNA, 102 nt, Human
ugaggcaggagaaucgcuugaacccaggaggcgaagguugcagugagccgagaucaugccuuugcccuccagccugggcaacgugagugaaacuccaucuca

SEQ ID NO: 6569 - RNA, 63 nt, Human
ugaggcagucacagcuugaagugugacgcuuagugugucacugauguuggagcugggcucuca

SEQ ID NO: 6570 - RNA, 95 nt, Human
ugaggccugcucacugguagaacuucuuguuagggcuguuagcauggucagcuagcagcuggcauggggugaacuguuuuccauaggcagcuuca

SEQ ID NO: 6571 - RNA, 100 nt, Human
ugaggcgagagaaucgcuugaacugggaggcagaaguugcagugagccaagaucguaucauugcacuccagccugggccacagagcgagacucugucuca

SEQ ID NO: 6572 - RNA, 77 nt, Human
ugaggcuagcuucauccaggauaaacagcuccuucaacucgcccagagagaaguggcgcucuacauccugcuccuca

SEQ ID NO: 6573 - RNA, 92 nt, Human
ugaggcugaacucaagcagcuggugucucgacccgaugucguggagaugcacgaugugacagcgcaggacccaaagcucuugguucaccuca

SEQ ID NO: 6574 - RNA, 71 nt, Human
ugagggccugggacucgucuuuacacuuucagaaucccugugugugccugaaaaaauauccuuugugcuca

SEQ ID NO: 6575 - RNA, 79 nt, Human
ugaggggugaauucaugauccucgcuuacugacuuccugcgcucggggagucaggugcggggagcgguuaagcccuuca

SEQ ID NO: 6576 - RNA, 107 nt, Human
ugaggugggagaauugcuugaacccaggaggcggaggcagaggcugcagugacccaagauugugccacugcacuccacccugggcaacagagcaagaccccaucuca

SEQ ID NO: 6577 - RNA, 100 nt, Human
ugaggugggaggcucccuugagccaggaggucaaggcugcagugagcugugaucaugccacugcaguccagcccgggcgacagagugagaccccaucuca

SEQ ID NO: 6578 - RNA, 64 nt, Human
ugaguauaccugucuguaucgguucagaguucauggcgaaccugucaagugaagacacuacuca

SEQ ID NO: 6579 - RNA, 102 nt, Human
ugagucggaguaucgcucucguugccuaggcuggagugcaguggcgugaucucggcucacugcaaccuccaccucucggguucaagcaauucuccugccuca

SEQ ID NO: 6580 - RNA, 131 nt, Human
ugagugaaagguguuuaugagaagucgaugacuccggaucuuaucauccaagaggacagcacagaauaguuaauuuugucccuggagggacuaggaugcuggacgucuuuuucugauacccgaucauuacg

SEQ ID NO: 6581 - RNA, 75 nt, Human
ugaguggugucacaaagcacaggucauagacccugaggguugaggcuacugugaggaacugcuugacacgacuca

SEQ ID NO: 6582 - RNA, 95 nt, Human
ugagugugacggaugugacggggccugggcaccaggguacaguagaacuuuaggcugggacucuggggccugcucccagcuccacgucagauuca

SEQ ID NO: 6583 - RNA, 72 nt, Human
ugauaaaaauagugugagacuguccaucaucgaugcuuuguugaugggacguccucucauacugauguauca

SEQ ID NO: 6584 - RNA, 68 nt, Human
ugauagcaacucugcuuccuugccucaggacagguuuguggcaaggaagaaagcagaaguugcuuuca

SEQ ID NO: 6585 - RNA, 57 nt, Human
ugaucccugucuauucauauuugacuuaauuauuuaaauuuaauuugauagggguca

SEQ ID NO: 6586 - RNA, 76 nt, Human
ugauccuguucucuuccacucugccagcaguuccuuuuguacugcuucugguaguucauagaaaacuugaggauca

SEQ ID NO: 6587 - RNA, 108 nt, Human
ugauccuuaugaucuguguuauguugggccaaaggugauuacuuuauaaauuauaaagaucccuaaacucugcauugccuuuggucccaaacaagcaaaucuggguca

SEQ ID NO: 6588 - RNA, 86 nt, Human
ugaucugucuuuauaaaggagauggaagugaauucaagauauugagauguuagauuugacuggguuguccuuuggcuagaagauca

SEQ ID NO: 6589 - RNA, 73 nt, Human
ugaucuuacuggacauuuuaugguucaaguauucaacuagcuuauuagaauacucccuaaaugcaguagauua

SEQ ID NO: 6590 - RNA, 72 nt, Human
ugaugaguaaggaaggaugaaaggaaagggagugcugaguugcccuacuuucccuuucauucuuugucauca

SEQ ID NO: 6591 - RNA, 73 nt, Human
ugaugcacaaaaugggacugcugaagaguggacaguuggaccuuacuuuggugaccccauacauuugugguca

SEQ ID NO: 6592 - RNA, 72 nt, Human
ugaugucaguuccuuugcgcccugacugcaucaucaugcggcggcgaacggugucaaauggauaggaaguca

SEQ ID NO: 6593 - RNA, 65 nt, Human
ugaugucuuugaccugagguauagaguuguccucuaaaaucuuugcauaaggcauagggacauca

SEQ ID NO: 6594 - RNA, 71 nt, Human
ugauugccugccagaaaacugcacaugacuccaauguccugcacauugccagacuuccaaacaggcaguua

SEQ ID NO: 6595 - RNA, 61 nt, Human
ugauuggugccuguuuccucauugacuucauguuuuuugaaagcacuggcagccaggaaca

SEQ ID NO: 6596 - RNA, 86 nt, Human
ugauugugcaccacaggcguggacaaaaauagauaugcaagcaagcagcgauguggcacugaagaacaccugugagugggcgauca

SEQ ID NO: 6597 - RNA, 66 nt, Human
ugauuucuaggacucaagcagcaagccaggauucuagguguggcugcugugucaucuuugaaguca

SEQ ID NO: 6598 - RNA, 97 nt, Human
ugcaaagaugcuguccgugcgcguugcugcggccgugguccgcgcccuuccucggcgggccggacuggucuccagaaaugcuuggguucaucuuuca

SEQ ID NO: 6599 - RNA, 64 nt, Human
ugcaagagaauauuggcaauggagacuucucuguguacagugccagcacccacaaguucuugua

SEQ ID NO: 6600 - RNA, 75 nt, Human
ugcaagagggucagguauaugugugucuaauacaguggucuguacuuccauccacauauauguggcuuuguugua

SEQ ID NO: 6601 - RNA, 74 nt, Human
ugcaauauuuauccacaauucuagacauuuuccauuuuuguggaagaguugcuguuaccuuaauuauaaaugca

SEQ ID NO: 6602 - RNA, 71 nt, Human
ugcaauccuugguuccagaacccagcaauuccuaucaucacaauuguuucaagucuuauccaagcccugua

SEQ ID NO: 6603 - RNA, 82 nt, Human
ugcacuggcaccuagacauguacaacaggaaccguguggauacaucccccacaccuguuucuuggcaugucauguguaugca

SEQ ID NO: 6604 - RNA, 65 nt, Human
ugcacuguggcacgggcuuggccggggcugccuggcucugagcaggcucgugggacggcccugua

SEQ ID NO: 6605 - RNA, 92 nt, Human
ugcagaauagucaugucaggcugaauauagcagcacccagugagaagaucccuggccucaaugacucuuaacucaaccugaacucuucugua

SEQ ID NO: 6606 - RNA, 70 nt, Human
ugcagccggugguaucauguacucaagaccuggcuuggagauacacggcaggucugaugccccgguugua

SEQ ID NO: 6607 - RNA, 60 nt, Human
ugcagcuaugcucugaaugauuucauuccugagagugauagcauucugguccuggcugca

SEQ ID NO: 6608 - RNA, 83 nt, Human
ugcaggagucuuggagggucggaugcggcgccggaugaggaugaggcguggcggaagaugcguuuggcucugcagacacugca

SEQ ID NO: 6609 - RNA, 76 nt, Human
ugcaggggauggauaaacagggaaacacugugcauuccucacagccaacaguguaggucuuggugaagccccggcg

SEQ ID NO: 6610 - RNA, 73 nt, Human
ugcaguaugaugucuaucaguauuuucugccugagaaugaccucacugaggagauguugcugaagcaucugca

SEQ ID NO: 6611 - RNA, 73 nt, Human
ugcagugcucugggaacucauuacugggucaagacaagaugucaccuggugaugaaaucccaucauauacuca

SEQ ID NO: 6612 - RNA, 60 nt, Human
ugcaguggcgugaucucugaauugccaaagaauucagaaggcugauuauuaagcuacuca

SEQ ID NO: 6613 - RNA, 71 nt, Human
ugcaucuucaucuuggucaccacgccagagaggauccgaccucgaauggacacauuaccagugaaggggca

SEQ ID NO: 6614 - RNA, 71 nt, Human
ugcaucuucaucuuggucaccacgccagagaggauccgcccucgaauggacacauuaccagugaaggggca

SEQ ID NO: 6615 - RNA, 79 nt, Human
ugcaucuuucauaguucuguuaacuauuuuguacaucgcuucuuuuucaaaacuaguucuuaggaacagacucgaugca

SEQ ID NO: 6616 - RNA, 120 nt, Human
ugcaugauaugugguaaggccuuuagacuucauucacaccuuauucaacaucaaagaauucauacuggugagaaacccuaugaauguaaggaaugugggaaggccuuuagcuaucauuca

SEQ ID NO: 6617 - RNA, 60 nt, Human
ugcaugggaaugaggcuguuggacgagaacugcucauuuucuuggcccaguaccuaugca

SEQ ID NO: 6618 - RNA, 75 nt, Human
ugcauuaaucuucucauuuucuacuauucucucaacguugucugugagaccguacucagagugaggauuucugca

SEQ ID NO: 6619 - RNA, 63 nt, Human
ugcauuacaaaccugcagcuugccaacaacaacaaaaaagguaaagguuucacagucagugca

SEQ ID NO: 6620 - RNA, 78 nt, Human
ugcauuucgccauguugcccagcacucaagcaaucauccuaccucagccucccaaguagcugggauuacaggcaugua

SEQ ID NO: 6621 - RNA, 98 nt, Human
ugccaagaagauccugcuggagaugggggaguucuuucagauucaggaugauuaccuugaccucuuuggggaccccagugugaccggcaaaauuggca

SEQ ID NO: 6622 - RNA, 82 nt, Human
ugccacagccuugguaagaucuugaacuagugcagaauucagcugugguagagugcugaucuuagcaugcuucgauguggca

SEQ ID NO: 6623 - RNA, 73 nt, Human
ugccaccaugccuggcuaauuuugguauuuuuaguagagaugggguuucaccauguuggccaggcuggucuca

SEQ ID NO: 6624 - RNA, 63 nt, Human
ugccauuucacacauggacuccaccguuaguuuuagaaguuggagacugugugugguuccgca

SEQ ID NO: 6625 - RNA, 72 nt, Human
ugcccagcuccacaagcgccugcagcgccuccacgucaccggcgugggcagcagcacaggccaggcugggca

SEQ ID NO: 6626 - RNA, 74 nt, Human
ugcccaugccuugcuuuugauccauaguuguauaaugauugauucugaccuucugauuagcaaagcccagggua

SEQ ID NO: 6627 - RNA, 65 nt, Human
ugccccccgggccgucuuccccuccaucguggggcgccccaggcaccagggcgugauggggggca

SEQ ID NO: 6628 - RNA, 77 nt, Human
ugccccguuacucuuagugugauagacuaccacgcugguuuauguucagcguuccccuauauuguuguuucggggca

SEQ ID NO: 6629 - RNA, 79 nt, Human
ugccccuuccaugaccagccacaucugaaaaggaaagcauucugcucuuuccagaucuacgcugugccuuggcagggca

SEQ ID NO: 6630 - RNA, 71 nt, Human
ugcccgcguacaugggcugaggaaugcucaagcagaagaaaugguagaguuuucuucaggcuuaaagggua

SEQ ID NO: 6631 - RNA, 71 nt, Human
ugcccgcguacaugggcugaggaauguucaagcagaagaaaugguagaguauucuucaggcuuaaagggua

SEQ ID NO: 6632 - RNA, 71 nt, Human
ugcccgcguacaugggcugaggaauguucaagcagaagaaaugguagaguuuucuucaggcuuaaagggua

SEQ ID NO: 6633 - RNA, 71 nt, Human
ugcccgcguacaugggcugaggaauguucaagcagaagaaaugguagaguuuucuuuaggcuuaaagggua

SEQ ID NO: 6634 - RNA, 74 nt, Human
ugcccgucuuucuugguucaccuuaucgggggugggccuccggcagggaacggccugggacaacugggggggca

SEQ ID NO: 6635 - RNA, 88 nt, Human
ugcccuguugaccagaauuuguuagauugcuauuacaaugcugauuauauuuuauagcaauuacugacauaagguuauacuuugggca

SEQ ID NO: 6636 - RNA, 130 nt, Human
ugcccuuucccccaguauuguagagcaagucuuguguuaaaagcccagugugacagugucaugauguaguagugucuuacugguuuuuuaauaaauccuuuuguauaaaaauguauuggcucuuuuauca

SEQ ID NO: 6637 - RNA, 67 nt, Human
ugccggugacaaauuaacagagguccuugaagaggcuaacacucuguuuaaugaagugucccgagca

SEQ ID NO: 6638 - RNA, 93 nt, Human
ugccuaguggaccagagccuucgucuggacugccgccaugagaauaccagcaguucacccauccaguacgaguucagccugacccgugagaca

SEQ ID NO: 6639 - RNA, 107 nt, Human
ugccuaguuugcuggaucguuccccucuguauuggaaguuaaugccccugaugaucuuuaucuacagaauagcuuuaagguggagagggguaacuauuaauuaggua

SEQ ID NO: 6640 - RNA, 79 nt, Human
ugccugauguauuuacucgugaucuucauucaugcuuggggacagagugagugggauuuaugaguuacuguacucagca

SEQ ID NO: 6641 - RNA, 84 nt, Human
ugccugccaagccaguggcucagcuucucuuauggugacauucugcaugucauuaaugccucugaugaugagugguggcaggca

SEQ ID NO: 6642 - RNA, 70 nt, Human
ugccuguuccgugcauguggucauaaaucaaaaccauaaucaggguccaugagcauaacacgcacgggca

SEQ ID NO: 6643 - RNA, 98 nt, Human
ugccuuagaaaucuacuugacaaacagauacugaacacucauccauggcuuaauccacaaauguuagaguguauuucugaaacuagcagacuagggua

SEQ ID NO: 6644 - RNA, 70 nt, Human
ugccuucucuaggucccuauuccugcuuggcagccgagcagagguacccucuuaggacuuaggauaggca

SEQ ID NO: 6645 - RNA, 73 nt, Human
ugcgaaagacggggcacuggugcuuuuaaauccagagugggacugccugcgccugcuccuguuaucaauagca

SEQ ID NO: 6646 - RNA, 81 nt, Human
ugcgcaucacugugggcguggauggcuccguguacaagcugcaccccagcuucaaggagcgguuccaugccagcgugcgca

SEQ ID NO: 6647 - RNA, 92 nt, Human
ugcggugcuccccagaaaaggggaaggggcaguggggugagaagguccuggcuccccuucucccggccuuccucugccuggggcccacugca

SEQ ID NO: 6648 - RNA, 73 nt, Human
ugcgucuucccuuccuggacucacagacugggguggcccagaacaacugcuacaucuggauggagaagaggca

SEQ ID NO: 6649 - RNA, 61 nt, Human
ugcguguccuaacugguuggaaaaacugugaucaccacuucaaguguagggacuccucgca

SEQ ID NO: 6650 - RNA, 64 nt, Human
ugcguugucaguggcccgggugcggacccaggacaggccuugggccacccggggcggcaucgcg

SEQ ID NO: 6651 - RNA, 126 nt, Human
ugcguuguuacaggaagucccuugccauccuaaaagccaccccuuuucucucuaaggagaauggcccaguccucucccaaguccacacaggggaggugauagcauugcuuucguguaaauuaugua

SEQ ID NO: 6652 - RNA, 69 nt, Human
cguuugaagaagagugcagauacacuuugggggauccaaaaggagcugcaauuuuaaagucuucugaug

SEQ ID NO: 6653 - RNA, 82 nt, Human
cguuuuuaaaaugaacaucucugugugccacaguuccuaggacuggggcaaggacacagugucaagucuuguuuugaggaug

SEQ ID NO: 6654 - RNA, 91 nt, Human
cuaaaacggcuuuugaugaggccauugcugaacuugauacacugaaugaagacucauacaaagacagcacccucaucaugcaguugcuuag

SEQ ID NO: 6655 - RNA, 71 nt, Human
cuaaccauugaugagcacuccugauuuuaaucuagaacauucagauuuaccauaauguuccuuagugguag

SEQ ID NO: 6656 - RNA, 90 nt, Human
cuaacuuugacagagucacacaggucuuuugaaugcaggaugucugaaccuuucugugcucaugugccugucuggcucuaagaaggguag

SEQ ID NO: 6657 - RNA, 80 nt, Human
cuacaagucccagcaggccccgcggccaaggugccucgucuuuccuggacuccuggagcagagccucuugggaaauguag

SEQ ID NO: 6658 - RNA, 75 nt, Human
cuacacagacuucuauuccucucggagcaugcuaccaacgucggaaucauguucagggacaaggagaaugcgugg

SEQ ID NO: 6659 - RNA, 96 nt, Human
cuacaugaagaagagagaagaggagaugcgugauaccaagagucaaaaaacucggguccuauacuucagcaucuuuucaaguucugucucaugugg

SEQ ID NO: 6660 - RNA, 80 nt, Human
cuaccaucuuuauggcagccgcauggacaggcagacgaaacagcagcccagacagaauguggcuuacaacagagaggagg

SEQ ID NO: 6661 - RNA, 65 nt, Human
cuacccccaccaccacuuccugagaugagaugucuagguauaggaggauguggcuguugggguag

SEQ ID NO: 6662 - RNA, 66 nt, Human
cuacccccaccaccacuuccugagaugagaugucuagguauaggaggauguggcuguugggguuag

SEQ ID NO: 6663 - RNA, 71 nt, Human
cuaccugaggcgucuccagaacagcucagcgccccaaggagcuggaauucgagguaggccggccucggugg

SEQ ID NO: 6664 - RNA, 96 nt, Human
cuaccuuguuuuugguuggcuuuuguuguuguuccugcuacuuucaccuuuaagcagagcagucaggagacaagcauaaaccagagcacuggguag

SEQ ID NO: 6665 - RNA, 68 nt, Human
cuacgugccagcucuaguuuucagccuugggagguuuuauucugacuuccucugauuuuggcaugugg

SEQ ID NO: 6666 - RNA, 74 nt, Human
cuacugcuggaauucuugucauugcagaaaaucaauguuguguucugauuuggggcauucuagcuugcaaguag

SEQ ID NO: 6667 - RNA, 77 nt, Human
cuagagacagacauagucaaaaugaaaacauaaauuccaauuuugugucaauuauuuucaaacuauguucccucugg

SEQ ID NO: 6668 - RNA, 61 nt, Human
cuagagcaagccucaauaaguuuauuuuauuaccuuggaauucuuugaugguggugucuag

SEQ ID NO: 6669 - RNA, 78 nt, Human
cuaggaauaucaggcucucagaagcugccugugaggaugaagauucagccucagaaggucuaggugagcuuuuccugg

SEQ ID NO: 6670 - RNA, 85 nt, Human
cuaggacagcuuugcucuuccugccccuuauaggagcccucacaguucaucuuccugguggcgcagaugagugaggcacccuugg

SEQ ID NO: 6671 - RNA, 130 nt, Human
cuauaaaaccauccagaccucucgauggccacuucugaaaacauccacggugaagggcagggcaggccuggcuguggagugggccagcugaguaccugggcgucacaagggaaaugguuggggauuaugg

SEQ ID NO: 6672 - RNA, 93 nt, Human
cuaucuacaaacagaauauaacaaaaggaaaaugugacuuaagaagugaucucagguccauagcucuucgguucuuccaaauuuguagaucag

SEQ ID NO: 6673 - RNA, 106 nt, Human
cuaucuuuucaucucauuaauucaauuaaaaccauuaccuuaaaauggguuucuuucgaaguguggugucuuuuauauuugaauuaguaacuguaugaagucauag

SEQ ID NO: 6674 - RNA, 81 nt, Human
cuaugacugcucugccauguugcuuugccgaccucgccccugggaaggggaccgggcaaggccacuuccagaggguugugg

SEQ ID NO: 6675 - RNA, 86 nt, Human
cuauguaugagagaauaaaguauuuuggaaaaacaaacggauaauucuuuaaauccagaacuacuuuuuaucuucugauaucauag

SEQ ID NO: 6676 - RNA, 61 nt, Human
cucaacccuuucuuuaaugucauccagggagggggccagggauggaggggaggguguugag

SEQ ID NO: 6677 - RNA, 73 nt, Human
cucaacuggauucggaaugugcugauuuccauuggacucaaguugaucucacuuauauucugagugccgggag

SEQ ID NO: 6678 - RNA, 69 nt, Human
cucaagcuucccagaaucccuugucccuccccacuuugggcacuuagggguggggcuggggagugagag

SEQ ID NO: 6679 - RNA, 79 nt, Human
cucaagguucccugggcauccugcccacccaagcugacugcuaaggucaucgauacggagcaggagcccaggccuagag

SEQ ID NO: 6680 - RNA, 92 nt, Human
cucaaguggcuaaugacacaaucauuacagaaacguucaugauggguccgugcaaagaagaagcuggccugauuaugugguagucgcaagag

SEQ ID NO: 6681 - RNA, 90 nt, Human
cucaaucuggcugcuccucuccauguacccauuccccuuggggugcaagccacaccacccuucacuugggggaugauagcagccaguggg

SEQ ID NO: 6682 - RNA, 68 nt, Human
cucacugcccuggagaaagagaggaaugacaccaccugucccguugcugacucuaaggcuuuuaugag

SEQ ID NO: 6683 - RNA, 68 nt, Human
cucagaguaggucauucugguuugcccuaugccaugugguaagaagccagucagccugcccauuugag

SEQ ID NO: 6684 - RNA, 76 nt, Human
cucagccagacguggagggagccgggugccgcaggaaguccuuuccaccucucauccagcuucacgccugguggag

SEQ ID NO: 6685 - RNA, 75 nt, Human
cucaggguugucccccaguagaagugaugggcugcuuugagccguucuuacugaugucuggucugauccccuggg

SEQ ID NO: 6686 - RNA, 81 nt, Human
cucaguaugcaugguuggcaauguagagugacugugcugcugcuccaccaucuucuacacugccuucauacuugcccugag

SEQ ID NO: 6687 - RNA, 84 nt, Human
cucaguggaagugcugauggagccucugugaagcacaguccugagaccagugcagugaagacugaggucugcccuuccacugag

SEQ ID NO: 6688 - RNA, 86 nt, Human
cucauagugguagauagcuuauuggucaggguagauagagauauguuuucuguguaacugucuaguuuuuguccuaccauucggag

SEQ ID NO: 6689 - RNA, 71 nt, Human
cucauccugcuccuccaggccuucaucaccaccauaagcacaagggucagcauaggcagggucacccagag

SEQ ID NO: 6690 - RNA, 69 nt, Human
cucauggacagcuucgaugcuuuuggaagcauucaccaucuuccaguucaaagucgugucuuucaugag

SEQ ID NO: 6691 - RNA, 81 nt, Human
cuccacuuccccaucccccuaagcccccacugccuuccuuagugauagcagucauaaaucucagggcaccguggaguggag

SEQ ID NO: 6692 - RNA, 66 nt, Human
cuccagaguagcguaggacuucaggcaugcaccaccaugccuggguaacuugcguauuuucgguag

SEQ ID NO: 6693 - RNA, 75 nt, Human
cuccagcaaacgacaaccaacugcacgauggucugaggcagagugugguucagucagggaggucagaagcuggag

SEQ ID NO: 6694 - RNA, 69 nt, Human
cuccagcagugugacgggguaccgggugcucugagaccauuuccggguucccguugccuuugcugaggg

SEQ ID NO: 6695 - RNA, 97 nt, Human
cuccauagccaucaucugcuacagggccaaagccaccuccagcgcccaggugauuggggugcugcucugggucgaacaugcggaucugggauugggg

SEQ ID NO: 6696 - RNA, 66 nt, Human
cucccacccugccggccucaggaacagcuggcuccagaugggggguggcaggcagugaagugggag

SEQ ID NO: 6697 - RNA, 69 nt, Human
cucccaggcaauauuccaggauaggcugccaguuggacuaaggaagccacuccugcggaacccugggag

SEQ ID NO: 6698 - RNA, 65 nt, Human
cuccccauugaaguucacaagacgggaggccauuucuccucauucuuggugcaucaaauccggag

SEQ ID NO: 6699 - RNA, 79 nt, Human
cuccccccauggccaggccuugcuccuguucugccugauguucccugguugugggccugggcuuggcucuggggagggg

SEQ ID NO: 6700 - RNA, 111 nt, Human
cucccggaguuuauggucuggugagaagaucccugcucugagucacugccaagcucuagcuaugugacuuugaacagggaauuucugucccuaucuauaaaauaaacgggg

SEQ ID NO: 6701 - RNA, 89 nt, Human
cucccugaaguaaggaguuggucacuugcaugccugggaguaggcagcaauauuucuauauaugugucugacucuuagcuuucauugag

SEQ ID NO: 6702 - RNA, 74 nt, Human
cuccuccaggagaccauaagauagaucccccauccucucagcccuauucccaugccucccucucauuggaggag

SEQ ID NO: 6703 - RNA, 60 nt, Human
cuccucgcuccgugcucgcaggugccuccuccuggacggcggcagcggcggcgcgaggag

SEQ ID NO: 6704 - RNA, 67 nt, Human
cuccucuggacuuuucgguucccuccccuguuguaacuaggggagggugagugucuguguaggggag

SEQ ID NO: 6705 - RNA, 88 nt, Human
cuccugaaagucauccucgccagucccggcguucaauguccaucaauggcggucuaaugcuggggaaaaaagguggcauugcaaggag

SEQ ID NO: 6706 - RNA, 60 nt, Human
cuccuguggugaauggauaaguaaaggcagaaaagauuauaugucauaccuccauggggg

SEQ ID NO: 6707 - RNA, 77 nt, Human
cuccuugcccaaauuugcccccugugugcuacaugaucggaugacucauaacucuaagggccugguuaagcaagcgg

SEQ ID NO: 6708 - RNA, 80 nt, Human
cuccuuggcagccgggagaggagcaagcgcacgccacugcccgugacccaggcguccggcugcuguccccugccggggag

SEQ ID NO: 6709 - RNA, 74 nt, Human
cuccuuguuccagggaacacucaguuucccuacaggugaucuuggggagagacuguucccaggcaacccuggag

SEQ ID NO: 6710 - RNA, 73 nt, Human
cuccuuguuccagggaacacucauuucccuacaggugaucuuggggagagacuguucccaggcaacccuggag

SEQ ID NO: 6711 - RNA, 86 nt, Human
cucgaagugauccugaggccgaagauugggcugccugguguugcagagacagaagccgggagcggcugaucaggaacacgugcgag

SEQ ID NO: 6712 - RNA, 80 nt, Human
cucgcggcagcuggaagcggcuggucaccugcagugugcucacauuccacaccagcaccaugccguccaugcugcacgag

SEQ ID NO: 6713 - RNA, 79 nt, Human
cucgcuauauggggaacgggugucucaaaggcuguugagcacaucaauaaacacuauugcgccugcccugguuagcaag

SEQ ID NO: 6714 - RNA, 65 nt, Human
cucggagugggguugggacguuuucacucccaguggaaacgccaacuauaaccccucccuccgag

SEQ ID NO: 6715 - RNA, 66 nt, Human
cucgggcugagugaggcacagguuaugauggcuuugucacaucaccugaaugcuguggaguccgag

SEQ ID NO: 6716 - RNA, 69 nt, Human
cucgggucccacguguccccgguacucgccggccggagccuccggcuucccggggccgggggaccuuag

SEQ ID NO: 6717 - RNA, 75 nt, Human
cucgucaaaaaauauucacaguucauaaacuuuccuauuuauguauggagcagcaagacugaaacuguugaggag

SEQ ID NO: 6718 - RNA, 87 nt, Human
cucuaacaaggugcagagcuuagcugauuggugaacagugauugguuuccgcuuuguucacaguggcuaaguucugcaccugaagag

SEQ ID NO: 6719 - RNA, 71 nt, Human
cucuacgguucuccaugcccccuccaguuugggggucuaaaccaaacaggagaggugcaggggaccaggag

SEQ ID NO: 6720 - RNA, 63 nt, Human
cucuaucugccgagcuucuucaccuacgccaaguacaucgugcaaguggaugguaagauaggg

SEQ ID NO: 6721 - RNA, 110 nt, Human
cucucaccugaauuuugugguagaaagucuguauuuguuguugugagcguguuaaauugauaacaaaccaaacuacuugauagcuaaagcagauuguuucggguggggag

SEQ ID NO: 6722 - RNA, 116 nt, Human
cucucaucauagauuaaucacuuaguugcaagggaccaguaaauuaacagaauggugaacauuuuccuuuucuuggugcuuuugcuggaugacuagugguuucugcuggaacagag

SEQ ID NO: 6723 - RNA, 81 nt, Human
cucucaugcaggcaugugugagcagcugcaggugugugagcaaaugugcaucacuggggaacaggugucuguggaugaggg

SEQ ID NO: 6724 - RNA, 76 nt, Human
cucucccuugacccaagccacgaacgagcuggagggaaucugcgguacuuugagcaguuauuggaggaagagagag

SEQ ID NO: 6725 - RNA, 65 nt, Human
cucucccuugcaauuguucgccccucugggccaaaccaaagggacgcugcucuguacagguagag

SEQ ID NO: 6726 - RNA, 65 nt, Human
cucucccuugcaguuguucgccccucugggccaaaccaaagggacgcugcucuguacagguagag

SEQ ID NO: 6727 - RNA, 102 nt, Human
cucuccuauaaccaggauucacggguccaggaaucaagggauagaaguaggagugguuccucucaccuguccccucaacuggaguucuacugguuuggaggg

SEQ ID NO: 6728 - RNA, 102 nt, Human
cucucuccucccugauuugcuggaggcucuacauaaacuuuaagaccuucuuacauaguaagcguuaagaagagagcugucaguuacagaggcgggcaagag

SEQ ID NO: 6729 - RNA, 86 nt, Human
cucugcggcuuuccuugaccucugacccgccgaccacgcuugaucccgggccgcggggccaggaagucggaguuugagccccggag

SEQ ID NO: 6730 - RNA, 81 nt, Human
cucugcucucaggagaccuggcuaugaggcccucggggcagggauacaaaguuagugaggucuauguccagagaagcugag

SEQ ID NO: 6731 - RNA, 76 nt, Human
cucugcugcccuuucugugccccccagguucuaucuccccgucacacccgaggccuggcuucaggagggagcggag

SEQ ID NO: 6732 - RNA, 78 nt, Human
cucugggaagcuuagaagauacuucagcacugggaggauucuuuuacaggaacuguguguugauuucugguuccagag

SEQ ID NO: 6733 - RNA, 75 nt, Human
cucugggcuguggagugggugggcaacgggccuggguagcugggcccaggcaacccaccccuccaccucuuggag

SEQ ID NO: 6734 - RNA, 81 nt, Human
cucuguaaagcgggcugaugacuguaccugccucacagauagcugggauggugcaugucaugugcucagcugggaacagug

SEQ ID NO: 6735 - RNA, 84 nt, Human
cucugucuccugaguagcuggaauuacaggcaugagccacugcacacugcuuacgcuuugaucucagcacaaccaggcuaggag

SEQ ID NO: 6736 - RNA, 74 nt, Human
cucuguggccuacaaaucugggcaccagugguucuaaaaucgccugcgugccucagcaagugccagccacggag

SEQ ID NO: 6737 - RNA, 70 nt, Human
cucuguugcucagcaggaaugcagggguacaaucacgacucacuauacccuugaacuucugggcucaggg

SEQ ID NO: 6738 - RNA, 84 nt, Human
cucuguuuaguuugauauuaaagcaaaauuaagaggucuuaguuuuuccuauagaacuuuuaauaugucaauucagaaauagag

SEQ ID NO: 6739 - RNA, 109 nt, Human
cucuguuuccuaauucuaggcuagcuuuuuuugugagaugugaaucuuacucuugugaaauaugggaucaagacacauaagcaaaagucuagugagaauuaggacagag

SEQ ID NO: 6740 - RNA, 89 nt, Human
cucuuaaaccuuuagaaaugcuacagcaucuagcuucucuagaucaauaaucacagaggcuuaagugcugaccucauaaagauaaagag

SEQ ID NO: 6741 - RNA, 78 nt, Human
cucuuaguuuugauuugaggcaucccguaaaguuguaguugcagaaucccaaacuaggcuacauuucaaaauucaggg

SEQ ID NO: 6742 - RNA, 71 nt, Human
cucuucgucacucuuaugucucucuccuuuucugugucuguguguggggagagagagagagagaaagagag

SEQ ID NO: 6743 - RNA, 76 nt, Human
cucuucuucccccucaagguaacauuggauguggcugauuaacucccacaagaaccugagcauuaagggucaagag

SEQ ID NO: 6744 - RNA, 91 nt, Human
cucuugauaaucugauuuaacacaaauuuccucauugaguuucuccucaugaagaaacggccucagugagguaaaucggaaugcacaggag

SEQ ID NO: 6745 - RNA, 80 nt, Human
cucuugccucagucuuccaaauagcugggacuagaggcacaugccacugggcccagccuauuugcaaaacuuuuguagag

SEQ ID NO: 6746 - RNA, 73 nt, Human
cucuuguugaccaggcuggagugcaauggcgcgaucucggcucacuguaaccucugccucccggguucaagag

SEQ ID NO: 6747 - RNA, 91 nt, Human
cucuuuauucugacaacauuaugacauuaaauaaaauccaagagguauuggauuaguccuuguuuggucucuggugauuuagauaaggcag

SEQ ID NO: 6748 - RNA, 91 nt, Human
cucuuugaaacacugccaugccuacguccaucagcuacuaaaugauucgcaaauguacugacugcacuuauauaugcaguggccuaccgag

SEQ ID NO: 6749 - RNA, 77 nt, Human
cucuuugaagcguuuuccaacaguauagaucucaugaaucaaauccuccaugcagaugaugccguauuuaccaagag

SEQ ID NO: 6750 - RNA, 88 nt, Human
cugaaaacucugauuuccaaauuugugaaugguugaacuacagauacuacuguaucaguguucuuaccaauugcaacaguuaauucag

SEQ ID NO: 6751 - RNA, 64 nt, Human
cugaaacaaaaagcauuguuguuugccaugauacaagugcacuguggcaaugcccguugcucag

SEQ ID NO: 6752 - RNA, 82 nt, Human
cugaaacgcuacaccaggcaaauucuuaguccuacugugaaaucgauggggucuuggaaaauggacugggacuguguuucag

SEQ ID NO: 6753 - RNA, 120 nt, Human
cugaaagaccaaccacauuggccacacaggcuaucugaaccacgguugacugucucuccagauggaucccucugugcuucuggacggcaaggauggccaggcauguuauugggaucucag

SEQ ID NO: 6754 - RNA, 102 nt, Human
cugaaagucuaucugcugccacgccugggcacauacugcaucauuuacaaaacuguagagcaccuguugugugugcaguugugauuucuuauagauuuuuag

SEQ ID NO: 6755 - RNA, 86 nt, Human
cugaacauuuuccgaaaaucauuuugagcaaaauaucuguuuaauaacaagauaaccacaucaagaugguuggaaagcugaagcag

SEQ ID NO: 6756 - RNA, 76 nt, Human
cugacagauuucuucccucuucccuccccaucacccaccucagugauaacacauuacugauagaggaagucauuag

SEQ ID NO: 6757 - RNA, 85 nt, Human
cugacaugugcauuauccaugucauuuuaaacaaagugaccuauggaaggguacgcugugcugugacaugguaaugggcuguugg

SEQ ID NO: 6758 - RNA, 93 nt, Human
cugagaguuggggccacaccaccagugaggggugcaguagucacucacagacucagacaagcaacccacuggcuugccugucccaauucccag

SEQ ID NO: 6759 - RNA, 105 nt, Human
cugagaugccuuuaguggaacucuucuccucagaaccauguagagucuaccugacuccaggugguacuuuuaagguauccaggagaccuuuagauuugcucucag

SEQ ID NO: 6760 - RNA, 71 nt, Human
cugagcuccggcagccucagcggcucugagucucccagccucaacccuggccgccgccugccaaucuucag

SEQ ID NO: 6761 - RNA, 96 nt, Human
cugaggaccccucggaucugcuccagcacgugaaauuccaguccagcaacuuugaaaacauccugacgugggacagcgggccggagggcaccccag

SEQ ID NO: 6762 - RNA, 92 nt, Human
cugaggaugggcaacccccaggucugcagcuccagguacauaucacgcgcacagccugggcagccuggcccucaccggucgcccacucccag

SEQ ID NO: 6763 - RNA, 96 nt, Human
cugaggcaccuccacuggccccuuugugaggcacgcuugaccuggguuucauggaaagaaugugcccucaccaaagggugcuaaacaaggccccag

SEQ ID NO: 6764 - RNA, 80 nt, Human
cugagguuacuguggcucggcaaaggcagcuagaggaaucugcaagucaucuggccugcuuccaggcugcagaaucccag

SEQ ID NO: 6765 - RNA, 94 nt, Human
cugagucagcgcacgaucacugucgggguguacgaagcggccaagcugcucaacgucgaccccgauaacgugguguugugccugcuggcggcgg

SEQ ID NO: 6766 - RNA, 75 nt, Human
cugaucaauccuucuuuuucucuuuugcccacaauuuaagcaaguagaugugcagaagaaaugggaaggauucag

SEQ ID NO: 6767 - RNA, 66 nt, Human
cugaucccucccccagcucugcugggucccggggccacagcgucaggccgguggggguggagguag

SEQ ID NO: 6768 - RNA, 86 nt, Human
cugaugcugaggauuccgacggcagcauugccuccugggagcuacggguggcaggggaacgcuccuggaugauccccagcaaacag

SEQ ID NO: 6769 - RNA, 70 nt, Human
cugauggcugaagcuccuaauauggcaguugugaaugaacagcaaaugccagaagaaguuccagccccag

SEQ ID NO: 6770 - RNA, 76 nt, Human
cugcaagaagaaaccaagacugagaaugcugucauguguuaaguauauuuaaaguggcuacguucuaguuuugcag

SEQ ID NO: 6771 - RNA, 95 nt, Human
cugcaagacugugcccuuccccuccugaaagaugucaucgcaacagauaaagaagacguugccuucaaagaccugggauguggccauucuugugg

SEQ ID NO: 6772 - RNA, 67 nt, Human
cugcaaguccagccagaguguuuuauaucgcgucaacaauaagaacuacuuagguugguaccagcag

SEQ ID NO: 6773 - RNA, 78 nt, Human
cugcagcagaucugcaagauccucaaugcgcacauggacucacugcaguggaucgaccagaacucggcccugcugcag

SEQ ID NO: 6774 - RNA, 117 nt, Human
cugcagcccaagcaaaauggaaauacaagcaaucauguaguucacuguguccaucagacaggaacaaaucagaugaccaggaauugagagacugaacauuuccucagguggcuggag

SEQ ID NO: 6775 - RNA, 86 nt, Human
cugcagcccuuguaccucaaagcgaucccacaauguccacucuugguuauaguacuggugacguggugcggcaagggguacagcag

SEQ ID NO: 6776 - RNA, 85 nt, Human
cugcagggauuuuguuugcuccuucugccauuugaguacacagcuagaaauggcaucuaugaagcagacaguaggcccuuaccag

SEQ ID NO: 6777 - RNA, 83 nt, Human
cugccaaauauccauuagacauugagugagaaacaggucacaagauugccacucccuuaagcaggaucuagguauuuagguag

SEQ ID NO: 6778 - RNA, 66 nt, Human
cugccccaucaggcccaucucaagauguuggauuacagugcaacaugagaugggguggggacacag

SEQ ID NO: 6779 - RNA, 100 nt, Human
cugcccccgcccucuggacccgagugacucaggccuuuguuuguccuuccugguagaggcggguucccucccucggcaagaugccggagugcugggaugg

SEQ ID NO: 6780 - RNA, 63 nt, Human
cugcccuccaucuaaaggcgcugcuugauuuugaggauaaagauggagacaaggugguggcag

SEQ ID NO: 6781 - RNA, 92 nt, Human
cugcccuucgagaugugcccuucucagcccuguacugguucaacuaugagcuggugaagagcuggcucaauggguucaggccgaaggaccag

SEQ ID NO: 6782 - RNA, 81 nt, Human
cugccgauguucuggcauggauggugguccuguaguccuuuauugaucgauagcagggaacugaccgagcgagguuggcag

SEQ ID NO: 6783 - RNA, 65 nt, Human
cugccgccucuccgagcucuugugacgcggaccucagugccaggauggcucggggcgagcggcgg

SEQ ID NO: 6784 - RNA, 76 nt, Human
cugccggaaguuuaccagcucacuuucggcgucgcgcccgccuccguggagcaggccggaaguggcuuuccggcag

SEQ ID NO: 6785 - RNA, 96 nt, Human
cugccuaaugaugguguauggaagcuguagcauuucuggcaccugccaacuugucagagcugccuuucccuuccuggcacuuugucuauguggcag

SEQ ID NO: 6786 - RNA, 99 nt, Human
cugccuauauuacauucauuuugaugguuuguaucucaaaggaguacagugaacgaaacuuguuuaaagauacaccggaaagaaaaagagaagaggcag

SEQ ID NO: 6787 - RNA, 72 nt, Human
cugccucucugcaggccgugugcuuugcucgguugaucuugcagagccuaagacacaggcccagagaggcag

SEQ ID NO: 6788 - RNA, 72 nt, Human
cugccucuucuccugcuggcagguacacuucuucaggcuguguccucugugcagguagguaggggauggcag

SEQ ID NO: 6789 - RNA, 83 nt, Human
cugcggugcaggucgaccagggccugggagcgcugcuggucccggagcuccuccagccgcugccagcccugcuccugcagcag

SEQ ID NO: 6790 - RNA, 128 nt, Human
cugcgucuaaauuccuggagaauauuccuucuguccuagcacucaucuggccuccccauccccuuagguaggcuaguccauguguguguuacaggggcugcuagaaaguuccucccuauuuugagcag

SEQ ID NO: 6791 - RNA, 100 nt, Human
cugcgugcccggaguccccgccugugucgucucugucgccguccccgucuccugccaggcgcggagcccugcgagccgcgggugggccccaggcgcgcag

SEQ ID NO: 6792 - RNA, 62 nt, Human
cugcuccuuguggaagaauaaggacauucagaggcuguuaccuucuccucucaaggaugcag

SEQ ID NO: 6793 - RNA, 102 nt, Human
cugcucuggcauaggaauacuugaauagcuugguuaaaugaagggauggccaggagauguuacuuuuccaagcuauucaggcacuccuuaugucagagacag

SEQ ID NO: 6794 - RNA, 91 nt, Human
cugcucuuccaaagcuccugcgucuguuuuuaaagggccuggggaaaaauacugccuaggaaaaugccaaaauggaauuaggagagaguag

SEQ ID NO: 6795 - RNA, 80 nt, Human
cugcugaggccuguccccaccucaccccuugguugucgaugguguggaacauuggggugaggggcaaaaugccuaagcag

SEQ ID NO: 6796 - RNA, 78 nt, Human
cugcugagguucuggaguggcacaggaacaggaggagcaaaugacacugggucuuugugcugaggcaggacacagcgg

SEQ ID NO: 6797 - RNA, 60 nt, Human
cugcugcgcccuguccuccgucggcucugcgggcucccgggccuacagcggcugcggcag

SEQ ID NO: 6798 - RNA, 60 nt, Human
cugcuggacauuccaaaucccaccaucgauuguggcaggcgcuuugggauuuccuuucag

SEQ ID NO: 6799 - RNA, 60 nt, Human
cugcuggcagagaugcauuccagagaugcacuccgcucuggaacucacucucagccacag

SEQ ID NO: 6800 - RNA, 91 nt, Human
cugcuggugggagaaccuagaguugggaagacaucacugauuaugucucuggucagugaagaauuuccagaagagguuccuccccgggcag

SEQ ID NO: 6801 - RNA, 68 nt, Human
cugcuguuguccaacagaacgaccuaguauuugaauuugcuaguaacgucauggaggaugaacgacag

SEQ ID NO: 6802 - RNA, 66 nt, Human
cugcuucuucgggccugcagguccuuugggcacggccguagagaccagaagggccuggagaacuag

SEQ ID NO: 6803 - RNA, 68 nt, Human
cugcuucuuuucuccucccuuuuacuugccgguagaacacaguuaugggucgcaagaagaagaagcag

SEQ ID NO: 6804 - RNA, 86 nt, Human
cugcuugaauggauguauuuugucuguauguaaagauuuaacuacguaaauguugacauauuaauuagaugguuuguuucaagcag

SEQ ID NO: 6805 - RNA, 64 nt, Human
cugcuuggugcgagugcccgagggcguuggaggcagcgugacuccugcaccuugugcuuuguag

SEQ ID NO: 6806 - RNA, 83 nt, Human
cugcuuuugcacagaucugggaguaucggauguagcugaguccagccugucuccaguaggccaccaugcuguagcgaaagcgg

SEQ ID NO: 6807 - RNA, 71 nt, Human
cuggaaacugaucucggaguuaaggcgaauuguucaagaacacaaacuacaucgcacucgucaguugucag

SEQ ID NO: 6808 - RNA, 92 nt, Human
cuggaaauguauuccauuucaagaaaguacgacuaucagcagccacaaaaccaagcugacagugugcaacucucauuggaaugaaaccucag

SEQ ID NO: 6809 - RNA, 68 nt, Human
cuggaacagcccauuuuaucuuugaauggucuucugccagcccauuuugaggccagaggugcugucag

SEQ ID NO: 6810 - RNA, 81 nt, Human
cuggaacugccuucgugccgccucaaucucuuuguucaucucaucuuuaaggaucuuguucucuuugugacagcguucuag

SEQ ID NO: 6811 - RNA, 101 nt, Human
cuggacaccaguagguagugucaagccagagauucggggcaguagauaaauguucauuuuacugaugcacuuuaguuuuuggucuguuaccuguuuuccag

SEQ ID NO: 6812 - RNA, 93 nt, Human
cuggaccuuuuguccuauguguguggauuccagggcaacucuagcaucagagcaaaagccuuggguuucucgcauucaguggccuaucuccag

SEQ ID NO: 6813 - RNA, 65 nt, Human
cuggacuuggaugggcccgaguugggggcaacaccccgggcauuggggcuuuccagcucucacag

SEQ ID NO: 6814 - RNA, 87 nt, Human
cuggagagagugccucagggcuuuuugaaccugcucauugccacuggugaugaccuggccgucaggcagcucguagcucuucuccag

SEQ ID NO: 6815 - RNA, 69 nt, Human
cuggagaucucugguuccccggggagucugagagcuucgaggaugcccauguggagcacagaucuccag

SEQ ID NO: 6816 - RNA, 65 nt, Human
cuggagcaaacgccuucauccggaugccuggaggccaugaaggaauggagugcguaacgcuccag

SEQ ID NO: 6817 - RNA, 109 nt, Human
cuggaggauuuggggugccccucucggcagggaacaggaaguaggaaucccagaagggucugggggaacccuaacccugagcucaguccaguucaccccucaccuccag

SEQ ID NO: 6818 - RNA, 100 nt, Human
cuggagggccugaauuucaaccucacggagauuccggaggcucagauccaugaaggcuccaggaacuccuccguaccucaacagcagacagccaguccag

SEQ ID NO: 6819 - RNA, 81 nt, Human
cuggagguggaagccaacaaugccuuugaccaguaucgagaccuguauuuugaagguggcgucucaucugucuaccucugg

SEQ ID NO: 6820 - RNA, 86 nt, Human
cuggaugaagcugacgaaauguuaagccguggauucaaggaccagaucuaugaccauauuccaaaaugcucaacagcaacacccag

SEQ ID NO: 6821 - RNA, 79 nt, Human
cuggaugcuuuggagccaagcuuucgucccaugcaagggaaacaaccacuucugggauguccgcugcaaucugcuccgg

SEQ ID NO: 6822 - RNA, 74 nt, Human
cuggauucagccugggccugggcagugggcaggggcugugcgccacccccgguaacaggcccaggcgguuccag

SEQ ID NO: 6823 - RNA, 71 nt, Human
cuggauugcaguggcccaaucugggcucaugaaaccucugggucccggucaagugguucuucugccuucag

SEQ ID NO: 6824 - RNA, 60 nt, Human
cuggcaucacuggcgggcucgggaccgggcggggccuggcccgucgcccggccagucugg

SEQ ID NO: 6825 - RNA, 82 nt, Human
cuggcaucuugggugaguuagagauggaaguacauuuuaauaggaugcuucuuuucucuucccccagugccuagguugccag

SEQ ID NO: 6826 - RNA, 91 nt, Human
cuggccacauaugccccugucaucucugcugagaaagccuaccaugaacagcuuucuguagcagagauuaccaaugcuugcuuugagccag

SEQ ID NO: 6827 - RNA, 76 nt, Human
cuggccaggcgguggguucucucuagcuuuaguucuacugcaacguucagagcaggcccauagucuuacaggccag

SEQ ID NO: 6828 - RNA, 75 nt, Human
cuggccagggugguggcuaacgccuguaaucccagcacuuugggaggccgaggcggguggaucaacuguggucag

SEQ ID NO: 6829 - RNA, 80 nt, Human
cuggcccgacgccgacggccucucaguggcucccggaggacccggcgggcccaguguuggagagcugaaggucaggccag

SEQ ID NO: 6830 - RNA, 72 nt, Human
cuggccucaagugguccucccaucuuggcuucccaaagugcugggauuacagaugugagccaccauggccgg

SEQ ID NO: 6831 - RNA, 79 nt, Human
cuggcggccggcgggcacagccggcucauuguucugcacuacaaccacucgggccggcuggccgggcgcggggggccgg

SEQ ID NO: 6832 - RNA, 80 nt, Human
cuggcugcuccucuccauguacccauuccccuuggggugcaagccacaccacccuucacuugggggaugauagcagccag

SEQ ID NO: 6833 - RNA, 76 nt, Human
cuggcugcugcugucuuccuagauacacugaauccacuucuguguagcaccugggucagcugacaauuaaugcuag

SEQ ID NO: 6834 - RNA, 77 nt, Human
cugggaagaacugauaucugagaacaacuuaaacggcgauuuuagugaaguugacgcucaagagcaggauuccccag

SEQ ID NO: 6835 - RNA, 94 nt, Human
cugggaagaaguaugguagugguggaugaaggguggauauuuuaaauugugcaguuacaguuuacuguccuauuaccucugcucguuuaaccag

SEQ ID NO: 6836 - RNA, 95 nt, Human
cugggaccgugccuucaagcccuaacaacuucuuggcccacgguguccuccccgacagcgugcaccuucacccgcugcucaagguccgcucccag

SEQ ID NO: 6837 - RNA, 75 nt, Human
cugggacuauaggugugugccacgaugcuggcuaauuuuuuuguauuagagaugugguuucaccacguugcccag

SEQ ID NO: 6838 - RNA, 77 nt, Human
cugggacucagagccccgcuucuucccacuccacuuguugucccaugaaggaagaagugggguuccuccugacccag

SEQ ID NO: 6839 - RNA, 63 nt, Human
cugggauagaagccuuugaccaggcaggucaggcugaccugguucuuggucagcucaucccgg

SEQ ID NO: 6840 - RNA, 72 nt, Human
cugggcauggugucuuaugccuguaaucccagcacuuugggaggcugaggcuggaggaucacaugaacccag

SEQ ID NO: 6841 - RNA, 80 nt, Human
cugggcuucaaggaagggcaaagcaucaaguaguguaucgggaacauuacaaacaagaaaggaggugcuucuaagcccag

SEQ ID NO: 6842 - RNA, 78 nt, Human
cugggcuuugggccuggugguugggagucaccuacugacaucgggacugacauuccugaaccccugguaugaggccag

SEQ ID NO: 6843 - RNA, 79 nt, Human
cuggggacugaagaccacugaguugaccacauccucgugccgcagccuggccagacagauguuguaguggcggucccag

SEQ ID NO: 6844 - RNA, 73 nt, Human
cuggggcuaccucucuacagcuguuuccucagaggggaaaaaucuuggaggaccagaugggugggagcucugg

SEQ ID NO: 6845 - RNA, 74 nt, Human
cuggggcucaccgcaauccuuccaacucucagccuccacagguagcuggggauaacggggcugugagccacugg

SEQ ID NO: 6846 - RNA, 93 nt, Human
cugggggcugagaccacccuugccugcccccuucuuucugccuuaagaauguccuuuuaggcugggcaugguggcucacgccuguaaccccag

SEQ ID NO: 6847 - RNA, 86 nt, Human
cuggggggcuucggcagaacccggagaccaccauggccucauuugggccacaagugaaaaacaugguucaggcuggagccuuccgg

SEQ ID NO: 6848 - RNA, 72 nt, Human
cuggggugaggcgggcagcgcuacgcgugggguaggaccaucuuacgcugggaccccgccaaggagccccag

SEQ ID NO: 6849 - RNA, 77 nt, Human
cugggguguuuauggcaagucacuuugacagacauuaauguggcagauguugucugacuuacuguuucaacaaccag

SEQ ID NO: 6850 - RNA, 78 nt, Human
cugggguguuuauggcaagucacuuugacagacauuauguguggaaauguggucugacuuacuguuucaacaaaccag

SEQ ID NO: 6851 - RNA, 78 nt, Human
cugggguguuuauggcaagucacuuugacagacauuauuguggcaaauguugucugacuuacuguuucaacaaaccag

SEQ ID NO: 6852 - RNA, 78 nt, Human
cugggguguuuauggcaagucacuuugacagacauuauuguggcaaauguugucugacuuacuguuucaaccaaccag

SEQ ID NO: 6853 - RNA, 77 nt, Human
cugggguguuuauggcaagucacuuugacagacauuauuguggcaauguugucugacuuacuguuucaacaaaccag

SEQ ID NO: 6854 - RNA, 76 nt, Human
cugggguguuuauggcaagucacuuugacagacauuauuguggcaauguugucugacuuacuguuucacaaaccag

SEQ ID NO: 6855 - RNA, 79 nt, Human
cugggguguuuauggcaagucacuuugacagacauuauugugggcaaauguugucugacuuacuguuucaacaaaccag

SEQ ID NO: 6856 - RNA, 79 nt, Human
cugggguguuuauggcaagucacuuuugacagacauuauuguggcaaauguugucugacuuacuguuucaacaaaccag

SEQ ID NO: 6857 - RNA, 79 nt, Human
cuggguauaggaccgucgugagacauggucaguuaaccccuacugaugcauguguugugccaugguacucccugcucag

SEQ ID NO: 6858 - RNA, 72 nt, Human
cuggguccccaagucuggucuucugugaggcaggggcuaagcaggagcuuguccaggaaugugggggucugg

SEQ ID NO: 6859 - RNA, 115 nt, Human
cugggucuugcugugcccucccaggcuuaguguucccucccucaaagacugacagccaucguucugcacggggcuuucugcauguaacgccagcuaagcauaguaagaaguccag

SEQ ID NO: 6860 - RNA, 95 nt, Human
cugggugaaccaggauggucgcuuucugucucguucaaugauccucuugcccugaucuuguucagacggugucucuccuguguacagcaccacag

SEQ ID NO: 6861 - RNA, 74 nt, Human
cuggguucccaaauucuccuugcuguucugcaucauugucuagauggauuaguaaagaagaaugaaaacuccag

SEQ ID NO: 6862 - RNA, 74 nt, Human
cugguaccuuugugcauguugccuucauuccugagcagguaucauccucagggaaccagcauggcaccuaccag

SEQ ID NO: 6863 - RNA, 74 nt, Human
cugguaguugguaaaggagcuggccuugaacucagggauaucuugaaagccacuguugcuucuauggacucuag

SEQ ID NO: 6864 - RNA, 76 nt, Human
cuggucacaucaucuaucaucuacgaagaaagcgccggaaggcccgaggacguccuggaugauuggacgacgccgg

SEQ ID NO: 6865 - RNA, 87 nt, Human
cuggugcgcacuuggcuggaggacaugggagugacgcuggagucguugaaagugugccauucuccugucccuggacugcgacaguag

SEQ ID NO: 6866 - RNA, 67 nt, Human
cuggugcuaccaagaagucagauggaaacaauugauguuucuauugaagcugcuucuggugguaaag

SEQ ID NO: 6867 - RNA, 83 nt, Human
cugguguggccagguccauugugcugaugccucaagagauccaggcugguacagaugggucuggcacauucuguaccugccag

SEQ ID NO: 6868 - RNA, 93 nt, Human
cugguguugugggagaaagaacgcggggcccgaaaaaaagucccaaauuaugaacgacgccugcggaacccaauguuuuuuccacaauggggg

SEQ ID NO: 6869 - RNA, 82 nt, Human
cugguuccgccggccguggucgccgagucggugucguccuugaccaucgccgacgcguucauugcagccggcgagagcucag

SEQ ID NO: 6870 - RNA, 90 nt, Human
cugguucucgccgccucacgcgaacucuacaaaugcaucaagaaagcggugaagcagaagcagauucggcgcggggugaaagagguucag

SEQ ID NO: 6871 - RNA, 86 nt, Human
cuguaaggaagaaccugcugucugccagagaggauaagcugcccaucucagcagcugucuaaaagaaggcaggugucucuuuaaag

SEQ ID NO: 6872 - RNA, 77 nt, Human
cuguaaugcagagaccugugacuauuuccucagcuaccggaugauaggggcugauguagaauuugagcugagugcag

SEQ ID NO: 6873 - RNA, 77 nt, Human
cuguaccagguacugugcugcauuacacauguuuacgcacuccccgacaugcuugugagguaggcagugcuauacag

SEQ ID NO: 6874 - RNA, 83 nt, Human
cuguacgcucccacgguggcacaugaacgacuucuuccacuccuuccugauuguguuccgcgugcuguguggagaguggauag

SEQ ID NO: 6875 - RNA, 68 nt, Human
cuguaguccaacuauucaggaugcugaggugggaguaucuauuugagcccagaaaguugaggcuacag

SEQ ID NO: 6876 - RNA, 83 nt, Human
cugucaagaaggaacaucaaagugaagacauuuucugucaggcaaauuuucaggaaagucuccuuugcacccuuacuugaggg

SEQ ID NO: 6877 - RNA, 68 nt, Human
cuguccccaagcgcaugccaucugcagccagcagucuuggaacuuugguugguggcaccaggggacag

SEQ ID NO: 6878 - RNA, 73 nt, Human
cugucccccuaccccaagucccccagucccucaaaggagggcagggaguggggacuugcaggaagcaggacag

SEQ ID NO: 6879 - RNA, 80 nt, Human
cuguccgguugaaacacaacgcgaggaucgggcgugguggcucacgccuguaaucccagcacuuugggaggccgaggcag

SEQ ID NO: 6880 - RNA, 102 nt, Human
cugucucugggcccugucugaggcuucuuaagauguuguuacaauaaucuacuauguggagugucuggaggugucucuuacuucucuggcauuaagagacag

SEQ ID NO: 6881 - RNA, 105 nt, Human
cugugaaagagacuggucauccugcauuaguaugacagaggggggcugcagaauguugcuauacuggugguacuggauuaucauggcccugggaauuuuucauag

SEQ ID NO: 6882 - RNA, 110 nt, Human
cugugcaccucgugguagaaacucuuugggguucgccagcuguagcucauauuucauguuggggucaugccgaacacccaugaaguuguaguuccacgaggacugggcag

SEQ ID NO: 6883 - RNA, 84 nt, Human
cugugcaccuucccugggacaacuuucuuauugaugggucuuguguuuaauuaaugagaguuuguuuuagggguaugggcccag

SEQ ID NO: 6884 - RNA, 75 nt, Human
cuguggaaaaacuaagggaugcuuuagauauggcaaaccaggcuguaaugcagagaccugugacuauuuccucag

SEQ ID NO: 6885 - RNA, 73 nt, Human
cugugggcgagugaaaggguuccaaccggaaggggaacuggacgcaagggacaacacgcacucgggaacacag

SEQ ID NO: 6886 - RNA, 75 nt, Human
cuguggggggcgucugcgcccuggccaauguccugggggcucagguaugccagcuggagcgacugugcugcacgg

SEQ ID NO: 6887 - RNA, 72 nt, Human
cuguguacgccgccagcugggugagcauggggcagccccaguggccaccggagcugugugagcaagugacag

SEQ ID NO: 6888 - RNA, 74 nt, Human
cugugucuuugguuuuaagaguaaauucuaguuaacaugaccuucagaaacuccuggaaacaucugaggcgcag

SEQ ID NO: 6889 - RNA, 72 nt, Human
cuguucaccuugucacagggcuaugucuuggcucuuggcuaagacuuuaagggcccacacagcagagaacag

SEQ ID NO: 6890 - RNA, 67 nt, Human
cuguuccaaagccaauacgaagaccucccaaaaauugguuggguuaauuuguaauggucccagacag

SEQ ID NO: 6891 - RNA, 70 nt, Human
cuguugcgccuccaugugcuuuggaucagcaaccccagugguauucuaccagagcauugugggaaagcag

SEQ ID NO: 6892 - RNA, 116 nt, Human
cuguugguucuuucuccugacuccugugguuuugcuaauggcacuuuacagacuccauggagaugucagguggaccaucuucuagggcccagcaggaguagggaaugugccaacag

SEQ ID NO: 6893 - RNA, 66 nt, Human
cuguuugaaugugcugguaacugcuuugcuucuugaguagagccaccaccaccauagcccagccag

SEQ ID NO: 6894 - RNA, 91 nt, Human
cuuaaggagagagauuguguucuuccucucucaggggugauaacucaggaagccucuggguugggaagaccaucaguucuuuugucuuagg

SEQ ID NO: 6895 - RNA, 77 nt, Human
cuuaaguguguuuugugugugugcccacacguagacaaauguguacggugcacacacacagugcaucauuuuuuaag

SEQ ID NO: 6896 - RNA, 72 nt, Human
cuuacaaaguauaucuaaggauuauucugcugaagauucaguuuaagaguuuccuugggagaacuaaguaag

SEQ ID NO: 6897 - RNA, 62 nt, Human
cuuacagcugagaccuguuccugcaagccagcugccuugucugaacagaacguagugguagg

SEQ ID NO: 6898 - RNA, 87 nt, Human
cuuaccccaguauccuauuaucucauaccuaaggcagugaugguuucucagaccucuuagauugagaagauguggcauggguguaag

SEQ ID NO: 6899 - RNA, 72 nt, Human
cuuaguggcauguacuggugggagagggaguucccagaucuaauccccccagcaguaugcaucugaucugag

SEQ ID NO: 6900 - RNA, 78 nt, Human
cuuaugagugugaagaauguggaaaauguuuuagucaaaagggcacccuaacugaacaucaucgaguucacacuagag

SEQ ID NO: 6901 - RNA, 93 nt, Human
cuuauuuucucacaagccugguuauuugaggaugugcuuguaacguaugcuuucucuucuauuucucauagccaaugcuuguaccugaauagg

SEQ ID NO: 6902 - RNA, 93 nt, Human
cuuauuuuuucacaagccugguuauuugaggaugugcuuguaacguaugcuuucucuucuauuucucauagccaaugcuuguaccugaauagg

SEQ ID NO: 6903 - RNA, 93 nt, Human
cuuauuuuuucacaagccugguuauuugaggaugugcuuguaacguaugcuuucucuucuauuucucauagccaaugcuuguaccuuaauagg

SEQ ID NO: 6904 - RNA, 70 nt, Human
cuucaaacugguuucuucacucugaagcagguuccccuuccccuucaggauaucuggaccaaguuugaag

SEQ ID NO: 6905 - RNA, 131 nt, Human
cuucaagccuccugaggagaaucuagaugucucagguacaaagagguuuuaauuucacagcaucuccaacagcgcacuuugggugauguggaccauucuguauugagcagaaauuuucuaauggaaggaag

SEQ ID NO: 6906 - RNA, 83 nt, Human
cuucaagugucuugaugguagacaaggugaacguuuccuccuucucaaauucauccccuaccucaucccaggcugcuucgaag

SEQ ID NO: 6907 - RNA, 102 nt, Human
cuucacaccccaaacuucuaggugaucugugggauuuauaccugggcagccuucagguacgucugaagucccacccaugaggcuccucaaaguggaguggag

SEQ ID NO: 6908 - RNA, 131 nt, Human
cuucaccaugcaggggugacuuuuauuugaaggcagaaaacacccuauuuggggguucacucauaaucugcaacaguuuguuuguuuguuuuuaaaaaagagaaaaaucagaagccaaagggccugggaag

SEQ ID NO: 6909 - RNA, 71 nt, Human
cuucacccacguaauguauguccugcaagcugucccacaguuguggggcacgucucgguugucgggugaag

SEQ ID NO: 6910 - RNA, 73 nt, Human
cuucagagaggugggauguggaggggagaggacaugaggauggagcugccaaagccauccugccacugugaag

SEQ ID NO: 6911 - RNA, 71 nt, Human
cuucagaugagcuccucucuuuccaaaggcagguuaacacggguuaggaaggagauuaggagacucugaag

SEQ ID NO: 6912 - RNA, 89 nt, Human
cuucagcuugaugcauggucacuucuuuacuauuuaaaauacuacacauuguacaaaauaucgaagacacuaccauaugcuaaaggaag

SEQ ID NO: 6913 - RNA, 60 nt, Human
cuucaggagccagcuguagguguccuuguccugcaggagcugcagcauggccuucugaag

SEQ ID NO: 6914 - RNA, 87 nt, Human
cuucaggcaguaaaccaacagcucacaaaggagaaagagcacuaccagguguuagagugaaguaauugggaaacuguucauuugagg

SEQ ID NO: 6915 - RNA, 73 nt, Human
cuucaucuccacucugcacgggggcugagggccccuucucugggccugggcacccuuagaggggagaacgaag

SEQ ID NO: 6916 - RNA, 78 nt, Human
cuuccagguccucaguacacaaccaccacgagggaaacccagaccuagguuuccggcgccgacucugaggcccgggag

SEQ ID NO: 6917 - RNA, 69 nt, Human
cuuccaugggcaggggccaugacagggagauaggccacaccuuucccagguggaaccugcagauggagg

SEQ ID NO: 6918 - RNA, 73 nt, Human
cuucccagcuguugagggccguuccuugggcaggcggccgcccgccuuggcccgucucuggagugcugggcag

SEQ ID NO: 6919 - RNA, 86 nt, Human
cuucccaggcccguggccaacccagcaguccuucccucagcugccuaggaggaagggacccagcugggucugggccacaagggagg

SEQ ID NO: 6920 - RNA, 78 nt, Human
cuuccggccgccgguucauuagcgugaagauguuggagcgccgcuuggacugcuuucggauggguguggggguggagg

SEQ ID NO: 6921 - RNA, 99 nt, Human
cuuccuauaaaguuugcucucucuuuuugaaggaaauuucugggcaaacaacauuuugagaaagaaauucagauaugggaaaguaaagaucauggggag

SEQ ID NO: 6922 - RNA, 73 nt, Human
cuuccuccauccugagguuuggggggagaugcagugaaccugcaaauuccccaauuugaaagggugcuggagg

SEQ ID NO: 6923 - RNA, 79 nt, Human
cuuccuccucucugaccgguuggccagggacuaugcagccaucgucuucuuugcuaacaaccgcuuugagacagggaag

SEQ ID NO: 6924 - RNA, 70 nt, Human
cuuccugggcuucguggcugaggugcuggugcuggucaccaucaucuucaucuacgagaagcgccggaag

SEQ ID NO: 6925 - RNA, 130 nt, Human
cuucucacuuucccuucacacacagucguguaguuuugcgcuugcuugauuaaucucuuggccucagucgguuuucuaccauauggaguugguucauucucucgaauggcuguguaguccaguguguggg

SEQ ID NO: 6926 - RNA, 62 nt, Human
cuucucuuaaucugccuuuggucuguugauuuucagugaacaaucagagaguaaaggggaag

SEQ ID NO: 6927 - RNA, 110 nt, Human
cuucugccagccccuggccuuuacuuucuuccuugccuaugcagggcaaacaaaaugugaaauucugcccucagcugagcugaguaagggcuccuggggguuggcuggag

SEQ ID NO: 6928 - RNA, 63 nt, Human
cuucuggccuuaugucucaggaaugcaguuuauuuugauuggcaucuucuaccaggccugaag

SEQ ID NO: 6929 - RNA, 81 nt, Human
cuucugggaccugccagcaccgugguuugugguuagcuccuucuugccaagccaaccaugagcucccagauucgucagaag

SEQ ID NO: 6930 - RNA, 76 nt, Human
cuucuguccaccuguccugcagaggagucguuuccagcccggcugccccaggaugggugaguucaacgagaagaag

SEQ ID NO: 6931 - RNA, 103 nt, Human
cuucuuaaacuccguggcuugugcuuucauuuuguuucagaccacguagggggcugacugaaagggaugaaacaauucagguuuucuagggagauugagcaag

SEQ ID NO: 6932 - RNA, 80 nt, Human
cuucuucagugagacgggcgcuggcaagcacgugccccgggcuguguuuguagacuuggaacccacagucauugaugaag

SEQ ID NO: 6933 - RNA, 76 nt, Human
cuugaaugauaagcuugccuugcucuuuggaaaaugaugauuguuauuacagaagugaaacaaacuucuauucagg

SEQ ID NO: 6934 - RNA, 82 nt, Human
cuugaccagccggaaagcauuggggaugacggccgacagcagggugguguggaugucacccaggacuuuccggaaggcaaag

SEQ ID NO: 6935 - RNA, 71 nt, Human
cuugaccaggcucggaggucgccccgaucgaaacagugaccgggacauggggugccccguuuaaggucagg

SEQ ID NO: 6936 - RNA, 97 nt, Human
cuugagacuuguguagacucugaugcucguaggugacacauaguaaccuuccuggugcucuggcaaccucgcagugucaugguggcaucuuuccaag

SEQ ID NO: 6937 - RNA, 76 nt, Human
cuugaggcuuuaaacaaucacuguauggauaguaaaaauucuacuguauggaauacaaguguaauuugaauccaag

SEQ ID NO: 6938 - RNA, 77 nt, Human
cuugaguuggggacaugagugagaacuggggguuuugaggaguaacccuugugaacacauguacuccagcagccagg

SEQ ID NO: 6939 - RNA, 75 nt, Human
cuugauacuucucucguuguugaacagagaaaaaauauaccagccuccucuggaagcagcgagggaaaauuuaag

SEQ ID NO: 6940 - RNA, 67 nt, Human
cuugauaggugucagucuuguaaucaguauauaaaagaagaaucccaugaugauaaagccuaugaag

SEQ ID NO: 6941 - RNA, 74 nt, Human
cuugaucugucacccaggcugcaguguaguggcaugaucucggcucacugcaacccccgccuccuggguucaag

SEQ ID NO: 6942 - RNA, 100 nt, Human
cuugauuuccagguacagcaggccucuguaacuuuucuuggcagugaagucaugaagucuccuguccucuaaagcuacagaaauuuaaccuggaagcaag

SEQ ID NO: 6943 - RNA, 71 nt, Human
cuugcugugaggagagccaagcugagggcauguacaggccaugugcaugcuguuccuguggcauaagcaag

SEQ ID NO: 6944 - RNA, 107 nt, Human
cuuggacagacccuucgauucuaauuacuuuaggaaaacuccucggcuaaugaaacuuggagaggguaaauucagaguaggagcuggagaagaagggauuguuuagg

SEQ ID NO: 6945 - RNA, 101 nt, Human
cuuggacaggugcuagacgacuuuccgccaaacacuccaccucagcaaagcggguguugagggccauggaagggugagaagggucuucugacauguucaag

SEQ ID NO: 6946 - RNA, 100 nt, Human
cuuggcccacauccaggcuacccccagcccgcuucuccccugcuuagcccagggaggagacaguaaaggugaugggggcagccgggagggaggggccaag

SEQ ID NO: 6947 - RNA, 60 nt, Human
cuuggccucgagcaagccuggccuauccccuguagggggugggugaggggcgaggcugag

SEQ ID NO: 6948 - RNA, 121 nt, Human
cuuggguaagaaaagagaguuggagaaucccuuaaagggcccagaauauucacuaguugaucauucagcagguauuuauugagccccuguuaucuuucaggcacucuucuacuuaccaggg

SEQ ID NO: 6949 - RNA, 99 nt, Human
cuugggucccuggguuacauggagagauucgugguguagcucaaucuaugugucauagcuaucccacaaucucuucuucaacuucuccaacacaccaag

SEQ ID NO: 6950 - RNA, 60 nt, Human
cuuggugacaaauauguuguguaaaguucaggggagaguccgccacauguuguucccagg

SEQ ID NO: 6951 - RNA, 112 nt, Human
cuugguggggcugguuagcgagucauuguauguagagguggaguaaaggcagcacaggugcagucgugaacaugcuuccgcauagaagguggcaaauaagcuccucccugag

SEQ ID NO: 6952 - RNA, 62 nt, Human
cuugguugugcaucuucccagucuauuucugcuucuagaaauacccuguguacaacagcaag

SEQ ID NO: 6953 - RNA, 67 nt, Human
cuuguccuucuucguguaggagcagagagccccauccagacgggcuugcccuucauagaaguccaag

SEQ ID NO: 6954 - RNA, 72 nt, Human
cuuguggaccacgcccgccgggcccaaggauccgccgccggggcgcggaccgggggcugggcuggccgcagg

SEQ ID NO: 6955 - RNA, 107 nt, Human
cuuguuucggacuauagagugcugauggcagagauuggugaggauuggauaaaucugauguguccucauuaauuuuccucaugaaggauuacaugggccgaggcaag

SEQ ID NO: 6956 - RNA, 103 nt, Human
cuuuaaggaggcgaggaagugccggcaagucugaucuuuaaaauggugacuaaauaguaguguggcuauagaauuuauugucuaaacccgagcaacuuugagg

SEQ ID NO: 6957 - RNA, 93 nt, Human
cuuuacugaagcucacuggguguccaucaaucacaaaguggcguaugcagccugugaaggguuugcugggggccaagcguggugucaguagag

SEQ ID NO: 6958 - RNA, 90 nt, Human
cuuuaggaggcugaggugggaggacugcuuaaggcaaggagucugagaccagccugggcaauacagcaagaucccaucucuauuucaaag

SEQ ID NO: 6959 - RNA, 75 nt, Human
cuuuauuaaagugaaacuacuacuucaauauaugcagaaaacaacauauuggauauuuucaccucugggauaaag

SEQ ID NO: 6960 - RNA, 92 nt, Human
cuuucacuacaucagagaaccaucagaaguacaggcaauggucuguaagaacaauuucaaauauuucuucuagcagauggcugaaggagaag

SEQ ID NO: 6961 - RNA, 110 nt, Human
cuuuccuaguaaagcuguuguauuuccuauaugucuguacucuuccugugaaauuuccauccuuuuugugugucaggaaaguagguacugccauuguuuugaguggaagg

SEQ ID NO: 6962 - RNA, 72 nt, Human
cuuuccugggguucuuaggagugaggagaaguaugugggacaucucuucuuuuccuguucccucuaggaagg

SEQ ID NO: 6963 - RNA, 64 nt, Human
cuuucugaccacuuguggugucauuggacugauuugccagaugacaucaaugugggaauuugag

SEQ ID NO: 6964 - RNA, 70 nt, Human
cuuugaagcagguaucuugcauggcccaccggggucgaagucccugccaugcuaccucugaaagucaaag

SEQ ID NO: 6965 - RNA, 106 nt, Human
cuuugagaugacugguauugaauggagcagucuuugaaaggcaccaacccuuccuaacugaugguggucucuugaaagaggcucuuccaaauuugucuucugaaag

SEQ ID NO: 6966 - RNA, 102 nt, Human
cuuugcauuacaacugccuacacuauucaguagaguaacgugcuauacaggcuugaagccucagagcaacaggcuauaccagacaguguaggugugcaguag

SEQ ID NO: 6967 - RNA, 82 nt, Human
cuuuggaaaaacaguuagucuggagccuguggcccaggcccuucuguccccaggcaucaucccaacagcucauuuucccuag

SEQ ID NO: 6968 - RNA, 78 nt, Human
cuuuggucuugggggugcagggcuuggugacgcggauggucuccuggcacugagcauuguagcgcgccuucuccaggg

SEQ ID NO: 6969 - RNA, 79 nt, Human
cuuugguuauaaauuaugaucuaccuaccaaucgugcuauauucacagaauuggcuagggggucgauuugggaggaaag

SEQ ID NO: 6970 - RNA, 90 nt, Human
cuuugugagcuuggcgagugcuggggcuagucaguaacuugaaguccaagaucccuaauucagcucugugcucucacagccuuaccaaag

SEQ ID NO: 6971 - RNA, 95 nt, Human
cuuuguuauaauugauaggauacaucuuggacauggaauuguuaaagccaccucugagcaguguaugucaggacuuguucauuagguuggcagag

SEQ ID NO: 6972 - RNA, 80 nt, Human
cuuuuaacucuggaguagaugucuugcuaacccccaccaccuugagugaggcaguaccauacuuggaguucaucaaagag

SEQ ID NO: 6973 - RNA, 99 nt, Human
cuuuuccacuggaggcuucaaggagcacguggacagucugaaagccccaauauggaugcuggaggcuucagaccccuugaggcauagaugguguugaag

SEQ ID NO: 6974 - RNA, 77 nt, Human
cuuuucuccccuuuacccugaggaaucuauuuugguuaacaggucaaaauuuuuuuccagguaguaggggaggaagg

SEQ ID NO: 6975 - RNA, 131 nt, Human
cuuuugagcugcuucuuauaaugugucucuuguguuaaggugcaucuagugcaguuagugaagcagcuuagaaucuacugcccuaaaugccccuucuggcacaggcugccuaauauacagcauuuuaaaag

SEQ ID NO: 6976 - RNA, 94 nt, Human
cuuuuggagacaaucugacagguuaaaacaggaacuguuggaauuauucuagcuguaacuacuauuggcuauguguugauuggauccuagaaag

SEQ ID NO: 6977 - RNA, 70 nt, Human
cuuuuggcagagcucccacuauuugcaauggauuuuggauaaacaagaucuguugaaggagcgccaaaag

SEQ ID NO: 6978 - RNA, 62 nt, Human
cuuuugugaguguauauaaugguuuuguuaggauggcaaaaccagguauccaaaggcgaaag

SEQ ID NO: 6979 - RNA, 100 nt, Human
cuuuuucucugcccuucgucauuaugcagccugugaacagcgucugggaaagugguggucauugguugcauaauuugaucugaggcuuauggaggaaagg

SEQ ID NO: 6980 - RNA, 72 nt, Human
cuuuuuucuguucucguccggggaucccgagcuguccugcagcuguacccugagaacucagagcaguuggag

SEQ ID NO: 6981 - RNA, 84 nt, Human
gaaaaaugaguaaaauaauuaaugaaacauauuuagagcacuuaauggucucuguuuucaauauaauucuugauuucauuuuuc

SEQ ID NO: 6982 - RNA, 103 nt, Human
gaaacagacugggccaauguccacaaagaauuccuggucagcaccacccgauguccaaaggugcaauaucaaggaagggcaggcgugauggcuuauuuguuuu

SEQ ID NO: 6983 - RNA, 102 nt, Human
gaaacagacugggccaauguccacaaagaauuccuggucagcaccaccgauguccaaaggugcaauaucaaggaagggcaggcgugauggcuuauuuguuuu

SEQ ID NO: 6984 - RNA, 72 nt, Human
gaaaccuaggaagaacaacacaguugagacaauguagcagcagcagugggugcuguguccuccacuggauuc

SEQ ID NO: 6985 - RNA, 89 nt, Human
gaaacucuaauauugaaucucuuaaauuuaguguauguaaacagcuuacaaauacguauuggcuaaauggauuuaauuuugguuuauuc

SEQ ID NO: 6986 - RNA, 75 nt, Human
gaaagcuaguaacagguacauagguaaccaaaguauauagcuuauuuggugaaucuucguccucauuacguuuuc

SEQ ID NO: 6987 - RNA, 80 nt, Human
gaaaugcaaugguaaagaacaaggcagcauguagugcuugcacuuacaaauacuaccaguuuuguaacaauuugcauuuu

SEQ ID NO: 6988 - RNA, 73 nt, Human
gaaaugcuacgagguguucagcuugucacaguccagucaaaggcccaacugcgauuguccaccuugugucuuc

SEQ ID NO: 6989 - RNA, 64 nt, Human
gaaauuccaucgaucugucaugggccccaaagguuccagaauccagcagauuacucgggauuuc

SEQ ID NO: 6990 - RNA, 74 nt, Human
gaacaacacaucaaagaugcauuuguauguucauauaacacuaauaggacaauacaaaguaucuucacggucuc

SEQ ID NO: 6991 - RNA, 96 nt, Human
gaacacaaagagguguagaaucuggguugguccuucaaggcagcucauugcagcuacuggccuccagugaaacaggucucuuugagcuauuuguuc

SEQ ID NO: 6992 - RNA, 82 nt, Human
gaacagaaucuuguggaagaagaaugaaguugcugauuaugaagcuacaacauuuuccaucuucuauaacaacacucuguuc

SEQ ID NO: 6993 - RNA, 84 nt, Human
gaacauugcagagguacugagccauaacagagaggcgacuacgcuguugcuuccuguauuggcugcaagucucucugccacuuc

SEQ ID NO: 6994 - RNA, 72 nt, Human
gaaccaggccccagacaugcugcauagauuuuauggaaagaacucuucuuauguccaugggggauuggauuc

SEQ ID NO: 6995 - RNA, 68 nt, Human
gaaccagucagguuuacuuacgcuggauguuugagugugaagaaauaccggcccaaguacugcgguuc

SEQ ID NO: 6996 - RNA, 76 nt, Human
ugcuacgaggaggucaaggaccgcugcacccuggcagagaagcuggggggcagugccgucaucucccuggagggca

SEQ ID NO: 6997 - RNA, 62 nt, Human
ugcuacuauuuuauugcccgagguggggguguaugcaccgcacaccggggcuaugagaagca

SEQ ID NO: 6998 - RNA, 75 nt, Human
ugcuaugaacacuaugggaucaggcugcccaagaaggggaagccugagccaaaccaugaguggacauuauuggca

SEQ ID NO: 6999 - RNA, 65 nt, Human
ugcucagacugggugugcuggggcucaugguggacugaucaugcugcccugggacccagcuggua

SEQ ID NO: 7000 - RNA, 88 nt, Human
ugcucccagcccugaccguucugcauaugaacaugggccuugguuuccccaucuguaugaagaagggaguagggcugggugauucgca

SEQ ID NO: 7001 - RNA, 64 nt, Human
ugcucccuggacgguggcucuagacuuuugagaagcucaaaacuuuuagcgccagucuugagca

SEQ ID NO: 7002 - RNA, 83 nt, Human
ugcuccgccuuuucuggguacuuacgguccugagucucaaguucgucuucgagaugcuguuugugccagaagcuggcggagca

SEQ ID NO: 7003 - RNA, 61 nt, Human
ugcuccuucaucagcuuugccaacucucggagcucggaggacacgaagcaaaugaugagua

SEQ ID NO: 7004 - RNA, 80 nt, Human
ugcucugcuuuuaaauuucugaacuucuucaauacaaauuaaaauaguacuggagucuuuugggaggccaauagcuagca

SEQ ID NO: 7005 - RNA, 71 nt, Human
ugcucuggugugugaaggucgguggguuaacugugugccuacugaaccuggcaaauaaacaucacccugca

SEQ ID NO: 7006 - RNA, 74 nt, Human
ugcucugucacccaggcuggagugcaguggcgugaucucagcucacugcaaccuccaccuccuggguccaagca

SEQ ID NO: 7007 - RNA, 73 nt, Human
ugcugaacaggaaaggcaccaaagaaagacacuggcaaugaaagugcuauugggaaaauacuguguucaagca

SEQ ID NO: 7008 - RNA, 75 nt, Human
ugcugagcucggcuuauauuucggaccacaugaaggugcacagccaggguccucaccaugucugugagcucugca

SEQ ID NO: 7009 - RNA, 74 nt, Human
ugcugagcucggcuuauauuucggaccacaugaaggugcacagccagguccucaccaugucugugagcucugca

SEQ ID NO: 7010 - RNA, 71 nt, Human
ugcugagcuggggugggcuccacucaguucaagcuuaccagcugcuuuguuuaccuacucaagccucagca

SEQ ID NO: 7011 - RNA, 67 nt, Human
ugcugaggacucccaagcguacugcucaucaucguuauguuuggugaucacaguuacuuucucagca

SEQ ID NO: 7012 - RNA, 76 nt, Human
ugcugagguucuggaguggcacaggaacaggaggagcaaaugacacugggucuuugugcugaggcaggacacagcg

SEQ ID NO: 7013 - RNA, 71 nt, Human
ugcugcugacaaaccaagaggauuugccagaggucuugauccugaaagaauaauuggugccacagacagca

SEQ ID NO: 7014 - RNA, 80 nt, Human
ugcugggggcccgaguggugcugguggaaaagcgcacaaguucucucgccacaacgugcuccaccucuggcccuucagca

SEQ ID NO: 7015 - RNA, 131 nt, Human
ugcuuauuuguuuuacaaccuguaucaucaaacucucucucuaaacuuuaaaaugcuguauaaauaugauacuuuugaggagagagugugcucagaacuuagacgggauuugguaggccaaguaugcuaag

SEQ ID NO: 7016 - RNA, 97 nt, Human
ugcuuccuuaccuacaagaaaauuuagaaguuggugcaaauggcauuuccaugaguacuucucaugcaucuuugcauauuucaccuggggggaagca

SEQ ID NO: 7017 - RNA, 88 nt, Human
ugcuucgggcugcuacaucaacucucucagugugugacuuccuuggagagaagauugcaucuguuuuggguaucagcaccccaaagua

SEQ ID NO: 7018 - RNA, 89 nt, Human
ugcuucucauguagggcgccgacagcauauucugaaucagcuggggguuuucaguuaucuguugcagcaggcucugcaugccuggggua

SEQ ID NO: 7019 - RNA, 92 nt, Human
ugcuuggaggaaaggccuggggcuccucuacuggaucuacacucuguccccaggguuuuuagaucccacugagccccgccugacuugaaaca

SEQ ID NO: 7020 - RNA, 68 nt, Human
ugcuuuacugcugugguccauguagugacaacuaaguuacuuugaaaggcucuacaaaguuccaagca

SEQ ID NO: 7021 - RNA, 66 nt, Human
ugcuuucuuuaggaucccaaacaucgcugccgccuccgcagcgccgucggaucccuggggagagca

SEQ ID NO: 7022 - RNA, 93 nt, Human
uggaaaagauuauguaacuccuugagagcauacucuuucucuagcccaaaggcagugagagaguuuucuuguucaggauugcuuaacuuucca

SEQ ID NO: 7023 - RNA, 99 nt, Human
uggaaaagguguucaucuguacuauguugguggagagguguaugcggaaugccucagugacagcagcauauuuguacagaguaggaacugcaacuuuca

SEQ ID NO: 7024 - RNA, 75 nt, Human
uggaaagcggaguuccuaacaggauaaaaguucccccaucaguucccccaguaccuccaagcaaguagcuuucca

SEQ ID NO: 7025 - RNA, 74 nt, Human
uggaauaaagucacaugaaaacaaaacacaacuauauauauuuucaguuuguuugccuuauugauguuuuucca

SEQ ID NO: 7026 - RNA, 94 nt, Human
uggacagcauugagagcuuucgugagucugacauuaacagauggccuauuggugauacugugucuccagggcuauacgggcucugaaauugcca

SEQ ID NO: 7027 - RNA, 81 nt, Human
uggacuaagaacgauggcugguuucaugcaaaaaggaaacauaaucuuguuuaugauacuggcuuuuguaauccuggucca

SEQ ID NO: 7028 - RNA, 101 nt, Human
uggacuaggacccuggaggcagaaauaguuaccgaggggaaguuacaggccugagugugagucccuguuugguugcugaugagcuuugagguccuuggcca

SEQ ID NO: 7029 - RNA, 74 nt, Human
uggacuucauuuucuuucacgcugcugcuugcccaguggguguagacagcaagaaaaugaagaaaaucagucca

SEQ ID NO: 7030 - RNA, 102 nt, Human
uggacuuggcccacauccaggcuacccccagcccgcuucuucccugcuuagcccagggaggaaacauuaaaggugaugggggcagccgggagggagggucca

SEQ ID NO: 7031 - RNA, 85 nt, Human
uggagaaggacuucauuggcuuucugcucuucaacgccacacaacguguccuuggagaagacagcacaauggggcucuaucuuca

SEQ ID NO: 7032 - RNA, 68 nt, Human
uggagagcuggcggggcgaagaguagggucuaugucugccaacucuaacagccugcccgugcuuucca

SEQ ID NO: 7033 - RNA, 74 nt, Human
uggagcucagcccagguuccagcucaauugaagaaucuccuccuuccacuggaaaccuccuuggcuggguucca

SEQ ID NO: 7034 - RNA, 96 nt, Human
uggaggaaugggagcuaugggcaaauacugggagcuggcuggaugccaggauacagcagccaucugccaucauuacccuagcuucaggauccucua

SEQ ID NO: 7035 - RNA, 105 nt, Human
uggaggcugacaucuccauguauggcaaagaggagcuccuacaagguuguggaaagccaugaagaaaccuccuuuuugaaaggaccaacaggaaaaagcuuacca

SEQ ID NO: 7036 - RNA, 69 nt, Human
uggagguagagcucaucaccagguuccucccgaugcucauguccuuccugguggaugacuacacuuuca

SEQ ID NO: 7037 - RNA, 69 nt, Human
uggaguaccuucuacugccucagugggcaaauccaaaaccccauuaguggcaaggaagaaaguguuccg

SEQ ID NO: 7038 - RNA, 112 nt, Human
uggagucucguucugucaccaaggcuggagcacaacaucagcucacugcaaccucugccucccagguucaagugauucuccugcuucagccucccaaguagcugggacuaca

SEQ ID NO: 7039 - RNA, 62 nt, Human
uggauaauugggugccauuaacacaaacaggucacaauccugcuguuuucuagcccugucca

SEQ ID NO: 7040 - RNA, 71 nt, Human
uggaugcagcuaugaaugcaaggccacacaagguggauggaagaguguggaaccaaagagagcugucucca

SEQ ID NO: 7041 - RNA, 78 nt, Human
uggaugguuuuagccauagauuacacugcagaagaaaauauuaacugaccucggcggcauagcaauggcaacuaucca

SEQ ID NO: 7042 - RNA, 79 nt, Human
uggauucuggauauauuauaaugagugacacuuugacagcggaugucauuggucgaagaguugaaguuaauggagaaca

SEQ ID NO: 7043 - RNA, 98 nt, Human
uggauuuuuacaucuuaccaaauauggagagcuuuggccauuauuucuuuggcuauucuuuugccucuuuuucucucuccuauuuuucuguaauucca

SEQ ID NO: 7044 - RNA, 78 nt, Human
uggauuuuuauggacucuuuauuaggguauuaagauauugaaaauaauacacguaaaccacaaaagaguagcauucca

SEQ ID NO: 7045 - RNA, 88 nt, Human
uggcaaguuacaccuaaccccuggcuccauggagguuacagugcacacagcaacuaccuccuaguggggguuuaguacauauuuguua

SEQ ID NO: 7046 - RNA, 84 nt, Human
uggcacagauccucgaacaauucuuaaagauuuauugccggaaacaauaccuccaccugaguuggaugauaugacacuguggca

SEQ ID NO: 7047 - RNA, 74 nt, Human
uggcaggacccgcuggugcuggacggagcagcugaccacagacugagauccucaucacgggacaccuuccgcca

SEQ ID NO: 7048 - RNA, 78 nt, Human
uggcaucacagucacauuugaagcgguucccucaggaaaaggacuggguugaacaguuugaauuggcugugguaucca

SEQ ID NO: 7049 - RNA, 85 nt, Human
uggcaucccagauguugcaguugaagucgucguagccagcgagcagcagccguccgcugcgcgagaaggcaacagagggaugcca

SEQ ID NO: 7050 - RNA, 63 nt, Human
uggcauuuuuauggucaucucuggagucccuuugauucaagaaauuauaccucuaggaugcca

SEQ ID NO: 7051 - RNA, 70 nt, Human
uggccagcaguuuuuaggucugucaguacugcacugcaagaauggcagauuuugggaucucugcuggcca

SEQ ID NO: 7052 - RNA, 69 nt, Human
uggccaggugguggcuccugcagccuggagcugaugugcaguggccucugugagccccagccugagcca

SEQ ID NO: 7053 - RNA, 63 nt, Human
uggccauuuguaucacucauucugccuacaaaacaaagaaugcacuguggaauuugagggcca

SEQ ID NO: 7054 - RNA, 101 nt, Human
uggcccucccugccugcuuauguauggacagaguauguugucucagcuuccuccgagagagacuggugguuuagcuucugucuacacaggcagaagggcua

SEQ ID NO: 7055 - RNA, 95 nt, Human
uggccgggcgcgguggcucaagccuguaaucccagcacuuugggaggccgagguggguggaucacaagguccggagauugagaccauccuggcua

SEQ ID NO: 7056 - RNA, 69 nt, Human
uggccucccacccagcucagagaccuggugaggaccacccauaagggcugugcagaggguuagaggcca

SEQ ID NO: 7057 - RNA, 73 nt, Human
uggccucucugugcuuccauuuccccaucuguaagauaggaauaacacaucucacaggagcauggagaggcua

SEQ ID NO: 7058 - RNA, 95 nt, Human
uggccucugggacucagauuccuccucuuuaaaauggugcuaauaauagcacccacccucugugaggaggaugcugugaggacaaaaugagauca

SEQ ID NO: 7059 - RNA, 74 nt, Human
uggccuugagccacugcuucuccgucagugagucgcuguaguccaccuccuugcgguggcgggagccacggccg

SEQ ID NO: 7060 - RNA, 71 nt, Human
uggccuuuaacugaccuaaagaggugugugugauuuaauuuuuucccguuccuuuuucuucaguaaaccca

SEQ ID NO: 7061 - RNA, 75 nt, Human
uggcuaaauucgugauccgcccagccaugccgccgacugcagugacauacugcggcugaucaaaggagcuggcua

SEQ ID NO: 7062 - RNA, 95 nt, Human
uggcuacacuaaaaaaugaccugggaagccaaaggucagcucaaaagagaauuugauuaauuccugguuuuccagacgauuguuugguggacaca

SEQ ID NO: 7063 - RNA, 73 nt, Human
uggcugacuggggcuggggugagagaggaaagaccuacauuuccucuccugccagaugcccuuuggaaagcca

SEQ ID NO: 7064 - RNA, 69 nt, Human
uggcugaugggcaagggggcaaaguccggacaucuuuggugcaaagacucccccugacccaccaggcca

SEQ ID NO: 7065 - RNA, 99 nt, Human
uggcugcaugauaguaagaguauggcugagccugucuugcagaucauccaguaccuguacaggccaggcuacacuguucuccagcacucucuguagcca

SEQ ID NO: 7066 - RNA, 75 nt, Human
uggcugguccuacuucucugccccaccaaugggggacuugaauguggcagagaauacagucagucagggcagcca

SEQ ID NO: 7067 - RNA, 73 nt, Human
uggcugucuucccccucaguguuuaggaacgucuccaagacgucugaagacaaccuugaggagggagcaguua

SEQ ID NO: 7068 - RNA, 66 nt, Human
uggcuguggugucuggguguggccuggggcucccucugcaggggccccccucggcagccacagcca

SEQ ID NO: 7069 - RNA, 83 nt, Human
uggcuuuaucucuugccuugaccuccuacauuaucaacaaagugagaguuuaagaucuccugggcaggagauuucagaagcca

SEQ ID NO: 7070 - RNA, 77 nt, Human
ugggaaaucugcuuccuagggcuguuagaaggaaauuggucuccuuaaauuacgucagcaucugaggcaguuuccua

SEQ ID NO: 7071 - RNA, 92 nt, Human
ugggaaggcuuucgcagacaugaugggcaagguggacgucugaaaguggugcaaccuguccgaguucaucguguacuaugagaguuucacca

SEQ ID NO: 7072 - RNA, 81 nt, Human
ugggaaggugacauuuggcuuccugauuacgggagggaguugguuaucucagguggagcaggaaagccugguugauucuca

SEQ ID NO: 7073 - RNA, 87 nt, Human
ugggaauacacccugcuuuuaaaggcucccagagccugaggaagaaagugaccaggcuuaggggagccggagcggcagggauuuccg

SEQ ID NO: 7074 - RNA, 73 nt, Human
ugggaauguguggggggcuuccaugggcacaugauccucaagggcauucuagcccauuaggcucccaguccca

SEQ ID NO: 7075 - RNA, 99 nt, Human
ugggaauguuuacugaauuagcuauucuauacucuaaauuuaagccucagaaaaugagggagcaccuggagcuguucuggucuagagugaauauuccca

SEQ ID NO: 7076 - RNA, 88 nt, Human
ugggacugcugagauguccucuauucuugaagagcguauucuuggagcugauaccucuguugaucuugaagaaacugggcgugucuua

SEQ ID NO: 7077 - RNA, 82 nt, Human
ugggagggcaagagaggaagagauggcagcuuuuuaagugaaauuuuaaucuuaucuaucuuuuguucauuuugagucccca

SEQ ID NO: 7078 - RNA, 80 nt, Human
ugggauggcaaaguuuguuggcucagacuguugcuaacaggaacucugaagcccgggcuuucaagccagaaacaaucuca

SEQ ID NO: 7079 - RNA, 107 nt, Human
ugggauuacagacaugagccacugugcccagccagggcuguguguuauguagugacagcucacugauacagcucucucuggggacuuaggaaccaaguuugacccca

SEQ ID NO: 7080 - RNA, 104 nt, Human
ugggcaaaaagugagaaaguaagacugugggaggugacuguuacagaucggaaaacucugauugaaccauucacuuuauuagccaguaaacuuucucaacccca

SEQ ID NO: 7081 - RNA, 105 nt, Human
ugggcaaggauuggcaccggcccugccugcgcugcgagcgcugcgggaagacacugacccccggcgggcacgcggagcacgacggccaugcccuuacuugccaca

SEQ ID NO: 7082 - RNA, 77 nt, Human
ugggcaucaucuccuccagggacauugauuuucucaaagaggaggaacaugacuguuucuuggaagagauaaugaca

SEQ ID NO: 7083 - RNA, 73 nt, Human
ugggcccacugugagagcccccccuuugggagagaaaagucucagagagggggaaguguggacaagaggccca

SEQ ID NO: 7084 - RNA, 75 nt, Human
ugggccuguuguggaguacgcuuuggacugagaagcaucgaggcuauaggacgcagcuguugccaugacggccca

SEQ ID NO: 7085 - RNA, 82 nt, Human
ugggcgccuguaaucucagcuacuugggaggcugagacagagaauugcuugaacccaggaggcggagguugcagugagccua

SEQ ID NO: 7086 - RNA, 113 nt, Human
ugggcugagggaaagcauguccacaccaggugcccagacaucugguuggcuuuggcugauuuguccugcaggcaccugccuugucuggauuugcacacuuuccaaguugccca

SEQ ID NO: 7087 - RNA, 78 nt, Human
ugggcuuaacucagggagacuuuguacauuucaggcaauuacgcuuuuggacgcaagguuuuaucucaggcaagcgca

SEQ ID NO: 7088 - RNA, 82 nt, Human
uggggaaaaggucagaaagaccuccugacuccauguuacaguagacaaaacaaguuggacucuuuuggaccuauaaacccua

SEQ ID NO: 7089 - RNA, 61 nt, Human
uggggcacugaggcccgggauguaggcacuggacagcagcaacccaggcaucugugcccca

SEQ ID NO: 7090 - RNA, 61 nt, Human
uggggcacugaggcccgggauguaugcacuggacagcagcaacccaggcauuugugcccca

SEQ ID NO: 7091 - RNA, 65 nt, Human
uggggccaauuuuguaacucagaucuugcugagaccaggagcaucugauuuaacaggaaguuuca

SEQ ID NO: 7092 - RNA, 80 nt, Human
uggggccuuccgguucacagcgaauuacugguuaaccaauugacaaaaaguagaaugcuguaaaaacuguuaggugccca

SEQ ID NO: 7093 - RNA, 77 nt, Human
uggggcuugcacugccuucucaggccagcuauacccuagcugagcaaagaacugaagaagcaaguguccacucccca

SEQ ID NO: 7094 - RNA, 77 nt, Human
ugggggagcgagggaaggaguuaaugaaacuguauugcacaaugcucugaucaauccuucuuuuucucuuuugccca

SEQ ID NO: 7095 - RNA, 77 nt, Human
ugggggagcgggggaaggaguuaaugaaacuguauugcacaaugcucugaucaauccuucuuuuucucuuuugccca

SEQ ID NO: 7096 - RNA, 73 nt, Human
ugggggcuguggcagggccgccugccugggguucccuuacucaucugguaguucaugcaggccacggcccuca

SEQ ID NO: 7097 - RNA, 97 nt, Human
uggggggaugaccaguacagacaugccaguuaaguuuauacuagugggaucccaaauccaaagcaguguacguggugauauggucagugacuaacca

SEQ ID NO: 7098 - RNA, 65 nt, Human
uggggguccugccccuggagggccuuauggaccaccagcugguggagggcccuauggacacccca

SEQ ID NO: 7099 - RNA, 63 nt, Human
uggggguccugccccuggagggccuuggaccaccagcugguggagggcccuauggacacccca

SEQ ID NO: 7100 - RNA, 75 nt, Human
ugggguauuaccagguuaagaggcugcccgucccccuggaugcucagcaggcugaacccagaaggguaagcccca

SEQ ID NO: 7101 - RNA, 76 nt, Human
uggggugacgccgccuagccucagucacucugggaaccgccagcgcccucccaguggagcaggcucagucacucca

SEQ ID NO: 7102 - RNA, 67 nt, Human
ugggguuccacuuucuggugugguuccuuugugucaaaggaaucagggacacacaguguggguucca

SEQ ID NO: 7103 - RNA, 73 nt, Human
uggguagcagggugaucuaacauuauacauccuggaaguuguuugaugcaagaaaggccucucuugcugucca

SEQ ID NO: 7104 - RNA, 93 nt, Human
ugggucaucuugcuucucaaauuaccuguugccacuuggaauauauaucgauacauuauggugcccgacgggaacaugggaguguuugaucca

SEQ ID NO: 7105 - RNA, 86 nt, Human
uggguccaggaucuuggaaugguaucccaugguucaaucuucuggauucaaccacauaaauuuaccccacccaugucguggaccca

SEQ ID NO: 7106 - RNA, 106 nt, Human
ugggucccagauucuuccugguggaggcauucggagagcaacacccuggccuuaacacacuacauaucuuugaauuucacacgggggcagccuucugggaaaacca

SEQ ID NO: 7107 - RNA, 87 nt, Human
ugggucccggugaugggaaggguaucagguugccggggaguuuccacucuucucuggugauuguuccuucccucccuuccucuccca

SEQ ID NO: 7108 - RNA, 105 nt, Human
ugggugaggaacagguagagaaguguaagugagacaaacuucccugccauuugccaaaguggcagcacauaauguaucaugagugccucuacccucugauaucca

SEQ ID NO: 7109 - RNA, 94 nt, Human
uggguucuguggccacugcuggaccaaggacguggaugagccuccccuagucacucauccaucccacuggcuccagagauggucacaugaccca

SEQ ID NO: 7110 - RNA, 70 nt, Human
uggguugcgcgcgcgucgacgacagcaagcgccccggggcguguagaaacaacgcgcagcacgcauccca

SEQ ID NO: 7111 - RNA, 81 nt, Human
uggguuuugaauuugcaguaacaggugugagcauucuagcagcaguuugaugaucauguaugauacugcaaacaggaccua

SEQ ID NO: 7112 - RNA, 109 nt, Human
ugguaccuuauuauugaaaaucagauaaacuuugguuggguggguauuuggaggaaucuuuuaagucuuuucuuaagcaaaguuuggacauucuaaaauaagguugcca

SEQ ID NO: 7113 - RNA, 80 nt, Human
ugguauuugugcgcaaucugcugcuagcccccugccucuuucugguacugggauuuuuguauuauucugcguggaagcua

SEQ ID NO: 7114 - RNA, 78 nt, Human
ugguccaauaagcagccuaagcuuucauucucaucccaagaagggacaggagucuuggcccagaggcuguggggacca

SEQ ID NO: 7115 - RNA, 107 nt, Human
ugguccaugagaauugacgauaaauaggaauugccuuggcaaaaugucagucugagaaguuucucucugacauccugggcauccuucuuuuuguccuucccauccca

SEQ ID NO: 7116 - RNA, 78 nt, Human
uggugaauuaucauuuauuuuguacuguguuaggcagcucuguaguugcuacauuuaaccaaauaagucaauuugcua

SEQ ID NO: 7117 - RNA, 97 nt, Human
uggugacugauuccaaaucuaccagcuaacacauccaccaccacugcgggcaggcaagugacuagaaggcaaguuguggacuuggccucagggacca

SEQ ID NO: 7118 - RNA, 76 nt, Human
uggugaggagacaccgggcuguuuauacugauuguucuauaacaggugaagaaacaaccuugguguguucucacua

SEQ ID NO: 7119 - RNA, 73 nt, Human
uggugcagcagaccuguaaaugucuucaaauucauuauuccucagaucgucaaguacaguccugauugcauca

SEQ ID NO: 7120 - RNA, 103 nt, Human
uggugggacacagagccagugacugacauagaagagcagugggguagaauuacaguuccaucuggugccuuuucucugagcaaagcuguauccaucaccacca

SEQ ID NO: 7121 - RNA, 78 nt, Human
uggugguggcagacuuugggcugucacggcucauaauggaagagaggaaaagggcccccauggagaaggccaccccca

SEQ ID NO: 7122 - RNA, 113 nt, Human
ugguucauaauauuccuugcagauguugaacgaugggcuggauuguuuuggaaccuuguuccagcagagcccauguguucaugaagaaaacauuugcuuacagcuuaugacua

SEQ ID NO: 7123 - RNA, 72 nt, Human
ugguucuggagaugagcauuggggcgccggaagcccagcaacgccuggcccugagugagcaccugguuacca

SEQ ID NO: 7124 - RNA, 61 nt, Human
ugguucuguuuaccuugauuagugaaguaauuugcugcaguguuacagaggagcagaauca

SEQ ID NO: 7125 - RNA, 106 nt, Human
ugguugcaaggcaggaaauauuggugaaaugcuagcaaagucacaauuucuacucugaacaugauuugcaguguucaucaguauuuuucugaacccugcuuuacca

SEQ ID NO: 7126 - RNA, 111 nt, Human
ugguuggcucucucugacuucugcuggccauuuucuucauggcuagaaggcuucagaacaagaggcuggaaaaucagaagagcguggucaucaccucagcaugagccacca

SEQ ID NO: 7127 - RNA, 74 nt, Human
ugguuucauuaaaauguguaagguuggcugggugcaguaacucaugccuguaaucccagcauuuuaggagacca

SEQ ID NO: 7128 - RNA, 78 nt, Human
uguaagucaugacuguuaucacaggggagagagauuaggcucaacucugaauacagugaagacaauuggggauuuaua

SEQ ID NO: 7129 - RNA, 66 nt, Human
uguaaugauuggugccuguuuccucauugacuucauguuuuuugaaagcacuggcagccaggaaca

SEQ ID NO: 7130 - RNA, 69 nt, Human
uguacaauggcgauuauguucuguaccuguaacggcuauuugcaaagcagauacuugagccauugugca

SEQ ID NO: 7131 - RNA, 113 nt, Human
uguacagaguuggaaaguaagaccauggcauauacagaaggaaagagcacaguguuaaggcucaggaaucaguacaagucaucagggucagcauucucccacuuucaagugca

SEQ ID NO: 7132 - RNA, 91 nt, Human
uguacauacuuucgccuaaaacaguucuguauauucuuuuguuaacgggguagcaaaagcauauaaaaagguuuuggggggaugcagugca

SEQ ID NO: 7133 - RNA, 75 nt, Human
uguaguaacgcccuuuucccagugauaugagcacagguuuuuccagcuccaugagcaccuggaaggcguuauuca

SEQ ID NO: 7134 - RNA, 67 nt, Human
uguagucucagcuacucuagaaggcuaaggcaggaggauugcuugagcccaggagguggaggcugca

SEQ ID NO: 7135 - RNA, 73 nt, Human
uguauaugcauuuguuauuuauauugaaaacauuccauuguuccuugcaguauagaaggcaaaugcaauuaua

SEQ ID NO: 7136 - RNA, 75 nt, Human
uguaugcauuuccucugguuuuauuauucaaauuaagaaaauacuuaaaaauuuuuugguaacagcuugcaugca

SEQ ID NO: 7137 - RNA, 101 nt, Human
uguauuauucaacuuuaaucuuuugcgaaauguuguauuuacugcuuaaaaucuagguggguggauauauucauguaugcauauauugauagauuaauaca

SEQ ID NO: 7138 - RNA, 76 nt, Human
ugucacagugggauuugguggaaaacuauuuggcagcagauggaaaaucuacaacauggagugucagacugggaca

SEQ ID NO: 7139 - RNA, 80 nt, Human
ugucaccauccucugcauugacuugggcacugacaugguuccugccaucucccuggcuuaugagcaggcugagagugaca

SEQ ID NO: 7140 - RNA, 93 nt, Human
ugucaccauccuucaagcugagacuccuggugagccuuugccaccaugaaaaccacauagcugaccagggcugugcuugagguacagaggaca

SEQ ID NO: 7141 - RNA, 62 nt, Human
uguccagcaacuucaucacuggggcacaaugagcuguucuucacauuugaguguccuggaca

SEQ ID NO: 7142 - RNA, 81 nt, Human
ugucccagcaagagugccgguuagucaguguuuguugaaaauacaguagaaaagcugauucugguuaucucuuuaaggaca

SEQ ID NO: 7143 - RNA, 74 nt, Human
ugucccauagagcuuuugcauccucuggauguauugcgaaagaaauguccagacuuugagggcuacaggguaca

SEQ ID NO: 7144 - RNA, 71 nt, Human
ugucccuugcaagggugacaggccgcugccggcucugugcugguacggcucaucccuugcacccaggggca

SEQ ID NO: 7145 - RNA, 95 nt, Human
uguccgguucugguggcucaugccuguaaucccagcauuuugggaggccgagaugggcggaucacgaggucaggaaguuaagaccauccugggca

SEQ ID NO: 7146 - RNA, 61 nt, Human
uguccucucuugacuucucagagaacagaagggguuccugagcagguagccuggggggaca

SEQ ID NO: 7147 - RNA, 85 nt, Human
uguccuugauuauuuguuaaaaucugcuagaaaaguaacaggaauguuaucaagccuuucuagacauuuugaacacaaucugaca

SEQ ID NO: 7148 - RNA, 78 nt, Human
ugucgacuccucaugcuggacuugucuuucggguucuuuguagcccaggggagcaucaaaguccacguucaugucaca

SEQ ID NO: 7149 - RNA, 101 nt, Human
ugucgaugucuccucaccugaugaaaaaucaguaauaacuuacgugucaucucucuaugaugcauuuccuaaagucccugaagguggggaaggcauuggug

SEQ ID NO: 7150 - RNA, 98 nt, Human
ugucggcuuugcuggcccagcaagccugauaagcaugaagcucuuaucuuugguggcuguggucggguguuugcuggugcccccagcugaagccaaca

SEQ ID NO: 7151 - RNA, 95 nt, Human
ugucuaccccauguuuggucuuucaagagugcauugcguguggcaugagauguacauagcuucauguuuguuucuaaugaagguggggauggaua

SEQ ID NO: 7152 - RNA, 111 nt, Human
ugucuauagaguaugugggccauuuucugcccguaaaauguucaaauguuuucucucucuaaagcuuuguucauuguaucugguggaauuuugguucucagggaguagaca

SEQ ID NO: 7153 - RNA, 88 nt, Human
ugucugcaagauuccgauuaaugcuauuuuuaugguuccaaauuuaagauagacaauagcugaucauaauagggaacacuuacagaca

SEQ ID NO: 7154 - RNA, 69 nt, Human
ugucuggugauuaguucugugacuguguuuuaccugggccagcaugccauggaaugccaucaccggaua

SEQ ID NO: 7155 - RNA, 64 nt, Human
ugucuguggcaaaaguuuaaucagaggaaauucuuucccagucugucgauuuaugccucagcca

SEQ ID NO: 7156 - RNA, 69 nt, Human
ugucuuaaccaauuugggggcaggguggggucucaagccuuuggccccugugacuccaaguauaaggca

SEQ ID NO: 7157 - RNA, 109 nt, Human
ugucuucucagguagcagggcgcguuuccacuuaaggugugucugucacgcaccucauucuccccagacagucuuugaguaacaucuguucccaucuuccuuggaagca

SEQ ID NO: 7158 - RNA, 75 nt, Human
ugucuuggaaaggccaaagagaaugcacuguauacugccauuguaucaaauguuuugggcaccuuuuucagggca

SEQ ID NO: 7159 - RNA, 75 nt, Human
ugucuuuuuauuugguccaaccccugcuuuacugcucaugcugcuuaaagcaggagggacuagagaaacaaggca

SEQ ID NO: 7160 - RNA, 95 nt, Human
ugugaaaccauuaugcagaugaagaagaugaagcccgagagguuaugaaacagacccaagugggcucgcucuucagucucggcauaaggaauccg

SEQ ID NO: 7161 - RNA, 91 nt, Human
ugugaagacagugagaacaaguuugacuuuucagugauguccuauaauauacuuucacaagauuuacuggaagauaacucucaccuuuaua

SEQ ID NO: 7162 - RNA, 73 nt, Human
ugugaagcaacugaagaaaauguuugaagcaacaagauugcuugcaacaauuguuaugcuuuuguguuucaua

SEQ ID NO: 7163 - RNA, 82 nt, Human
ugugaauaaaacuuuuaauaauguacagcagaaauugggcaggcucauucuuauauuaaaacaaaagauuuccuauauuaca

SEQ ID NO: 7164 - RNA, 64 nt, Human
ugugaaugggaagugguuaaagccugaacacagaaauucagugccuugccaggaucccaucaca

SEQ ID NO: 7165 - RNA, 63 nt, Human
ugugaccuccaccaaaagggcaaauacagacuaucccguuuuauccccguguguguuggcaua

SEQ ID NO: 7166 - RNA, 89 nt, Human
ugugagcaugugugugugcauguaccggggaaugaaggugaacauacaccucugugugugcacugcagacacgccccaguguguccaca

SEQ ID NO: 7167 - RNA, 103 nt, Human
ugugagcuccugaggagucaggccugagucugugggucaucuagcacauccuuaauagaaugauugccuggaugugaccacccucacccccaacccucacaca

SEQ ID NO: 7168 - RNA, 93 nt, Human
ugugaggacaugagauuuggaggggcuggaguggaaugauaugguuuggcucuguguccucacccaaaucucaucuugaauuguauucccaua

SEQ ID NO: 7169 - RNA, 128 nt, Human
ugugauacaagugugaguuacaucauagucuauuucuugcuaaggccaaaguagaggaagucgagguaaauuugcaaaugcuauuugagccaguggccauggaaauaauuaugcucacauucuucaca

SEQ ID NO: 7170 - RNA, 74 nt, Human
ugugauccuggcccggagcaccuccaugccucagcuuggcgagaggucuggggugauccgggugaagcaauaca

SEQ ID NO: 7171 - RNA, 100 nt, Human
ugugauuccucagccagagcaaccucucuaugccaaguacaggcacugcucagggagaaggagagugcugaacggcaagggugcagguggagggauggca

SEQ ID NO: 7172 - RNA, 92 nt, Human
ugugcaaggugaggacaggccccgaaugcuuaugaugcuuucacagaaugugucauaccgugccucgggguugaccacauagugcuugcaca

SEQ ID NO: 7173 - RNA, 84 nt, Human
ugugcaaucccuaauauaauguaaaugcuauguaaucguuguuauacuguauuguuuuuauuuguauuauguuuuauugucaua

SEQ ID NO: 7174 - RNA, 86 nt, Human
ugugcaucccagcaguaagcaacaauggcugauccagaagguacagacggggagggcacggguuguaacggcugguuuuauguaca

SEQ ID NO: 7175 - RNA, 65 nt, Human
ugugcauuuucagcaacuugccaaguauaauuuuccugauaaaggcugggcugcugauauguaua

SEQ ID NO: 7176 - RNA, 67 nt, Human
ugugcgcuucuacuuccucacucguguuuacuccgaguaccuugaggauguucuggaagagcugaca

SEQ ID NO: 7177 - RNA, 76 nt, Human
ugugcugcugggaaggaucuuuggccuaggggaugacuuaguuuauucaaagcuuuucuuaagcccuuucaguaca

SEQ ID NO: 7178 - RNA, 103 nt, Human
uguggaagagaaauggaagucggcucccauugcggcagacaucauggcuuccaagcuucgcugcucuugggcuccgaaacaguauccauuggcuuuauccaca

SEQ ID NO: 7179 - RNA, 60 nt, Human
uguggaggaggaugacgaugaugagcuggacagcaagcucaauuauaagccuccaccaca

SEQ ID NO: 7180 - RNA, 79 nt, Human
uguggggaucuggugcugugguucugcaugaagacaguaacggugucuucauccaggaaccacauugucuggaccuaca

SEQ ID NO: 7181 - RNA, 61 nt, Human
uguggggugcccccgaugggaggcugucccaucucccaguccccaucucuuuuuccccaca

SEQ ID NO: 7182 - RNA, 82 nt, Human
ugugguacuucaggaacucuuuuucaaacucacaucacaguacaucuggagauugucuaagaggcagccuccugacaccaca

SEQ ID NO: 7183 - RNA, 98 nt, Human
uguggugccugguggagaccuggccaagguacagagagcugugugcaugcugagcaacaccacagccauugcugaggccugggcucgccuggaccaca

SEQ ID NO: 7184 - RNA, 92 nt, Human
uguguaccggcacgcccaccgaggcucuggcguccuuuugacuacauuuguccgggagggcaaggucgagccguuggagggugccguggcca

SEQ ID NO: 7185 - RNA, 90 nt, Human
ugugucagucaggauaggucaacugcuguaacaaacagcccucaaaucucaguggcugaacaccauacagcucugcuucuggcucacaca

SEQ ID NO: 7186 - RNA, 61 nt, Human
uguguccuugacuaaaaccauacguggcuauggaaaccauguuuguaguucugaauacaca

SEQ ID NO: 7187 - RNA, 70 nt, Human
ugugucgcgcgggucaaccuggccacgugcucccuagguccaugcgcgguugggugcgccugccggccca

SEQ ID NO: 7188 - RNA, 73 nt, Human
uguguggggagagcucucccaccacacagagugugccugugaaacucugucucuucucuguucuccccccaca

SEQ ID NO: 7189 - RNA, 73 nt, Human
ugugugugaugagaacauguuugggccaauuaagauauuauacuucacaaauacuugcuuuauauuuacacca

SEQ ID NO: 7190 - RNA, 70 nt, Human
uguguguguaugugugugagugagauggguagcgggggugcuaucaugucgcccacgcgggucacgaacg

SEQ ID NO: 7191 - RNA, 74 nt, Human
uguguuccgugacuggcuccccagcaaucucaccagaugugcuuagauuuggguggacucagucacgcugccca

SEQ ID NO: 7192 - RNA, 70 nt, Human
uguguugaugcauuuucacuucuguggucauaggaaauggacuggucuaaagagagugaggcgcaacaca

SEQ ID NO: 7193 - RNA, 72 nt, Human
uguguuggcaaaggcuguuaauaguaguuaaguguuaagacugcuuuucuuuaacguuuucaugguaaugca

SEQ ID NO: 7194 - RNA, 89 nt, Human
uguuaagaagugaggggcaggaugaaaucaccuaggguagguauuuagagggagggcgccgugcaaaauaaaauccucacuaugaaaca

SEQ ID NO: 7195 - RNA, 77 nt, Human
uguuacaggaggcagaaagaaaugauuuagguagacgggguaaagccaguccccagcagaaaauuugccuuuuaaca

SEQ ID NO: 7196 - RNA, 110 nt, Human
uguuauuauuuauuucuuuuaauacaaagcuuuggcauuagcaguuuuaugagaaaauaaaaugugcgaaaaauaaaugcuuguguggcaugauugguaaaugaugcaca

SEQ ID NO: 7197 - RNA, 73 nt, Human
uguucauaaucccaaacaagggcccugcuggcagcaacaggacagguggggccaggacagggaagcuggagca

SEQ ID NO: 7198 - RNA, 119 nt, Human
uguuccucuaagguugucauaauaagugcaucauuaccaaguauuacagcagguacugguuugcaucagggcugcugacguugucugugggcauuguuaagaaaccaaucugggaaaca

SEQ ID NO: 7199 - RNA, 110 nt, Human
uguucucucauuacgggacugaaaauguaugcugucuuacaugaaugcaguugguaaacuguggauuuacuugagaagcuuugcauuguuaaguuuuccaugaaagagca

SEQ ID NO: 7200 - RNA, 108 nt, Human
uguucuugcuaccaaggcucucaaccaccaugauugcgcuagcacagccucgcgauagucacgcuucacggcgcaucguggggaugacugagcacggaggcgaggaca

SEQ ID NO: 7201 - RNA, 76 nt, Human
uguucuuggugagaagggccggcggauucgggaacugacugcuguaguucagaagagguuggcuuuccagagggca

SEQ ID NO: 7202 - RNA, 83 nt, Human
uguucuuguguucuuugccuuauucaucauuuuuaaggcuuaucuaauuaacuguguuuggaacugguauaaauacaucaaca

SEQ ID NO: 7203 - RNA, 85 nt, Human
uguugaaaacaaauacuguuucauuuguugaaaacaaauacugugucauuuguuuucagacagcaaacagaaugauucuuugaca

SEQ ID NO: 7204 - RNA, 73 nt, Human
uguugcuauuuccuaaccugcaggcagaaccugaaagggcauuuuggcuccggggcauccuggauuuagaaca

SEQ ID NO: 7205 - RNA, 72 nt, Human
uguugcugagugagucuuucuagccaggacaagcugauuggaauuuuugaaugguagagaagaaacagcaca

SEQ ID NO: 7206 - RNA, 119 nt, Human
uguuggcauuuggagaggaagcacuguacuauauaccacaguguacugcccauagcuggauacacuguaggaacuuaguaaauauuuguugaguugucuggagaaaaaaaggaccaaua

SEQ ID NO: 7207 - RNA, 84 nt, Human
uguugugguggaugcacugaguggccugagggugaccuugcuggacguuacuauaggcucauugagaugacagaugcugcagca

SEQ ID NO: 7208 - RNA, 82 nt, Human
uguuuaacuuuguaagaugcaaagagguuggaucaaguuuaaaugacugugcugccccuuucacaucaaagaauacuggaca

SEQ ID NO: 7209 - RNA, 101 nt, Human
uguuuaggucgggggaaaggaaggggcugacaaccgcagacaucuggacaccagcaaggguccaggggagguuugcagaacuucuuuguccuuggcuaaca

SEQ ID NO: 7210 - RNA, 68 nt, Human
uguuucaugacugguaacagaguagucucgaggggauccuuggagaaccuguucugacuuuagaagca

SEQ ID NO: 7211 - RNA, 81 nt, Human
uguuuugaaagaagagaaauaugggucuguuccgcuggcucacggaggucagaguuaagguuaucucucuuguucuaaaca

SEQ ID NO: 7212 - RNA, 85 nt, Human
uguuuuucuccucauccuguaccucuuuuuucauuaagaauccugccuggaaguuuaggucaaagaggcugcuuggagcaaaaua

SEQ ID NO: 7213 - RNA, 109 nt, Human
uuaaaucugggaacagccaaaccuuggaucaauucugugugcuuaagaaacuugaguuucauuaaggcguggaauuuguguaauuggaauucauauucccagcauuuaa

SEQ ID NO: 7214 - RNA, 77 nt, Human
uuaacagguaaaugagaagagcauuguggacauuauuggcuguccccaauaaaaugcuguucauuaugcacuguuaa

SEQ ID NO: 7215 - RNA, 88 nt, Human
uuaagacccacucuguuuaaaaauauauauucuauguaugcguauauggaauugaaaugucauuauuguaaccuagaaagugccuuga

SEQ ID NO: 7216 - RNA, 68 nt, Human
uuaagcaucugcaauggugacuuccaccucaacuccuggcucaauacugauggaaguaaucugcuuaa

SEQ ID NO: 7217 - RNA, 89 nt, Human
uuaauaccaauagaagggcaaugcuuuuagauuaaaaugaaggugacuuaaacagcuuaaaguuuaguuuaaaaguuguaggugauuaa

SEQ ID NO: 7218 - RNA, 62 nt, Human
uuaaucauuaggaugucagcugacccuuguagaaagggcaaauugggaucuuggguuuuuaa

SEQ ID NO: 7219 - RNA, 119 nt, Human
uuaaucgccuugcagcacaucccccuuucgccagcuggcguaauagcgaagaggccccgaccgaucgcccuucccaacaguugcgcagccugaauggcgaauggaaauguaagcguuaa

SEQ ID NO: 7220 - RNA, 77 nt, Human
uuaaugguugauauugcuaggguggcgcuuccaauuaggugcaugaauagguggccugcaguaauguuagcgguuag

SEQ ID NO: 7221 - RNA, 104 nt, Human
uuacaagcuguguggcuguggacaaauuuaaugucuuugugacucgguuuuuauaaaucgggagcauucagaguagauguaagcacuacacagauuucuuguga

SEQ ID NO: 7222 - RNA, 97 nt, Human
uuacacacucgugauguaguucaucugugauugugaagccucagaauauucugguugacaagugaaucuccaugugggugacauuaagauuguguga

SEQ ID NO: 7223 - RNA, 71 nt, Human
uuacaggugguugcuuugaacuuuauuugagaaaaacagaagauaaauguaucaaaagaacacacaggugg

SEQ ID NO: 7224 - RNA, 71 nt, Human
uuacaugagaauguuauuugaauggaauuuucuuaacccagaagguaguauuuauaaucauuuacuuguag

SEQ ID NO: 7225 - RNA, 74 nt, Human
uuacauuuucuuuuacuaaaaaagagacauagaagccgaugagucuuuuuggaucuuggacaaagaaaaugugg

SEQ ID NO: 7226 - RNA, 80 nt, Human
uuaccacauggagcauuucacaguuucaaagaaguuuuccuuauuuuaaaacugcaagaaaaugcuacacuugaugguag

SEQ ID NO: 7227 - RNA, 62 nt, Human
uuaccuguuuagccuaugaauugaauugacuggccagauggggucaaucguuugacagguaa

SEQ ID NO: 7228 - RNA, 107 nt, Human
uuacucugaauuagaaacauguuuaugauaauccuauuagaaaauuugauugauugauuaaagugucuuuuugggucgacaucccuagcguuucugauccugaguaa

SEQ ID NO: 7229 - RNA, 71 nt, Human
uuacuguuuuauuuauaccaugcauagcucaaaaagagagauaaaaugaaguguuaacaggaagucaguaa

SEQ ID NO: 7230 - RNA, 80 nt, Human
uuagaaugcagauucucagcccccucccagacauggugaagucagaagcucucagggagggacucagcaaaugauucuaa

SEQ ID NO: 7231 - RNA, 82 nt, Human
uuagagauguuggaaguuguuguuuuuccugucuaaugucuuguauaucauuaggaaguuguccagaaacuugcgucucuga

SEQ ID NO: 7232 - RNA, 99 nt, Human
uuagauuggggcagguuaaggcaggcggccgaauuuggggcuaauugggccaauuggccuuauggggggccgaauaacauuuaauggcccgcgguuuaa

SEQ ID NO: 7233 - RNA, 89 nt, Human
uuagcaugaagucccucuggaucuugagcugguuuauggacucaaucgucucauggaucuuacuguccagagcacugaucuccugcugg

SEQ ID NO: 7234 - RNA, 68 nt, Human
uuaggauaacauugcugucggaggucacgcaagcuaacggcaagugugucuaucaguagugguccugg

SEQ ID NO: 7235 - RNA, 80 nt, Human
uuaggcauugaacacauucuuaaaaacacuggucuguaagaaacugguguuuugaaaaauuaaagugugucguagucuag

SEQ ID NO: 7236 - RNA, 73 nt, Human
uuaggcugaaacauaugaaauugcugcauuuguaguuuaaaaacugucagcaguuucauaugguuccaccuaa

SEQ ID NO: 7237 - RNA, 72 nt, Human
uuauaauauagagacuucaguagguauaaauaggaguuaccuauuuaauucucccagucaucaaugagguaa

SEQ ID NO: 7238 - RNA, 86 nt, Human
uuauacaaaauccucauugacgccacggacaaaggccauccucccauggcgggucauugcaccguuuuagugagaauuuuggauaa

SEQ ID NO: 7239 - RNA, 97 nt, Human
uuauacugcauauggugaacaugaggaggauguaaugcuaagugaaauaagaggacaaauaguguaucauucuccuuaugugaaguauccaguguag

SEQ ID NO: 7240 - RNA, 89 nt, Human
uuaucugguuacccagugguacaguucauauaggaagggcaggauaaaugcuugauucuuugcucuuguacacuaaguuuuuaagauaa

SEQ ID NO: 7241 - RNA, 96 nt, Human
uuaugauugggaaagaaugccaagaugguauuuucuuuuggcaagaugcuugguugugcagucauugaagauaacuuggcacuauuuucugcauag

SEQ ID NO: 7242 - RNA, 71 nt, Human
uuaugguaagcaaaauaaauuguauuuuuccauccuuggggaggauaaaggaacucuuugcacugcuauaa

SEQ ID NO: 7243 - RNA, 72 nt, Human
uuaugugaacacaauuuccccuucuguuaagacuauaaacuauaugaguauguguacugcauguuuacauaa

SEQ ID NO: 7244 - RNA, 107 nt, Human
uuauguuuuguuguuugauuuccuaguucauaacagaagggguuuuguaagcugaccuagcuugacaauccuuuuuggguuuuuugguuucaaacaugaucuuauaa

SEQ ID NO: 7245 - RNA, 96 nt, Human
uuauuccacuucggagaccgccccccuugucccucagaugcauccaaaucaggaguuagggaucauacuccacugugguccugaauuauagaauaa

SEQ ID NO: 7246 - RNA, 100 nt, Human
uuauuuaguaaacauucuuugagucuacacuauguacagaugugcugcuauguaguagcaaagauucaggaugugcccucaaggaaugucugucaaguaa

SEQ ID NO: 7247 - RNA, 83 nt, Human
uuauuucugccgcuaaaugaguuguaggaccuugggcugucucuuuuaccccugggucuuaguuugcucauugguaaaaauga

SEQ ID NO: 7248 - RNA, 131 nt, Human
uuauuugguuuguaagaauuuauuuuuaagggucaaggucauuuguaacauuuugugugugucaauucaaugcaauguuggcugccuuuugaagucuuugauauauuggugaauauucuucugaucuauaa

SEQ ID NO: 7249 - RNA, 92 nt, Human
uuauuuuugacaggaacuguuuuuaauccaugugguuagucuuuggcaacaagcugacugguggauauagaacgaggguugguuagcgguga

SEQ ID NO: 7250 - RNA, 86 nt, Human
uucaaacugggcucaguggcucacaccuauaauccaacacuuuggaaagcugaggugagaggaucacuugagcccacgaguucgag

SEQ ID NO: 7251 - RNA, 74 nt, Human
uucaagcgaaggucaagcuguaaacuuuaagacauguucacccuuaaaagugccacuuugaaugguuguuugaa

SEQ ID NO: 7252 - RNA, 101 nt, Human
gaaccgaugcacuggcaccuagacauguacaacaggaaccguguggauacaucccccacaccuguuucuuggcaugucauguguaugcagcucuucgguuu

SEQ ID NO: 7253 - RNA, 69 nt, Human
gaacugcucugcagaaaggucgcugcucaaguggcugcacucacaggcuagccuuucugcacugcuguc

SEQ ID NO: 7254 - RNA, 130 nt, Human
gaacuugcgagcugcagugccaggucaaccccuagcucugacugcccgugguggccccaaggacacccagcccagcuaucaccauggcaauggaccuuacaacgacguggacaucccuggcugcugguuu

SEQ ID NO: 7255 - RNA, 78 nt, Human
gaagaaagaccugcaccugccugauccgaugggcaaagguggccuuuggaaggggcguuguccaguuccucuuucuuc

SEQ ID NO: 7256 - RNA, 79 nt, Human
gaagaacgaguaaccugaaaugaaggagcgagaaucccacccucagccccccaacagcuuccucagcuucuuuuucuuc

SEQ ID NO: 7257 - RNA, 73 nt, Human
gaagaagggaccccaggucagagacuggagccauuacuucaagaucaucgaggaccugagggcucagaucuuc

SEQ ID NO: 7258 - RNA, 74 nt, Human
gaagacaaauugaagggagagaugauggaucuccaacauggcagccuuuuccuuagaacaccaaagauugucuc

SEQ ID NO: 7259 - RNA, 77 nt, Human
gaagacauggaaauccucugggguggacgggugcagcugacgccucgucccuacugcagaggaaguucggugugguc

SEQ ID NO: 7260 - RNA, 70 nt, Human
gaagagcucaggagauagggaagaggaucuguccagggguuagaccucaagguugacuugugaguucuuu

SEQ ID NO: 7261 - RNA, 101 nt, Human
gaagagugaauggcuugacguacuugcaguuaacggugcaaaaugggcuggcugccucuguuccuacgguacuguaacuuugaucaugucuguuccuguuc

SEQ ID NO: 7262 - RNA, 77 nt, Human
gaagaguugcgauguggggccggaucuuaugcaugacgaucuuccgcuggccugggcuccgcacgucaaucaucuuc

SEQ ID NO: 7263 - RNA, 77 nt, Human
gaagaucaaucugauggcuaaagaucaguaugacugcguaaggcaguuugacaucuacccaucccuaacagauuuuc

SEQ ID NO: 7264 - RNA, 67 nt, Human
gaagauggauguggcugacuucgagugggugaugugguacaccuccuuucgcaacgucaucaucuuu

SEQ ID NO: 7265 - RNA, 77 nt, Human
gaagaugguaacugggaucucguuggaaauaacacccccauuuucuucaucagggaucccauauuguuuccaucuuu

SEQ ID NO: 7266 - RNA, 106 nt, Human
gaagcacguaauguuuaaaauguguuguuuuucacaaguaauuuaaguauagcauuauuauuauuugguacuugagucaaagacgacauuuagauucuucagcuuu

SEQ ID NO: 7267 - RNA, 114 nt, Human
gaagcuaccugagguuuagaauuccuucagcccuagcugcuuuuauucugcuuuuuauuuaaacaaaaagagggggaggaucugaaggaaacuaguuuucuguacaaaggcuuu

SEQ ID NO: 7268 - RNA, 95 nt, Human
gaagcuagagggaggucaggagaaggguaacagggaggaugcaaagcagacaucuacccuggucaccccaggaucaggauaucuguccuuguuuc

SEQ ID NO: 7269 - RNA, 61 nt, Human
gaagcuaggcaccugcccauuuccuugggaguaaagcugaugguguagguggucuggcuuu

SEQ ID NO: 7270 - RNA, 80 nt, Human
gaagcuaugaguggagcugccgccuggucaccuucacccauggaguccucucuauaggccucuccgcuuauauuggcuuc

SEQ ID NO: 7271 - RNA, 66 nt, Human
gaagcucucuugggcugcuaagaugggccuuggaacacaccgcgcguuauagcccaagaggguuuu

SEQ ID NO: 7272 - RNA, 66 nt, Human
gaagcuguagagugcugcccgaaaucucuaggaaguugguggcaagggacagcacucacacucuuc

SEQ ID NO: 7273 - RNA, 83 nt, Human
gaagcuguccccuccucccugccacccucccaggcucauuaguguccuuggaaggggcagaggacucagaggggaucagucuc

SEQ ID NO: 7274 - RNA, 103 nt, Human
gaagcuucaugcacuuaaagaaguauuuuuagaauaagaauuugcauacuuaccuagugaaacuuuucuagaauuauuuuucacucuaagucauguauguuuc

SEQ ID NO: 7275 - RNA, 104 nt, Human
gaaggaacaauggucgugccaaaaagggccgcggccacgugcagccuauucgcugcacuaacugugcccgaugcgugcccaaggacaaggccauuaagaaauuc

SEQ ID NO: 7276 - RNA, 77 nt, Human
gaaggaacaguuugccuggagacauuucuacugguaccuuaccaaugaggguauccaguaucuccgugauuaccuuc

SEQ ID NO: 7277 - RNA, 96 nt, Human
gaaggacucuggaaccucguguuuucuuuaggauacagagaguaacuguagcuauaauuuguacuucagacaagcaaucauuggucagaguccuuu

SEQ ID NO: 7278 - RNA, 81 nt, Human
gaaggaggcuguucugugcauuguuggauuuuuagcagcgucccugaccucaguccaauagaugccaguaacaacucccuc

SEQ ID NO: 7279 - RNA, 92 nt, Human
gaaggauuggagagccacuugaggucauauguuaagguauguaaaacacacuguucugaucacuuacaucuguggcucuccaguuuuccuuc

SEQ ID NO: 7280 - RNA, 79 nt, Human
gaaggcgucuuucagagucaucuauccucuuggcaugccaaugcaagaggaaagcauuccucaaaccaaagaaaucuuc

SEQ ID NO: 7281 - RNA, 61 nt, Human
gaaggcugaguacugggcacucucaucucucacuggugagaauguccgagaauucuucuuc

SEQ ID NO: 7282 - RNA, 92 nt, Human
gaaggcugcgaagguggagaguuaccggugucgaagcgccuucaagcuccuggaggugaacgagaggcaccagauucugcggcccggccuuc

SEQ ID NO: 7283 - RNA, 90 nt, Human
gaagggacuuccugggacacaucagauccauuucuggaguucuuccgcagggugaugggacaugggccugguggucgucuuggggccuuc

SEQ ID NO: 7284 - RNA, 60 nt, Human
gaaggggucagggggcuccuugcuucuagugaacaagggcccugaguucuagagcccuuu

SEQ ID NO: 7285 - RNA, 64 nt, Human
gaaggggugaccacccccuugggccuucugggggaacucucccuuggggguggcuugcccccac

SEQ ID NO: 7286 - RNA, 89 nt, Human
gaaggguuuacgaugcauuguuaucauuaaccagucuuuuacuacuaaacuuaaauggccaauugaaacaaacaguucugaaaccguuc

SEQ ID NO: 7287 - RNA, 73 nt, Human
gaagguucuggucuuggcccuaagaggucucuucauaauugaccccagggagucaucaagcauuggagcguuc

SEQ ID NO: 7288 - RNA, 71 nt, Human
gaaguauuuggaacaguaaaggaagauguaucauuacauggauauaaaaaauacuugcugucacaaucuuc

SEQ ID NO: 7289 - RNA, 73 nt, Human
gaagucccguguugccauccucaaggcuaaccugcgcaaguccccaguugccaaggauguggacuuggaguuc

SEQ ID NO: 7290 - RNA, 77 nt, Human
gaagucggucguguccggcgugaugggcuugcuguccuccuggucagagcccaucccuguccggggacugccgcuuu

SEQ ID NO: 7291 - RNA, 85 nt, Human
gaagugaaaauguuuuacaaucucuagguuuggcuaguucucuuaacacugguuaaauuaacauugcauaaacacuuuucaaguc

SEQ ID NO: 7292 - RNA, 94 nt, Human
gaaguggagaguguaggaaauccacugcagaaugaggucugcuugucauccucucagucucaacugcucucccuccuucaucgcucucuguuuc

SEQ ID NO: 7293 - RNA, 61 nt, Human
gaagugggucagauugcaguguguaguuuuggagaaucuguaaagcuguuacacccauuuc

SEQ ID NO: 7294 - RNA, 80 nt, Human
gaaguugaucuacuuccagcugcaccgggcccucaagaugauuguggaucccguggagccacauggcgagaugaaauuuc

SEQ ID NO: 7295 - RNA, 81 nt, Human
gaaguugccucagguuacgaggucuuggcacaauuauauguguaauuguguuauccaggauuuuccaagcuucgguacuuc

SEQ ID NO: 7296 - RNA, 90 nt, Human
gaaguuguuagggcggccuucgaggguagggggauucucacuggaguggcucaaugaggaucuugcaggaggccggcaggugaugagauc

SEQ ID NO: 7297 - RNA, 72 nt, Human
gaaguuucagucaauaauccacugcauauaggauggugguuccauaagauuguaauggagcuguaaaauuuc

SEQ ID NO: 7298 - RNA, 117 nt, Human
gaauaaauaagcugcucuaauugccaagaauucacaugugguuguaugcagcauuacugggaaauugaaguguaucugcaugugauucugcugugauggacacuuguaaguuuguuc

SEQ ID NO: 7299 - RNA, 113 nt, Human
gaauaaauaagcugcucuaauugccaagaauucacaugugguuguaugcagcuuuacugggagacugaaguguaucugcaugugauucugcugugauggacacuuguaaguuu

SEQ ID NO: 7300 - RNA, 93 nt, Human
gaauauugcauguagaguucgacgcuggacaucugugaagaccaaccugggcuuuuuggguguguugccucuauccuucccauguucuuguuc

SEQ ID NO: 7301 - RNA, 108 nt, Human
gaaucugguugguuccuuaaagaucacuugacauggacaggguuuggaaaacuauuugaucauuacggagacugucaccgucaagagguguuuauuaucauuagguuu

SEQ ID NO: 7302 - RNA, 87 nt, Human
gaaucuucgugguugccaucgugcuauagauuucgagucucuaauugaagaaaaucaucuguuguaucucgaggagccccuugauuc

SEQ ID NO: 7303 - RNA, 85 nt, Human
gaauguaaaaggaauauuacaguguuaacugccauauauguaauauacacaaacucaauuagcauuguaauggccaaaugcauuc

SEQ ID NO: 7304 - RNA, 80 nt, Human
gaaugugucccagagauucugguauguuguaucuuuguucucguugguuucaaagaacaucuuuauuucugccuucauuu

SEQ ID NO: 7305 - RNA, 75 nt, Human
gaauguuucuugaaauuggcgucaaacugucuuguauuucauuucuuuugcgaugccuaauugaaucgaaacuuc

SEQ ID NO: 7306 - RNA, 103 nt, Human
gaauuccuaaguauguggucuguauugugcuuguacugaccauguauauaugcuaugguuauuuagugcuagcuaagaacauaccauuuccccaguagcaguc

SEQ ID NO: 7307 - RNA, 71 nt, Human
gaauugaugauguauuugcaaacauuaaugugaaauaaauugaauuuaauguugaauacuuucaggcauuc

SEQ ID NO: 7308 - RNA, 68 nt, Human
gaauuggugaacggaagaguccuuauguugcaguaugcuguauaguaauggccuucagcauccucuuc

SEQ ID NO: 7309 - RNA, 94 nt, Human
gaauuucaugccugggcaaagucaaaguuuuuuccuuuaaucacauuacucaaagaauaaguugacuauaucccaacagcacuuguccaaauuc

SEQ ID NO: 7310 - RNA, 80 nt, Human
gaauuuggggaggacacaguccagggcggaacucuauccaucugucugucugucugucugugucuaucucccuaucuguc

SEQ ID NO: 7311 - RNA, 96 nt, Human
gaauuuugugaaacagacuuguauauucuauuuuacaacuacaaaugccuccaaaguauuguacaaauaagugugcaguaucugugaacugaauuc

SEQ ID NO: 7312 - RNA, 84 nt, Human
gaauuuuuuauacaguuacuaguuuaaugggugaaaaauaguauuguuuuaauuuucaugucauuaauagugaaguuaauauuc

SEQ ID NO: 7313 - RNA, 71 nt, Human
gacaacauggcugugugcuucagcggcuuccugggcacguaggagcagcuguaagugccauugccguuguc

SEQ ID NO: 7314 - RNA, 123 nt, Human
gacaacuuguuggguacauaucaguauacgacauuaauauaucucccuguccccaauuagguuaucagucacuugauggaggagauuguauguuauauauuacuuuguauucuucacaguguc

SEQ ID NO: 7315 - RNA, 93 nt, Human
gacaagaaaugccccuucacugguaauguguccauucgagggcggauccucucuggcguggugaccaagaugaagaugcagaggaccauuguc

SEQ ID NO: 7316 - RNA, 98 nt, Human
gacaagcagagaccaggaaaagacaaggacaugaauuuaagguacucaaguuccaaauacacgaauccauggcuaguuguuucuuuuucucucuuuuc

SEQ ID NO: 7317 - RNA, 81 nt, Human
gacaaggaccaggaccugaucaccaucauuggaaaggaggacgccguccgagaggcacagaaggagcuggaggccuugauc

SEQ ID NO: 7318 - RNA, 68 nt, Human
gacaagggugccucuaaaagcuugacagggccuugacugcacaauucgagcugaauuugccccuuguc

SEQ ID NO: 7319 - RNA, 66 nt, Human
gacaaugccgcugcacugccuacuuugagggaucgaggugugaggugaacaagugcagccgcuguc

SEQ ID NO: 7320 - RNA, 78 nt, Human
gacaccgccgggacaaagcugauugucucucccugcagccacacaguggcucccuaucacgcugccaccggaccuguc

SEQ ID NO: 7321 - RNA, 72 nt, Human
gacacggauggacaauacggaaccgucagaccucugguuagacgacacagagcugacgcuucaucacguguc

SEQ ID NO: 7322 - RNA, 99 nt, Human
gacacggggacauacaacgcaggcagcuucggacagguguggucuggagacauucacaucacgucgcggcgcugacggaguauacagaagccccguguc

SEQ ID NO: 7323 - RNA, 109 nt, Human
gacagcacagccuccucugaaggccggccauaccagaguccugccucggcaugggccucaccauugaggcagcuccacugucugugcuggucugagggugcugccuguc

SEQ ID NO: 7324 - RNA, 90 nt, Human
gacagcagaacuuuucuauccaaaugaaugccgucccauggaaaguggcuguccugggaggcuacacguuucuccaauggugaugcuguu

SEQ ID NO: 7325 - RNA, 72 nt, Human
gacagcagagauggugaagggccugugcgggaggcgacagugaaacccuuugccaucgacauauuuccuguc

SEQ ID NO: 7326 - RNA, 82 nt, Human
gacagccaguaucauccugagcacugagguaugcuuuccauggccgagacccagcccuacucauugcgauggucuggauguu

SEQ ID NO: 7327 - RNA, 71 nt, Human
gacagcuccuaugaugggcccaacccaauauaucccaauguuuucccaauuucccaugauaacugcagguc

SEQ ID NO: 7328 - RNA, 91 nt, Human
gacaggaucuugcucuguugcccaggcuggagugcaguagugcaaucauagcucacugcagccuccaacuccugggcucaagugauccuuc

SEQ ID NO: 7329 - RNA, 82 nt, Human
gacaggauuccaguacaggucucucauuuccuucaugauuaggaauacuacuuugaaaugagagaccuguacuguaucuguu

SEQ ID NO: 7330 - RNA, 95 nt, Human
gacaggggcaguuaggccgcauagcuggagagugagucacauuuacuuaguuuugccaugugacaggucuuuccccuaugucaucucccuugauc

SEQ ID NO: 7331 - RNA, 91 nt, Human
gacagugaaggauucuuaucacauaaugugcaggccaugugccugugaacuugaaguuugcgcaaaauguggaaagaaagaagacauuguu

SEQ ID NO: 7332 - RNA, 71 nt, Human
gacaugacauuaggaacuuagcauuuuagaucuguguucaaacaagucuuaaaauugucuagucucauguc

SEQ ID NO: 7333 - RNA, 77 nt, Human
gacaugaggacuuugggcucugaggcaaaggugauaauggcaacgcucacauugaucucaaagcugaagauccuguc

SEQ ID NO: 7334 - RNA, 65 nt, Human
gggaacaaaccucucaccucaggccagaaggggaugaccuccauuugcuucucugaguaguuucc

SEQ ID NO: 7335 - RNA, 65 nt, Human
gggaaccauaggagaauuuauuucuagauguaaauaauuauuuuaaguuugcccuaugguggccc

SEQ ID NO: 7336 - RNA, 95 nt, Human
gggaacggaaggaggaaugcuggacuggaggccccuggagccagauggcaagagggugacagcuuccuuuccuguguguacucuguccaguuccu

SEQ ID NO: 7337 - RNA, 92 nt, Human
gggaacuaaauucauuccugaugccagaucugaucgagucaguaugucuucagcuugaucagauuuuaaaaucaguuuugaaagugguuccc

SEQ ID NO: 7338 - RNA, 72 nt, Human
gggaagaccugcagugcacgguuucuuccaggcugagguaccuggaucuuggguucuucacugcagggaccc

SEQ ID NO: 7339 - RNA, 64 nt, Human
gggaagacguuuucuuuaucgcccugagaagaucuaccccagggagaaucugagacaucuugcc

SEQ ID NO: 7340 - RNA, 90 nt, Human
gggaagcacugucugugaggucucuaacuagcuguauugaaaaugauaaaugauccuagaggcuaguauuaucucguugacauuuuucuc

SEQ ID NO: 7341 - RNA, 73 nt, Human
gggaagguggggaggguccgaggggaaggggacccagcuucccugugcccgcucaccccacuccaccaguccc

SEQ ID NO: 7342 - RNA, 66 nt, Human
gggaaguaugugccgccgagcccugcgccgacgcgggccagccgccgcggcgagcccaugcccccc

SEQ ID NO: 7343 - RNA, 81 nt, Human
gggaauaccuuggcaagcagcuccaguccgagcagccccagaccgcugccgcccgaagcuaagccugccucuggccuuccc

SEQ ID NO: 7344 - RNA, 72 nt, Human
gggaaugauagcauugaaggacucggggauaucuaacagcaauaccugaucacuacuucgcacuaaguucuc

SEQ ID NO: 7345 - RNA, 73 nt, Human
gggacaagggagauggagguaagacagaugaacacaacacagucuuugcugaaggaggucaucccuuguaccc

SEQ ID NO: 7346 - RNA, 62 nt, Human
gggacaucccgaggaaaggcugcguguacggaucacgggcacagccagccgcggggcguccc

SEQ ID NO: 7347 - RNA, 93 nt, Human
gggaccccuccccagggccuuuuccuccucugcgucuuccaucuacugaaaugggagagcggguggggagcuucuguucuggugaagggaccc

SEQ ID NO: 7348 - RNA, 72 nt, Human
gggaccuaccaggggcuucuggcaacuuuaagaaggaaagucugagcaauuggaggcuccuggaggcugccc

SEQ ID NO: 7349 - RNA, 98 nt, Human
gggacguccgcgacuaccuggaagagaggcuggaagcugaauucggucagaagagaauccaucugaauagccaguuuccaggcacccagcggcuuccc

SEQ ID NO: 7350 - RNA, 73 nt, Human
gggacuacgggugugcacuccucgccuggcuaauuucaauuuuugguacaggcaggaucuugccaccuugccc

SEQ ID NO: 7351 - RNA, 71 nt, Human
gggacucuggcuaaggcucuucauuuccccuggagcaggggcagaagugaggaggggagggucggagucuc

SEQ ID NO: 7352 - RNA, 77 nt, Human
gggacugcugucugcugucuacacuacacacuacuacacugcugucugcugugugugauaaggacacagauaguccu

SEQ ID NO: 7353 - RNA, 76 nt, Human
gggagaauccccuaagcuccagggcccagggucuaaccugagaggucggggcugcaggaagcugggggaggcuccc

SEQ ID NO: 7354 - RNA, 75 nt, Human
gggagaggugauugauguacacaaccguguccgaauggugacagugggcaucgucugcaccagccccauccuccc

SEQ ID NO: 7355 - RNA, 83 nt, Human
gggagcaugggcaccuccuagguccgggcuggcuuuccauuuguccccuaauuccagucucucucugaggcccagcugcuccc

SEQ ID NO: 7356 - RNA, 97 nt, Human
gggagccgguugaggaaaggcagacauccgacuucuugcccugguauaacuggcacgacaaggguaaggaucugcaucugaucuuccacggguuucc

SEQ ID NO: 7357 - RNA, 106 nt, Human
gggagcggcuaggccgggacgcccgugguccucaccccuugagcugcuuuggagacucggcugccagagggagggccaugggccgaggccuggcauucacguuccc

SEQ ID NO: 7358 - RNA, 78 nt, Human
gggaggaaaagcuaugaaacuguauagggcuguauauauacuugucucagcuuaaugcaggaaauuggcuuacuuucc

SEQ ID NO: 7359 - RNA, 90 nt, Human
gggaggagauguagcacgggaucaugggggcagcgcgugaucuuugcacuucgcagcccaucuggguaccuguugguucaggcucuuucu

SEQ ID NO: 7360 - RNA, 70 nt, Human
gggagggggcuccucucaggaggggugagggcauuauugcauuugcuggggggaaggacaacccucuccc

SEQ ID NO: 7361 - RNA, 89 nt, Human
gggaggucacacugcccgucggaccuuggcaugcuccauucagcugaccugcugaggacaggcaucgccgagacuccuuggguccuccc

SEQ ID NO: 7362 - RNA, 62 nt, Human
gggagucauugaacuucagcucuggaaaggauguuguuaccaaguucaguuugugaauugcc

SEQ ID NO: 7363 - RNA, 67 nt, Human
gggagugguaggcugccuuuucuccugguauuuguacacaaaagcuggggagagcuuuuccacugcc

SEQ ID NO: 7364 - RNA, 94 nt, Human
gggauaguauuaauuuuuuuugguugggugcugugguugguuaaaaugaccaacuauuuugcagccccuccuuucaauagguugauucuauucu

SEQ ID NO: 7365 - RNA, 85 nt, Human
gggauaugaggagaaugaggaguugcugaggaacaaugcaccaccugcugcuggaggugagaagcggacccaucacuugcuuccc

SEQ ID NO: 7366 - RNA, 92 nt, Human
gggaucauugauuguguggugagaaucccuaaggagcagggcuuccucuccuucuggagggguaaccuggccaacgugauccguuacuuccc

SEQ ID NO: 7367 - RNA, 91 nt, Human
gggauggaaaaugcagacacaauauagcaaauagagggucuuuuccugucauggaaaucggucagcccugaugcuucugcauuucuuuccc

SEQ ID NO: 7368 - RNA, 73 nt, Human
gggauucuccaccaggacaccgccagcguccccaccguccucagcuuggcaaacguuucccgaagaggauucc

SEQ ID NO: 7369 - RNA, 83 nt, Human
gggauucugugucuggcuccuuucacuuagcauaaugucuuuaagggacaugcagguuguagcagguaucaguacuccauucc

SEQ ID NO: 7370 - RNA, 62 nt, Human
gggcacauuggugguauuuugguauguggccacuggcacuaaacaacugaccauuucuaccc

SEQ ID NO: 7371 - RNA, 64 nt, Human
gggcaccccagugucccgcuggcccagcaggagucacuguuggccucuggacacucaucggccu

SEQ ID NO: 7372 - RNA, 106 nt, Human
gggcacugcggggugcuugcugucucgcuugagggccucacgaugcguccaucacugcugaugacccguuaccuggaguccuggggcgcagccaagccuuuugccc

SEQ ID NO: 7373 - RNA, 84 nt, Human
gggcacuuccaacacaacuugucuuggugauauuuggccagcaaaugucaacauuaccaaagaaaaguuggagguggauggcuu

SEQ ID NO: 7374 - RNA, 66 nt, Human
gggcagagggcaugugaaguaaccuaggaccugcuggucacccugggugaugugcugcccucguuc

SEQ ID NO: 7375 - RNA, 81 nt, Human
gggcaggggaggggcucagucuuucuuggcagcagcuuuccucauggcggccaguacguugcucagcuccucccgcuuccu

SEQ ID NO: 7376 - RNA, 81 nt, Human
gggccagggaggcacaaaccuaacuguaccccugcuacaggcaggguggauagacagagacccauugucccuuccaugucc

SEQ ID NO: 7377 - RNA, 70 nt, Human
gggccaugcgcuuacauugauaucauuagcuggcagucggcugacaauuucacagugcucccacuggccc

SEQ ID NO: 7378 - RNA, 70 nt, Human
gggccccaagcucgcuaguccucggaucccagaaacauaacuccgggggugcagaccugcuuggaggccc

SEQ ID NO: 7379 - RNA, 62 nt, Human
gggcccgggcaggacugggccucccucugaucgaugagguggugagcccagagcccgagccc

SEQ ID NO: 7380 - RNA, 86 nt, Human
gggccuugaggaugauguuccgggugugcauccccuggaaguagucgaucugcuccugcgucauccggaagcggaccuucuugccc

SEQ ID NO: 7381 - RNA, 101 nt, Human
gggcgagcucgguggugacgcgcggcccucacgugacccagagcugcagagcgacgcagccuucggugcagucgucacucgcgucuggcuaccagcucccc

SEQ ID NO: 7382 - RNA, 69 nt, Human
gggcgcccgcacuccucagcucuuggguggucgaugggacugggcgccguggagcaggggguggcgcuc

SEQ ID NO: 7383 - RNA, 78 nt, Human
gggcgccuccuccgcggguaugaccaguccgccuacgacggcaaggauuacaucgcccuugaacgaggaccugcgcuc

SEQ ID NO: 7384 - RNA, 75 nt, Human
gggcgcuccaggaccggccccagcgggcaaaccccccgcauucacccccgcacccggggcuccacccaagcgccc

SEQ ID NO: 7385 - RNA, 81 nt, Human
gggcgcuuuuugcggggggcgaaaagauaugaaaagcagccaguuauuuuccgccccccuuuuaaagagaaaaacgcgccc

SEQ ID NO: 7386 - RNA, 76 nt, Human
gggcggaagguacacuauaggcucggggagguagaaugggcuauuugcugaagcuucuugguggcccugcuagccc

SEQ ID NO: 7387 - RNA, 66 nt, Human
gggcggacgcgugggccagcagcugguggggacugguuucaacgccagcuuucugugcuucugccu

SEQ ID NO: 7388 - RNA, 90 nt, Human
gggcggaggcacucgcgcgggggguaauucggggucuggguucuggugccgcgcagcuuuccccgauggcccacugcgugaccuugguuc

SEQ ID NO: 7389 - RNA, 73 nt, Human
gggcggccgcucuagaggauccaagcuuacguacgcgugcaugcgacgucauagcucuucuauagugucaccu

SEQ ID NO: 7390 - RNA, 86 nt, Human
gggcgggggcccucgucuuacccagcaguguuugggugcgguugggagucucuaauacugccggguaaugauggaggccccugucc

SEQ ID NO: 7391 - RNA, 88 nt, Human
gggcgguaaguuggauuucgaugaaccggucccugaaguugugcucccucugggacuccauccuucaucucuccaaucucaccagccu

SEQ ID NO: 7392 - RNA, 121 nt, Human
gggcgucagacuugcauacgcagcagaucagcauccuucgcuggcccuuagcaacuuagguggucgauuggaaacugugaaggugugaucuuucaggagcuggaagucuuaggaaaagccu

SEQ ID NO: 7393 - RNA, 94 nt, Human
gggcgucugcuggagugugcccaaugcuauaugucaguugagguucuaagacuuggaagccacagaaaugcagaaugccacuccggaagggucc

SEQ ID NO: 7394 - RNA, 74 nt, Human
gggcguucuguggcuuucauuaauauaguucuuaguuuuccacuggucuguaucccauucugccuuggacgccu

SEQ ID NO: 7395 - RNA, 64 nt, Human
gggcguuggcagagguggcggcggcggcaugggugccccgacguugcccccugccuggcagccc

SEQ ID NO: 7396 - RNA, 80 nt, Human
gggcuagaagguaucuacaacuucacacauaaccaaaaacagagaaguggugaaguggugaaaggaguuucucaaagccu

SEQ ID NO: 7397 - RNA, 62 nt, Human
gggcucgggcucugggcucaccaccucaucgaucagagggaggcccaguccugcccgggccc

SEQ ID NO: 7398 - RNA, 81 nt, Human
gggcucuguaugggaggccauggccuucgccagcaucuauaagcuggacaaccuuguggccauucuagacaucaaucgccu

SEQ ID NO: 7399 - RNA, 75 nt, Human
gggcuguagugcacuuugagcgagggcggccuggggaccgccggguggcugugucgucauuagcaucauuggcgc

SEQ ID NO: 7400 - RNA, 81 nt, Human
gggcuguggugucuguccgcuuucaggaagacauuauuucaauauggaauaagacugccagugaccaagcaaccacagccc

SEQ ID NO: 7401 - RNA, 66 nt, Human
gggcuuccccagugucuuugggggucugugaaaaagaggauccucugagguuuacugggagggcuc

SEQ ID NO: 7402 - RNA, 78 nt, Human
gggcuuccccucggccuccaggugaggcugcccauugcaggcacugggcaggccugaccuugcuggggcucauggccc

SEQ ID NO: 7403 - RNA, 81 nt, Human
gggcuugcuggguuuacagauggcaaagaucuggcaaauuaaaaauagccuuaggccaaagaucaaacccaaggugggcuu

SEQ ID NO: 7404 - RNA, 83 nt, Human
gggcuuuggccugaauucaggaagugguccccugauuccaaacacaggcuggguccgggggacgauugggauggccagaaucc

SEQ ID NO: 7405 - RNA, 72 nt, Human
ggggaaagauguccucaucugcucaggcacucauccaugccccgccuccaagcagugugaugucgacucccu

SEQ ID NO: 7406 - RNA, 101 nt, Human
ggggaaaucaaggaugcucgguuuaagguacacuguuuccauguuauguuucuacacauugcuaccucagugcuccuggaaacuuagcuuuugaugucucc

SEQ ID NO: 7407 - RNA, 74 nt, Human
ggggaaaugacuggcccaaggggacaagacgcaucuuaagaugucaaguccuggacccuucccugcaaggcccc

SEQ ID NO: 7408 - RNA, 80 nt, Human
ggggaacacaggagcguaccacuacacuugggcugauuuuuuguaaauuuuguaggagacagggucucccuguguugccc

SEQ ID NO: 7409 - RNA, 73 nt, Human
ggggaacugacuuauagaaaaugcucagcacguggccuagcacaaggcauucuuuaaaucugagucucucccc

SEQ ID NO: 7410 - RNA, 81 nt, Human
ggggaagggacgggacguugcaguuuaaggcauuucuggcuucggagccaucccugccaccucugcaccugccccuugacc

SEQ ID NO: 7411 - RNA, 87 nt, Human
ggggaaggggcuagcagguguguaaacagaggguuccaucaggcuggggcagguggccgccuuccgcacacuugaggaacccucccc

SEQ ID NO: 7412 - RNA, 78 nt, Human
ggggaaguggaagcgccgggcccugcugcgggggggagagccacugacgccgggaccgggaccgccgccgccgccgcc

SEQ ID NO: 7413 - RNA, 73 nt, Human
ggggacagcgaccugcagcuggaacgcaucaacguguacuacaaugaggccaccggcggcaaguacgugcccc

SEQ ID NO: 7414 - RNA, 84 nt, Human
ggggacagcgcgugugguggccgaggaugcugcggggcguguagcuccgugcgccccucgcuggugacugcugcgccgugccuc

SEQ ID NO: 7415 - RNA, 82 nt, Human
ggggaccggucucaccgaaugcauccugucgggcaucaugucugugaacgggaagaaggugcugcacauggaccggaacccc

SEQ ID NO: 7416 - RNA, 82 nt, Human
ggggaccggucucaccgaaugcauccugucgggcaucaugucugugaacgggaagaaggugcugcacauugaccggaacccc

SEQ ID NO: 7417 - RNA, 82 nt, Human
ggggaccggucucaccgaaugcauccugucgggcaucuugucugugaacgggaagaaggugcugcacauggaccggaacccc

SEQ ID NO: 7418 - RNA, 73 nt, Human
ggggacggucucaaugcgugaucagagaaucuucaccuuggugaaaaguggcucagauccagacaaugucucc

SEQ ID NO: 7419 - RNA, 102 nt, Human
ggggacuacaauggccacgucggucuggguguuaagugcuccaaggagguggccaccgccauccguggggccaucauccuggccaagcucuccaucgucccc

SEQ ID NO: 7420 - RNA, 73 nt, Human
ggggagaaaaagcuguagaacaaauguuugggguuaccauugaaaaucuaaugucugcaauauuuuucuccuc

SEQ ID NO: 7421 - RNA, 68 nt, Human
ggggaggaggauuaggcuggacugaucgcgggucgcaggugaccccgggaccagaugucccuccccuc

SEQ ID NO: 7422 - RNA, 78 nt, Human
ggggaggagguggcugugaagaaggugcgagaccucaaagaaaccgauaucaagcacuugcgacagcugaagcacccc

SEQ ID NO: 7423 - RNA, 74 nt, Human
ggggaucuuggccucacgguguaagaagggagaggaugguuucucuucugcccucacuagggccuagggaaccc

SEQ ID NO: 7424 - RNA, 90 nt, Human
ggggaugaauucuucaaauaggagccgauggaucugugguccuuugggacucaucaaagccuugguuuagcauuugucaguuuuaucuuc

SEQ ID NO: 7425 - RNA, 83 nt, Human
ggggcacguggcaggaaggggaggcaaggccaaggcaggggauucccccaccggccgccccccaaaccccuacccaaggcccc

SEQ ID NO: 7426 - RNA, 88 nt, Human
ggggcagagcggauggaagccggagaucccagguucccggaauacuccggcuggggccuucgggcuucuccuguccccucccuacccc

SEQ ID NO: 7427 - RNA, 87 nt, Human
ggggcagccugcaacccccaaaggccgguguugggcuuccaaaugcuucaggccuggggccagaaagggguuacaaaagguugcccu

SEQ ID NO: 7428 - RNA, 78 nt, Human
ggggcagucaguaggaacuguaacuaugucucugaugcaccacguguuuagacacagcacaguccuuuuuucuguucc

SEQ ID NO: 7429 - RNA, 68 nt, Human
ggggccagcagccugauuuagcagcuaaugaagccagcuucugagggaaaauucaguuguugugccuc

SEQ ID NO: 7430 - RNA, 62 nt, Human
ggggcccccugugacccuggagagugucccucucucagggaugccacaaccaugggggcccc

SEQ ID NO: 7431 - RNA, 75 nt, Human
ggggccggcugggggccugagcgggaggccaucaucaaccuggccacccagcccaagaggcccauguccaucccc

SEQ ID NO: 7432 - RNA, 82 nt, Human
ggggccuguggcaaaagaacugagcggacugccaucuggacccucugccggaucagguccuccucccccuccaccaggcccc

SEQ ID NO: 7433 - RNA, 69 nt, Human
ggggccuuugaauuugaggucuaugggcgggucgaggaccaggaucugcucgugcuucgccguggcccc

SEQ ID NO: 7434 - RNA, 86 nt, Human
ggggcgggcuucugggggccauguuugggggaagggaagguuccccacccacccuuggaaaacccccaguccccugaagccccccc

SEQ ID NO: 7435 - RNA, 73 nt, Human
ggggcuauugagaaaacuugucuucacaagacggguuaauauuugugugaacggcgguuaguuacuauacuuc

SEQ ID NO: 7436 - RNA, 62 nt, Human
ggggcucauuugcaggggggagccaaaagggucaucaucucugcccccucugcugacgcccc

SEQ ID NO: 7437 - RNA, 81 nt, Human
ggggcugagcaaugauagaauuucuagggcugggaagcagaacccuuaagucucugcccucccaauucuauuacucucccu

SEQ ID NO: 7438 - RNA, 92 nt, Human
ggggcugaggaggaggagcagggggugcugcguggaaggugcugcagguccuugcacgcugugucgcgccucuccuccucggaaacagaacc

SEQ ID NO: 7439 - RNA, 87 nt, Human
ggggcugugaugucagccacugaggguguugugcucacguucgagggcccagcacaaaaauccuuguaugacaucucaugcugaccc

SEQ ID NO: 7440 - RNA, 65 nt, Human
ggggcuguuauggggauaagcuggugagguccccaaauauugaccaacuggcaucccacagccuc

SEQ ID NO: 7441 - RNA, 76 nt, Human
gggggagcuugaaggaacuacuacuaagccccuggccccaaacccaagcuucagucccacuccaggcuucaccccc

SEQ ID NO: 7442 - RNA, 77 nt, Human
gggggcgugguggcgggacuggaccucuggggccuguguugggccuuagcucgguaacuggugaccccuuugcccuc

SEQ ID NO: 7443 - RNA, 88 nt, Human
gggggcugcagaacuggaauucuggucuaggacaagacaagugccagccagcguucucuaucuuuauccggaauccucugcucacccu

SEQ ID NO: 7444 - RNA, 95 nt, Human
gggggcuugcccaggugcugggacaggacgaugagguugaccagcgucucuggguagccacuauccuugucuagcgccuccugcagcaggcccuc

SEQ ID NO: 7445 - RNA, 78 nt, Human
ggggggaggaacccaccaacagggggggucuccacaacuccucaguguccgccccacuugugucgggaagcccccccc

SEQ ID NO: 7446 - RNA, 64 nt, Human
ggggggccacccguuuuccaaaauuucguucaaaguuucaaguuggaauccugguggucccacc

SEQ ID NO: 7447 - RNA, 73 nt, Human
gggggguggccagcccugaaguugcccucccagggaggaaccagcucugggagggaggggcugucagaccucc

SEQ ID NO: 7448 - RNA, 72 nt, Human
gggggucaccacacuuugcuaacucuugugugcacauauuuuauaauagaguagcgagggaauggugccgcc

SEQ ID NO: 7449 - RNA, 62 nt, Human
ggggguccgggcgggguguaaacuggugccgcgguguguuguuugccccccggcugaucucc

SEQ ID NO: 7450 - RNA, 76 nt, Human
gggggugcagggcccugugguuggacuucaccucucagcacugaaaacccaaaacccagcuggccuuaacacuccu

SEQ ID NO: 7451 - RNA, 74 nt, Human
gggggugcugugaugcgugaggcagccgggggaggcccggaguccgagacugcuugagcgcugcgcacaccccu

SEQ ID NO: 7452 - RNA, 65 nt, Human
ggggguuacugcagugauggagaugcaagccccuacucuugcccucuaucccuucuacagccccc

SEQ ID NO: 7453 - RNA, 72 nt, Human
gggguaguggauggcaacugauggaacaggagaaugcucagcagcauuugcucuuccagccugucacgccuc

SEQ ID NO: 7454 - RNA, 74 nt, Human
gggguauaaucaugugucacauagcauuguuuuggucaacaguggaccacauguaugaggacacauauaauccc

SEQ ID NO: 7455 - RNA, 97 nt, Human
gggguaugaggcuuuauucaggaagagcucaagaugggaggggagccccuggggucccacucuuguggccucuugauaccaaggcucaugggacgcu

SEQ ID NO: 7456 - RNA, 76 nt, Human
ggggucagaagacuggauugugaguaggccaguuuucaguacagggaaaaaagcuacagaucacucuuuugacccc

SEQ ID NO: 7457 - RNA, 77 nt, Human
ggggucaguacaucccccagucguggcccucuggacaguggcgggccugccucaugagggcuccaaugugcugcccc

SEQ ID NO: 7458 - RNA, 91 nt, Human
gggguccaggcucugguuggggcuguggacugaggucugaucuccaggcugguauguggacugugggcaguuuggacugggccuggguccc

SEQ ID NO: 7459 - RNA, 72 nt, Human
ggggugcagggggucucugugcugcugcugcagguggugcugcugcugcggugagcgugagacccgcacccc

SEQ ID NO: 7460 - RNA, 63 nt, Human
ggggugguggaaugguccuuccuuuaagccccggaaaagggauggacccacuuucuccacccc

SEQ ID NO: 7461 - RNA, 69 nt, Human
ggggugugaggaagcuguccccagagcucccuggggagugaggggugggcaaagccaacuaaacacccu

SEQ ID NO: 7462 - RNA, 69 nt, Human
ggggugugaggaagcuguccccagagcucccuggggagugaggggugggcaaagccaacuaagcacccu

SEQ ID NO: 7463 - RNA, 71 nt, Human
gggguuauaaugagaagaaaauaacagacaauauucagugugagauuuuucaaguucuuuaugaagaagcc

SEQ ID NO: 7464 - RNA, 93 nt, Human
gggguucauucacauugcaagauuauucccacuugucuuugaugaacucagggcaugugaacgggugauugggaccagugugaaugagccacc

SEQ ID NO: 7465 - RNA, 62 nt, Human
gggguucuccggggaauccuccagcuuggucagcaaguucucgggguucuccggggaauccu

SEQ ID NO: 7466 - RNA, 62 nt, Human
gggguucuccggggaauccuccagcuuggucagcaaguucucgggguucuccggggaauucu

SEQ ID NO: 7467 - RNA, 89 nt, Human
gggguucugcuuuuuuuacccaggcuggagugcaguggcacaaucucagcucacugcaaccuccgccucugggacucgagcaauucucc

SEQ ID NO: 7468 - RNA, 75 nt, Human
gggguucuuguaguugaaaaacuugagcccauggggacacuauacaagggcacaaguuuuccaacuaugaacucc

SEQ ID NO: 7469 - RNA, 101 nt, Human
ggguacauaucaguauacgacauuaauauaucucccuguccccaauuagguuaucagucacuugauggaggagauuguauguuauauauuacuuuguauuc

SEQ ID NO: 7470 - RNA, 68 nt, Human
ggguacaugugcacaaugugcagguuaguuacauauguauacaugugacaugcuggugcacugcaccc

SEQ ID NO: 7471 - RNA, 78 nt, Human
ggguagacuauuucaguggaaaaaucuggaacucaagggcuguuguucagauucuuuuguaccacguugguggucccc

SEQ ID NO: 7472 - RNA, 85 nt, Human
ggguagauguuuucuuggcagccauauuuguaggcacugcuggauacuuuaguguuagaaguggcuauuaagagacgaguuuccc

SEQ ID NO: 7473 - RNA, 79 nt, Human
ggguaugaugucagcuugaacagucauggccucuucuucuguuuccaauucuguuucuugauuuugaacuuccucaccc

SEQ ID NO: 7474 - RNA, 71 nt, Human
gggucaagccagcaccugaugaaacuuccuucagugaggccuugcugaagaggaaucaggaccuggcuccc

SEQ ID NO: 7475 - RNA, 80 nt, Human
gggucaagcugaaaaggcaagguuucuucaacuggcuugagagcuaugagguaggcuguuuccuucuuucgcuuuguccc

SEQ ID NO: 7476 - RNA, 62 nt, Human
ggguccucuucuuuucccagagcuccaccccaaccaggagcucuagauaauggagagcuccc

SEQ ID NO: 7477 - RNA, 62 nt, Human
ggguccucuucuuuucccagagcuccaccccaaccaggagcucuaguuaauggagagcuccc

SEQ ID NO: 7478 - RNA, 104 nt, Human
gggucggcaggaaguugcggcugaugagcagcucccggagcgguggggcggggccuccucuucuccaguuccaguacgcucaucagucguccuccugcugauuu

SEQ ID NO: 7479 - RNA, 94 nt, Human
gggucgucgccucguccagucucucuggguggccaugcuugguuuuauguaacucuggccuagggcaucccacugacucuaugaggagugaccc

SEQ ID NO: 7480 - RNA, 108 nt, Human
gggucuaaugcuauuccaaaagguuacuucucaaauuagggaaaccugggaauuugaagcgauacagguccagcccuggggcaaguaacuggaaggguuuauaggccc

SEQ ID NO: 7481 - RNA, 76 nt, Human
gggucucaccuuuagccucugcccccaguucuggucugacccaacagaggggcucuaugauauuaagaaggggccc

SEQ ID NO: 7482 - RNA, 72 nt, Human
gggucucuuuucggcgcucuagaggcagagggaggggaucccugucgugacaagagcgccugucugcgaccc

SEQ ID NO: 7483 - RNA, 61 nt, Human
gggucuuuggaggggaguuugccucucccaacggagagcaguucuaccacuacaaggaucu

SEQ ID NO: 7484 - RNA, 81 nt, Human
gggugaucuaccaaaacaguuugaguuuuaaauuauccagugcagugguuccuagacucacuuugugcauggaggcagccc

SEQ ID NO: 7485 - RNA, 110 nt, Human
gggugaugccaccuccugggugggugaugccuccucuggguggugauaccuccucuaggugggugaugccuccucuggguggugauaccuccucuaggcgggugaugccc

SEQ ID NO: 7486 - RNA, 88 nt, Human
gggugcacugugcuggaccaacccugauucugcuggggcuagcgggucuccauuaggaguggggugcuccguccggcacagugugucc

SEQ ID NO: 7487 - RNA, 80 nt, Human
gggugcagugaguggccucaaaguugugcagaugcuuccgagccagaaacaaagccagcugccgccguccaucugcacuc

SEQ ID NO: 7488 - RNA, 94 nt, Human
gggugcauggccggaugucucugggacugaacgggggagggagugugaucugcugcuccuccaaauucccacaaggacuuuccuaucaucacuu

SEQ ID NO: 7489 - RNA, 114 nt, Human
ggguggaaggaaaucugaggacaguucuaaggagucuugucugcuuucagugcgaucuucuagucauacugaagacaauaccucuccagauuggucuuuccccuucuucuccuc

SEQ ID NO: 7490 - RNA, 61 nt, Human
ggguggcggcgaggacgagucugugcuccaucagcugccgcacccgccgccucccgccccc

SEQ ID NO: 7491 - RNA, 82 nt, Human
ggguggcgucauggaauggguguggucuaagccaggucuccagauaagggcauucugccucuuccuucucuugucgccucuc

SEQ ID NO: 7492 - RNA, 92 nt, Human
gggugggagggaggauggugcgucauuuaacauuaaauugccucucucuacaguauguggcugagcaucauggaccuuccucccucugcccc

SEQ ID NO: 7493 - RNA, 60 nt, Human
ggguggucggauggcagcgugacgccaguaucauuuccagcauuuccaucuuuaccacuc

SEQ ID NO: 7494 - RNA, 62 nt, Human
ggguguaugguucuguaaaaaccagugaauucuauuuuucaagguuuuuggaaagcacaucc

SEQ ID NO: 7495 - RNA, 73 nt, Human
gggugugugcccacaacacucuaggugcagagccccugggcaaaguauuacagggugugaguggggauuaccc

SEQ ID NO: 7496 - RNA, 80 nt, Human
ggguguugaccuuggccacaucaaugucauacagcuucuucacagccuguuuaaucuggugcuuguuggcuuuaacaucc

SEQ ID NO: 7497 - RNA, 85 nt, Human
ggguuaucugcaacugagaggggcugguuaaggcguccccaaguuggaagggcgcuuugcuucuguuuucuggaugcagaguccu

SEQ ID NO: 7498 - RNA, 66 nt, Human
ggguucaaagccuuuauugggucagggcuugcuccagagcucaggggccagguaggucaggagccu

SEQ ID NO: 7499 - RNA, 72 nt, Human
ggguucacagcaguaggggcugggcuuccagcaggcucaugauucaggccuuaacccuugcccugggagccc

SEQ ID NO: 7500 - RNA, 74 nt, Human
ggguuccaaugggugcacaguuccaaaaauguggagggacccuucucaguuuugaggccaugaauccaaagccc

SEQ ID NO: 7501 - RNA, 77 nt, Human
ggguuccuguucacucuugacucuguggcaaauuguauuuacaguagaccgcugacguuucccaaguggacagaucc

SEQ ID NO: 7502 - RNA, 62 nt, Human
ggguucggggcggaggcccgggggggugcgcgcgcccgggguccggccucucacucgcuccc

SEQ ID NO: 7503 - RNA, 78 nt, Human
ggguugagauugcuguccucccaaaggugaugucgguccugacgcuccucaucuaugaacugcucagagucuccuccc

SEQ ID NO: 7504 - RNA, 114 nt, Human
ggguugauauuauuggcacauucccuccaaaugacagacaucaucucuucuccugaauuuauggggcugaguuucucauuuguaguauggugugugucucugcauauggaacuc

SEQ ID NO: 7505 - RNA, 84 nt, Human
ggguuggcugguuucaugguggguugguucaugagcagccuccuguucuaugaggcuuuucaacaguuucacauccagcugccc

SEQ ID NO: 7506 - RNA, 88 nt, Human
ggguuggggggacuucagaucauacagucugccauggagaaaagaacuugcuggcagacagccugaugguucagaggcuccagugccc

SEQ ID NO: 7507 - RNA, 82 nt, Human
ggguuuccugucccucagcuccuguccuuuguuccuggacagcaacgacacagaggaccagcuuggagguucaggaaaaccc

SEQ ID NO: 7508 - RNA, 65 nt, Human
ggguuuuaaguaugccaaugaggagaguugccaaagucaucucuaacucaggcaucucuggaucc

SEQ ID NO: 7509 - RNA, 78 nt, Human
gguaaaguggggaaggccacaucugagcggggucgcgcucggugauuguuccuggccaguguggagucucuaaacacc

SEQ ID NO: 7510 - RNA, 110 nt, Human
gguaauuuuuuguugaaggaggcuguucugugcauuguuggauauuuagcagcgucccugaccucaguccaauagaugccaguaacaacucccucccgauuaugaucacc

SEQ ID NO: 7511 - RNA, 110 nt, Human
gguaauuuuuuguugaaggaggcuguucugugcauuguuggauuuuuagcagcgucccugaccucaguccaauagaugccaguaacaacucccucccgauuaugaucacc

SEQ ID NO: 7512 - RNA, 74 nt, Human
gguacaguugguggcuaucaaauuaggacucaguaauuacuugugucacugagugaaagcugcucauugcugcc

SEQ ID NO: 7513 - RNA, 102 nt, Human
gguacuagacuauuaugcagauggugcccaagaucuuccuggcccccagcccagggucacccuccuuuaggaagauuguguauuuagcugaugaccugugcc

SEQ ID NO: 7514 - RNA, 85 nt, Human
gguagaaggcaguggcaagagggguucagguagggggaugaugagggaacaccagacuuggcuaguugggccacugcuagaagcc

SEQ ID NO: 7515 - RNA, 60 nt, Human
gguagcaggccccaaguuauuauuccccgcccugaauauucaucuuguagcagcucugcc

SEQ ID NO: 7516 - RNA, 61 nt, Human
gguaggaaugaggcuagaccuuuaacuucccuaaggcauacuuuucuagcuaccuucugcc

SEQ ID NO: 7517 - RNA, 93 nt, Human
gguaggaggaucgcuugaguccaggagguugagguugcagugagcuugugccacuguacuccagccugagugacagagcgagacccuguugcc

SEQ ID NO: 7518 - RNA, 89 nt, Human
gguaguagccauggcggccaugaguuuguugcggcggguuucgguuacugcgguggcagcucugucuggccggccccuuggcacucgcc

SEQ ID NO: 7519 - RNA, 97 nt, Human
gguauaaucuagcagucuguggauuugauccuuccaccucauaaaaaaggcauaggugggcaguauaauugauuugcagggauaugcuagaauuacu

SEQ ID NO: 7520 - RNA, 117 nt, Human
gguauuucccaagucucugggugguuggaaggcuguggcuggucucaguuggguuacucaaugcccaggaggggcugagcaccagccauaucuuugcuugguucacaugaugauacc

SEQ ID NO: 7521 - RNA, 79 nt, Human
ggucaaccggggagcggcagaaccagaguucgaaggaaaccuuucugaaucugacgucugccccuucuaaauuaggacu

SEQ ID NO: 7522 - RNA, 95 nt, Human
ggucacagaaggauagagccugggggcaaaaugucuaacuugucuacauggggaccacaguucacauuaugcaucucaggcuccacagugaggcu

SEQ ID NO: 7523 - RNA, 77 nt, Human
ggucaccacgccagagaggauccgcccucgaauggacacauuaccagugaaggggcauuucuuggcaauguggugcc

SEQ ID NO: 7524 - RNA, 63 nt, Human
ggucaccccgccggccccgacgggcgcccuggcgcccggggguacccagaggcgggaaagacc

SEQ ID NO: 7525 - RNA, 67 nt, Human
ggucacucauacuacagacacuuggccuaugacugucaucuaggucaucuggauccugaaguugauc

SEQ ID NO: 7526 - RNA, 102 nt, Human
ggucacucaucuguuuguucauuccuuuaacaaguaugugucgagugccuacuaugugcugggcacuguagguucaaugguaagaaaagcagauacaggacu

SEQ ID NO: 7527 - RNA, 81 nt, Human
ggucaggaguucaucuugauuuuuacauuugaaaauaaugaaauaaauuuacaaaauaaaaggaaaagugaauaucuuucc

SEQ ID NO: 7528 - RNA, 76 nt, Human
ggucaugauguuggauucuguugccuggguaccaccagagggaaagcuggggcggagggauuuguucguguugacc

SEQ ID NO: 7529 - RNA, 74 nt, Human
ggucaugugaagcguacgugugugugcauuguauguguguguacauugugugugcauugugugugcauguggcc

SEQ ID NO: 7530 - RNA, 93 nt, Human
ggucauugugcccugccaagcacagcguagaucuggaaagagcagaauguuauccuuuucagauguggcuggucauggaaggggcaguugucc

SEQ ID NO: 7531 - RNA, 91 nt, Human
gguccaauugguuccaagacgcguaggcgaguaggucugaaagcccccgguaucauaccucgaaucucagugcggggaaccaaugcagacu

SEQ ID NO: 7532 - RNA, 74 nt, Human
ggucccucuggcgccguucgguuucucuuauugccuucacugaggaugagucccuuuguggcucuauguggacc

SEQ ID NO: 7533 - RNA, 74 nt, Human
ggucccuucuaugugaaaagagaaggugggcugaagccucuaagaucuucuccaguuuucacauaguauggacu

SEQ ID NO: 7534 - RNA, 93 nt, Human
ggucccuugaauuuccauauuaauuuuaagagcagcuugucaaauugugcaaagaauuuagcugugauuuuaguaggaaauuuauuuuagauc

SEQ ID NO: 7535 - RNA, 86 nt, Human
gguccggcugcccuugaccgguccgaccuggcguccuccccgauaagccgccccacgggccggucccccgggccacaccgccggcc

SEQ ID NO: 7536 - RNA, 60 nt, Human
gguccuccuccuggacguuguaaaucaggaccccaccauaacuuaacaggaggacggauc

SEQ ID NO: 7537 - RNA, 63 nt, Human
gguccugguguacaauaauacauccauuguucaggaugagauucuugcucaccgucuggggcu

SEQ ID NO: 7538 - RNA, 83 nt, Human
gguccuguucuuacuaucucaaaaaugggcaucgaacaaucaaucuaggagcguggcaguggguaaaaugguggacaggcacc

SEQ ID NO: 7539 - RNA, 71 nt, Human
gguccuugccaucuccuuccaucugcccauuaacucucgcaagugccuccgugaggagauucacaaggacc

SEQ ID NO: 7540 - RNA, 125 nt, Human
ggucgcgcucacugcagauuggagaacaggugcaucucguagcucuucuuuggaaacaaaagaagccaccagcugaggaagaugcucaccggucaccgucccuuuauuuaugcccagcgaugacc

SEQ ID NO: 7541 - RNA, 72 nt, Human
ggucgcggagauggaauuggagcagagagaagggaccauggcagccgugggcuuugaggaguucucagcgcc

SEQ ID NO: 7542 - RNA, 82 nt, Human
ggucggaauuuugggauggcgcuguagcagcggcugucagucguagcccgugcgcccgcgccuguccugguccgguccggcc

SEQ ID NO: 7543 - RNA, 64 nt, Human
ggucuaugucaugaaugaacucggaggugaggcucuccucuagucaaggucaaauucauggguc

SEQ ID NO: 7544 - RNA, 99 nt, Human
ggucuauuucauuauugguggguagcgcauuuaacaguuaaauacauuuaaauaauguauaggugacugcaggacugcagcauugguaacuagauaacc

SEQ ID NO: 7545 - RNA, 75 nt, Human
ggucucacugaccccacaaggggcucuggagcugggauggccccagaggguuucccaaguuggggugaggaggcc

SEQ ID NO: 7546 - RNA, 74 nt, Human
ggucugauuggguuugguuuaguauuccuaugagcguaaaugguaaaauucuucugauacccacucuuuagacu

SEQ ID NO: 7547 - RNA, 78 nt, Human
ggucuguguguguagugagaguguguagccacuauuauaacuggaauuuaauuuacauucauaaacuacuauauuucc

SEQ ID NO: 7548 - RNA, 79 nt, Human
ggucuugaucuccugaccucgugauccacccaccuuggccucccaaagugcuggcguuacagguaugagucaccgcacc

SEQ ID NO: 7549 - RNA, 101 nt, Human
ggucuuguacuacuuccaagauugugcuaauuagugacaaacauugggcuuucccuucaauguuauggucuuuaugaaaacaaacaggauaguucagggcc

SEQ ID NO: 7550 - RNA, 82 nt, Human
ggucuuguugaacaguguguagacuaguggguugacugcugaagagagauaaccgauccaaacaaacacauugagcagggcc

SEQ ID NO: 7551 - RNA, 61 nt, Human
ggugacaacaugcuggagccaagugcuaacaugccuugguucaaagggauggaaagucacc

SEQ ID NO: 7552 - RNA, 61 nt, Human
ggugacaacaugcuggagccaagugcuaacaugccuugguucaagggauggaaaagucacc

SEQ ID NO: 7553 - RNA, 61 nt, Human
ggugacaacaugcuggagccaagugcuaacaugccuugguucaagggauggcaaagucacc

SEQ ID NO: 7554 - RNA, 61 nt, Human
ggugacaacaugcuggagccaagugcuaacaugccuugguucaagggcauggaaagucacc

SEQ ID NO: 7555 - RNA, 82 nt, Human
ggugagacagggagucccggcugcccuguggccccauucuguuguggaggcuucgcugggagcugagaacacccugcugucc

SEQ ID NO: 7556 - RNA, 79 nt, Human
ggugagagaauucauaaauauuaguuaaggaucuaaaacaaacuucucaaauaacugaaagcugaaaccucuggaagcc

SEQ ID NO: 7557 - RNA, 71 nt, Human
ggugagcaggaugagcacccuguaggccacacgaacuuucugguccucuuaucuccugccuccuucucacu

SEQ ID NO: 7558 - RNA, 75 nt, Human
ggugaggcuaggaccuggcccagggcaacugucuccucaacagcauuugcgccuccauuccauuuaguuuccacc

SEQ ID NO: 7559 - RNA, 99 nt, Human
ggugaguccuucaacuacaucugcaagguuuuauuucuuaggaaaauauuuaaagcaaauauuucaaaaaugacuaaaucugagugguagggagucacu

SEQ ID NO: 7560 - RNA, 103 nt, Human
ggugaguugggagcugugauggaucuguuggcggguuuuggauguguaaagaaugauauauauauuaaauaggucaaucagacuaugacagcuauguacgacc

SEQ ID NO: 7561 - RNA, 98 nt, Human
ggugcaaacaccccguucauguaacacgggccugaggucagcaguagaggaccaguauugguuuuggccccagccucugcguggauggauugaacgcc

SEQ ID NO: 7562 - RNA, 90 nt, Human
ggugcacccuguggaauuuggcagaaaaggcccaaucgcccuuuagagggugaacugaagccuguuccugcaauguucuaaggagugccc

SEQ ID NO: 7563 - RNA, 82 nt, Human
ggugcacgcauguaaucccagcuacucaggaggcugaggcaggggaaucgccugaaccugggaggcggagguugcggugacc

SEQ ID NO: 7564 - RNA, 87 nt, Human
ggugcacugcgagcgcgcgcggaccgcgcacaggcggcggagccgguaugggcccgccuggcccugggcgccgcgccgacgagcacc

SEQ ID NO: 7565 - RNA, 90 nt, Human
ggugcagcagucagcagcaaagugaaagcuguucagaacuacuggauuuuccaguggaagcuuugacaucauuaacucugucucugcauc

SEQ ID NO: 7566 - RNA, 98 nt, Human
ggugcaggguggggugggagugggcagcugccgcuacaccagcagaguaagacugcaggggugcagcccucccucccaugcccuucuguucagacacc

SEQ ID NO: 7567 - RNA, 65 nt, Human
ggugcaguaccgcggcgaggugcaggccaugcucggccagagcaccgaggagcugcgggugcgcc

SEQ ID NO: 7568 - RNA, 77 nt, Human
ggugccaagguaggggacagggccugggggugguuuugagggcaggcugccugggguguuguccucuucuugggauc

SEQ ID NO: 7569 - RNA, 109 nt, Human
ggugccagcaacagcugcaaccaggaucuugacauagucacuaguuggugaggauacaucagcuaucucaguauuuggggucacuggugcuucagugcuuuugcgcacc

SEQ ID NO: 7570 - RNA, 69 nt, Human
ggugccaggagaagcagcaucugcugaaagucagcuugcugguuugcagauggcugucuuccuguugcu

SEQ ID NO: 7571 - RNA, 76 nt, Human
ggugcccauccuuauguacauaguguuuucaauguuuagcuccgacuaccaaacgagaucaugcagcuaggauacc

SEQ ID NO: 7572 - RNA, 73 nt, Human
ggugcgcggugcucacagcucaucguggugccgggucacgguccucgccauaguugagugagccugacgugcc

SEQ ID NO: 7573 - RNA, 75 nt, Human
ggugcgggagcgacggggcccagggauuguguuuaaaguagugcuucuaccaacaugucccgugguuccagcgcc

SEQ ID NO: 7574 - RNA, 72 nt, Human
ggugcgugacgucucagaagaagggauucacucaguacuacuguacccccacuucgugacuagaauugcacc

SEQ ID NO: 7575 - RNA, 75 nt, Human
ggugcucagcagcgagaggacgcgucacucugccguucugcagggugacgcccuccccguaccucgcugagagcc

SEQ ID NO: 7576 - RNA, 74 nt, Human
ggugcugucgggcggaccaccauguauccgggcauugcugacaggaugcagaaggagaucaccgccuggcgccc

SEQ ID NO: 7577 - RNA, 80 nt, Human
ggugcugucgggcggcaccaccauguauccgggcauugccgacagaugcagaaggagaucaccgcccugggcccagcacc

SEQ ID NO: 7578 - RNA, 84 nt, Human
gguggacacuucugccacccuauucuguagccccagacagagauggggaaacauaugccuggagugacagagccuuccuccacc

SEQ ID NO: 7579 - RNA, 76 nt, Human
gguggacgggcuccugcggcaaggggacaugcuucgggcauuccaugcagccuugcggaacucucccgucaacacc

SEQ ID NO: 7580 - RNA, 71 nt, Human
gguggagcagaaaggcaggaguccugcucccuggcaccaucauggagcaugcccagcccagaucugccccc

SEQ ID NO: 7581 - RNA, 72 nt, Human
gguggagcagaaaggcaggaguccugcucccuggcaccaucauggagcaugcccagcccagaucugcccccc

SEQ ID NO: 7582 - RNA, 61 nt, Human
gguggagcgguucauuuauuuggaaacuaugacaugaaaaccaaauuugaaaacucacauc

SEQ ID NO: 7583 - RNA, 63 nt, Human
gguggaggaucacuuuugcccaggaguugaagaccagccugagcaacacagugagacuccauc

SEQ ID NO: 7584 - RNA, 84 nt, Human
gguggcacauugauuauaacacacagcugaggucucgaucacacuagaugucuccagucagucguguggaaaucgaugugcuuc

SEQ ID NO: 7585 - RNA, 86 nt, Human
gguggcacuggcaggaugugccuccugaggugugucgaguguucucuacauggggcacuguggaggugucaucggcucaguucccc

SEQ ID NO: 7586 - RNA, 88 nt, Human
gguggcccaagcguugccugcagguugauggcaggggcacgucaaggcguaacccuggaucugcgcauugcuggaccuaugggccacu

SEQ ID NO: 7587 - RNA, 86 nt, Human
ggugggauuggauuggagaugagguucgaauaaagucaguucauuacuugacacccgaacagugucuuuucuccaaaacuucuacc

SEQ ID NO: 7588 - RNA, 82 nt, Human
gguggggaugaaagcugagaaagcgaagaggugguucaggggaucacucuuuccuacuuguuccucucaccucaaacucacc

SEQ ID NO: 7589 - RNA, 60 nt, Human
ggugggggacacaggugcgcagcugcacagagucagcagcagcagccugcuccccgcacu

SEQ ID NO: 7590 - RNA, 78 nt, Human
gguggggggcgaacacgccgcgguccucgucgugugaaguaagaacucugcuagagaggaaauggcugcuucaucauc

SEQ ID NO: 7591 - RNA, 87 nt, Human
ggugggugaguuggcugccggugaguugggugccgguggagucguguugguccucagaauccccgcguagccgcugcuccuccuacc

SEQ ID NO: 7592 - RNA, 75 nt, Human
ggugguacaggauggcauagugaaggcccugaauguggaaccagauggcacaggccucaccugcagccuggcacc

SEQ ID NO: 7593 - RNA, 87 nt, Human
gguggugaccuggaagguguuguaggcauagucacagaaggugaccaccuuuugugcacgcucccggccacgcaugagguucacgcc

SEQ ID NO: 7594 - RNA, 81 nt, Human
gguggugccaaguguaucccucgcguuuaaagaggggauggucacacuauuccaagaaacuggggcaggcagggaaccacc

SEQ ID NO: 7595 - RNA, 73 nt, Human
ggugguggacugcacuccggggccauuuaaugucuuuaggccuugagucucggcuucggucccagucaacgcc

SEQ ID NO: 7596 - RNA, 68 nt, Human
gguggugggugugaggaagggcugggcacuuucacugucuuuuccuucauaaacuggcaagcacuacc

SEQ ID NO: 7597 - RNA, 127 nt, Human
ggugguuuguuucaccuaucaacccgucaucuagguuuuaagccccgcaugcauuagguauuuguccuaaugugcugcuucccuuuucccccaagacccugacaggccccugggugugauguucccc

SEQ ID NO: 7598 - RNA, 71 nt, Human
gguguaaauguugagccuuuuuggccuggcuuguuugcaaaggcccuggcaaacgucaacauugggaagcc

SEQ ID NO: 7599 - RNA, 63 nt, Human
gguguacagauuuuucacaagacuuggacagauuuaucaguccuggcuagacaaguccacacc

SEQ ID NO: 7600 - RNA, 78 nt, Human
gguguagaagcauuucuuuacugaaccuuaccagggagccauccaggauccugaagaguuuguggaaggaauggcacu

SEQ ID NO: 7601 - RNA, 106 nt, Human
ggugucggcgcgggagcagcacuuccacagccaagugcgggaguccacgguuguuuuugagcacguucacucucgcagugucagcuggggcuguuuugcuuuuacc

SEQ ID NO: 7602 - RNA, 76 nt, Human
ggugucggcuccgucaaccacuuuugugcaccuguccccacgaggacacauggacaauagugcgacugcugagacc

SEQ ID NO: 7603 - RNA, 88 nt, Human
ggugucuccucagaugauaacaguuuucauugacggcuacuaugaggaacccauggaugugguggcacuguuuggucugaggggcauc

SEQ ID NO: 7604 - RNA, 74 nt, Human
ggugugagcucugaggaguccugaacccugggugcagcauccuagcauccugggaguccuuuucugcccacacu

SEQ ID NO: 7605 - RNA, 73 nt, Human
ggugugcccgaugugcagcgagcaguucccuccugacuaugaccagcagguguuugaaaggcaugugcagacc

SEQ ID NO: 7606 - RNA, 71 nt, Human
ggugugcccggaaccggcccuugguggggaaauaaugccuuugcuaagggggccccggauuccgggucgcc

SEQ ID NO: 7607 - RNA, 63 nt, Human
ggugugguggcucaugccuguaaucccaggacuuugggaggccaaggcgugagcaccugcgcc

SEQ ID NO: 7608 - RNA, 79 nt, Human
gguguuccugaaguaucugaaaaauaugaaauuagcucuguucccacuuuucuguuuuucaagaauucucagaaacauc

SEQ ID NO: 7609 - RNA, 60 nt, Human
gguguuggcgggggcggagggcaggggaacgggauccuucucccgcugcccaccaacacc

SEQ ID NO: 7610 - RNA, 95 nt, Human
gguguugggucugccgugccucccuuccuuccuccucuuggggccacuggcugcuccaguuccccauccguggcaagccgguagagccauucauc

SEQ ID NO: 7611 - RNA, 92 nt, Human
gguuaaacucugcuuauucauguuuaaagacgcugaaaacuuauguuuucagauuuuuauuccccuaacaggauaaaagccugguuaccacc

SEQ ID NO: 7612 - RNA, 75 nt, Human
gguuagagaaacucaucagaagaaaguuucaaucacuucacuguuauuuucugcaauucuuauucucuuauagcc

SEQ ID NO: 7613 - RNA, 102 nt, Human
gguuagcagagaaacuuggaaaguucuguguuaggaucuugcuggcagaauuaacuuuuugcaaaaguuuuauacacagauauuuguauuaaauuuggagcc

SEQ ID NO: 7614 - RNA, 100 nt, Human
gguuagguaacccuugugacccuguaugaagguccacuuccuuccuuuccuccgggagggaauggucuucguggcuuggaauuauaagucaaccugcacc

SEQ ID NO: 7615 - RNA, 72 nt, Human
gguuauaguacuaccaauguuggugacuugguaagauuauauccaggugauugguguguguguauuauggcu

SEQ ID NO: 7616 - RNA, 106 nt, Human
gguuaugaggcauuuuuugaaauucauauauccuuacuauaauagugaaucaucaaguguugaauguaagugcaguagaaauuaugaaaucucuugccacagaacc

SEQ ID NO: 7617 - RNA, 87 nt, Human
gguucaaauguaagucccuccgaugccuucuuucugcuccccgcgcagugcauagugaggccacugcugcuuacccuucccggaacc

SEQ ID NO: 7618 - RNA, 69 nt, Human
gguucaccggcuucaugguaugcgcggguauuuccgaaaaagcuaucuuaagcuggaacauuuugaacu

SEQ ID NO: 7619 - RNA, 72 nt, Human
gguuccuguuguuaucuguaccuaaguuacucaguucugagugcaugucugguacagauaacaacaggagcc

SEQ ID NO: 7620 - RNA, 76 nt, Human
gguucgggccaagcggggcacagcccagggcuucgggaugcccgaggugggccaucacacucugcuggagccaacc

SEQ ID NO: 7621 - RNA, 81 nt, Human
gguucuucaguugcuucaggccaucuggauguauaugugcaggucacaggguuaugauggcuuagcuugggcucaggggcc

SEQ ID NO: 7622 - RNA, 105 nt, Human
gguucuucaucuuguguuugaagacaagaagcuggauccggaacuccugcucugugagguccaggaagccagccagcuuggccacaggcauggugguguagagcu

SEQ ID NO: 7623 - RNA, 94 nt, Human
gguucuugcagauucccaaggaaaugucagaaaggcaaaauggccagcauuauccauuugcuuuuuuggguuuacugggugaauagcacuuucc

SEQ ID NO: 7624 - RNA, 64 nt, Human
gguugaacaaugcucucacauuacaggaauuuagggccuagaauguguaaggcucuugccagcc

SEQ ID NO: 7625 - RNA, 82 nt, Human
gguugcacaacgagcacagcccggacuaugaguuggagaucuaaauucugaucugagucuggaacugacaaguugugugacc

SEQ ID NO: 7626 - RNA, 100 nt, Human
gguugcgcagagguggucuuauccagcucagcuuccccugggacccaccgugggaccugaggcagaacugggguggacuuggccuccuccauggcacacc

SEQ ID NO: 7627 - RNA, 71 nt, Human
gguugcugcugcccaaggaccgcggagucggacgcaggcagaccauguggacccuggugagcuggguggcc

SEQ ID NO: 7628 - RNA, 130 nt, Human
gguuggcuuucuuuauaaggugggugaggaagacuaacaaaaguaaugugagccagugucuucaaaaggggggcugaaaccaguugcaaaaaaugucagucuauagccacucccaacccaccuacuuccc

SEQ ID NO: 7629 - RNA, 105 nt, Human
gguuguauguuuugaccacuuccaccuaugaaaauuaucugaacauuauucagauuuaagaguucaugggagcaggugguacagaaccuaguguugaauauaauu

SEQ ID NO: 7630 - RNA, 111 nt, Human
gguugugggcagagcuccuggcccggaugcugucuccuguucuaucgagagacuuggaagaucagcacugagauuauuaugagcagaauggucaggaggaugcccagagcc

SEQ ID NO: 7631 - RNA, 77 nt, Human
gguuguuaacaucugacacagugagugagaaaaaauccagcacagucacugggcagguuuaagaagaaguggcagcc

SEQ ID NO: 7632 - RNA, 72 nt, Human
gguuguuuuuaaaaaagcucuucuguuuaaaacauauuuguaaaacaagauuuggaugacauggaagcaauc

SEQ ID NO: 7633 - RNA, 89 nt, Human
gguuuaaacaagauuggaaggaacaauuuaaaagcacucauguauaauugauaugucaaguuacuaaucauuccucuauucauuaaacc

SEQ ID NO: 7634 - RNA, 97 nt, Human
gguuuacuguguaccuauccugccuuaauucuagaaucagcucuuucuccaacaagcuuugguucuucuuaguggcgcaugauauguauuagagacc

SEQ ID NO: 7635 - RNA, 73 nt, Human
gguuuccaccuccugccuccggcccuccagaggggugaggccccaaccccagggcagcagaaggaugagggcc

SEQ ID NO: 7636 - RNA, 89 nt, Human
gguuugugauuuuucuguaaaggaaaaggcagggugauuuaaccaguuugaccaccuuuccuguacucuuacaggaaaaucgcagcacu

SEQ ID NO: 7637 - RNA, 78 nt, Human
gguuuucaagcaugcaaaacaguuuauuguaacuuacugaaaaauauuaacaauuaauugugaauacaugcuguuacc

SEQ ID NO: 7638 - RNA, 79 nt, Human
guaaaacaauggccauacucuguugaggaccaccaaggaaacuaucuuuuuacuuggucauuaacaaaugccuuuuuau

SEQ ID NO: 7639 - RNA, 125 nt, Human
guaaaucucccugauaccaucacucuuaaaccuuuagaaaugcuacagcaucuagcuucucuagaucaauaaucacagaggcuuaagugcugaccucauaaagauaaagaguucccaugauuuac

SEQ ID NO: 7640 - RNA, 107 nt, Human
guaacuagccauucucaugaugaaaugacauugguauuugagagggaacagaaaaaucacaguaccugcucuugaguucauucacgcuacagggaagagcuaguuac

SEQ ID NO: 7641 - RNA, 78 nt, Human
guaacucuucucuuguaccaggaagcagcuguaggugggguaaugggaucugucuccuggugcagaggggcagcuuau

SEQ ID NO: 7642 - RNA, 83 nt, Human
guaacugaauaguggaacucagaaagacauccuauucagaaggaucucucaugauaauaguuuccuucacuauuguaguauac

SEQ ID NO: 7643 - RNA, 106 nt, Human
guaacugcaaagaugcuguccgugcgcguugcugcggccgugguccgcgcccuuccucggcgggccggacuggucuccagaaaugcuuggguucaucuuucauugc

SEQ ID NO: 7644 - RNA, 93 nt, Human
guaagcagucuggauucguguuuauugaagccaguaauuagagacaucuuuuuuucccaggacuagaaagcaagguuccacaugacugcauac

SEQ ID NO: 7645 - RNA, 75 nt, Human
guaagcuaugugaguuuuacaaugcuuuuaaacugucauauuuccuguugagcacuuuaacuggcacauucuuau

SEQ ID NO: 7646 - RNA, 109 nt, Human
guaagggacuugaguauacuuggauuuuugguaucuguggguuggggggacgguccaggaaccaauaccccauggauaccaagggacaacuguacuuauuuaccuuuau

SEQ ID NO: 7647 - RNA, 81 nt, Human
guaaguccugcucauguauguuccuuuauuugaagcaaaccuacagguguuucuuaauaugacagaaucaugaagacuugc

SEQ ID NO: 7648 - RNA, 98 nt, Human
guaaguuacugacaagccucagcaaacccaaagauguuaacaguauuuuaagaaguugcugcagauuccuuuggccacuguauuuguuaauuucuugc

SEQ ID NO: 7649 - RNA, 76 nt, Human
guaauuucugcuuuguuggucaggguuuacagcauuaauggacagguucacccugaccuacaagucggaacgugac

SEQ ID NO: 7650 - RNA, 82 nt, Human
guacaccagagacuccgggucacucacugucagaauauucuuauacauacaaugagucuccacgccuguacaaugaguguac

SEQ ID NO: 7651 - RNA, 82 nt, Human
guacagaagugcaauguacagaagccacguguacauuuugugccaauuccguaccauguguacauucuguaccauucuguac

SEQ ID NO: 7652 - RNA, 130 nt, Human
guacagauaaggaauugagcgcagaaaaguugugacuugcucaaguuuucaggguuagaaaguggcaaagaccuaauucuaaaaaggcuuuauaauuacagauuuugugcucuuaucuuuuauucuauac

SEQ ID NO: 7653 - RNA, 60 nt, Human
guacagggagaucuggaguucuguuuccuccuguuggauucuagaacuccauguuaguac

SEQ ID NO: 7654 - RNA, 79 nt, Human
guacauaagugucaugcagcaggacgucacuguuggaagaagucuccucaugaccauaucccuguuguccauuguguau

SEQ ID NO: 7655 - RNA, 99 nt, Human
guacauguuaugggguacagagugauauuuugauauauuuaugcaauacguaaagaucaagucagagucauuaucauauccauuaccuaaaucauguau

SEQ ID NO: 7656 - RNA, 79 nt, Human
guaccaugaaugcgcuaaagcuggacuccaugacuguaccggaggcggcacaggguaccagcgacuaguaugauggugc

SEQ ID NO: 7657 - RNA, 71 nt, Human
guaccccucucagucugcaguauugaguuguuuaaaguauaugugcagucuugcuuacaaggagggguuac

SEQ ID NO: 7658 - RNA, 89 nt, Human
guaccgcucugucaucuagguuggugugcaguggaguggcauacuguuaauuucacagaguauauaauuuagguuuccaaagaggguac

SEQ ID NO: 7659 - RNA, 88 nt, Human
guacgaggcuggguuuacaugaagaucuggugucgccaugggcucgcgccccgcccguuguuaccgguauuguaagaacaagccguac

SEQ ID NO: 7660 - RNA, 91 nt, Human
guacgcugugacacaggagagcaagaucacguauuuggaaagagugaugacccaagacugauuaugaaucuccaaguaacacaucaaguac

SEQ ID NO: 7661 - RNA, 75 nt, Human
guacggcguguccucccugcagcgcggcguggccgacuacaugcgcgcgcaccuggcgggaggcgcgggcccggc

SEQ ID NO: 7662 - RNA, 81 nt, Human
guagaacccaauagaaauaugugauaaauaaauacaaugucaaguuagaaaaaauguuguaguuucauguuguugguuugc

SEQ ID NO: 7663 - RNA, 73 nt, Human
guagacauggucuuuucccucuagagcuuaccagaugagugugagauaaauagaaaaguaaacaugccauugc

SEQ ID NO: 7664 - RNA, 74 nt, Human
guagagacggggucuuguuauguuccacaggcuggucuugaacuccugggaccaagcaauccucccaccucugc

SEQ ID NO: 7665 - RNA, 72 nt, Human
guagagaugggguuucaccauguuagccaggauggucucgaucuccugaccucgugauccacccaccucagc

SEQ ID NO: 7666 - RNA, 67 nt, Human
guagagcuuuaugcugaaaagguggccacuagaggucugugugccauugcccaggcagagucucugc

SEQ ID NO: 7667 - RNA, 72 nt, Human
guagaggugggguuucaucaugggggccaggauggucucaaucucuugaccucgugauccgcccaccucggc

SEQ ID NO: 7668 - RNA, 86 nt, Human
guagaguuaagccuggcaggagcgugcucuguugcacuaaaugugugguggcaggccccucaaagccgugguuggaauaaucuuac

SEQ ID NO: 7669 - RNA, 81 nt, Human
guagauaaaaggugaaccaugugacaugggcauuuuuguaagucaaaaacaaauuucacauaugguaaaccuaauauucac

SEQ ID NO: 7670 - RNA, 71 nt, Human
guagcauguacauauugccgaucuggguucauuuauuccuuccagauuauuuauuaucuauuuacugcugc

SEQ ID NO: 7671 - RNA, 62 nt, Human
guagcgcagguacgucgucuguagcaggcaggaaucaguggcuacgggaugaccugugcaac

SEQ ID NO: 7672 - RNA, 71 nt, Human
guagcuuuaaaagucuugaucucuggugauguaagucaucuaacguccuuuguaaagacugccuuggcuau

SEQ ID NO: 7673 - RNA, 89 nt, Human
guaggaggagucagggauuuucugguuugagagacaaugacacacaccccuaaguucaccuucucucgaauaguaggcccugcucuuac

SEQ ID NO: 7674 - RNA, 60 nt, Human
guaggcaugacuaagggguaaggguugacuauucuugagcuaccucaccaacuugccuau

SEQ ID NO: 7675 - RNA, 79 nt, Human
guaguacagaagagaaaaucaguggaucaucuaugagucaagaugcccaucuuuggauuucuaauguuauacuagcuac

SEQ ID NO: 7676 - RNA, 85 nt, Human
guaguggguguugagauugaacgcuuucuuaauugguggcugcuuuuaggccuacuauggguguugaauuuuuuacucucucuac

SEQ ID NO: 7677 - RNA, 108 nt, Human
guaguuaccauugccuuuucugugagcuauuuguuuugguuugcugaaacuaguccaaaacaggaaauuuaacagacagccacagccaaagagugucaugugaauuac

SEQ ID NO: 7678 - RNA, 73 nt, Human
guaguucuugagcagugcgucaugguugugcgaguuugugucaaacuugcuguacgucugcuugaggaucugc

SEQ ID NO: 7679 - RNA, 72 nt, Human
guauacggggaccgcugaaagcuguggcuuuauaggauagggagagucauagcauaucaggucucauuaugc

SEQ ID NO: 7680 - RNA, 71 nt, Human
guauacuugaugggacaggcauugcccggugucaccauguugggcuugagcaggguccccuccagguauac

SEQ ID NO: 7681 - RNA, 72 nt, Human
guauauauaugauaaaugauuauaacgugugugucagugacaauauguagucuuugguuguuaguuauauac

SEQ ID NO: 7682 - RNA, 86 nt, Human
guaucucuuccgucuguuuguccauucuuuuaacacugggcuuuggcuucacuucacagguaggaggcugggcacaaaagggauac

SEQ ID NO: 7683 - RNA, 86 nt, Human
guaucugccagcagaauggcauggugcccaucguggagccugagauccucccugauggggaccaugacuugaagcgcugccaguau

SEQ ID NO: 7684 - RNA, 73 nt, Human
guaugagggaagggagguggaagcucauaucccaccccaggggguuuugaggaucuuuucccuucucucucac

SEQ ID NO: 7685 - RNA, 92 nt, Human
guaugcacagacagaguugggacaugggacauaucuucagggccuggagacugaagccaccuaugacgcagccacccaggaguuugugauac

SEQ ID NO: 7686 - RNA, 76 nt, Human
guauguaaacaauuauacauguauuuaucacccuaaaagguugaaacauguaaucaacuaauucucuucugcauac

SEQ ID NO: 7687 - RNA, 85 nt, Human
guauguuagacugggauugucuucaucaucaucuuuauccagucauacagcaggggugacagaaaaacauucucaggacucauac

SEQ ID NO: 7688 - RNA, 76 nt, Human
guauugcuauuuguuuaaagcacucacauaaauccauuucacccaaaaaggaaacauaaagugcuucuagcaguac

SEQ ID NO: 7689 - RNA, 76 nt, Human
guauugggcgcaggggcagaagucaggagcuuuguacuguuuuuauaugaucucaacuguuuuugugacuuauuac

SEQ ID NO: 7690 - RNA, 95 nt, Human
guauuuuuaguggagauaggguuucaccauguuggccaggcuggucuugaauuccuggccucaggugauccgccugucucagccccccaaagugc

SEQ ID NO: 7691 - RNA, 71 nt, Human
gucaaaaagcagucaucuauucauugaauuuuacagcaaacccaccucaaagaguauuugaacuuguugac

SEQ ID NO: 7692 - RNA, 89 nt, Human
gucaaauccacacauguauauucucucuaugcccaggcccaucugggggagggcagcccagagacacgugugcaccugugugggcugac

SEQ ID NO: 7693 - RNA, 71 nt, Human
gucaacagcagcuggaggaaaauggcaagaacuuggaaucaagauuagguuagaauaacacugcuguagac

SEQ ID NO: 7694 - RNA, 87 nt, Human
gucaacagcgacuucuaccggaggaugcagaacagcgauuucuugcgggagcucgugaucaccaucgccagggagggccuugaggac

SEQ ID NO: 7695 - RNA, 69 nt, Human
gucaaggauuuggguuggggcacccaggaagccugaggguuagcuggguggaccuccuggcuccucggc

SEQ ID NO: 7696 - RNA, 60 nt, Human
gucacccgggagcggagguugcgugagcaggauugugcgacugacuccagccugggugac

SEQ ID NO: 7697 - RNA, 73 nt, Human
gucacgaaagagugucggauucggaucgcugguggauugccagacgagguuuagggucgcggcuacaagugac

SEQ ID NO: 7698 - RNA, 97 nt, Human
gucacgauggcucaugccuguaaucccagcuacucaggaggauugcuugacccugagagguggagguugcagugagcucagaucacaccaucgcaac

SEQ ID NO: 7699 - RNA, 66 nt, Human
gucacuuuaaacugaggaaacggcaaaugguguuuuaaagcucuuuguauuucuccaguuucugac

SEQ ID NO: 7700 - RNA, 94 nt, Human
gucagaacccuuuuccacgugcagaauggcuuugauggcuugugugcgucauccguucuaagccauugcugaccguuccccugggggggcuggc

SEQ ID NO: 7701 - RNA, 71 nt, Human
gucagaggaaaaggcacuuugaaccuccuguaacgaugcugagguuuggacauucugacccagccccugac

SEQ ID NO: 7702 - RNA, 79 nt, Human
gucagauggagacugagaaagcaagauguuggcuaccagaaauggaguuucaaaaauuuucuuaaaagcucuauuggac

SEQ ID NO: 7703 - RNA, 84 nt, Human
gucagcagaucccagugaaggguuuuguguguuuaggccucauuucuuugucuuuuuccuacuccguuccuggcauuugcugau

SEQ ID NO: 7704 - RNA, 110 nt, Human
gucaggacuguuggcuaagggaaugucugcuuggacugaucauugaacaaucuuuccaacuaaaagcuucuaugauucucuaaguagcaaucagcaccgacaguuaugau

SEQ ID NO: 7705 - RNA, 75 nt, Human
gucaggccgguuuaaucggccgaggguucagucagagcuagaacauuccagaggucgcccagcuccggcgcugac

SEQ ID NO: 7706 - RNA, 97 nt, Human
gucaggggugcccauaaugaauuguguuuacccugagaacaaauccacuacauuggaauuuuaggcauaaccaguaucauuaaaaggagccccuugc

SEQ ID NO: 7707 - RNA, 108 nt, Human
gucagugccaauuuugccggucacacugggguccccaaagaagucaagguaaucauccugaaucugaaagaacucccccaucuccagcaggaucuucuuggcauuggc

SEQ ID NO: 7708 - RNA, 88 nt, Human
gucaguguuccagguguaucuuagcuaaaacuagagaaugcccuaacuuagaugguuuuugaagccuauacaauugguauuguuugac

SEQ ID NO: 7709 - RNA, 62 nt, Human
gucaguuguggaagaggucaucacuccccggaaggaccuggccucuuuaauccucaauugau

SEQ ID NO: 7710 - RNA, 88 nt, Human
gucaucaucaucaucaucgucaucaucaucaucuucacguuuucuuuucaaugcauuugaugauucauuggcaguauuuugugaugac

SEQ ID NO: 7711 - RNA, 81 nt, Human
gucaucuacaacaacaguguaagugaaccugcuguugcccucagcaacaaguucaccaucauuagagcccuguagaaugac

SEQ ID NO: 7712 - RNA, 71 nt, Human
gucaucuuucuccuccucuugguugguuuacaagaguagugaauacuucaguuauggacagaaagaaagac

SEQ ID NO: 7713 - RNA, 73 nt, Human
gucaugugaugcucaaucagcaaaccagggauuggcuucauccugggaaaaagcuaucugggugcaacaagac

SEQ ID NO: 7714 - RNA, 67 nt, Human
gucauucaagaguugcuuguggacuacuaugugaaagauacaagacacaaauguaacuucugaggac

SEQ ID NO: 7715 - RNA, 62 nt, Human
gucauuuuggguugccgugcucccaaaacauuuuaaaugaaaguauuggcauucaaaaagac

SEQ ID NO: 7716 - RNA, 99 nt, Human
guccacugauauucacuagccuguuuguccucaccccugaagcagauaaacacauguagauggaggaaaagugacaggcagguggguucaucagugggc

SEQ ID NO: 7717 - RNA, 60 nt, Human
guccagaagaagcuacuccuuccagcaggccuaauaggauggcaucuaauauuuuuggac

SEQ ID NO: 7718 - RNA, 64 nt, Human
guccauauuacccuucagcaccugagucccaagcugaggucucaacaugggugaugugaaggac

SEQ ID NO: 7719 - RNA, 70 nt, Human
gucccagaucacugccgcugaaccuguagggaccuuauaguacaaauuagaugcagcguagaucagggac

SEQ ID NO: 7720 - RNA, 66 nt, Human
guccccggcagcgguuggcgaguggggaccgaacccccgguucuccaugaucccgcuggccggggc

SEQ ID NO: 7721 - RNA, 64 nt, Human
gucccggcgaagagaagagacacauuguuggaaggcagcccaugacagcuucccuuccugggac

SEQ ID NO: 7722 - RNA, 106 nt, Human
gucccgggagcguguguucuccgaggaccgggcccgcuucuauggcgcugagauugugucagcccuggacuaccugcacucggagaagaacgugguguaccgggac

SEQ ID NO: 7723 - RNA, 87 nt, Human
gucccuaucacucggagcggagaccugagcuaugagucaucagugaggugcuauacucagagccauuccgcucaggucauggaggac

SEQ ID NO: 7724 - RNA, 64 nt, Human
gucccucaaauaaaagucacuuucacgagguggucaaggaaggccagugugcuuuuguagggac

SEQ ID NO: 7725 - RNA, 70 nt, Human
gucccuccgaacaagugaaaagagguccuuguaugucagggcccuguuugauuaugaucggacucgggac

SEQ ID NO: 7726 - RNA, 75 nt, Human
gucccucuucuccauccugcuggucguggaggacucccgauggucucugcgcaucaguggucauggcucugggac

SEQ ID NO: 7727 - RNA, 74 nt, Human
gucccugucauugguggccaugcugggaagaccaucaucccccugaucucucagcgcacccccaaggugggaac

SEQ ID NO: 7728 - RNA, 86 nt, Human
gucccuucccuccccaggccucgcuuccccagccuucugaaagaaggagguccaaggggaucgagggcuggcggggagaagcagac

SEQ ID NO: 7729 - RNA, 63 nt, Human
guccgcucugacucggcuggcgucuuucgcucgcguuggaggccgccuuuucagaagcggugc

SEQ ID NO: 7730 - RNA, 76 nt, Human
guccgggacucagggacuugguggccacgcagcuguccauagggagguugaaugguugcugcacuuugguccggau

SEQ ID NO: 7731 - RNA, 75 nt, Human
guccggggcgaggggcccaucuucuucuacacugggaacgagggcgacgugugggccuucgccaacaacucgggc

SEQ ID NO: 7732 - RNA, 85 nt, Human
guccuauaguguugaugcauuuucacuucugugguccuaggaaauggacuggucuaaagagagugaggcacaacacaagcagggc

SEQ ID NO: 7733 - RNA, 74 nt, Human
guccucccucaccagaugauuccuaggacucauggugcaacauacaggagccaggcuuuagggacggggaggac

SEQ ID NO: 7734 - RNA, 69 nt, Human
guccugcgccgucagcacaagccacgcuucagacacaagaggcccaagagcuucugcuaggugcagggc

SEQ ID NO: 7735 - RNA, 64 nt, Human
guccuucaugggccugcuggccauguacaccuacuuccaggccaagauaagggcccugaagggc

SEQ ID NO: 7736 - RNA, 78 nt, Human
guccuucuccuaggugggauaaaacucugggaaagccuuuuuuccucuggagaguaggauuuucuuguggagaaggau

SEQ ID NO: 7737 - RNA, 87 nt, Human
guccuugaacuuggaaccugacaauguugguguugucguguugggaaaugauaaacuaauuaaggaaggagauauagugaagaggac

SEQ ID NO: 7738 - RNA, 86 nt, Human
guccuugugcuccgcggcacccccaaggucacucaggcccugaacguccugaccacgaccuucgggcgcugccagagccccuggac

SEQ ID NO: 7739 - RNA, 85 nt, Human
guccuuugucauacauggcagcguaaguguaagcaaacucuucuaugaacacucgcucaaaccagccuuucagaauggcagggac

SEQ ID NO: 7740 - RNA, 93 nt, Human
gucgaccuguguaaauugucucaaaaauuugggggaagggaaauucauucaagcucuucccaaaaaguuuuugggaaccaaaaaaaaggcggc

SEQ ID NO: 7741 - RNA, 70 nt, Human
gucgcccaggccggagugcaguggugcgaucucagaucaguguaccauuugccucucgggcucaagcgau

SEQ ID NO: 7742 - RNA, 112 nt, Human
gucggagucacaggucuuuuguucgguggcagcauccacugcagaggcuaggcugucuuccuggccuuucagccuuucacggaucagcucggcaauggcccucugaguccgc

SEQ ID NO: 7743 - RNA, 73 nt, Human
gucggcuuuuauuauuccuaaacaaaagagcuuuauuuucucaugaguagguuuuagaguuuuaauuguugac

SEQ ID NO: 7744 - RNA, 87 nt, Human
gucgguggggcggggacgcgagguguggauggggggucgccuugaccucugccucagccaguagcgcagucucggccucgccguuac

SEQ ID NO: 7745 - RNA, 73 nt, Human
gucguagacggaauaguaggaccugaggaagacauccccgaggauccacaggggcuggccguucugggaggac

SEQ ID NO: 7746 - RNA, 61 nt, Human
gucguccccacagcuccggaagugcuuggcgccguugcgucacuuccggaucggggucgac

SEQ ID NO: 7747 - RNA, 74 nt, Human
gucgugcgugccccaacgaaggggggaaacaacccagacgggaagacccccaauaguggagagggccgcaucac

SEQ ID NO: 7748 - RNA, 70 nt, Human
gucuaauccuuuuuguagucacucauaggccagacuuagggcuaggaugaugauuaauaagagggaugac

SEQ ID NO: 7749 - RNA, 74 nt, Human
gucuaucaguggauggcauaauuaacuuuucgcauauuuugggcuuagaggucggauuaccauccgugguuuac

SEQ ID NO: 7750 - RNA, 92 nt, Human
gucucaaugccgcaggcaacuacuggucacccgggccagcugcagugucuggcugggguuaccguggccuggaguaccugcggcuccgagac

SEQ ID NO: 7751 - RNA, 102 nt, Human
gucucaccgagcaccuaggaggcaguccaggcucuuuagcaugguguuggaagcccuuaaugaucugcuacagccugggccuccagccuccucuccuuccac

SEQ ID NO: 7752 - RNA, 88 nt, Human
gucucacugagccuuagucgucggcaggucccaggcgcgaaguuucucggccuggaggagggggucgcgcgaagugccagaugcaggc

SEQ ID NO: 7753 - RNA, 61 nt, Human
gucuccagugauccacagacugcgauucagaaccgacguacagcuagguaucucuggagac

SEQ ID NO: 7754 - RNA, 66 nt, Human
gucuccgggguagcaggggcugcucugugcugggcugggccaguagggggcgcccucccugggagc

SEQ ID NO: 7755 - RNA, 70 nt, Human
gucucuuuuuaccuaguaagaguagacuucuuuaagucaaggaauaugcuuuauucaggugcucggcggc

SEQ ID NO: 7756 - RNA, 78 nt, Human
gucugaaacauuuuacuucauauuacacauacuuuucuuuuaaaaaaggcagaaacauugaaggaaacaacacucaac

SEQ ID NO: 7757 - RNA, 86 nt, Human
gucugauucugguuuugaguuacucuuuguucaguaacugcacuuuauuuuauuguccaaagagagucagagcuaagcauacaggc

SEQ ID NO: 7758 - RNA, 60 nt, Human
gucugcaauuaccacacaguuuggguuggaugugucgaucugaucaaauucugagcggac

SEQ ID NO: 7759 - RNA, 78 nt, Human
gucugccccagccuuguuuuacucccugcauuccauauucuguuguuccggcuugcagcccacagggcuggagaagau

SEQ ID NO: 7760 - RNA, 63 nt, Human
gucugcugccuuuuguuuagcuaagcccugcccacagagguugagucuauagaggcaguaggc

SEQ ID NO: 7761 - RNA, 71 nt, Human
gucuggaccugggacccacugcagauuauguuuuuccugacuuaacugagaaggcagguuccauugaagac

SEQ ID NO: 7762 - RNA, 79 nt, Human
gucuggaggcuaggaagugcaagaucaaggugccagcagauaugguaucugguuagggcccacuuccuaguuugcagau

SEQ ID NO: 7763 - RNA, 117 nt, Human
gucuggauuuuaaguccuugugcacggauggucucaagugaucaggauaguguggucgguacacccaaagcuugugaaugacuccauccaaagagcaucagucuguauucccaugac

SEQ ID NO: 7764 - RNA, 72 nt, Human
gucuggggcccugcgccugaugagcugccaugaaaguggccgccucucacacuggcaggcgguggcucagau

SEQ ID NO: 7765 - RNA, 63 nt, Human
gucugggugcaguuuauucugauuuacucugaggugagcugaaaucaggaccgcagcucgggc

SEQ ID NO: 7766 - RNA, 74 nt, Human
gucuuaagcugauuucagaaaacaaugcaucugucagaugucauuaagcaacaaucugggauacagaccuagac

SEQ ID NO: 7767 - RNA, 80 nt, Human
gucuuaucuguauuuuacugucugcucuuucugacugcuuguaaugagaagacaagugauuuucuugaaaugccugaggc

SEQ ID NO: 7768 - RNA, 84 nt, Human
gucuucaaaaugggguuuauaguaucaagugaggcuguuugguucuucugaaaacacacucauuuucugacacaugggcuagac

SEQ ID NO: 7769 - RNA, 76 nt, Human
gucuucauaucuccagguucugcuggagcaauuaccucccccaucuggcuccuuaggaccuagagguaguaaaggc

SEQ ID NO: 7770 - RNA, 68 nt, Human
gucuucuagaacgcuuggcguggaccucuuuaagugggucccuugcaagcguauuuccuuaagaagac

SEQ ID NO: 7771 - RNA, 72 nt, Human
gucuucuaugaaaaggcugauaaugggcugggcgcgguggcucacgccuguaaucccagcacuuugggaggc

SEQ ID NO: 7772 - RNA, 81 nt, Human
gucuugaaucucuauaguauucucaaauaagguccugaaacaacaggcuuuuauguuaaauucaauacuucugagcaaggc

SEQ ID NO: 7773 - RNA, 65 nt, Human
gucuugcuaggccaggucuuccaggugguuaccggggucacauggauuucugggcggagcgagau

SEQ ID NO: 7774 - RNA, 76 nt, Human
gucuuggggaagcuuuguuaaauuuuuguuaauguggguaaaucugaguuuaauucaacugcuucccuauauagac

SEQ ID NO: 7775 - RNA, 67 nt, Human
gucuugugcccacacugagccagcaaaguccugcugucacacccacaagcuccuugggggacaggac

SEQ ID NO: 7776 - RNA, 72 nt, Human
gucuuuggguaauuugaccccacgugcucucuggcccucaagcauguaaccucggggucugaggcccaggac

SEQ ID NO: 7777 - RNA, 74 nt, Human
gucuuuuguaaaucaaguaagaauccauuaaagaaauuaauuuuaaaugugcauuaccugguuacauaaaggac

SEQ ID NO: 7778 - RNA, 91 nt, Human
gugaacuuggcugggaccucagggcuuggagucagauagcuuugggaccuuggagacaugacuuaaccucucugggucucaguuuucucac

SEQ ID NO: 7779 - RNA, 91 nt, Human
gugaagacacgggagaaaauccaccauaauaaaacugacauucaauuuucaacuuuaguuauuuaacacagauuuucuuuauucucuuuau

SEQ ID NO: 7780 - RNA, 64 nt, Human
gugaagggcuugggauucguggcagcugaguccucacugaccaaggauugcccuugugcuuuac

SEQ ID NO: 7781 - RNA, 74 nt, Human
gugaauggaggugcucgugauguaaaacuucucauggggggaaccagggcauuacuuuuaaccaaaacauucac

SEQ ID NO: 7782 - RNA, 62 nt, Human
gugacaccacccaucuccaacauucagaugcccaggaugguaauggagguaaagugugucau

SEQ ID NO: 7783 - RNA, 79 nt, Human
gugaccuacuccaaugugugaggauggcuggacugccugcaugugccugccucgccccaugccuguggacuggaaacac

SEQ ID NO: 7784 - RNA, 72 nt, Human
gugacuacagccugccccugacuguguugucccagggcugaugcuguacagguacaggcuggagauuuucac

SEQ ID NO: 7785 - RNA, 60 nt, Human
gugacuccugcgggcgcccccacuucuuuuugggggugggagggccaggcgucggguuau

SEQ ID NO: 7786 - RNA, 62 nt, Human
gugacugccugguuaagaucuacaaaucugaugggauuaagggccuguaccaaggcuuuaac

SEQ ID NO: 7787 - RNA, 73 nt, Human
gugacuuugaugauuugaaaggagaacuagaugaauauguccaaaaauaccucccuggaaaaauuaaagucau

SEQ ID NO: 7788 - RNA, 90 nt, Human
gugagcgcacauagugucucacgugacuacuaguaugccaccugcaugaggcauuaacuuuaaacauggucugcgggacaugccgcucau

SEQ ID NO: 7789 - RNA, 89 nt, Human
gugagggccugccugggcccgugucauagucccugccccaggccgacggccugcaggucucgggggugacgcucgcuaggcgcuuucac

SEQ ID NO: 7790 - RNA, 94 nt, Human
gugaggggagcugugccuggauccugccuccaagucacaugagcacuagcucauaguggcagggugggggugggaggggcaggucuaaacucac

SEQ ID NO: 7791 - RNA, 96 nt, Human
gugagggguggcauaucggucgcuaccggaaaacucgcuaugggggcgcggcaugugccaacgcgaugcuugguaugccggaugucaaccuuucgc

SEQ ID NO: 7792 - RNA, 87 nt, Human
gugaggguggcuggacaaguuggguagaccugcaaaagggccagcggcucucugcauggcucuggccauccggcacuuucccuugac

SEQ ID NO: 7793 - RNA, 96 nt, Human
gugaggguuuaccacauaauccgggauuucuuggcaaugcccaaagacuuucugggccuucuaagagcaacaguggaucaagcugguaacccccau

SEQ ID NO: 7794 - RNA, 74 nt, Human
gugaguccauggcuaaaucaaagcugccccugagaagagacuuaauccaagccugauuguacuaguggcaucac

SEQ ID NO: 7795 - RNA, 71 nt, Human
gugaguuuaucaauaacucaggcauacuaagucaacacuuaaauuguguuucuguuuugaccuguacuuau

SEQ ID NO: 7796 - RNA, 71 nt, Human
gugaguuuuguuuccaccuggacugucaccugccggcccugcaggauguaccaggggaggaguggagcugc

SEQ ID NO: 7797 - RNA, 78 nt, Human
gugauccacacgcuggcccaggaguucgacauuuaccgcgaggugggcggagagccugugccugugacgagggaugau

SEQ ID NO: 7798 - RNA, 60 nt, Human
gugaucucagaggaaggagcaggcaccauucuuugcuguucuccaaccuccuugagugac

SEQ ID NO: 7799 - RNA, 82 nt, Human
gugaugaauuuggaagaaaaagacauuccucuacuucuggugaggagaguaaucgucauagacuuccaccuaauuccucuac

SEQ ID NO: 7800 - RNA, 93 nt, Human
gugaugcuuggaagcauuuucugugcuuugaucacuaugcuaggacacauuaggauuggucauggaaauagaaugcaccaccaugagcaucau

SEQ ID NO: 7801 - RNA, 73 nt, Human
gugaugggcacaaugggcccuugguaccugcugcugcugcuuggucacugugugggccucuauguggccucgc

SEQ ID NO: 7802 - RNA, 65 nt, Human
gugaugggcuagcacuuauaucgggugauucgauuuacaccgcguauaacuuuccagcccagaac

SEQ ID NO: 7803 - RNA, 95 nt, Human
gugaugucaugugaugggugaugucaugugaugggugaugucaugugaugugugaugucaugugaugggugaugucaugugaugcaugaugucau

SEQ ID NO: 7804 - RNA, 79 nt, Human
gugauguccggagauucggagcggcgauaucuggaucuaagucuccgcuccgaugugaagucuaucucugugacaccau

SEQ ID NO: 7805 - RNA, 79 nt, Human
gugauguuagggugucaauuuuagaucuuuccugcuuucucuugugggcauuuagugcuauaaauuucccucuacacac

SEQ ID NO: 7806 - RNA, 62 nt, Human
gugauucucucagcccugagguauacagaaucauuugccucagacugcuguuggauuuuaac

SEQ ID NO: 7807 - RNA, 96 nt, Human
gugauuuuaccuuuauuuccuucacuuuaagccaaucaugaaauuucacagugauuucuggggugggagcagaaggaaggcuguguuaagaaucau

SEQ ID NO: 7808 - RNA, 109 nt, Human
gugauuuuguucugagagaaggugauuggaguccuccaccuggcacugauuugagucauucaaggguuaggaugcaggucaucuuuuuucaauauuucaacaaaauuau

SEQ ID NO: 7809 - RNA, 72 nt, Human
gugcaagcccuguugugcuuguauauaauacauguacucucacagaccccaaaacagcugcuuuaaauguac

SEQ ID NO: 7810 - RNA, 75 nt, Human
gugcaaugggaaggacgacuguggggacggguccgacgaggccuccugccccaaggugaacgucgucacuuguac

SEQ ID NO: 7811 - RNA, 78 nt, Human
gugcacucaacagaacggcccuucaaaugugagaaaugugaggcagcuuucgccacgaaggaucggcugcgggcgcac

SEQ ID NO: 7812 - RNA, 72 nt, Human
gugcagacauucagcugugccgcggucacuguggaguucaugcacuacauaaucgcugcacgugcccugcgc

SEQ ID NO: 7813 - RNA, 94 nt, Human
gugcagcuggaauucuuucuaaccucacuugcaauaauuauuagaaccagaugauggucuggcaagugggugguauagaggcucuugugcguac

SEQ ID NO: 7814 - RNA, 77 nt, Human
gugcaggcugcgacaacgugguacucaucuggaaugugggcacagcggaggagcuguaccgccuggacagccugcac

SEQ ID NO: 7815 - RNA, 72 nt, Human
gugcaguggcucaugcauauaaucccaacuaucuaggaggcugaggugggaggauuguaugagccgagaaau

SEQ ID NO: 7816 - RNA, 62 nt, Human
gugcaucagccggcuugaguuuguucaauaucaaagcugaaaacuagcgaggucugcuguac

SEQ ID NO: 7817 - RNA, 110 nt, Human
gugccaauacaggacuaauugucagccuagaaaaggaacuugcuccauuguuugaagaacugagacaaguuguggaaguuucuuaaucugacagugguuucaguguguac

SEQ ID NO: 7818 - RNA, 83 nt, Human
gugccaccaugaacccaggugaaauaacacaagcauguggcucaucacaaagccuguuugguggucucuucacauggacgcgc

SEQ ID NO: 7819 - RNA, 73 nt, Human
gugccacuuuaugauggggauaugagaaaugcauuguuaggcaguuucaucaugcaaacaucauagaguguac

SEQ ID NO: 7820 - RNA, 106 nt, Human
gugccaggaggugguggacacguacggcaagcuccauccuguccauccugcuggaggaggucagcccugagcuguugugcagcauguugcacuucugcucuggcac

SEQ ID NO: 7821 - RNA, 81 nt, Human
gugccaucagucagguaccacuuaaaggauguacaggcgacuucuagauaucuguugagagccugguaaggggugaaacac

SEQ ID NO: 7822 - RNA, 99 nt, Human
gugcccaacauuggcagguggccaauaauugcaaaauaagcaaauguaugaaugaaccauuagaugcuuuguguuguauacuuacuaccugcugggcac

SEQ ID NO: 7823 - RNA, 80 nt, Human
gugcccugccccgcgcugggggccggaguccuugaauguggcuucaggggcuccuguccugggccagggcugaugggcac

SEQ ID NO: 7824 - RNA, 80 nt, Human
gugcccuggccccuaggcaccugcggccuggcccagaaguguccugggacugccggcggccgccugcgggagaagggcac

SEQ ID NO: 7825 - RNA, 82 nt, Human
gugcggguuuguuacauagguaaacgugucccauggugguuugcugcaccuaucaacguaucaccuagguauuaagccccac

SEQ ID NO: 7826 - RNA, 98 nt, Human
gugcuccuuuuugauauagauaaaauauuuaaugcuucuauuuacaucugcucauguagguuuuacaauauuccauguauauccaauguggaugguac

SEQ ID NO: 7827 - RNA, 62 nt, Human
gugcugggauuacaggugugagccaucuuuguuuuuagauucacauucauauacucccgcau

SEQ ID NO: 7828 - RNA, 96 nt, Human
gugcuggugggggccgacucugugagggcagccaucaccuucagcuucuuuuccaucuucuccuggggugugcuggccucccuggccuaccagcgc

SEQ ID NO: 7829 - RNA, 74 nt, Human
gugcugguguagaagcugcagcaaguucuccacaagacugagguaagaccacugaugaaguggcuacacuacac

SEQ ID NO: 7830 - RNA, 83 nt, Human
gugcuuauaaagugaaggggucauacaguugggccuucauuauuuugcugaauuaugugaugauucuuuugcuuucuacccac

SEQ ID NO: 7831 - RNA, 92 nt, Human
gugcuucaacugguaucuaugaggcccuagagcuccgggacaaugauaagacucgcuauauggggaagggugucucaaaggcuguugagcac

SEQ ID NO: 7832 - RNA, 92 nt, Human
guggaaacugcucucucacgacucucaaagaugaagacuuuuguaaacguguaucuuuggcuacuguggauaaaacaguuugaaaacuccau

SEQ ID NO: 7833 - RNA, 95 nt, Human
guggaaugggccuaaaguagugacaagguagucacagacuucuggaggaggguacuugggcuggugucuaccuggcauauuuaggaacauuccau

SEQ ID NO: 7834 - RNA, 83 nt, Human
guggacuuaaccauugcaaagcacacugucuuucucagcguucucugcaagucaguagguguuaguaugguugcaaaguucac

SEQ ID NO: 7835 - RNA, 72 nt, Human
guggagcagauaaccauuguuucucggccgcuaucuggucagaggggagcugggccgggaaauucugccuac

SEQ ID NO: 7836 - RNA, 71 nt, Human
guggaggcacacaccuguuggguuccaucuaacgccugcgggagguguauacuaaggggugcgacccccac

SEQ ID NO: 7837 - RNA, 62 nt, Human
guggaggugacuggugaugaauacaauguggaaagcauugauggucagccaggugccuucac

SEQ ID NO: 7838 - RNA, 82 nt, Human
guggagugaggcuggagaggggcuuggcaaucuucaggaauugaugcuguagcagcucuuuagcugaaccucucuucuccac

SEQ ID NO: 7839 - RNA, 61 nt, Human
guggagugcaccugggguugggggcacugugcccccagcccccugcuccuuuggacucuac

SEQ ID NO: 7840 - RNA, 100 nt, Human
guggcagggucauaggauaauaguggagagaaggucagcagauaaacacgugaacaaaggucucugguuuuccuaggcagaggucccuguggccuuccgc

SEQ ID NO: 7841 - RNA, 67 nt, Human
guggccagaagccucguuccuccugacucuuccugcagguggcucaggaaggauucagccuggccac

SEQ ID NO: 7842 - RNA, 66 nt, Human
guggcccaaacccagcugggucccuuccuccuaggcagcugagggaaggacugcuggguuggccac

SEQ ID NO: 7843 - RNA, 67 nt, Human
guggcccagacccagcugggucccuuccuccuaggcagcugagggaaggacugcugggauuggccac

SEQ ID NO: 7844 - RNA, 78 nt, Human
guggcccagaguccgagucgugcaggugcugugggcccugcuggcagugcuccuggcgucguggaggcugugggcgau

SEQ ID NO: 7845 - RNA, 88 nt, Human
guggcccaugacaaucuuuuuccaauguggccuggggaagccaaaagauuggacaccccugguuacaggaagaaguuccuugugcuau

SEQ ID NO: 7846 - RNA, 103 nt, Human
guggcccucauccuucagaauguggaucugccgaauugaagaggccugauuucagcuccaccagaugcagauuuguguuuuguuuucuuguuaucacugucac

SEQ ID NO: 7847 - RNA, 71 nt, Human
guggcccuuggaaacacuguaugaacugaagcacgcuucacauaucaggcaaguuacccaagggcaagcac

SEQ ID NO: 7848 - RNA, 66 nt, Human
guggccgcuucaguaggcagcgagcaucugugguggggggagcugcugcaguuccugaacggccac

SEQ ID NO: 7849 - RNA, 116 nt, Human
guggccuuuuuuccuuuuucuguaggccgccuuaagcuuucuaaauuuggaacaucuaagcaagcugaagggaaaaggggguuucgcaaaaucacucgggggaagggaaagguugc

SEQ ID NO: 7850 - RNA, 61 nt, Human
guggcgaggaguccgagccguugggggcauccaggcccagcugcugggagaccuuggccac

SEQ ID NO: 7851 - RNA, 114 nt, Human
guggcggcggcgcgugcgacggucaccucgguuuggggaagauggaagaguugagucaggcccuggcuaguagcuuuucugugucucaagaucugaacagcacagcugccccac

SEQ ID NO: 7852 - RNA, 73 nt, Human
guggcggcuccagacccggguagugccuuuguccccugaauacucacucccccgguccagagggccuucccac

SEQ ID NO: 7853 - RNA, 66 nt, Human
guggcguuuauucccuuaguauguaggugacccaggguggcuuugcuuuggcaagggagaagucac

SEQ ID NO: 7854 - RNA, 76 nt, Human
guggcucauugcuuaggugcccagguuuuucaggugcaauuaaaauuuagaacuaccacacaaaggcauuggcugc

SEQ ID NO: 7855 - RNA, 82 nt, Human
guggcuccgaucgagcgggaucaagcugcugcugcagguccaugcacgccagcaagcaggaucgccgccgacaagcaguuac

SEQ ID NO: 7856 - RNA, 78 nt, Human
guggcugcagagcuccacagagaaggggaucagagugagacugggcucuacaagccuuugugauguaucugcagccac

SEQ ID NO: 7857 - RNA, 93 nt, Human
guggcugcguggacaaguggcgucgcgguagccccuuacccggcaaaggcccgguuggggcucuguugcgggcgcacgacgcacggcggcgac

SEQ ID NO: 7858 - RNA, 88 nt, Human
guggcuggguuuagaaugauuccuugggaaaagggguagcaaaguaacuuuguccugaagaagccccaaguauccugagcccagcagc

SEQ ID NO: 7859 - RNA, 79 nt, Human
guggcugguggagcugucuuaaacgaagagaaccaugagcaaugaagucuguuuaccuuauuacacagcccacagcuac

SEQ ID NO: 7860 - RNA, 93 nt, Human
guggcuucaauucuaagaguggacagcggggaucuuccaagucuggaaaguugacaaggagaugaccuucaggccauucagaaaggagcugac

SEQ ID NO: 7861 - RNA, 63 nt, Human
guggcuucacgcaauccccacaccucggccuuccaaagugcugggauuacagguguaagccac

SEQ ID NO: 7862 - RNA, 97 nt, Human
guggcuuuaaaagacggacagcuuuagguuuguucucacuggaacugguuacacuuucugugcaaacuuaaccaagugaugaucgucuggaagcugc

SEQ ID NO: 7863 - RNA, 64 nt, Human
gugggaaaacugcuugacagaauucacauacuccgagguauaugcaguucugagucugugccac

SEQ ID NO: 7864 - RNA, 94 nt, Human
gugggacaaauauaaacaaagcaugauuuaaauauauauauauuuaaugugugauauguuuguauauauauuuaaacacaugcaauuguucuac

SEQ ID NO: 7865 - RNA, 108 nt, Human
gugggaccucuguggguccaggaucuuggaaugguaucccaugguucaaucuucuggauucaaccacauaaauuuaccccacccaugucguggacccaagcuuccuac

SEQ ID NO: 7866 - RNA, 92 nt, Human
gugggaccuucuguuuggcaggcuuccucucccuugccuggucaugguuuucuggugagaagaguguuccuggccuugcuggagguucccau

SEQ ID NO: 7867 - RNA, 84 nt, Human
gugggagcucgaagauugcugcacugugcauuucaagcaacaaagucugaaaagugccagggcaauuucuucacaguauuucac

SEQ ID NO: 7868 - RNA, 88 nt, Human
gugggaggaggacuggcaaaaauaugagaguaggaguuugggcucuugagcuugggccuggccuucaaauuuccacucuuucacucac

SEQ ID NO: 7869 - RNA, 60 nt, Human
gugggcaaggucaucccugagcugaacggaaagcucaccuggauggcuuucgugucccau

SEQ ID NO: 7870 - RNA, 94 nt, Human
guggggcccgugggcagcugggcaacuggauguccccagcugauuuccagcgagcuguggaugagagguuuccaggcugcaugcagggccgcac

SEQ ID NO: 7871 - RNA, 72 nt, Human
guggggcuggaagaaaagagcaucgacuugauuucuccaaccacucaucccucuuuuucuuucuucccccac

SEQ ID NO: 7872 - RNA, 83 nt, Human
gugggggcgcucaauaacuuggauaccggucggcauggucacaacacccgacagugcucuucgccagaaguuggcggcccuac

SEQ ID NO: 7873 - RNA, 73 nt, Human
gugggggcgguugugaucaugaggucaggaguucaagagcagccuggccaaaauggagaaagccugucucuac

SEQ ID NO: 7874 - RNA, 98 nt, Human
gugggguaaaacccagacgccaugaaagcggccauggccuuggagaaaaagcuuaaccaggcccuuuuggauuuucaugcccuggguucuugccgcac

SEQ ID NO: 7875 - RNA, 98 nt, Human
gugggguaaaaccccagacgccaugaaagcugccauggcccuggagaaaaagcugaaccaggcccuuuuggaucuucaugcccuggguucugccccgc

SEQ ID NO: 7876 - RNA, 98 nt, Human
gugggguaaaaccccagacgccaugaaagcugccaugugccuggagaaaaagcugaaccaggcccuuuggaucuucaugcccugggguucugccgcac

SEQ ID NO: 7877 - RNA, 98 nt, Human
gugggguaaaagcccagacgccaugaaagcugccuuggcccugggagaacaagcugaaccaggccuuuugcaucuucaugcccuggguucugccccgc

SEQ ID NO: 7878 - RNA, 100 nt, Human
gugggguugaaagcuaagaaagugaggaggugguucaggggaucacucuuuccuacuuguuccucucaccucaaacucaccuucuacugcgcagcaacac

SEQ ID NO: 7879 - RNA, 86 nt, Human
guggucucccgcgcgggacggagggacuggccggagcuggcgcuuucucagcacuagaucuggacuccgacccggcgccagaauac

SEQ ID NO: 7880 - RNA, 73 nt, Human
guggucuguauugugcuuguacugaccauguauauaugcuaugguuauuuagugcuagcuaagaacauaccau

SEQ ID NO: 7881 - RNA, 79 nt, Human
guggugccaccgcaguugcagaaaggaaugucagucagaaaugaauuguguuucagucacucugcaugguugcugccac

SEQ ID NO: 7882 - RNA, 96 nt, Human
guggugccugguggagaccuggccaagguacagagagcugugugcaugcugagcaacaccacagccauugcugaggccugggcucgccuggaccac

SEQ ID NO: 7883 - RNA, 65 nt, Human
gugguggcacaugccuguagcuccagccauuugggaggcugagguaugauaauugccugaaccau

SEQ ID NO: 7884 - RNA, 101 nt, Human
gugguggcaggcgccuguagucccagcuacucgggaggcugaggcaggagaauggcaugaacccgggagguggaacuugcagugagccgagaucacgccac

SEQ ID NO: 7885 - RNA, 93 nt, Human
gugguguaugggaucugcauggagguggucuaugagaaagcaaaccccagugagugcugcuucgggauucucuccaacugcaaccaugccuac

SEQ ID NO: 7886 - RNA, 60 nt, Human
gugguguuguuuugguccugauaggaagcugaagcugucuauccucuacccagcuaccac

SEQ ID NO: 7887 - RNA, 78 nt, Human
gugguuaaacgugagacccugggggccaaaagguguggggaccacaaggagaagacucucgggggaacaaugagccac

SEQ ID NO: 7888 - RNA, 105 nt, Human
gugguuacguuuuccacaggguaaugcauuugcaaggacaucaauccucuuccucuggguggcucucuuugauggaugcauuuccaugaugaaaugacaaggcac

SEQ ID NO: 7889 - RNA, 71 nt, Human
gugguuagugucuaugcucagaauccaaugcggagagagucucguccucugguucagacuguaguaaccac

SEQ ID NO: 7890 - RNA, 69 nt, Human
guguaaaauuucucccgggcacuggagucuugcuccgcguaguaacucuccaagccuucugggaugcac

SEQ ID NO: 7891 - RNA, 72 nt, Human
guguacgggcaguucacgggccaggcccuccucucagggcgagagaugguggggcccacgcugcccggauac

SEQ ID NO: 7892 - RNA, 94 nt, Human
guguacuuuucaauccuguguaauguuuaauucuugcaacugaaucaaaacaguguuaaauuauggcaauauugcacuuggggaaugaguacau

SEQ ID NO: 7893 - RNA, 83 nt, Human
guguagagugggccucuggaguccggcugccuggguucaaguccaggcuccccuacucggggcacaggggugcugcucugggc

SEQ ID NO: 7894 - RNA, 72 nt, Human
guguagcaggcuuccugcagacuguauagacugcacaacaaauuucuccuguaccuaugggaagccugucac

SEQ ID NO: 7895 - RNA, 81 nt, Human
guguaggggcgaggggguggcggugccaggguccugcaguucaccaggugcccacgugccugccacccgagcgccauucac

SEQ ID NO: 7896 - RNA, 60 nt, Human
guguauauauuuacggggucuaugagauguuuugauagacaugcaacgugaaauaagcac

SEQ ID NO: 7897 - RNA, 81 nt, Human
guguauuucgaguggcaucagucucacucaucuguggugccccgguguuuacaagagccagauggugucagaggaguacgc

SEQ ID NO: 7898 - RNA, 105 nt, Human
gugucacuugugcuuugcucuugucccacgugucuuccacuuugcauaugagccgugaacugugcauagugcugggauggaggggaguguugggcaugugaucac

SEQ ID NO: 7899 - RNA, 97 nt, Human
gugucccuuccaagcuguguuaacuguucaaacucaggccugugugacuccauuggggugagaggugaaagcauaacauggguacagaggggacaac

SEQ ID NO: 7900 - RNA, 69 nt, Human
guguccucccugcauccccccaccaagugccuuccugaaggccuggguguauuggccaggagaggacac

SEQ ID NO: 7901 - RNA, 103 nt, Human
gugucucaacuugagaaaccaaauagugcgaagggacucaggguggccagaccugugaccuuggccucauuuguaucuuguuuucgcugaggugaucagacac

SEQ ID NO: 7902 - RNA, 92 nt, Human
gugucucuaugaguccucucuaggaggagccuacaagcaguugguccgagcucgcuucacccgcucuuuccuggcccaaaucauaggacugc

SEQ ID NO: 7903 - RNA, 66 nt, Human
gugucuggaaaaauucaccgugagccugaaccacaagcuggacagccaugcggagcuucuagaugc

SEQ ID NO: 7904 - RNA, 100 nt, Human
gugugaaggcucuaagagacauugaaccuggagaagaaauuucuuguuauuauggagauggguucuuuggagaaaauaaugaguucugcgaguguuacac

SEQ ID NO: 7905 - RNA, 73 nt, Human
gugugagucccucugggagcccaacauggauccggaucaccuguuugaaaccaucucccaggccauucaacgc

SEQ ID NO: 7906 - RNA, 68 nt, Human
gugugcacagaugaacgaaguuauggcagaguuagcuaaagaacucccucaaguuucauuugugaagc

SEQ ID NO: 7907 - RNA, 76 nt, Human
gugugcauaaacuucuaucuccauguugguggccuauacgggcacccaugugaccaaggaacguugccuugcacac

SEQ ID NO: 7908 - RNA, 75 nt, Human
gugugccagacuuccguugagucacauauagacaggaccaaaacauacgugacucuuguuagccacuggcaacau

SEQ ID NO: 7909 - RNA, 70 nt, Human
guguggccgaugugucuauugaagauucugugaucucacucucaggagaccauugcaucauuggccgcac

SEQ ID NO: 7910 - RNA, 72 nt, Human
guguggucgaagcuucugaagcugccuacaaggaagccuuugaaaucagcaaagagcagaugcaaaccacgc

SEQ ID NO: 7911 - RNA, 76 nt, Human
gugugguuaugucucuguauaggcaagugucugugucuauagauacuuuugcuuuuuauagugauuaaagcuccac

SEQ ID NO: 7912 - RNA, 75 nt, Human
gugugguuuggacgaauuccaacuuguuucacgcuauaucaggaugagauaacugaaagggaagcagaaccauac

SEQ ID NO: 7913 - RNA, 66 nt, Human
guguguacacggguccuuuuuugcaaugaaauacaugguuaugacuugaauccaaaguguauacac

SEQ ID NO: 7914 - RNA, 102 nt, Human
guguguaguaguaucucauuuugguuuuaauuuauauauuucccugaugauuaaaaggggauguccuguaaauguuuucuuuugugaaauaccauagcacac

SEQ ID NO: 7915 - RNA, 92 nt, Human
guguguccgcaggcgcccgacgcugccgaugucccggggcugagccgcgcccaggugucccggacagugcgugcgagcguguguguccgcgc

SEQ ID NO: 7916 - RNA, 65 nt, Human
guguguccguggggccugccuugccuucugccucccugcagcugagguggcuaggcuugacacac

SEQ ID NO: 7917 - RNA, 80 nt, Human
gugugugcauguaugugugcauguguguguguguaugcgugugcgugugcaugugcaugugugcgugugugugugugugu

SEQ ID NO: 7918 - RNA, 95 nt, Human
guguguuuaaacaaacuguugcugagauucugcauuagucacaacgaauuuaccaaaauugguuugauucagauuuggcaauguguaaacuucac

SEQ ID NO: 7919 - RNA, 74 nt, Human
guguucuuguuugaucuucacguuaagaugcuauugagcuuuuuuauccauggauggucuuccaacaacugcau

SEQ ID NO: 7920 - RNA, 64 nt, Human
guguugccaaagauucaccgaagauaaacacuacccuuguacuuugguggggacuuuggaacac

SEQ ID NO: 7921 - RNA, 74 nt, Human
guguugggcugugacuggccugccagguguuugccucccucugcaacaccagccuguuacuaacagccuagugc

SEQ ID NO: 7922 - RNA, 84 nt, Human
guguuggguggcaaggucuaugugaucggaggcuuugacggcuuacagagaaucaacaacguggagaccuacgaccccuuucac

SEQ ID NO: 7923 - RNA, 73 nt, Human
guguuguacucauuaauguuauuaugagguuaauguuauuauuaggcuuuuaacaauaugacuguguacacau

SEQ ID NO: 7924 - RNA, 95 nt, Human
guguugugucccuggguacuugagauuagggaguggugaugacucuuaacgagcaugcugccuucaauccauuuaacccugaguggacacagcac

SEQ ID NO: 7925 - RNA, 79 nt, Human
guguuugaaagcucuguuuauaaauagugauugauacauuuaucauguauuuggugcugaagauaaacacuuuuuacau

SEQ ID NO: 7926 - RNA, 76 nt, Human
guguuuggaacugcuaccgauacaucaaugguaggaacuccucugauguccugguuuauguuaccagcaaugacac

SEQ ID NO: 7927 - RNA, 81 nt, Human
guuaaaaugucuauugggguccuuauuuaacucucaaaaggguuuuagaaguaaauagcagauucaacuauccauugaagc

SEQ ID NO: 7928 - RNA, 91 nt, Human
guuaacuuaaacauguuccccuuaaaugcacuugauggguguugaaauggucaaccuucuuaaaauuuuuaagaugaacuuaguucuuaac

SEQ ID NO: 7929 - RNA, 95 nt, Human
guuaaggacucugaagauguaccuaugguccuaguaggaaauaaaugugauuugccuucuagaacaguagacacagaacaggcucaggacuuagc

SEQ ID NO: 7930 - RNA, 83 nt, Human
guuacaaaauccuguguucgguuguaaccugaacucauuaaaagacuuguuuucagguuuaucaacuguuuauuuucacugac

SEQ ID NO: 7931 - RNA, 61 nt, Human
guuacaucuuggaaccugagccauggagguggcgccaccucccugaggagaaagguguggc

SEQ ID NO: 7932 - RNA, 69 nt, Human
guuacccuggcuggagugcagugacgugaucacggcucacugcggccacaaccuuccagcuuaggugau

SEQ ID NO: 7933 - RNA, 74 nt, Human
guuacggaacucucacuucuguguuauggacauuuucaugacaugcacagaaguggagaggaugguucugugac

SEQ ID NO: 7934 - RNA, 84 nt, Human
guuagaaaugcaaauucuugggcucugcccuagaccuacugaaacauacucugugggcggggcccagcaaucuguguuugaaac

SEQ ID NO: 7935 - RNA, 79 nt, Human
guuaggcuucugaggggucaggcagaauaugguguccauaucuuccauagcucugcagauucuugggaugaagucaagc

SEQ ID NO: 7936 - RNA, 72 nt, Human
guuaguuaacgcuguucacguagcucuuuucugccuuuucacuuagagcuguguguguaccaguuuccugac

SEQ ID NO: 7937 - RNA, 66 nt, Human
guuauagcugucggcugucugagagcaccuuuagcuacagaggcucauggauucgcagguuauaac

SEQ ID NO: 7938 - RNA, 74 nt, Human
guuauuuugacuugccucuucaucuggcaaaaucucugaaccacugcucuggagaugacagcaggcaaaaucac

SEQ ID NO: 7939 - RNA, 65 nt, Human
guucaaucagggguuucucacucucuuccuucagggagagcccagcgaguuuccuucguaugagc

SEQ ID NO: 7940 - RNA, 102 nt, Human
guucagaccaagaauucacugcaacaagauaucagcugaugguuacgaaguagaaaaucucaucucugaagaucucacaaagagaagucaugguuucaggac

SEQ ID NO: 7941 - RNA, 110 nt, Human
guucagcaaauccacuguaaguagugugaguacauagcucaccuaucaacaauuuucuuucuaaacuugaaggugagaacuauaguacuuaugcuuugucaugguugaac

SEQ ID NO: 7942 - RNA, 77 nt, Human
guuccaaauguugaugcaugugguuaauguugcauuagagcacuuugcaauugcauaauucauuaauguuugugagc

SEQ ID NO: 7943 - RNA, 73 nt, Human
guuccacgcaccgccuuugaguuggacacagauggcaaccccuuugaccaggacaucuacgggcgcgaggagc

SEQ ID NO: 7944 - RNA, 107 nt, Human
guuccauugacuaauggcagagagcugugcuucaaauacagcuguggucugagcaaacuuggcugcucuaaauacugaaugccaguuccuuugccaauuccaugggc

SEQ ID NO: 7945 - RNA, 87 nt, Human
guucccgccucaagauguugcaaaggagcugaagcugguguucccgggcgcccagcgaaugaaccgaggucgacaugaagugggggc

SEQ ID NO: 7946 - RNA, 78 nt, Human
guuccugagugggaagggcuuggugaucuauccgaaaauuggagacaagcuggacaucaucugcccccgagcagaagc

SEQ ID NO: 7947 - RNA, 95 nt, Human
guuccuuaggccacacccugcccucccuggacugccugaccucgcuccaaggcucaggggaagguucugagggcaggugugaaaaugcuuggaau

SEQ ID NO: 7948 - RNA, 63 nt, Human
guuccuucauucugaccuucaaauguguagagagcuuugcacgucccuauggcagggaggggc

SEQ ID NO: 7949 - RNA, 81 nt, Human
guucguagguuauaaauucuguuaguugcuaagaagcauuuuuaaaauuauguacuauagcucuuuauucagcagacgaac

SEQ ID NO: 7950 - RNA, 99 nt, Human
guucuagcucagguaguagucguacuucuucucggucuucuucuccuaaaaggaaaaagagacacaguaggaguagaucuccaacaaucaaagcuagac

SEQ ID NO: 7951 - RNA, 71 nt, Human
guucucaaagagguucuuuucagagcacguuccuuguaauggcuucagugacauugagaaccuugaaggac

SEQ ID NO: 7952 - RNA, 74 nt, Human
guucucuuucucugcaucugccucaguacuggggagauucugggacugaaccuaagauucagauggcagagagc

SEQ ID NO: 7953 - RNA, 69 nt, Human
guucugaauaacuuuauugcaagucacauaaucuugguuuagacuugacgcaacgggagguuacagagc

SEQ ID NO: 7954 - RNA, 82 nt, Human
guucugcagccuccuggccaguguaugagaggucccuggggaacagcagaggggcugccgauggguggguaggguguggagc

SEQ ID NO: 7955 - RNA, 76 nt, Human
guucugggagcucugcaaaaucaguagcaagugcuggaaaaggcacaugccgaagauacucaagagcucccaagau

SEQ ID NO: 7956 - RNA, 73 nt, Human
guucuguauaaacugguggacaguaaguuaguuccuuuguuuuaacuuauaagcccccacuucaccgcagaau

SEQ ID NO: 7957 - RNA, 73 nt, Human
guucuguuacacaauguuugcacaggcacagugguuucgccacgaaccgguguacacuugucaggggcagagc

SEQ ID NO: 7958 - RNA, 67 nt, Human
guucuugagcagugcguacaugguugugcgaguuugugucaaacuugcuguaggucugcuugaggau

SEQ ID NO: 7959 - RNA, 96 nt, Human
guugaacuugaccucgggggggauagacauggguuuggccuuuaaaaacauggccccagcagcuucaguccuuuucucgucgauggucagcacagc

SEQ ID NO: 7960 - RNA, 81 nt, Human
guugaagcugauguuacuagugguagauugguucauacgaugcacggaggggucaaugugucaaagacaucgguuaucaac

SEQ ID NO: 7961 - RNA, 71 nt, Human
guugaaggaagugagcacauuauuuguacugugaauauaaauuuuuggccuuuuauuuaucuuccuuugac

SEQ ID NO: 7962 - RNA, 112 nt, Human
guugaauucaaaaauuggaucucacuuaggcuuugaaggugacagccaucucugauagcugagcauaaguaaagaaagguggagugccgaugcagaaaggaaaauauucagc

SEQ ID NO: 7963 - RNA, 64 nt, Human
guugagaugauugugaaacuagguaucuuucauucugacuccuaguuuaacauuuaauuuugac

SEQ ID NO: 7964 - RNA, 66 nt, Human
guugaggcugaucccaggcacuguugcaacccagcugggugugugcaugcuuggggcagcacugac

SEQ ID NO: 7965 - RNA, 78 nt, Human
guugaugaagaugaaccuacuguaguaccaaccacuucugcaagaauggaaucacaagcuacuagcgcuuccauuaac

SEQ ID NO: 7966 - RNA, 74 nt, Human
guugccaaggaaggcuuuuucugauuuuuugacaaaugaauuuuugcacacuuucauuggugucuuucggcaac

SEQ ID NO: 7967 - RNA, 60 nt, Human
guugccaccgaggaggcggcggcccugcgucuggaacgccguugccaccgaggaggcggc

SEQ ID NO: 7968 - RNA, 69 nt, Human
guugccagaacgcugguguggggcgcuugucuuugggaccuuugugcuucccaguguguguuugguggc

SEQ ID NO: 7969 - RNA, 78 nt, Human
guugcccgagccguugccgucguaacuaggcguccuggaaguccacgucguuuaccguuuguaaggcgcuugcgcagc

SEQ ID NO: 7970 - RNA, 72 nt, Human
guugccuaucacagaugaacaaauccaggagaugaaaucaaaccuggagaacaucgacuucaagauggcagc

SEQ ID NO: 7971 - RNA, 80 nt, Human
guugcgcgugccugggaagcuaaaccccugcgguguuguuccugugggcaagugucuagcgcaugcaggugccgucugac

SEQ ID NO: 7972 - RNA, 71 nt, Human
guugcugcuucuugguuggaagauucuggacagccugaaaggcuuugagauacuccacacugagcaguggc

SEQ ID NO: 7973 - RNA, 91 nt, Human
guugcugugcaacucagauggccauuauguagguuugcccuagugcuuagcauggcuuauuccauggccaucacuauggcacccagguggc

SEQ ID NO: 7974 - RNA, 83 nt, Human
guuggaauuuuaaagaaaauauguuguaauaaugcuguuguaaguaauauuuuaaugucucuuugccuguuuucuauuucagc

SEQ ID NO: 7975 - RNA, 72 nt, Human
guuggaugagaagagguggugguuaaaggcugucguaaaggaccccuggcugcuugcuucaacuuguuucgc

SEQ ID NO: 7976 - RNA, 105 nt, Human
guuggauuugcaaaccuccccaaucaaguucaccgaaaaucagugaaaaaagguuuugaguucacacugaugguggucggugaaucaggucuaggaaaauccgac

SEQ ID NO: 7977 - RNA, 82 nt, Human
guugggaaugcgccucuucgcugugccgggagacccuuucccaaauggggcgcggcgguaacaggcgcgugggggacccgac

SEQ ID NO: 7978 - RNA, 66 nt, Human
guuggugacuuugguguaucgagcauggagaccgcacagucccauugaacaccuuuccucacugac

SEQ ID NO: 7979 - RNA, 77 nt, Human
guugguuagcaaaagugcagccucaagauggcugauggcaacgaggaucugcgggcugacgacuugccugggccagc

SEQ ID NO: 7980 - RNA, 74 nt, Human
guugucacuuaacccccaggaguuauuuauuaucuuuuuguuaaagucaggcucauuugggguaaugugaugac

SEQ ID NO: 7981 - RNA, 84 nt, Human
guugucuugaauccacaaucuuuucucuggcauuggguuccccaaccugaucaauugaguugggagcaauggauucaagucaac

SEQ ID NO: 7982 - RNA, 75 nt, Human
guugugacagaaugaccucaagcagggagaggaagggaacuacuuuuucacaccugaaauguuacugauuauaac

SEQ ID NO: 7983 - RNA, 72 nt, Human
guuguggggcugguugcugucuuuacguuucacaaccauggaaggacugccaaccucuacucccuucacagc

SEQ ID NO: 7984 - RNA, 74 nt, Human
guuguuauuggugcaggaguaauagguguagaauuggguucaguuuggcaaagacuuggugcagaugugacagc

SEQ ID NO: 7985 - RNA, 81 nt, Human
guuguucaagguguuguguucagggcccuuccagguaauugaggcuuuggggcggccacagacucgacaucuaggaacaac

SEQ ID NO: 7986 - RNA, 96 nt, Human
guuguucgggacuuaaagacacuugaccuguuugggcuguugccacuuaaaaguucaugaccacaaauguccacagugucuuccccuguuauuaac

SEQ ID NO: 7987 - RNA, 81 nt, Human
guuguucuuucccucguguccaugacuuuucucugccauuagcagggaagugugcggagggcuuccagggaaucaagugac

SEQ ID NO: 7988 - RNA, 83 nt, Human
guuguuggaccagaagcaccucuggcugcugggaucguugggaaccugaggucugcaggagugcaaugcuauggcccaacagc

SEQ ID NO: 7989 - RNA, 79 nt, Human
guuguuucuuuagcucuccuccaagacacuauggccaacugaagcccaaagccagcugagaggggagucugggaacugc

SEQ ID NO: 7990 - RNA, 80 nt, Human
guuuacaagacaugauuuugcuggcuuuacaaaaggacauucuauuuauuuuuccaguaauucuucauugucccauaagc

SEQ ID NO: 7991 - RNA, 122 nt, Human
guuuaguggcuucacgcagaaguuggcaggagcaugggcuucggaggccuauagcccgcagggauuaaagccugugguuuccacagaagcaccaccuaucauauuugccacaccaacuaaac

SEQ ID NO: 7992 - RNA, 83 nt, Human
guuuaguguauaccugucacucuagaauguaggcucccugagauaaaaacuauaauucuuuugauggcaguuacauucccaac

SEQ ID NO: 7993 - RNA, 75 nt, Human
guuuauaucuucacccuguaaugguugggaccaggccaaucccuucuccacuuacuauaaugguuggaacuaaac

SEQ ID NO: 7994 - RNA, 78 nt, Human
guuucacucuugucacccaggcuggagugcaguggugccaucuuggcucacugcaaccuccgccugccgaguucaagc

SEQ ID NO: 7995 - RNA, 77 nt, Human
guuucacucuuucgcccaggcuggagugcaguggugcaaucuccgcucacugcaaccuccgccuuccgauuugaagc

SEQ ID NO: 7996 - RNA, 102 nt, Human
guuucagacaucaaggaguaucacugugcuuuccuccucuuuauaacugugcaggugggugugcagagaaauagcagagugaugguucgaugauacugaagc

SEQ ID NO: 7997 - RNA, 77 nt, Human
guuucagagcauaacucgauugcccaucauccugaaagggauuuugacaaaagaggaugcagaguuagcugugaagc

SEQ ID NO: 7998 - RNA, 65 nt, Human
guuucagcacugauggaggcagccuggccaccgggggccgggaucggagucuccucugcugggac

SEQ ID NO: 7999 - RNA, 75 nt, Human
guuucccgguguggggcuggaccaggcggcgggcagcggguuuuccuccugguccuccaaaaugcgcuucagaac

SEQ ID NO: 8000 - RNA, 109 nt, Human
guuucuccagacuacuccaccuugggucggcuugguugucggugauauugagacacgacagugcgggggugucaucaacaccaguggccaaggaaggugcuggacuggc

SEQ ID NO: 8001 - RNA, 76 nt, Human
guuugaccacuguaagugccugcacucuguauucuauuaauaaacuaaaauaaagggaagacgcugcuggugaaac

SEQ ID NO: 8002 - RNA, 72 nt, Human
guuuggcccaggcggaagugcaggguugugaucaagguccagggaacccucgugccucuccgggguucaagc

SEQ ID NO: 8003 - RNA, 81 nt, Human
guuuggggacuggcucgggaaugggcucaggcagcuccacgggguuugccuggcagguucaggcucaggacagcccugagc

SEQ ID NO: 8004 - RNA, 105 nt, Human
guuuggguaaugaagccacagagauuugcugauacauuugcuaggcacgacuucuggucauuuagaaagcuauuuuguggcuucaucaauaagguauuccccagc

SEQ ID NO: 8005 - RNA, 89 nt, Human
guuuguggccuucagaaaucggaucuuggggagagucccuuccuaccugacugaccucccauaaggcugaugcugauuuggccagagau

SEQ ID NO: 8006 - RNA, 67 nt, Human
guuuuauuccaucccuguaucaaccuauuuaacacuucagcaggaccuggugcauguggauugauac

SEQ ID NO: 8007 - RNA, 74 nt, Human
guuuucagcuucccuaagggacuggcauaggguuuuguggggucaaugccaggaaccugggggaaacuggaugc

SEQ ID NO: 8008 - RNA, 62 nt, Human
guuuucauccucuaguacugaagugcccucaaggggguaggcacuguauagcaggagaaaac

SEQ ID NO: 8009 - RNA, 72 nt, Human
guuuucuaccugggcugacguugccuuguccggaggggcuugcaggguggcugaagcccuggggcagagaac

SEQ ID NO: 8010 - RNA, 86 nt, Human
guuuugaaggaugcgguguggagccagaggaugugugggagggguuucucuaacacugacuucuauuccaugagcuuuuucaaggc

SEQ ID NO: 8011 - RNA, 100 nt, Human
guuuugacaaaugcagauacauguguaacugaacuuaugacuuuccuuauagaaacuucagaaaguucccucauaccccuuaucucaaucuugucacuac

SEQ ID NO: 8012 - RNA, 79 nt, Human
guuuugaccacuuccaccuaugaaaauuaucugaacauuauucagauuuaagaguucaugggagcaggugguacagaac

SEQ ID NO: 8013 - RNA, 76 nt, Human
guuuuuuaagguuuuggaaguaacaaagggauacauacagcaagauccacuuacauaguuuuaaaacaugcaaaac

SEQ ID NO: 8014 - RNA, 128 nt, Human
uaaaacucaccaucaaauagauguaaucuuauuaauuacacauuuuguauuuuaauuauuucaaggagugaagaaaacaggguguuuuuguuuuuguaguucugauuacucauuuaugcauuguuuug

SEQ ID NO: 8015 - RNA, 86 nt, Human
uaaaagaaaaccaaagugguccacaaaacauucuccuuuccuucugaagguuuuacgaugcauuguuaucauuaaccagucuuuua

SEQ ID NO: 8016 - RNA, 87 nt, Human
uaaacauuucaugggagacaauaucauaaggguaaagagguagaaucacuuucagacuuagaauaauguugauucccaagugcuuua

SEQ ID NO: 8017 - RNA, 86 nt, Human
uaaagaaaauguaauucgagcugguuagcuuaauuuugugccauucuuuaacauaagaguaagcucuauuaugaaauacaacuuua

SEQ ID NO: 8018 - RNA, 74 nt, Human
uaaaggugaccguaaggagucccuuggggaggauuugaaaauuuguccuucccaaaaguugcccggaaccuuug

SEQ ID NO: 8019 - RNA, 128 nt, Human
uaaauucaggguaaugguuacaguuaggagaggaaagggaauacaaucagauuaugguaguaaacagggauuuuaaccauauugauuauguuuuauuucugaaacuggguaauggauacucugguuua

SEQ ID NO: 8020 - RNA, 63 nt, Human
uaacagcagaagauagaagaguugguacaacaaaucuucacuuagaugugucugaugcuguua

SEQ ID NO: 8021 - RNA, 83 nt, Human
uaacuggcgaaaagcuuucagaaacacuggagauaucguuagcuucccugauuucuuguguuuccgggaacguucuaagguua

SEQ ID NO: 8022 - RNA, 98 nt, Human
uaacuucuguuaugauagggugucugaggaaaagaaggaugcgguacauacuaagguacuacuuucuuuuucuuuaaaucucuauguaacaaaaguua

SEQ ID NO: 8023 - RNA, 73 nt, Human
uaagaugaguugauauucaaauauccaguuaguaaugaaaacaauacaauacugagagaaaaagcuugucuug

SEQ ID NO: 8024 - RNA, 82 nt, Human
uaagcccagggucuggccuugaaagcuccgcagaaaugauuccaaaacccaggagcaaccacuggcccuaccgugggacuua

SEQ ID NO: 8025 - RNA, 81 nt, Human
uaagcuauauauauaauauaauuacauauauaugcacauguauauauaguguguacauauauguguguauauauauacuua

SEQ ID NO: 8026 - RNA, 105 nt, Human
uaaggaaagugagauuugaggagucccuguuguucugcaacaucccuagauugaaugaucuguugcagaugguggauaccaaguucaaauuuaaagauuucuuug

SEQ ID NO: 8027 - RNA, 87 nt, Human
uaagggcaaagcgggcauacucccauggcaucgaacuuuugucuuaaaguaaaucaaggccguugaguugagaaugcuuugcuuuug

SEQ ID NO: 8028 - RNA, 95 nt, Human
uaagggcuuugccucguucauugcuguguccuggcacuucucagucucucacggaaugugccuuggauaaaugagugaagcaaagucaucccuug

SEQ ID NO: 8029 - RNA, 86 nt, Human
uaaguucuaggguacaugugcacaacaugcaaguuuguuacauauguauacaugugccauguuggugugcugcacccauuaacuug

SEQ ID NO: 8030 - RNA, 86 nt, Human
uaaguuuuaggguacaugugcacaacgagcagguuuguuacauauguauacaugugccauguuggugugcugcacccguuaacuug

SEQ ID NO: 8031 - RNA, 109 nt, Human
uaauaccacugggaagaaguaugguagugguggaugaaggguggauauuuuaaauugugcaguuacaguuuacuguccuauuaccucugcucguuuaaccaguuuguua

SEQ ID NO: 8032 - RNA, 77 nt, Human
uaauguaaagaagccuuucagugcuuuaacucuaggaguggagugcugguuacuguuuggcuuuagaagugacguua

SEQ ID NO: 8033 - RNA, 63 nt, Human
uaauuuccacugcuuugaaggcccugcaucugaauaaugcaagcucaggcgcgguggucguug

SEQ ID NO: 8034 - RNA, 73 nt, Human
uacaagaugauggacuugaacuuccugccaugcucagacauuccagacaggacaaggaccauuaggacuugug

SEQ ID NO: 8035 - RNA, 78 nt, Human
uacacagcacagaggcacgggcaccaugggagagggcagcacuccugccuucugaggggaucuuggccucacggugua

SEQ ID NO: 8036 - RNA, 94 nt, Human
uacacaggugcaucagacguguggacaugcagacacagacacacggagcauggguacgucaccgcgugucggcacguccagccgcacucgugug

SEQ ID NO: 8037 - RNA, 82 nt, Human
uacacucugaucgagauccuauuccagauguuccugcaguauacuuuguaaugccaacugaagaaaauauugacagaaugug

SEQ ID NO: 8038 - RNA, 85 nt, Human
uacagccaugucacuccuggcgacccuggggcuggagcuggacaguggcccugcucccagacuaguggugcugggauggcucgua

SEQ ID NO: 8039 - RNA, 62 nt, Human
uacagcugauagccuguuuuuguaaauaaaguuuuacuggauggcagaguugaauaguugua

SEQ ID NO: 8040 - RNA, 70 nt, Human
uacaggaccagggcagcagauugagccaccccuugggaggcgaucaggagucugugccuuggcagcugug

SEQ ID NO: 8041 - RNA, 92 nt, Human
uacaggccugcuuacuugggauguaggguuaguaaaugggguuucugcuuuaaaggacugacuugcuaucacacaaaagaggcagacuugua

SEQ ID NO: 8042 - RNA, 95 nt, Human
uacauaucaguauacgacauuaauauaucucccuguccccaauuagguuaucagucacuugauggaggagauuguauguuauauauuacuuugua

SEQ ID NO: 8043 - RNA, 75 nt, Human
uacaugacauuccaauauacuaugcaucaucuuuuggcccaagaauuggaugggcaguguaccagaacauaugua

SEQ ID NO: 8044 - RNA, 97 nt, Human
uaccggucaagccccuugaggccucgccguuggauccucuuacacgaauaagggugagcccccgacuggagagagcuuuggggggacaccccaggug

SEQ ID NO: 8045 - RNA, 65 nt, Human
uaccucacugaaguacucgcauguuguuugguacccacugagcaacuguuucaguuccuaaggua

SEQ ID NO: 8046 - RNA, 103 nt, Human
uaccugaaauugaucuuguaaugcagaaaguggcuauauguuauccagaagaguaacagauaccccaaauacacuugcuaacacaagaaauccugugaaggug

SEQ ID NO: 8047 - RNA, 94 nt, Human
uaccuggaggaaaugagucaucggugauaagcaaagccacacacaauauuguugguucuuauugacugaauuuacuuugguugccuuuuaggug

SEQ ID NO: 8048 - RNA, 86 nt, Human
uaccuuuuuccugucagaaagguuuuccucugugcuacccuuaacuuagggaugaacagacuauaacuaggaaaggaggaaaggua

SEQ ID NO: 8049 - RNA, 95 nt, Human
uacgcagguacacacguguaccugaguguguucaugagggcaucugguguccaugugucugaguguagccuuuguaucaugugugugugugugug

SEQ ID NO: 8050 - RNA, 78 nt, Human
uacgggcucugaaauugccagacaaaacccucauugaccucuaugaacagguuguucuggaauugauagagcuccgug

SEQ ID NO: 8051 - RNA, 86 nt, Human
uacguagugaggaucacaugcaugaagaauccauugcucgcugaaagaagaucuuggaaugagugcguggauccacaauucaugua

SEQ ID NO: 8052 - RNA, 87 nt, Human
uacguccuaguagcucugugaccuugaauuuguugcacaacuagcaaggguugugcuccucagcuuucucagugcuguugggacgug

SEQ ID NO: 8053 - RNA, 83 nt, Human
uacuaccaggccaucaaggugcuggagaacaucgaacugaacaagaagaguauguauucccgcaccuugauggccugguagua

SEQ ID NO: 8054 - RNA, 76 nt, Human
uacugcuugcaagagccuccaugugaaguuucugugcaaaccacacuaacauauuacuggcaucuucaaucuggua

SEQ ID NO: 8055 - RNA, 130 nt, Human
uacuugggaucaguuagucuagagccugcaaagcaaguggcuuggagagauagugauuuagcucaagagggagugagaugugacuguugccacauguuaaaugcuuuucugggccugauuauuuaaggga

SEQ ID NO: 8056 - RNA, 79 nt, Human
uacuuguauuuccauugcuugaauguaagagucagaugauguuuuaauugaaauaaaauucuaggcuggaugcaaugug

SEQ ID NO: 8057 - RNA, 77 nt, Human
uacuuugaaacggagaugucuuggaacauuggaaugucucagauuucugguuguuauguggaucuguguggaaagug

SEQ ID NO: 8058 - RNA, 62 nt, Human
uagaaagcagaccuguuucaggguucggggaagguuguucgauaugaacuggguccucucua

SEQ ID NO: 8059 - RNA, 94 nt, Human
uagaaaggaaucuccuaaaccucaaaaagaacauuuauguuagccuacugcuaacaucaugcuuaaugggagaaaacuggaugguuccuuccua

SEQ ID NO: 8060 - RNA, 76 nt, Human
uagaaauauguaaucgaucuuuucuuuggugggcaauuagcaauauugaggaaaguuaaagauguauguaucccua

SEQ ID NO: 8061 - RNA, 83 nt, Human
uagaaggaaauauauaaaaauguuuacaaauauuuuaaaaaguaaaaaaugaauaaaaguaaaaauuugagugguucucucug

SEQ ID NO: 8062 - RNA, 72 nt, Human
uagacaaauuccgucuccaaguuuccgagcaaagccaaaggaaggcuuugggaagaaaagagguuguugcua

SEQ ID NO: 8063 - RNA, 93 nt, Human
uagagagugagguaguagcaugccuaagguacaccucagcaguuccagaauucugcugcgagugguccuccaucaaacuacuucaccucucug

SEQ ID NO: 8064 - RNA, 71 nt, Human
uagagaugggguuucaacuuguuggccaggcuggucuugaacuccuggccccaggugauccacccacuuua

SEQ ID NO: 8065 - RNA, 87 nt, Human
uagcaugaagucccucuggaucuugagcugguuuauggacucaaucgucucauggaucuuacuguccagagcacugaucuccugcug

SEQ ID NO: 8066 - RNA, 61 nt, Human
uagcauugggugccaauuucgugguguggaauggugacaacaugcguggagccaagugcua

SEQ ID NO: 8067 - RNA, 84 nt, Human
uagccacucugcucuacgugguccaugcgguguucucuuuaaucagauggaagucuucauaaagccgcaguagaacuugagcug

SEQ ID NO: 8068 - RNA, 79 nt, Human
uagccugggcgcucuccagaaaagcuacacuugaacugacacacaauuggggcacugaagaugaugcgacccagaguua

SEQ ID NO: 8069 - RNA, 79 nt, Human
uagccugggcgcucuccagaaaagcuacacuugagcugacacacaauuggggcacugaagaugaugcgacccagaguua

SEQ ID NO: 8070 - RNA, 76 nt, Human
uagcucucccacaccaucaaguggcccucauaacuggaguagaguuccugguugcuuuucauaagagggagaguua

SEQ ID NO: 8071 - RNA, 85 nt, Human
uagcugggacuacaggcgcaugugccaccccuggcuaaguuuuuauauuuuaguagagaugggguuucaccuuguuacccagcug

SEQ ID NO: 8072 - RNA, 88 nt, Human
uagcuguuguaaaaguuugucuuuauuagccauauguauuacaauggugguugguuuauacacauuuuuaaccuuauaauaauagcua

SEQ ID NO: 8073 - RNA, 81 nt, Human
uagcuugagcuuguuccuaguuguccaucacagaaagcauuagcagaggaugcuguggugcagcgggaacagcuuggguua

SEQ ID NO: 8074 - RNA, 71 nt, Human
uaggaagucugagaaugaccuuuacuuuccuauuguuuguuaggagaguuuaacuucaaacuccaacccug

SEQ ID NO: 8075 - RNA, 90 nt, Human
uaggaguagaaaugugacuaagauguuugaacaaauaacauauggaaugcuaaacauauggaaugcuaaacguaugccauuuuucuccug

SEQ ID NO: 8076 - RNA, 93 nt, Human
uaggaucccaucucagucacacagaaucugcuuuguuuucagauuaugaaccacaaagauacacacgaacugucuugauuugaagggagccua

SEQ ID NO: 8077 - RNA, 60 nt, Human
uaggcaccacuugacccuauucgcgcaaguagucugggcaaauuuagcuagugucgccua

SEQ ID NO: 8078 - RNA, 77 nt, Human
uaggcaugugauuucagguuuuucguacugagaacauugagauuucaguuggaagacacccugaaaucuuaugagua

SEQ ID NO: 8079 - RNA, 81 nt, Human
uaggccccacuccagacccacagaaucugaaacugcaucuuaacaagauccucagaagaucuguguguacagugauguuua

SEQ ID NO: 8080 - RNA, 101 nt, Human
uaggccccagaacauuacuuaugcccuucaguuaccauaagauuugugcaagguuuuguacccugguaaaugaugccaaaguuuguuuucugugguguuug

SEQ ID NO: 8081 - RNA, 69 nt, Human
uagggaaagcugguacgccugcagguaccgguccggaauucccgggucgacccacgcguccgcacccua

SEQ ID NO: 8082 - RNA, 65 nt, Human
uagggccagcuucaugcacuguaccuuguacagucauacaagauuucaugcucagaagugcccug

SEQ ID NO: 8083 - RNA, 108 nt, Human
uaggggcagacuuugacuuagcaaggucuuuaacuguuaacauuuuucagcccagagagcugccuugcucucuaaaacaguuacuuuguccugguucacucuucccug

SEQ ID NO: 8084 - RNA, 104 nt, Human
uagguacuagauuugcguccugauggacaucgagcaggucucuggacucacaaucgagggaucugccaccgagaucugucgcgugcgcaagucuugaacaucua

SEQ ID NO: 8085 - RNA, 64 nt, Human
uaggucaaauguguccuccaucacugcuucccugagauuugauggagcccugaauguugaccug

SEQ ID NO: 8086 - RNA, 72 nt, Human
uaguaaagaauagaaaugcagcuacacacccaauucgucuuggucuggccuaaaauuucucagucuuuacua

SEQ ID NO: 8087 - RNA, 97 nt, Human
uaguauggaaagauuuaugacauaauuuuauuacuuacuguaaucguauacaguuuccauuaacuuuuaugacaucauaggguuuuccuaaauacug

SEQ ID NO: 8088 - RNA, 109 nt, Human
uaguauguugagcaucuuuuuguaaguguacuugccaucuguagaucuucuuuggugaagugucuguucagaucugugugcauuuuuaauuggguuguuuaacuuauug

SEQ ID NO: 8089 - RNA, 99 nt, Human
uagugacaagggcaucccaaggcacuugcccagagcugcagaguugugugugccauaccugcggcucaaagggaaggccuucuauccccugaguuucua

SEQ ID NO: 8090 - RNA, 90 nt, Human
uagugauucuugugagaucaagggaggauggagaugcaggcagcagcagccugaacuucuuucuccugcccugguuucuagcugucagua

SEQ ID NO: 8091 - RNA, 82 nt, Human
uagugcacaaugguggaaggaggcgguucguauguccccaggggcggcaucccaaugccagaccuuccucccaugggcucug

SEQ ID NO: 8092 - RNA, 84 nt, Human
uagugguucuucuuaucuccauccccaucggcuuccucuuuaagaaagccgguccugggcugaagagauggggagcagccgcug

SEQ ID NO: 8093 - RNA, 79 nt, Human
uaguuaccaccagcuuggccuagaaucucauugaacgcaacuugacuaguuaugacagagaggaccagggugagaacua

SEQ ID NO: 8094 - RNA, 65 nt, Human
uaguucaggcuuuccaguucacugagaaacauggggaagugugccagugguggaaaccuggagug

SEQ ID NO: 8095 - RNA, 81 nt, Human
uauaaaccugcuaucuugagguccuggucuuuuaaaaauuuuuuuuaauuuaaagcuuuuccaccgagguuuuaguuugug

SEQ ID NO: 8096 - RNA, 73 nt, Human
uauaauguggggacaaaaaauauaccuauagaggagaaauuuauaagagccuuauaggggguaacauauuaua

SEQ ID NO: 8097 - RNA, 86 nt, Human
uauacagguagagauguaugcagauguguccauauauguuccauauuuacauuuugauagcauggauguaugcaucucuuggugua

SEQ ID NO: 8098 - RNA, 93 nt, Human
uauauuugugaaauucauccacacugauguguauaacuguuauccauuuccauuguuguauagcauuccaccacaugaauacaccacaauaua

SEQ ID NO: 8099 - RNA, 120 nt, Human
uaucagcaaucuucucuacuuucauuggggagcacuauguccaugugaacgcuacuuaugugaacguaaaaugugucgcuccauauccuucucuguugucaucagaagauaacgcugaug

SEQ ID NO: 8100 - RNA, 67 nt, Human
uaucgauaguuguuaggugucagcuuccauguaggaagcggcuguaccgauccugagaacuucgaug

SEQ ID NO: 8101 - RNA, 71 nt, Human
uaucucaacgagaagggacaccucacgucgcugacagcucggcacguggcuggucccaggccccagagaua

SEQ ID NO: 8102 - RNA, 77 nt, Human
uaucuuaguguuauuucacagcuaacauucauuuaauacauuuuauugacaaugaugaugugucagacgcuguucua

SEQ ID NO: 8103 - RNA, 89 nt, Human
uaucuugguuaauugcuacugaaagguugagaaaggaaugguuugauauuuaccacagcgcugugccuuucuacaguagaacuggggua

SEQ ID NO: 8104 - RNA, 76 nt, Human
uaugaacuggccacuuuucagaugaaaccuggugggccagcucuguggggugaugcauuuaaaagggcaguucaug

SEQ ID NO: 8105 - RNA, 99 nt, Human
uaugagggacaugaacaccugcagauuuugggguccacagggguccuggaauuaauucccuguggauacugagagaugacuggacauccauucuccaug

SEQ ID NO: 8106 - RNA, 93 nt, Human
uaugauuugauuuuauauacacauauguauacauauuauauauaaauauauauguguauacauauauguguguauaucuaugaaucaaacaua

SEQ ID NO: 8107 - RNA, 62 nt, Human
uaugcagagaugaguuaguguuucuggacguggagaccuuuuaaauggcucaucugugugua

SEQ ID NO: 8108 - RNA, 83 nt, Human
uaugcauguguuuaaaccaaauaccagaauagcuuuaacaauagagcuagcauaauaguauuuauuaaagaaucacaucugua

SEQ ID NO: 8109 - RNA, 63 nt, Human
uaugcuauguuggcuaaacuggugucaucacuacaguggcauaauauugacuggcacagcaug

SEQ ID NO: 8110 - RNA, 130 nt, Human
uauggcaaaagggaucguuaggaucaaaugccaucagaguuuuggagauugcguagcucuucauggucauuggggggugcaauugacgcagcuugguauggucgcuaaagccagguagggguugccaugg

SEQ ID NO: 8111 - RNA, 76 nt, Human
uauggggcuggucucaucauaucuaaagaacugcccagcuuuuacgcauuuugaaugugguggaaccagcugcaua

SEQ ID NO: 8112 - RNA, 85 nt, Human
uauguauuguacuuuuaaucacuuacugagaauauuucaaauuuauauucucaucaggaaaauguaaaaaagauacugauauaua

SEQ ID NO: 8113 - RNA, 131 nt, Human
uauguuaaauucaacaucucuuguaauugucauuugucuguuuuucaaauaacccaaggauuucuaucagugcauuugaaaggaaccuggggauagcuaucaaguggaaagagagagagaaagaauucaua

SEQ ID NO: 8114 - RNA, 62 nt, Human
uauguucgaugccugucaaguucaugucuagcugucaauuugugaauacggcaucgaggaua

SEQ ID NO: 8115 - RNA, 88 nt, Human
uauguugaauagaaauggggaaaguaggcauuccuaucuuguuccaugucuuagggggaaugcuuuuaacucugucccauucaauaug

SEQ ID NO: 8116 - RNA, 101 nt, Human
uauguuucuaaaaaaguuuaguucuaaagaucagagaaaaagcaugacacaaagcguuuugacuauuuuaugaauaugugaauugaaagagaauguacaua

SEQ ID NO: 8117 - RNA, 78 nt, Human
uauguuugccguaaagucacacaguccaggcuugauaaucuucugagaaauugauaaaagaugugugauguagacaug

SEQ ID NO: 8118 - RNA, 80 nt, Human
uauuagguggugcauaaguaaugugguuuugccaugacuuuuauggcaaaaccugcaauuacuuuugcaccaacuuaaua

SEQ ID NO: 8119 - RNA, 74 nt, Human
uauucauuuugcauugauaggcuuuggggguaauuugcagcuuagagcuauuauaaauagugcuguggugaaua

SEQ ID NO: 8120 - RNA, 74 nt, Human
uauuccauuucaagaaaguacgacuaucagcagccacaaaaccaagcugacagugugcaacucucauuggaaug

SEQ ID NO: 8121 - RNA, 73 nt, Human
uauuggauugccacacuggucugauugccugcaaguuuggugaggcugaggcaaagaaugguggcgucuggua

SEQ ID NO: 8122 - RNA, 62 nt, Human
uauuguagcauugcugucugcaagggagccccuagccccuggcagacauagcugcuucagug

SEQ ID NO: 8123 - RNA, 78 nt, Human
uauuuagguaaagcucuaagacucaugagccaacuuuucauguaacuggcuuuccuaggcuggggcuugaacuaagua

SEQ ID NO: 8124 - RNA, 73 nt, Human
ucaaaaggcagcaucugauugugauuugguccagaaauuccuggccagaauauuuccaguguggugcauguga

SEQ ID NO: 8125 - RNA, 86 nt, Human
ucaaaccaaggguugccaauaggacugcaguuuauuggacgugcguuuugugaccagcagcuucuuacaguagccaaaugguuuga

SEQ ID NO: 8126 - RNA, 81 nt, Human
ucaaagggaaugauagcauugaaggacucggggauaucuaacagcaauaccugaucacuacuucgcauuaguuucucguga

SEQ ID NO: 8127 - RNA, 90 nt, Human
ucaacagggauuuggugccaacuggagucuuggugaccaauggggauuaugaucaagaacaguuugcugaugaccaaauaccacuguugg

SEQ ID NO: 8128 - RNA, 78 nt, Human
ucaacucccugccaagaaaaauguagaugcaauucuggaggaguaugcaaauugcaagaaaucgcagggaaauguuga

SEQ ID NO: 8129 - RNA, 72 nt, Human
ucaagacugguguuuccuagagcuuuccauuggcaaaugcugccuccuggaacugagggacaaagguuuuga

SEQ ID NO: 8130 - RNA, 84 nt, Human
ucaagagacaacuuuaaaaacuccauugugguccauuuucuaaaacagacacacacggaggguggaguaaaguaaugucuagga

SEQ ID NO: 8131 - RNA, 82 nt, Human
ucaaggugugcucugcgcaaagacacucucugcucuagcuucuggagcucacguucauguugugccucuguuugcaucuuga

SEQ ID NO: 8132 - RNA, 60 nt, Human
ucaaguuuguauucaguacaguugucauucacuucuuagacaaagaauugacaggcuuga

SEQ ID NO: 8133 - RNA, 99 nt, Human
ucaaugcagaaagacacaccacaaguaagugcuuuuaaugucaaguuuuuuuugagggggaaacauuuaagcauuggacuuuacaaguguuuacauuga

SEQ ID NO: 8134 - RNA, 73 nt, Human
ucacagcacuacuucuucaauguaaauuuuuuguccauuuuacagaugaaaaaacugaggauuagagaaguga

SEQ ID NO: 8135 - RNA, 96 nt, Human
ucacagggccuaaaggaagagugcugggccccuggaggacugagggaagccggcagucccuggaggcggugccggcugcucuccaggcgccuguga

SEQ ID NO: 8136 - RNA, 72 nt, Human
ucacagguuaaaaaaaaguccuucaugaaaaagaaagaucuuaagcagcaugauggauucagaagcucauga

SEQ ID NO: 8137 - RNA, 77 nt, Human
ucacaugacaaugaagcagauauggcucucccgcugguucggcaagccauccccuuugcuuuuacaauacaguguga

SEQ ID NO: 8138 - RNA, 90 nt, Human
ucaccacggugauuagugaaguaacagacagcagccuggaaaauuuccuuccggccuuuucugcuuaacuguuuuaucacuaucugguga

SEQ ID NO: 8139 - RNA, 93 nt, Human
ucaccaucugcagccuugaaggagcuuugguucggagacaggcaaaggagccauguguggagagccugguuucucaguacuuccagaccguga

SEQ ID NO: 8140 - RNA, 80 nt, Human
ucacccuguugccuaggcaggacggaaugcagugaagucaucauaguuuacuguaacacugaacuccugggcucaaguga

SEQ ID NO: 8141 - RNA, 85 nt, Human
ucaccgcuaaugaaagcugggcacugcaaauguucugcuaugcuccagaaaucagaaguugccagcuuuuauaucuagacuguga

SEQ ID NO: 8142 - RNA, 73 nt, Human
ucaccuccgggaacaccugguuccccaucacucugugcagcagaggguggcgggacauguugcucaggaggga

SEQ ID NO: 8143 - RNA, 76 nt, Human
ucacucugucgcccaggcuggagugcagugguacagccucagcucacugcaaccuccaccucccgggcucaaguga

SEQ ID NO: 8144 - RNA, 76 nt, Human
ucacucuguugcccaggcuggagugcaguggugcaaucuuggcucacugcaaccuccaccucccggguucaaguga

SEQ ID NO: 8145 - RNA, 96 nt, Human
ucacuuuuuacgugagcguauaaucccaagaucaguguuauauuuuacuggagaagcuauugaagaugaugaugaugauuaugaugaagaagguga

SEQ ID NO: 8146 - RNA, 72 nt, Human
ucagaaacuguguugcacauugguguacaucucuuuaaauagauuucaccuuggcauucacacuuugucugg

SEQ ID NO: 8147 - RNA, 97 nt, Human
ucagaaauagaauugagccaguuuuuaucagcagcaauauuuucagguaauagggguucccaaauucuguuggguuuuaacugguggauguuaauga

SEQ ID NO: 8148 - RNA, 114 nt, Human
ucagaucaguagugacaugagauuuucauaggagcagaaacccuauugugaacuccaaacacaagggaucuagguuaugcacuacuuaugagaaucuaaugccugaugaucuga

SEQ ID NO: 8149 - RNA, 91 nt, Human
ucagaugaugggaaaacucgaguaaagcugcuguuucagaaucuggacaccaaacagauugagaugaaggaacucgaguuccaggaccuga

SEQ ID NO: 8150 - RNA, 84 nt, Human
ucagcacuguggugagcuccaaggaagugaauaaguuucagauggcuuauucaaaccuccuuagagcuaacauggaugggcuga

SEQ ID NO: 8151 - RNA, 84 nt, Human
ucagcacuguggugagcuccaaggaagugaauaaguuucagauggcuuauucaaaccuccuuagagcuaacauggauggguuga

SEQ ID NO: 8152 - RNA, 64 nt, Human
ucagcagcaaagucaugaggucccaggcuuuucuauacuuggagacuuuuuauuauugcuuuga

SEQ ID NO: 8153 - RNA, 77 nt, Human
ucagcaggaaagaguuuaaaagacuugaauggaaaucagaaauuuagggauuugagaaaauaacuuuuugguacuga

SEQ ID NO: 8154 - RNA, 86 nt, Human
ucagccucuguuucccuggucaaggccacggcuuuucucugauccugaggagaguuuccuaccagaguggaagcagggaggacuga

SEQ ID NO: 8155 - RNA, 94 nt, Human
ucagccuuggucaucugcgauggagcgcuuucucagaacuguaggacauagaacugugcacaggaacagcuuccagagccgaaaaccagguuga

SEQ ID NO: 8156 - RNA, 75 nt, Human
ucagcgcacgccacagggccaguuuuggcuggagaggccugaagcagagccagagcagguccaggugaguucuga

SEQ ID NO: 8157 - RNA, 76 nt, Human
ucagcuucagcuucagcuuggccucauucauuugaaaauaaaauguuuacaugaggccgcgccuguguccagcuga

SEQ ID NO: 8158 - RNA, 71 nt, Human
ucaggaauccuugguaguuuaacucuggaaguuuuagugggacuuugggaaacaaauacuauuuguucugg

SEQ ID NO: 8159 - RNA, 75 nt, Human
ucaggaguucaccauuagacucucacauuuacauauauuccggaagaugugagagucuaauggugagcucuauga

SEQ ID NO: 8160 - RNA, 78 nt, Human
ucaggaucagguuccccuucgcuccacgaugggcaggucauagcccaagggagcgcaggcaagauuugaaucuccuga

SEQ ID NO: 8161 - RNA, 98 nt, Human
ucaggauccaacaagagguucugcgguuuaauaucccgauggcagauuccaaaggaauggauauaggcuaaacuucggaaccucuuguuggauccuga

SEQ ID NO: 8162 - RNA, 71 nt, Human
ucaggccaucugggcguauacgugcaagucacagggaaugccgauggcuuggcuugggcucagaggccuga

SEQ ID NO: 8163 - RNA, 102 nt, Human
ucaggccuggagcccaggaagucugguuucgaauuucaugcuucuaaccugagcacuguacugcuugguggaguucucugcuaguccuaccuuucaggcaga

SEQ ID NO: 8164 - RNA, 98 nt, Human
ucagguggcggugcagaaggucaacgccgcaggcacagaucccagcucuccuguuggcuuugugcuugggguagaucuucuucacauauucccccugg

SEQ ID NO: 8165 - RNA, 99 nt, Human
ucagucucuucucucaccuaccccaguacagcagacaaaacucucugacccaguuuaugagguaggauccuaugaaauugucauaacuuuugagucuga

SEQ ID NO: 8166 - RNA, 109 nt, Human
ucagucuuuuugucuauuccuggauuuuggugaaaacagaaucuaaucuuauauucgcagccuuaagguuagaaggucacuuacauccaguaaucacaguaagaucugg

SEQ ID NO: 8167 - RNA, 79 nt, Human
ucagugcgggaaccaaugcagacuggcauuaaggcuguggauagcuuggugccaauuggucguggucaacgugaacuga

SEQ ID NO: 8168 - RNA, 79 nt, Human
ucaguugcuaugaagccagcuaccagccccucgaccucgacagaugcgacagggacuugucgcugaucaaugugauuga

SEQ ID NO: 8169 - RNA, 61 nt, Human
ucaguuguugguccgacccagaacgcuucaguucugcucugcaaggauauauaauaacuga

SEQ ID NO: 8170 - RNA, 74 nt, Human
ucaguuuccguagucuauucuuucccucauuuuuuucauuucucugauauuuuuaguuucugcuaucuaacuga

SEQ ID NO: 8171 - RNA, 85 nt, Human
ucauaaguucuguagauacuuaugcaugaacauuuucucauuuaguuuuuggguucauuauuuguauuguguuuacuacuuguga

SEQ ID NO: 8172 - RNA, 86 nt, Human
ucauauaaugauuuagggaggauuuccucuuuauccuguggaauagugccaauaggauugguaucaauucuccuuugaauguguga

SEQ ID NO: 8173 - RNA, 72 nt, Human
ucauauagcuguggggggcuuuaauauucuggacauuuauucacugauguuagaaucaucacacauaucuga

SEQ ID NO: 8174 - RNA, 87 nt, Human
ucaucaggccaugguggcagcuguugccuccgcgugcgcaguacagcaggugccaggcuucccaaacagcuccaacccgggugguga

SEQ ID NO: 8175 - RNA, 83 nt, Human
ucaucaucaucaucgucaucaucaucaucuucacguuuucuuuucaaugcauuugaugauucauuggcaguauuuugugauga

SEQ ID NO: 8176 - RNA, 60 nt, Human
ucaucgagauagacacuguuuaaggccgcauagguguuagucccaguuccauuuucauga

SEQ ID NO: 8177 - RNA, 61 nt, Human
ucaucuauaaguagcaucugggaagaggagaucgaggccacaguuugcuauuuuaguauga

SEQ ID NO: 8178 - RNA, 91 nt, Human
ucaugaauccuucugucugacuaacucaauaacuuucuauaaaagccaauggaauucaaauaggagcuaggagacaacaaguuauauauga

SEQ ID NO: 8179 - RNA, 85 nt, Human
ucaugauggggggagaugugggguugcuacgcuauguuuggccagggcuggaucaucagauacuccaugaaucuucuaaugguga

SEQ ID NO: 8180 - RNA, 65 nt, Human
ucaugcugcagcauauuguacuggccugcugcuggcccgcaggcuucucaauagguucggcaugg

SEQ ID NO: 8181 - RNA, 73 nt, Human
ucauggcagugauucaguaaacaagugcugaaaaagaaaucagccuaugguuuaagccugaagaacugguuga

SEQ ID NO: 8182 - RNA, 65 nt, Human
ucauggcccacuggucgcacaucacucuguaaagcagcaagagaugcaggugugacugguucuga

SEQ ID NO: 8183 - RNA, 104 nt, Human
ucaugucccucuaaaugcaaguggaugauugugccaauaagccaggagagaaggaaacaucuucagugguccaguggcacauucaaaauuguacaaugacauga

SEQ ID NO: 8184 - RNA, 80 nt, Human
ucaugucuaagucagagucuccuaaagagcccgaacagcugaggaagcucuucauggaggguugagcuugaaacaacuga

SEQ ID NO: 8185 - RNA, 75 nt, Human
ucauugcugauggaggaauccaaaaugugggucauauugcgaaagccuuggcccuuggggccuccacagucauga

SEQ ID NO: 8186 - RNA, 64 nt, Human
ucauuguggggcucauuuugagauuaccauucuggggacaaccuucagaugagaacugcuuuga

SEQ ID NO: 8187 - RNA, 72 nt, Human
ucauuuguuuugagguuaguuugauuagucauugguggguggugauuaagucgguggugaugagauauuugg

SEQ ID NO: 8188 - RNA, 67 nt, Human
uccaaagcacuuuuguugagugacaacccgauuagcaaggcccuguuacugaacaaagggcagugga

SEQ ID NO: 8189 - RNA, 88 nt, Human
uccaaaggcuccaacagggcccuccagacucaauggcaggguggugucugcacaagcuggaaguguccuugugaugagcccaucagga

SEQ ID NO: 8190 - RNA, 75 nt, Human
uccaaaugucuggauuuuccagcuagagauggggagcucuuaacuuucuggcuccuggucccaggcuccuuagga

SEQ ID NO: 8191 - RNA, 62 nt, Human
uccaaugacucuuucuuuaacuuuuuugccccuccugaaguuccugagaguggagaucugga

SEQ ID NO: 8192 - RNA, 69 nt, Human
uccacacuuccugggaggucagagacaacuguuucagaagagucagaugggcuucccaagacuugugga

SEQ ID NO: 8193 - RNA, 66 nt, Human
uccaccugccgggcauugguugggggacuucuugugcucuucaauguuugcucgggagguacagga

SEQ ID NO: 8194 - RNA, 80 nt, Human
uccacuaucuugaaagcuauucauuuccgagaacaugccacguguuucgcaacuaaaaaugguaucaaaguaacagugga

SEQ ID NO: 8195 - RNA, 66 nt, Human
uccagacuuaaggaaggaagucccaccaguguuuguugcauuugaauuuccuuuaaaaaugcuggg

SEQ ID NO: 8196 - RNA, 81 nt, Human
uccaggcauggacagagggaugcgaggcuggccuucccuguccacgguccucugaggcagcugaagucucccaugucugga

SEQ ID NO: 8197 - RNA, 81 nt, Human
uccagggggcgcuuccaguuuacaccuggccccaccauuugugaaaguuguggccaggcuagacuggaaaaccgugcugga

SEQ ID NO: 8198 - RNA, 66 nt, Human
uccaggucuuuuuaaagaaucaacauguauucacaguacuugggaugcuaagcaaaggaccuguga

SEQ ID NO: 8199 - RNA, 75 nt, Human
uccagugaccugggaagcgaagaagaggagguggaauuugggccaggacuuacuucuuugacauugggaucugga

SEQ ID NO: 8200 - RNA, 86 nt, Human
uccaguucuucugggagaaaaauggcaggcuucuggggaaagaaagccagcugaauuuugacuccaucuccccagaagaugcuggg

SEQ ID NO: 8201 - RNA, 112 nt, Human
uccaguuuuauccugacugauucuuuucuguuguccuuuguuuucuuucuccucuucuagaucucuaaaugaucuuugggggugggagugagagaacgacgucaguccugga

SEQ ID NO: 8202 - RNA, 72 nt, Human
uccauaaugaugggcuuuuagguuguuucuaauguuaugcuauuagcagcuguuuaauuccaauauaaggga

SEQ ID NO: 8203 - RNA, 76 nt, Human
uccauggauuuugguaucuuggcaggagggugguccuggaauuagccgccaccaugcccagcuaauaccccaugga

SEQ ID NO: 8204 - RNA, 62 nt, Human
uccauuuaagcuacagacuuagaugucuaaaaauauguguccugaucuguacagugaguggg

SEQ ID NO: 8205 - RNA, 71 nt, Human
ucccaaccauaggcuucaauguagaaacaguggaauauaagaacaucuguuucacagucugggacguggga

SEQ ID NO: 8206 - RNA, 68 nt, Human
ucccacagcacauccuacccggaagaccagccucagaggguccuucuggaaccagcugucuguggaga

SEQ ID NO: 8207 - RNA, 65 nt, Human
ucccagcuuccagaugcgacauccagaugacccagucuccaucuuccgugucugcaucuguggga

SEQ ID NO: 8208 - RNA, 76 nt, Human
uccccacagccgccccacagccagucccggggcagguccuugggccgcgccgaccggcugcagccgcauguggaga

SEQ ID NO: 8209 - RNA, 63 nt, Human
uccccaccgugaccugccuggccuccccugucucagggagcaggucacaggucaccaugggga

SEQ ID NO: 8210 - RNA, 75 nt, Human
uccccauucguccaaccaggcauucaucccggucacuuuugguuacaggacguggcagcugguuggacuagggga

SEQ ID NO: 8211 - RNA, 72 nt, Human
uccccccccagucucggagagcaacagaaaaaagcucuguaauucaguguuccaaccaccgccggggaggga

SEQ ID NO: 8212 - RNA, 70 nt, Human
ucccccuaccccacuuuugccuucuaacuuuggugcccagcucagggugaggcaguuaaggguccaggga

SEQ ID NO: 8213 - RNA, 96 nt, Human
uccccgaaagcagauacugagguggagaauggcgugcaggaagguucauaggacagugcugugggcugagccggcuggguacaggcuugucaggga

SEQ ID NO: 8214 - RNA, 66 nt, Human
uccccgcgccgcgagaccaggcucccgcuccgguugcggcgaccgccuccgcggcgccccugggga

SEQ ID NO: 8215 - RNA, 75 nt, Human
ucccguucccccagucagccuggcccugcuggugccuccggcgcuacgggcugggcaagauggcggccuucggga

SEQ ID NO: 8216 - RNA, 88 nt, Human
ucccuauaaaaguauacuuaucugcaguuucccuugucaagaguauuaaaggucugcauaaaguaaaagcuaauacuauccugaggga

SEQ ID NO: 8217 - RNA, 93 nt, Human
ucccuccugugucccaaaacgaaaacacuccuauauuuuguagcgccuuccagaauggggcagcggaaacuaguguugggacaaaggaggcga

SEQ ID NO: 8218 - RNA, 103 nt, Human
ucccucugugcccgucuuaucuguauuuuacugucugcucuuucugacugcuuguaaugagaagacaagugauuuucuugaaaugccugaggcuagaaaggga

SEQ ID NO: 8219 - RNA, 87 nt, Human
ucccuggccgaggggcaggcuccucacggccucccugggaccccaggcgcgucgggaggcgucguccuccagccccgaggccggcga

SEQ ID NO: 8220 - RNA, 95 nt, Human
ucccuuuuauuaaccaucuucccuuucucgaguauacacaaguagaaaagaaacagugaaguaccccgauagggaggguggggagaggaugggga

SEQ ID NO: 8221 - RNA, 85 nt, Human
uccgaaagaagcuggugaucguuggggauggugccugugggaagaccugccuccucaucgucuucagcaaggaucaguuuccgga

SEQ ID NO: 8222 - RNA, 74 nt, Human
uccgaugcuacuauuuuauugcaggagguggggguguaugcaccgcacaccggggcuaugagaagcaagaagga

SEQ ID NO: 8223 - RNA, 71 nt, Human
uccgccggccguggucgccgagucggugucguccuugaccaucgccgacgcguucauugcagccggcgaga

SEQ ID NO: 8224 - RNA, 93 nt, Human
uccggauuggcagguagcgggucaggggucgugccugggaaaauuguuucucccgcaucuugaccuccuucucgaccagcugcugccuccggg

SEQ ID NO: 8225 - RNA, 79 nt, Human
uccgggaaaggauuaagauuggagaagacuaugcgaagaccuuagcuaagcucucucagaacucuuggcuuucaaagga

SEQ ID NO: 8226 - RNA, 105 nt, Human
uccgguugcgcuuuccuuucugucaagaagcaguuugaagaauuaacccuuggugaauuuuugaaacuggaccagagaaagagccaagaacaaaauugcaaagga

SEQ ID NO: 8227 - RNA, 86 nt, Human
uccguagugaccggcggcguccaaucagucaugggcucccgcuugggccagauggugcugagugggugucgacccggugcugggga

SEQ ID NO: 8228 - RNA, 73 nt, Human
uccgugcgcguugcugcggccgugguccgcgcccuuccucggcgggccggacuggucuccagaaaugcuuggg

SEQ ID NO: 8229 - RNA, 76 nt, Human
uccuaagucuucuuccauccagucaagccagaagaugcccaggggaguagggagguuuggggagggagguuuaggg

SEQ ID NO: 8230 - RNA, 90 nt, Human
uccuacgagaugaugaugcagugugugucccgcauguuggcccacccccugcaugucaucucaaugcgcugcaugguccaguuuguggga

SEQ ID NO: 8231 - RNA, 101 nt, Human
uccuagaggugaccagaauuuaaugucagggccuaaauagucauugaguagauugcauuccuauuggugcccucgaagaccucacuugugcaccuguggga

SEQ ID NO: 8232 - RNA, 83 nt, Human
uccucaaguuccuccagcuuuuuaugucugauaugccaaagccugccuucaugaagcagaaccuggaugagcuuggaauagga

SEQ ID NO: 8233 - RNA, 69 nt, Human
uccucacugaaugaggcguuugaguuuuacugguagccagugccagcaaacaaaucaacgccuugagga

SEQ ID NO: 8234 - RNA, 77 nt, Human
uccucaggcccuuuaacccuugcagaucggauggagaaagcugccagcacguucuagggaugggggcagauugagga

SEQ ID NO: 8235 - RNA, 108 nt, Human
uccucccccaggcauucuggucacuguuccuuuuuguugagaucauucucggugucucauauagcuggguugcagcuccguucuuugccaggaggugguaauagagga

SEQ ID NO: 8236 - RNA, 87 nt, Human
uccuccugucuuggucuaaacauguugagauuacaggcuugagccaccaugcccagccugaaaaacuuuuaagacaagacauuagga

SEQ ID NO: 8237 - RNA, 72 nt, Human
uccucuauccccugaccuucagcugaaccucaaauccugguaggccacccuuugguucucagggguacagga

SEQ ID NO: 8238 - RNA, 81 nt, Human
uccugagcucgcgcuguccucucguguggccacagccugauacaggcuggaaagguccaggaguuggguccgagcccagga

SEQ ID NO: 8239 - RNA, 84 nt, Human
uccugagcuucuucuaccucugagaguuuuucaucauuuuccaauguuugcugaaguucauggaugguacuaagaagaacauga

SEQ ID NO: 8240 - RNA, 80 nt, Human
uccugauguuugggacagcguaucuguaccagugcucuaaauaacaaaagcuagggugacaaguacauguuccuuuggga

SEQ ID NO: 8241 - RNA, 63 nt, Human
uccugcagagccgcuggugaccugggugaaaacuuuuggcccguuuggaagcggcacgcagga

SEQ ID NO: 8242 - RNA, 103 nt, Human
uccugccuggaaguuuaggucaaagaggcugcuuggagcaaaauacaguggugucucaucccaaauauucuccaggcguuucuuccauccuuccaggauuuga

SEQ ID NO: 8243 - RNA, 61 nt, Human
uccuggcccuguugguggcaggccuagcccaaggcaucagaggcccccuuagggcccagga

SEQ ID NO: 8244 - RNA, 102 nt, Human
uccugggucccaggaagauugagggaggggaugcugcagauguggaaguccaguuuucuuaccaccuugucagaauuuuuucccuucucuggggucccagga

SEQ ID NO: 8245 - RNA, 70 nt, Human
uccuguaguguuccuggagaagcuagagccugauuguaggcuacuacucaucaauuaacuucuacagugg

SEQ ID NO: 8246 - RNA, 92 nt, Human
uccuguccagcugcucuauccagugucccgauucagcaaugucaaaucccuccagcaccuuugcagauuccggauacgacagcucgucagga

SEQ ID NO: 8247 - RNA, 74 nt, Human
uccugugcugcaguagaaauuagagcauguccugcuuuaugcaggcuuugcuuuaguucuucugaaguguauga

SEQ ID NO: 8248 - RNA, 102 nt, Human
uccuuaagugguuucuccgaggcagucuggggcagcugguuaagaaaucuugcaucuuccagccagaguccauggacuagucacgcuugaucacuaaaaggg

SEQ ID NO: 8249 - RNA, 85 nt, Human
uccuugaacuuggaaccugacaauguugguguugucguguuuggaaaugauaaacuaauuaaggaaggagauauagugaagagga

SEQ ID NO: 8250 - RNA, 88 nt, Human
uccuuuuccucuuuuccuuccuccucuuuggaauuuuccugggaccuacagaauaaagggggggauggacaggggguuuucaaaagga

SEQ ID NO: 8251 - RNA, 77 nt, Human
ucgaaaaucuguugaucgacugguuuuuugcagcuuaacuucaaaugcaauccugguucuuuugacacaagauucga

SEQ ID NO: 8252 - RNA, 93 nt, Human
ucgaacauugcagagguacugagccauaacagagaggcgacuacgcuguugcuuccuguauuggcugcaagucucucugccacuuccuuuuga

SEQ ID NO: 8253 - RNA, 71 nt, Human
ucgaacuccugaccucgugaucugcccgccuuggccucccaaagugcugggauuacaggcaugagccucgg

SEQ ID NO: 8254 - RNA, 70 nt, Human
ucgaucuccugaccucaugauccgcccgccuuggccucccaaagugcucggauuagaggcaugagaauga

SEQ ID NO: 8255 - RNA, 70 nt, Human
ucgauuccgagcguagcugucuggaggagagacacuagacugcauuuccucgcgagugacgcuggaacga

SEQ ID NO: 8256 - RNA, 83 nt, Human
ucgcuauggaaugggaacgucuguugagagagcggcagccagcacugauuacuacaagagaggcgauuucauuccugggcuga

SEQ ID NO: 8257 - RNA, 74 nt, Human
ucgcucuaucacccaggcuggagugcaguggcaccaucagcucacugcaaccuccacuuccuggguucaagcga

SEQ ID NO: 8258 - RNA, 78 nt, Human
ucgcucuuuguugcccaggcuagagugcaguggcaugaucucggcucacugcaaccucugccuccuggguucaagcga

SEQ ID NO: 8259 - RNA, 90 nt, Human
ucgcugacagguccucugauuguccaaguguacucuucaagauuccaguuuggacagugcagccuuggaacaaauuaggacuggggguga

SEQ ID NO: 8260 - RNA, 93 nt, Human
ucgcugcagcagcaugcacuucuugguagcagaauggaaugaaccauccaucaacuucuauaaaagaagaggugcuucugaucuguccaguga

SEQ ID NO: 8261 - RNA, 63 nt, Human
ucggaggugucugagguugccaucagccagggcgaggucacccuggcccucaggaaccuccgg

SEQ ID NO: 8262 - RNA, 64 nt, Human
ucggcuccaagucugacccacucugcauccuuuuacaggaugugggagggggcagcugggcuga

SEQ ID NO: 8263 - RNA, 88 nt, Human
ucgggcgucuguccacacacaugaguuauguaccaacaacacuguguugauggcauugcuuauguguaggugaagcagucacgccuga

SEQ ID NO: 8264 - RNA, 85 nt, Human
ucggggcagcggucacggagcaggagcugcuggcgcuggacaccauccggcccgagcacguccugcgccucagccgggucaccga

SEQ ID NO: 8265 - RNA, 81 nt, Human
ucgguguggaggcaguguuugauuucaacugguuaucuguuaaaaggcuugugucccagugcaacacuaccuuugugcaga

SEQ ID NO: 8266 - RNA, 88 nt, Human
ucgugaacaguaauggggagcuguaccaugagcaguguuucgugugcgcucagugcuuccagcaguucccagaaggacucuucuauga

SEQ ID NO: 8267 - RNA, 66 nt, Human
ucguggccucggugaugcuuaacguccgccugcaggugcggaucgagugagcgccggcggcggcgg

SEQ ID NO: 8268 - RNA, 85 nt, Human
ucuaaauuaauuuggcaaaagauaggguacuuaguuuccuguuacugaguuagcucuacgucuucuggaccaaagcaacaugaga

SEQ ID NO: 8269 - RNA, 73 nt, Human
ucuacacuguggaguacgccugcagcgccgugaagaaccugguggacagcagcgucuacuuccgcagcgugga

SEQ ID NO: 8270 - RNA, 82 nt, Human
ucuacagaggcccuggcacauuuuuccuuuccaccccugaguccaccaaagcaaaauguccccuccagggccccucuguggg

SEQ ID NO: 8271 - RNA, 87 nt, Human
ucuaccacaccaaugccuucauggucuuacaucuuguccucuuaacccugacuucucuagcccucaugaaugcuuuaguguggcaga

SEQ ID NO: 8272 - RNA, 72 nt, Human
ucuagauuaauagcuuuaaacaggcaugaccuugcuuuuguccaagcucaaaugucugugugcaugucuaga

SEQ ID NO: 8273 - RNA, 107 nt, Human
ucuagggagacccaggacccgggagagagguagaggggagcagagacagccaccagcuucuaucuucugcucuaagcacauucuuucacgaguuuaaguuuccuaga

SEQ ID NO: 8274 - RNA, 67 nt, Human
ucucaagggcacuuuggccagcugagugaacugcacuguugacaagcuggcauguggauccuugaga

SEQ ID NO: 8275 - RNA, 71 nt, Human
ucucaauaucuauaugcuuugaaaacaagaaucuauuacaaauaagcuuggccuaagagcuagaguuggga

SEQ ID NO: 8276 - RNA, 60 nt, Human
ucucacauccaucaaaggaucucacacuggaaagagguccuauaauguaggaaugugaga

SEQ ID NO: 8277 - RNA, 74 nt, Human
ucucacucugcuggggacccaugaacagcacugccaaggagcagaccuuuuauuggguccccaaaaggaugagg

SEQ ID NO: 8278 - RNA, 75 nt, Human
ucuccaagcuggagaaugggggcuucccuaugagaaagaucucauugaggccauccgaagagccaguaauggaga

SEQ ID NO: 8279 - RNA, 74 nt, Human
ucuccagccugaaguucuccuccugcaacugcuccagcugggauugcagcagcagcagcuucuuggcagugaga

SEQ ID NO: 8280 - RNA, 101 nt, Human
ucuccauaucugauuucagauaacuuagaacagccuaugggaaguagucaugcaucucagguuuguucugagacaccugaugaccuguuagaugaugguga

SEQ ID NO: 8281 - RNA, 97 nt, Human
ucuccauguuugccucuaaauucagaacagcucccaucaagauccuagcaggacuuuuguguaacugcugguucugaagugaggguggagguggaga

SEQ ID NO: 8282 - RNA, 89 nt, Human
ucucccaggguuagaugacugcgggaagccuuugaucccaacccccaaggcuuuguauauuugaucauuugugaucuaacccuggaaga

SEQ ID NO: 8283 - RNA, 89 nt, Human
ucuccccaucacccagaugccuuccccagccuccgagcccucauagccgcucgcuauggggaggcuggggagggucccggauggggagg

SEQ ID NO: 8284 - RNA, 83 nt, Human
ucuccuccaugugucuuggcaggcacucauuucuguggcugucggcagagggaauguucuggagcugccaaggagggaggaga

SEQ ID NO: 8285 - RNA, 68 nt, Human
ucuccugggcuucucagugucucgccggcgggguucggccugagcuggauugacauagcccuugggga

SEQ ID NO: 8286 - RNA, 64 nt, Human
ucucggagagcaggacaucgaauguaaagcgcagaugggacuucgacaggcuucuucucuggga

SEQ ID NO: 8287 - RNA, 65 nt, Human
ucucggugugauugaugccccucaaaacucucguugcaguugggggguagagguugacacuguga

SEQ ID NO: 8288 - RNA, 75 nt, Human
ucucgugugccuuucccauaguaucguaaggacguuucgaguaauuuacaacaacuaagggaguguauaucggga

SEQ ID NO: 8289 - RNA, 76 nt, Human
ucucuacuguaauuaauugggucuauuauuaacucucuguuccaucauagaauguggccaggccuuacaauggaga

SEQ ID NO: 8290 - RNA, 87 nt, Human
ucucuaggcaaaugccuucaaguuuuccaguucugagguaacuaguucaguuuguugggauggaagcaugaaggaaagggcuagaga

SEQ ID NO: 8291 - RNA, 66 nt, Human
ucucuaucuguccaccaucuugccuugcccuuccuggggcugaggcagacaaaggaaagguaauga

SEQ ID NO: 8292 - RNA, 131 nt, Human
ucucucagguucuaugaggucaaggagcuugcuugucuuguucacuaugaaacucccaaauguucagcauauugccugguucucaaugaauacaaaggaaggcacuguucugagaugguaugaggacugga

SEQ ID NO: 8293 - RNA, 73 nt, Human
ucucuccaaguugucaggaaaccucugguuccccauucuccuggcgguacagcaagcacugacagugaguaga

SEQ ID NO: 8294 - RNA, 62 nt, Human
ucucucccucuauguuuuauuucauugccuggcaaagaagacagacuucaguugggaagagg

SEQ ID NO: 8295 - RNA, 127 nt, Human
ucucucuucccucucaucauagauuaaucacuuaguugcaagggaccaguaaauuaacagaauggugaacauuuuccuuuucuuggugcuuuugcuggaugacuagugguuucugcuggaacagaga

SEQ ID NO: 8296 - RNA, 73 nt, Human
ucucugaagcaacaggaucugagacuaaaaaaagugguaaaccugggccauucuugcugucuggauccagaga

SEQ ID NO: 8297 - RNA, 80 nt, Human
ucucuggcuggaccuggacugcagucacacucuaagagcuccucuuucuacaccucugccagugggcguucggucagaga

SEQ ID NO: 8298 - RNA, 78 nt, Human
ucucuuaaguuguuuuauuaaguuaauuugucuuacugaccauauaauuuagaacaaaaagcagcuguacuaaagagg

SEQ ID NO: 8299 - RNA, 81 nt, Human
ucucuucccacugcaggaagauugcagaaggcuguggauuaauuguagcauuucacugaucuucacuccagucacuaggga

SEQ ID NO: 8300 - RNA, 98 nt, Human
ucucuucugaacaagccccaucauuuggugaaccuccacccuaacaaaguagcgaugggguugggggcuaaauuaauuggaguggggcgaggacgaga

SEQ ID NO: 8301 - RNA, 76 nt, Human
ucucuuguccccuccuuuggcugccauuuuccaaugcaaugauaaggucugacagcugguagaggcagacaucuga

SEQ ID NO: 8302 - RNA, 93 nt, Human
ucucuuuauucucaguuuugcacaguaauaaguugacucacacagacuuaaagccugaaaacaucuuauuugugcagucugacuacacagagg

SEQ ID NO: 8303 - RNA, 79 nt, Human
ucugaagauagaucgccaucaugaacgacaccguaacuauccggacuagaaaguacaugaccaagcgacuaucuucaga

SEQ ID NO: 8304 - RNA, 66 nt, Human
ucugaaggaggcuuggcggugguugggcugguggcugagccugacugccucaucuucuccgccaga

SEQ ID NO: 8305 - RNA, 64 nt, Human
ucugaaguguaugugauauuguguauuguuacaauaauacacaauauuauuaaaguauauguga

SEQ ID NO: 8306 - RNA, 74 nt, Human
ucugaaucuucugggaggcagcggaaucugagacgaauccaggguccaaaucccgcaagcuccagaagcacaga

SEQ ID NO: 8307 - RNA, 74 nt, Human
ucugaccagcacccacacucaggcucuggccgcaguguccugucauucgagucagguucugggggcugguuuga

SEQ ID NO: 8308 - RNA, 91 nt, Human
ucugaccucaacuccaaaggagcuuuggcuucccugggccccagucggugacuucaggcaaaggcaaguuuugcuucugaguucccauaga

SEQ ID NO: 8309 - RNA, 115 nt, Human
ucugagaugcacugguauaauucacuggcuugcccaguugguacucucuuagccguggcuauuccugaugacuaacuggcaguaaaagccaggaaauuauggaggucuacugagg

SEQ ID NO: 8310 - RNA, 65 nt, Human
ucugagugcuaaauuuggaagacagcuuguaccugguuggaagcuuuguccaaaaugcacacaga

SEQ ID NO: 8311 - RNA, 72 nt, Human
ucugcaaggugguggaagugggcagcaagaucuacguggaugaugggcuuauuucucuccaggugaagcaga

SEQ ID NO: 8312 - RNA, 77 nt, Human
ucugcaagugugaaaggaaggcacuaaggaaagaccaccugguccugggccugccucuuccccuagcacccaguaga

SEQ ID NO: 8313 - RNA, 84 nt, Human
ucugcaggccuccuuuaugacuaaauccagccauuaagcuucaaaugaguuaccugcuggcauuguguaagggcagccagcaga

SEQ ID NO: 8314 - RNA, 106 nt, Human
ucugcauggacucaugguguggauggguuucugaggguguugguagcaguaacgguuccacaugaugaaacccagauggcugcuccccacugugcauccacccgga

SEQ ID NO: 8315 - RNA, 77 nt, Human
ucugcugcuucaacaacagugacuugcucuccaaugguauccagugauucguugaagaggaggugcucuguagcaga

SEQ ID NO: 8316 - RNA, 73 nt, Human
ucuggaggagcaguugucugaugaagagaaggugcguauagcagcaaaauucaucauucaugccccuccugga

SEQ ID NO: 8317 - RNA, 97 nt, Human
ucuggauuaucuacaaguguuugcuauuuacaaugugaaguuugcgaagugccgcguggauuuuuaugugaaacaagcauuucuguuacgguucagg

SEQ ID NO: 8318 - RNA, 77 nt, Human
ucuggcugcagaucuggagguggaggcaguacccuggacucuauucugcugccccuucaggguuuggaggagccgga

SEQ ID NO: 8319 - RNA, 65 nt, Human
ucuggcuggggauguucauauugugagaggagacuucgaugagaaucugaauuauccagaccaga

SEQ ID NO: 8320 - RNA, 66 nt, Human
ucugguauguuucuuauagcaaacuguuguucaugcaacacuugugcucaaaggggaaggcacagg

SEQ ID NO: 8321 - RNA, 80 nt, Human
ucugguguggagacuucgugguggugcuaagaaaaggaagaagaagucuuacaccacucccaagaagaauaagcacaaga

SEQ ID NO: 8322 - RNA, 63 nt, Human
ucugugcacuugauaauaacccugcaggcguucugcgugaaccaggcuguuaagugcaccaga

SEQ ID NO: 8323 - RNA, 76 nt, Human
ucuguguccagcccuugcagagagcuuuguccucugacaucagcuaccacacaggcucauucucaacuggcacaga

SEQ ID NO: 8324 - RNA, 63 nt, Human
ucuguguuugaagugucuauugggcuagcaugguuagaaauagaacauuaccaucauugcaga

SEQ ID NO: 8325 - RNA, 89 nt, Human
ucuuaccccaguauccuauuaucucauaccuaaggcagugaugguuucucagaccucuuagauugagaagauguggcauggguguaagg

SEQ ID NO: 8326 - RNA, 74 nt, Human
ucuuauaccccaaaagucauacagugucagaacaaaggcugggauggguaugauguaacagugggaauguaaga

SEQ ID NO: 8327 - RNA, 89 nt, Human
ucuuaugguuuauuccucagguaucauucugaucauuguuguuacaggagagaugagaggaaguuagaggggcuagaagaaccaggaga

SEQ ID NO: 8328 - RNA, 98 nt, Human
ucuucaaacauuuaaaucaagcuuuggacuaauuaugcuaauuugugaguucugaucacuuuugagcucugaagcuuugaaucauucagugguggaga

SEQ ID NO: 8329 - RNA, 61 nt, Human
ucuuccaucggccucggucuuuuagauucccugccuucgagccgaaccgagauuuggaagg

SEQ ID NO: 8330 - RNA, 80 nt, Human
ucuuccauugacauaaaaauagucucaggcuugugugggaaaauuaaguauauagauacuauugcauuuaucaagggaga

SEQ ID NO: 8331 - RNA, 121 nt, Human
ucuucccuucaucuccaggggucauccccucaccuuauugggcaaaacugcaucaaucuccuuuugcaguuucugcuggacaucagggugaguggccaguucauauaaagugaaggaaaga

SEQ ID NO: 8332 - RNA, 73 nt, Human
ucuuccggcagaccgauugccuucaugaaggcuucaaaguuuuccuggcucugcaguugguacuugccggaga

SEQ ID NO: 8333 - RNA, 77 nt, Human
ucuuccuccucugugccuggugcuucucaggcccucaggggccucccuucaccgccaccacccccgggagaugaaga

SEQ ID NO: 8334 - RNA, 80 nt, Human
ucuugaccauauaccuuggaguugaauauuguuuucauacugcugugguuugaauguucccuccaacacucauguugaga

SEQ ID NO: 8335 - RNA, 72 nt, Human
ucuugagaagugggugagggcaugcaaauguaaaaaaguaagguguguucugggaucuacuaguucuugaga

SEQ ID NO: 8336 - RNA, 86 nt, Human
ucuugcacugccaccucacuuuccaccacugucagccuggaaagagauccaggucuggagcuggagagaacaggcccugugcagga

SEQ ID NO: 8337 - RNA, 69 nt, Human
ucuugcccaggcuggagugcaguggugcgaucuuggcucacugcaaccucugccuccuggguucaagca

SEQ ID NO: 8338 - RNA, 96 nt, Human
ucuugcccgccccucagcacccugccuugucuccaggagguccgaagcucugugggaccucuugggggcaagguggggugaggccggggaguaggg

SEQ ID NO: 8339 - RNA, 96 nt, Human
ucuugccucuuauuuacauucuccaaacucacuauccauucagcuuguguuagaaggaaugcuaaaaguauggggaguuguaguaugggaccaaga

SEQ ID NO: 8340 - RNA, 63 nt, Human
ucuuggcuuccacguccauugcucagcucacagugguacagaccaaguauguggaagccaagg

SEQ ID NO: 8341 - RNA, 75 nt, Human
ucuugggaacuggaguaaaggucacucuugcuacgcuuuagcagagacugguggcauuuugccccugcccugaga

SEQ ID NO: 8342 - RNA, 69 nt, Human
ucuuguaaacgauugggcuccagcuaucgagccuuaccaaagaguuaccagcagccccaguguacagga

SEQ ID NO: 8343 - RNA, 80 nt, Human
ucuugucucagcaacuuucccaucucgucucuucucuuguaacaagagaagagacgagauguacaagagaagagacgaga

SEQ ID NO: 8344 - RNA, 82 nt, Human
ucuugugucgagacuucgugguggugcuaagcaaacaggaagaagaagucuuacaccacucccaagaagaauaagcacaaga

SEQ ID NO: 8345 - RNA, 80 nt, Human
ucuuguguugagacuucgugguggugcuaagaaaaggaagaagaagucuuacaccacucccaagaagaauaagcgcaaga

SEQ ID NO: 8346 - RNA, 80 nt, Human
ucuuguguugagacuucgugguggugcuaagaaaaggaagaagaauucuuacaccacucccaagaagaauaagcacaaga

SEQ ID NO: 8347 - RNA, 81 nt, Human
ucuuguguugagacuucgugguggugcuaagaaaaggauagaagaagucuuacaccacucccaagaagaauaagcacaaga

SEQ ID NO: 8348 - RNA, 80 nt, Human
ucuuguguugcgacuucgugguggugcuaagaaaaggaagaagaagucuuacaccacucccaagaagaauaagcacaaga

SEQ ID NO: 8349 - RNA, 84 nt, Human
ucuuguucaacauaggguagguggcagccacggguccaacucgcuugaggcugggcccugggcgcuccauuuuguguuccagga

SEQ ID NO: 8350 - RNA, 98 nt, Human
ucuuguuucuugauggucaguucguauggaaugcaccugcaaggguaccuccuugucugaaagucgugcuuuaaaccuaacuuaauuaagagacgaga

SEQ ID NO: 8351 - RNA, 66 nt, Human
ucuuugcagggccaauauugacagcagagucaccaaacacuuccuucaguuaucggucaacaaaga

SEQ ID NO: 8352 - RNA, 64 nt, Human
ucuuugcccccuuuggcaguggcugcccagucaaugggcagagccagcugaggggggcuuugga

SEQ ID NO: 8353 - RNA, 62 nt, Human
ucuuugcccgucuccuggggaccccccaacgaaauguggaguccucgggggccgugcacuga

SEQ ID NO: 8354 - RNA, 121 nt, Human
ucuuuuauaguuuauguuuucauuuuggugaagccuuaaaaugagaaggcagaugacaaugcucaguaacuagucugcuuucuugacccagagccuuaaugauuuuuaagcuuauaaagga

SEQ ID NO: 8355 - RNA, 91 nt, Human
ucuuuucaauaccugguaugguaugaggcacaggauaguugcugacaaacauuuguuagcuaauuaucaugugcugggggaguuggaggga

SEQ ID NO: 8356 - RNA, 73 nt, Human
ucuuuuuaccuggccgugugguuagugauugguacuauuagcaaucagcuaacuacacugccuaguaacuaga

SEQ ID NO: 8357 - RNA, 90 nt, Human
ucuuuuuccuacuucugcaguggggucugucuccuuucauuuucacuauuugaacagcugacgguaagcuccuugaggacaggaaccaga

SEQ ID NO: 8358 - RNA, 101 nt, Human
ucuuuuucugagguuucauuccaaugagaguugcacacugucagcuugguuuuguggcugcugauagucguacuuucuugcuauucacaacaagaaaaaga

SEQ ID NO: 8359 - RNA, 64 nt, Human
ucuuuuuuaguaacagaguacucguauacuuaucacuguaugcacucauugggucuaagggaga

SEQ ID NO: 8360 - RNA, 78 nt, Human
ugaaaagugcuccccaucaucugaagaagcagcaccugguaacaggcauggccauucagaggguacuuagcauuuuca

SEQ ID NO: 8361 - RNA, 80 nt, Human
ugaaaaugaguucacaauagauguauggauuuguuucuugguucucuauucuauuuuauuggucuaggugcuuauuuuua

SEQ ID NO: 8362 - RNA, 104 nt, Human
ugaaacagacugggccaauguccacaaagaauuccuggucagcaccaccgauguccaaaggugcaauaucaaggaagggcaggcgugauggcuuauuuguuuug

SEQ ID NO: 8363 - RNA, 72 nt, Human
ugaaaguuuaguuuuauuauggacacuuuaugcaaacauuucaauacuuuuggcuacuucuauaaucuuuua

SEQ ID NO: 8364 - RNA, 78 nt, Human
ugaaaucuacauuagcagugcugugcaagauucuuacauaauucaagaccuaaaaccagccugcagugugagguuuca

SEQ ID NO: 8365 - RNA, 62 nt, Human
ugaacaacacacacgcugcuguaucucccugugggcagauuugguagccucguguggguuua

SEQ ID NO: 8366 - RNA, 110 nt, Human
ugaaccagcuucucagcucuacuguguuugacccuguguucaagguuaggggaauuauaguuucccaggucuccaucguggggguaaucagaggggcagagaaggcuuca

SEQ ID NO: 8367 - RNA, 99 nt, Human
ugaaccuuaccuaaauaaugaaagccagccagauucauuuuccacggcacaugguuuccuguggguaagauguguuuauuugguuuugguacaaguuca

SEQ ID NO: 8368 - RNA, 77 nt, Human
ugaacugaaugagagagaaaaagagguccagaguaguuuguggagcgauguuuccaucucuaaugccacucagcuca

SEQ ID NO: 8369 - RNA, 81 nt, Human
ugaagaaaaaaugcaaacugaccgggcaaauagauucgaguauuuauuaaagcagacagaacuuuuugcacauuucauuca

SEQ ID NO: 8370 - RNA, 73 nt, Human
ugaagaagguguagcucucggcggggauguuacccuuggaccaggaacacuuuguuguagcugcccuccauca

SEQ ID NO: 8371 - RNA, 72 nt, Human
ugaagaagguguagcucucggcggggauguuacccuuggccaggaacacuuuguuguagcugcccuccauca

SEQ ID NO: 8372 - RNA, 92 nt, Human
ugaagacuccaucacaguuccagauggguaggaauaccuugcagggcuggggcaagguauugccuucucuggaaggcugugcauucucuuca

SEQ ID NO: 8373 - RNA, 102 nt, Human
ugaagauccucacugagcgaggcuacagcuucaccaccacggccgagcgggaaaucgugcgcgacaucaaggagaagcugugcuacgucgcccuggacuucg

SEQ ID NO: 8374 - RNA, 82 nt, Human
ugaaggaaccaaggcaacagggggguuccuggauccuauuuacucgggaaaaaccuuccuaaaccuggccuuggcccuuuua

SEQ ID NO: 8375 - RNA, 69 nt, Human
ugaaggcagucacagaacaggggcaugaacucuccaacgaagagagaaaucugcucucuguugccuaca

SEQ ID NO: 8376 - RNA, 62 nt, Human
ugaagggaggcacugaggucuucugaucuggggagaacagacugggacucaucuuccuuuca

SEQ ID NO: 8377 - RNA, 70 nt, Human
ugaagucacacaugaaagaagccaugaucaagcuugguuuccacuugcucugcuucuucauguaucuuua

SEQ ID NO: 8378 - RNA, 94 nt, Human
ugaaucuacucugacguggccaaaggcauccugcaguacguggcucggagccugagccaccgguccggaggcuucuauacgcgcagaagaugca

SEQ ID NO: 8379 - RNA, 79 nt, Human
ugaauucagugagauacaaaaagcuccuucuguauuggagaauuccgauggagugaauacaugugauauccugaauuca

SEQ ID NO: 8380 - RNA, 80 nt, Human
ugacaaguuuuuguuuguauccaauuacagaguuccauaagacuaugauuugaauauugugguacaacuuaaauuuggca

SEQ ID NO: 8381 - RNA, 101 nt, Human
ugacaaucuugguuaccauccauuaagugcugcugauuuuggaaagaucaugaaaaacgucuuuccaaacaugaaggcacgucguuugggcacaagaggca

SEQ ID NO: 8382 - RNA, 62 nt, Human
ugacauuagcagcauuaggucuauagguggcugcuuaacuaauuaugaacucagcugcuuca

SEQ ID NO: 8383 - RNA, 64 nt, Human
ugaccaaaacugugccuuguggaaaugaacuucacaaguuccucaucugggacacugcugguca

SEQ ID NO: 8384 - RNA, 75 nt, Human
ugacccacacagcuggccacuugcuggucaugcucugaaacuuugcaucagggcuguaccagcuggucaggguca

SEQ ID NO: 8385 - RNA, 77 nt, Human
ugaccccaacccauccugccagggcagggccuaucuuccugccucuggaagacuuguugcagguggguaguggguca

SEQ ID NO: 8386 - RNA, 85 nt, Human
ugaccucaaagucacaacccucauauguuaaaucauggccggcagcucaugguacagauuuggcgaaggguuguggggagaguca

SEQ ID NO: 8387 - RNA, 93 nt, Human
ugaccucauggagaagagguuggcaagcaugguggagaggccuugagccaggcagcucugggcuaugaagcccaacuucaacucugcgaggca

SEQ ID NO: 8388 - RNA, 87 nt, Human
ugaccuggcggacaggugggagccacagcguacaccccaugauucccucugugcugugcguagugccuacugcuugcuuccagguua

SEQ ID NO: 8389 - RNA, 96 nt, Human
ugacuugcugagauguccgucuauucuugaagagcgguauucuuggagcugauaccucuguugaucuugaagaaaguugggcgugucuauaaguua

SEQ ID NO: 8390 - RNA, 72 nt, Human
ugagaauacacauuguauguuucugugcacaugacagugugugugugugcacguacauacuguauagucuua

SEQ ID NO: 8391 - RNA, 62 nt, Human
ugagaauguuccccccauuggaaacugacgcuuggcuccuuucuuguggauggauuuucuca

SEQ ID NO: 8392 - RNA, 102 nt, Human
ugagacacagucucgcucugucacccaggcugcggugcaguggugugaucuuggccucacugcaaccucugccuccuggguucaagugauucuucugccuca

SEQ ID NO: 8393 - RNA, 101 nt, Human
ugagacagggucucgcucugucacccaggcuggagugcaguggcacgaucucagcgcaccgcacccuccgccucccaggcucaggcgauuccccugccuca

SEQ ID NO: 8394 - RNA, 71 nt, Human
ugagaccuacucuccacugcucugcagcuggauggcugauggcaggcugagcaguggggaagcagguuuua

SEQ ID NO: 8395 - RNA, 65 nt, Human
ugagacgaagacuguggcugaggcuuuguuuucaggccgaaagcaggacacucagcucauucuca

SEQ ID NO: 8396 - RNA, 79 nt, Human
ugagacgggguuuggcucugucgcgcagagaucgugccacugcaauccagccugggcgacagagcgagacucugucuca

SEQ ID NO: 8397 - RNA, 71 nt, Human
ugagacucuggccuacuuccuaacaaugucuuggaagugggaugaugguaaaggagaaaggccacagucca

SEQ ID NO: 8398 - RNA, 101 nt, Human
ugagauggagucucacuuugucacccaggcuggagugcaguggugugauaucggcucacugcaaccuccaccucccggguucaagugauucuccugccuca

SEQ ID NO: 8399 - RNA, 97 nt, Human
ugagauggagucuuuguugcccaggcuggagugcaguggcaugaucuuggcucacugcaaccucugccugccagguucaagugauucuugugccuca

SEQ ID NO: 8400 - RNA, 91 nt, Human
ugagcaccagguggucuccucugacuucaaagggaaccaaauccuccacuuugaagcuggguggcuuggcucaagaccauuuguaagcuca

SEQ ID NO: 8401 - RNA, 74 nt, Human
ugagcagagggauggaacagagggugagagaggcaguggccgucuccaccucagcuccugcucccucugcauca

SEQ ID NO: 8402 - RNA, 72 nt, Human
ugagccaagaggaacggagcuuccaagacuaucuugggaagauucauggggcuuacuccucugagaaacuca

SEQ ID NO: 8403 - RNA, 92 nt, Human
ugagccagccgggugaauggcagaaagaauagaggcuauuugaauacugauguggcccucacuuucuucuauuuccauuaaugacaugcuca

SEQ ID NO: 8404 - RNA, 66 nt, Human
ugagccucuccuggcucugucugcuggucuaggccaggguggggcugaucaagggcagagagcuca

SEQ ID NO: 8405 - RNA, 63 nt, Human
ugagcugcuucaucucagacgcacuaagccguguguccucgcccucucccgugaggcaguuca

SEQ ID NO: 8406 - RNA, 101 nt, Human
ugaggcaggagaaucacuugaaccccaggaggcggagguugcagugagcugagaucacgccacugcacuccagccuggcgacugagugagacuccgucuca

SEQ ID NO: 8407 - RNA, 103 nt, Human
ugaggcaggagaaucacuugaacccgggagguggagcuugcggugagccgagaucgcgccauugcacuccaggccugggcaacaagagugaaacuccaucuca

SEQ ID NO: 8408 - RNA, 101 nt, Human
ugaggcaggagaaucauuugaaccugggaaguggagguugcagugagccaagaucgugucacugcacucuagccuaggugauaaagcgagacucagucuca

SEQ ID NO: 8409 - RNA, 102 nt, Human
ugaggcaggagaaucguuugaaccugggaggcggagguuguguugagccgagaucucgccauugcacuccagccuaggcaacaagagcgaaacuccaucuca

SEQ ID NO: 8410 - RNA, 71 nt, Human
ugaggggcuccugaaagaccuacugccaggaccagugacccuggugauggaacgcucggaggagcucaaca

SEQ ID NO: 8411 - RNA, 116 nt, Human
ugagguaaguauguuauuggaaaggugugaucuauauagaacccuguacaugaaaaggaggagaugccgcuaucuuggcagggaugaucauguauuugaaauaguaacucacagca

SEQ ID NO: 8412 - RNA, 102 nt, Human
ugaggugggagaauugcuugaacccaggaggcagagguugcagugagcugagauugcaccacugcacuccagccuggguaacagagugagacucuugucuca

SEQ ID NO: 8413 - RNA, 81 nt, Human
ugagguuuuccagcuaggguggugggaacaggcccuacccuagguccugugucagcaccacuguuccuucuaaucuucuca

SEQ ID NO: 8414 - RNA, 62 nt, Human
ugaguaauguggugcagaguguuucagcagugaagcugacagcaaaggcacagacauucuca

SEQ ID NO: 8415 - RNA, 88 nt, Human
ugaguauacuuggauuuuugguaucuguggguuggggggacgguccaggaaccaauaccccauggauaccaagggacaacuguacuua

SEQ ID NO: 8416 - RNA, 128 nt, Human
ugagucaccgaagagugauaaucccaggcaguacagaaugagcucagcugagguugugcaauggguugugaaugacgaugaaguuguggaucaccucugguucugagacacucuguucuugguguuca

SEQ ID NO: 8417 - RNA, 86 nt, Human
ugagucagcugcuuccacauaaaagucauauauacgcaagguagaaauauguugagacaauauaugauuaugguggcagcugauca

SEQ ID NO: 8418 - RNA, 77 nt, Human
ugaguccaaguguauggugcucuggagcaagagugcuucugucuuuuuuauguuuuggagugcagugcaggauuuca

SEQ ID NO: 8419 - RNA, 88 nt, Human
ugagucccagggccugaaggguucuuggacaugggccgauuuuccugucaccuauguccccucaaccucaucaccacugggcagcuca

SEQ ID NO: 8420 - RNA, 101 nt, Human
ugaguguaugugugagagagaauguuauguuuaucacugaguucccauuguuucauucucauagcacuuauuucuucauacuuucuauacacauuuacucg

SEQ ID NO: 8421 - RNA, 96 nt, Human
ugagugugggcagugcggccccugcggagugaggcgcggcgcgcccuucuugccuguugccucuuccuccuccuguccggggcccgcccgcgcucg

SEQ ID NO: 8422 - RNA, 88 nt, Human
ugaguguguuucuggacacaaacuucugcaguagaaugaccuaacaugucgguuucauugcagucauuauaggauugaaauacguuca

SEQ ID NO: 8423 - RNA, 107 nt, Human
ugaguucggucacagacuugauguuuuugaaaguugucaccaguuuauugucaccuuccaacugaaccacugucuugacuuucuccccugucauugucuccagcuca

SEQ ID NO: 8424 - RNA, 93 nt, Human
ugaguugagugcucagaauucuaccuauaaaugucuaaauauuaagcaggcuaauguuuauacugggcuagauuuaaaaagguacucaagcca

SEQ ID NO: 8425 - RNA, 86 nt, Human
ugauaaauguaccccucucagucuguaguaugaguguuuaaaguauaugugcagucuugcuuacaaggagggguuaccauguauca

SEQ ID NO: 8426 - RNA, 74 nt, Human
ugauccccccaggagggcaacaccacuuggugucaggggcgucccggcagagaaguguggcuaaggggggguca

SEQ ID NO: 8427 - RNA, 67 nt, Human
ugaucuccugaccuugugauccgcccgacuuggccucccaacgugcugggauuacaggcaugaguca

SEQ ID NO: 8428 - RNA, 62 nt, Human
ugaucuccugugggucuggugcuauauucuagagaaguuugcaccuggacaauaggaauucg

SEQ ID NO: 8429 - RNA, 80 nt, Human
ugaugaaaauccacaaugucuuugagcuucugguuguguaaugcugggguuuaaagucaccauuuguggguuuggcauca

SEQ ID NO: 8430 - RNA, 72 nt, Human
ugaugaaaugcacuuucccgugcagcaguguucuuuugccugucaacugcugggugguuuuugcauucauca

SEQ ID NO: 8431 - RNA, 63 nt, Human
ugaugagcagaacaaagauuugagaagcacuuucccugcaucugguucagacucugcucauca

SEQ ID NO: 8432 - RNA, 66 nt, Human
ugaugaggacugggacagguacgugcacccugugcuucaccuaacugccugugccgaucucucuca

SEQ ID NO: 8433 - RNA, 115 nt, Human
ugauggccccaacagguucugggcuucaguggagcccuacugugcugacaucaccagcgaggagguccgcacacuugaggaguuacugaagcccccaagaagaugaggcugagca

SEQ ID NO: 8434 - RNA, 72 nt, Human
ugaugucaguuccuuugcgcccugacugcaucaucaugcggcggcgaacagugucaaauggauaggaaguca

SEQ ID NO: 8435 - RNA, 96 nt, Human
ugauucaaagcaagaugguagcauuggagaggaugagauauggucagaugaggauauauuuuaaaaguugagcuaacaggauuugcugaggaauca

SEQ ID NO: 8436 - RNA, 72 nt, Human
ugauucuggagaaggagaggaugaugcggagguucagcaagaaugccugcauaaauuuuccacccgggauua

SEQ ID NO: 8437 - RNA, 64 nt, Human
ugauucuggcacaggaaauggucuccaaaaucucaaaauaucagaucucuaccuugucaaguca

SEQ ID NO: 8438 - RNA, 71 nt, Human
ugauugccccucuaacuccauggacagacacuagugguggugaaguucauaaaguuuugagguggcaaaca

SEQ ID NO: 8439 - RNA, 76 nt, Human
ugauugguaagccucauaauuggccuuuguuaucuuuguacugugacgaaggcaguggaugauacauuaccaauca

SEQ ID NO: 8440 - RNA, 73 nt, Human
ugcaagucggccacaggagccacggaaccgcaguaggauuucuacuguuauacagcccuugaggcagaaugca

SEQ ID NO: 8441 - RNA, 60 nt, Human
ugcaauguucaucuccccaucaggucuuuuaaagcugcugauggggagaugaacauugca

SEQ ID NO: 8442 - RNA, 84 nt, Human
ugcacuggcaccuagacauguacaacaggaaccguguggauacaucccccacaccuguuucuguggcauggucauguguaugca

SEQ ID NO: 8443 - RNA, 130 nt, Human
ugcacugguccaugagaauugacgauaaauaggaauugccuuggcaaaaugucagucugagaaguuucucucugacauccugggcauccuucuuuuuguccuucccaucccacucuccaacacaguggca

SEQ ID NO: 8444 - RNA, 72 nt, Human
ugcagaagucucccugggaguaauuuuggugaagucagcuuuugccuuuuucaucacaggcaggcuuuagua

SEQ ID NO: 8445 - RNA, 75 nt, Human
ugcagacaaaccaguguuaagaaaguauucaccaucauuuaaacaaauaaccacuuaaauagaacagugucugca

SEQ ID NO: 8446 - RNA, 65 nt, Human
ugcagaccuggcuuagaggaccccuaaggcugaggggucacuuccagaacugaguccgguccgca

SEQ ID NO: 8447 - RNA, 108 nt, Human
ugcagauuccuuuuuguuaaaugcugacuguguccuugguuucccauucaccugggaaguagaagaauaaaaaucauuccauaguuccauccaaggagggcagcugca

SEQ ID NO: 8448 - RNA, 87 nt, Human
ugcaggaugugcacuaaacaucugugugacuggcuccuuuuaaaaguuuucaaaagauuuagccaggcacaguggcuuguuccugua

SEQ ID NO: 8449 - RNA, 74 nt, Human
ugcaggcugccggucuuggucguaugaaaccaaacacacuugugcuuggauuuaagaaggauugguugcaagca

SEQ ID NO: 8450 - RNA, 82 nt, Human
ugcaguacucuaauuuagccaaguaauugcugcuguaaaauccaaaucuacagagcgcacaauuuuuuaaauggagugugca

SEQ ID NO: 8451 - RNA, 76 nt, Human
ugcaguuagugggugauuugcuauuuuucuuaguaguuaaaaaauggaacuaaauagugaauauacauacacugca

SEQ ID NO: 8452 - RNA, 75 nt, Human
ugcauauuuuaacaucugaaaucagaaagugucuuuacuggguuuuugguuuuagaaacauaaaauaauaaugua

SEQ ID NO: 8453 - RNA, 71 nt, Human
ugcaugggguucuuuugugaugaugacaguuuggauaaagguuccaagguucauuauucacagcccgggua

SEQ ID NO: 8454 - RNA, 90 nt, Human
ugcauuacccuccccaacuuaaaaucuuuugauaacccaggcagcuggguuauccccaauuuaaagucuuuuuguuguagcuguauggca

SEQ ID NO: 8455 - RNA, 80 nt, Human
ugccaacgcagagccagcuguucagcguacucuuuuagagaaauagaagauugucggcagaaacagcccaggcguuggca

SEQ ID NO: 8456 - RNA, 63 nt, Human
ugccaauuuuauaaccugccccccagagcuguaccaugaggggggagcagguuggaauaugca

SEQ ID NO: 8457 - RNA, 83 nt, Human
ugccaccauucucuucuccccucccaguggcagcgaggccagaugcugcugcugcgccuguaagagugagacuaauggaggca

SEQ ID NO: 8458 - RNA, 131 nt, Human
ugccaggcauaaucaacauuccucauuacuucuucaacauccucuugaaagcugugcucauuuuacaaaugagaaaacagauuuagagaaauauaaugacuuguaugaggucacauagcuuaugaguggca

SEQ ID NO: 8459 - RNA, 74 nt, Human
ugccauuuaugcccccggaaccaagacccgcgacuacagcuaccugggcuccgauaccgugcugcauguaggca

SEQ ID NO: 8460 - RNA, 86 nt, Human
ugccauuuuuugacucuucugccacuaaccaacauucucauauccacucaagucuguuuuuaguuaggaucaguuuuaaacaggca

SEQ ID NO: 8461 - RNA, 91 nt, Human
ugcccacauuccuguuagcugaggucaccugacucugcuugucguuuuugcacaggcagacgugugcauucuggagagcagggagugagug

SEQ ID NO: 8462 - RNA, 96 nt, Human
ugcccaugauguuuucaguacaaaucuaagucccaagauuagguuggaaaggguauuucuuguuggcuuaguuuggguuggaauuuagcaugggua

SEQ ID NO: 8463 - RNA, 87 nt, Human
ugcccccugcucuggcuggucaaacggaaccaaguccgucuuccugagagguuugguccccuucaaccagcuacagcagggcuggca

SEQ ID NO: 8464 - RNA, 83 nt, Human
ugccccuuucuuuucagccuuucugcggaagcugucucguggacaucucucgucaacagcacaaggcuggaugguucaacgca

SEQ ID NO: 8465 - RNA, 71 nt, Human
ugcccgcguacaugggcugaggaauguucaagcagaagaagugguagaguuuucuucaggcuuaaagggua

SEQ ID NO: 8466 - RNA, 67 nt, Human
ugccgggagcugggcaugaaagcccuggacaugaauucauguccagagcuuucaugccuuaaaggua

SEQ ID NO: 8467 - RNA, 75 nt, Human
ugccuccucugggugcgugaugccuccucugggcgggugaugccuccucugggugcgugaugccuccucugggca

SEQ ID NO: 8468 - RNA, 62 nt, Human
ugccucugcuuucauuucuaugguuauucguggaaugacucauugaccacgcggagaaggca

SEQ ID NO: 8469 - RNA, 67 nt, Human
ugccuggcucuuuucuuuucuuuuaaagggaggcugggaaagccggagagcuaguaggagccaggca

SEQ ID NO: 8470 - RNA, 99 nt, Human
ugccuguguccugucgcaagaggugaguccgucuugugggugcugcugucugggugccugugccucaggggauucgccuucuguacaggaagcaaggca

SEQ ID NO: 8471 - RNA, 86 nt, Human
ugccugugugggacugagaugcaggauuucuucacaccucuccuuugugacuucaagagccucuggcgucucuuucugcaaaggca

SEQ ID NO: 8472 - RNA, 71 nt, Human
ugccuucaugaagcuugugaccaaguggaggaaauagcuauuaaccacacaaucacauaaucaagaaggua

SEQ ID NO: 8473 - RNA, 103 nt, Human
ugcgcaucaagcuggaggagcaggcccagcagauacgccugcaggccgaggccuuucaggcccgucucaagagcugguucgagccccugguggaagacaugca

SEQ ID NO: 8474 - RNA, 78 nt, Human
ugcgcauucccaagucacgaugucacuguacauccgaucggagaugaggauacaugugugaugccacuggaugaugca

SEQ ID NO: 8475 - RNA, 72 nt, Human
ugcgcgagagagggggcucgaggugcuuuuccuauauggggccgagggacaauggucaccgucucuucagca

SEQ ID NO: 8476 - RNA, 96 nt, Human
ugcgcugggcagaagcacgcaccgcauccugggcagccugacccgagcugagcuggccgaaggggaacucgguguauggccgacugcccacgugca

SEQ ID NO: 8477 - RNA, 77 nt, Human
ugcguagagguguuuguaguauucucugauggaaguuuguauuuccugugggauugguggugauauccccuuuauca

SEQ ID NO: 8478 - RNA, 62 nt, Human
ugcguagcauuugcugcauggguuaauugagaauagaaauuugccccuggcaaaugcacaca

SEQ ID NO: 8479 - RNA, 73 nt, Human
ugcuaaauguuuucuucaagggaaccagauuuaguucuuuacagaauuuuccagugaaauaaaacauguugua

SEQ ID NO: 8480 - RNA, 73 nt, Human
ugcuagauagaugaaaauuugaaaaauaacagaaugccuucuuccucccuuucccauuuuuugaccccuggca

SEQ ID NO: 8481 - RNA, 95 nt, Human
ugcuaggcuuauucucuuccucauucagucucucaaucaaucaauacuuacugaguacuugucauugcaagaccugaggaauagaggggcuagca

SEQ ID NO: 8482 - RNA, 76 nt, Human
ugcuauguugccaaggcuggucuugacuccugggcgaucgccugcgcucagaauucagaccagcugggcgcaugua

SEQ ID NO: 8483 - RNA, 81 nt, Human
ugcuauugugaagggugcuugguuuuuucaaaauuggcuuccucagauauuugcaaaacuuuguucaccuguucauaagca

SEQ ID NO: 8484 - RNA, 65 nt, Human
ugcucacagggugugacuggcccacuaucuaggguagugagccuauuuuguggccccugugugca

SEQ ID NO: 8485 - RNA, 65 nt, Human
ugcuccaggcugggcauucagaugugguccggguagacacuauggaugagcugcccagccuugca

SEQ ID NO: 8486 - RNA, 87 nt, Human
ugcucuacaaaguugagggucagagggggaacaauuauauagaaauuucggagauguguauucuuuggccuucgaaauucuggagca

SEQ ID NO: 8487 - RNA, 60 nt, Human
ugcucucaggagugcaacgagguaaaagcaagaagcucuauucaacgcauuuuuuaggua

SEQ ID NO: 8488 - RNA, 74 nt, Human
ugcucuguugccuaggcuggagugcagugaugcaauuuuggcucacugcaaccuccaccuccuggguucaagca

SEQ ID NO: 8489 - RNA, 84 nt, Human
ugcugaaaccuuucagaaauagccauaauuuuguauuacauacaaguaagccauuuuaaggaguuucaugaaagacguuuggca

SEQ ID NO: 8490 - RNA, 67 nt, Human
ugcugaggacucccaagcguacugcucaucaucgauauguuuggugaucacagcuacuuucucagca

SEQ ID NO: 8491 - RNA, 62 nt, Human
ugcugaugaaauuuaucaccagacagcuucuauuuaaaagcaacuggcugugacauugagca

SEQ ID NO: 8492 - RNA, 69 nt, Human
ugcugcccaggcugggaugcaguggcgugaucucggcucacugcaaccucugccuccugggcucaagca

SEQ ID NO: 8493 - RNA, 75 nt, Human
ugcugcugcccauccuggccauguugauggcacugugugugcacugccacagacugccaggcuccuacgacagca

SEQ ID NO: 8494 - RNA, 71 nt, Human
ugcugcuucuuggcuggcuugcuuuggcagucacugccacuggccuugccuuuggcacauggaagcaugca

SEQ ID NO: 8495 - RNA, 90 nt, Human
ugcuggcgcugcgcugcggcucccgcuggcucggccugcucuccgucccgcgcuccgugccgcugcgccuccccgcggcccgcgccugca

SEQ ID NO: 8496 - RNA, 105 nt, Human
ugcugggcgugugaggcggcugugcugugccugugagacaggaaugguuccauuacaccaugggaaaucacugauuuauaggucccaaacugccacacaucagca

SEQ ID NO: 8497 - RNA, 103 nt, Human
ugcuguaggcuguaugcuguuaaugcuaaucgugauagggguuuuugccuccaacugacuccuacauauuagcauuaacaguguaugaugccuguuacuagca

SEQ ID NO: 8498 - RNA, 63 nt, Human
ugcugugaucugauuggaggagggacaguuucugguacccauccucugauuuauacauaugca

SEQ ID NO: 8499 - RNA, 73 nt, Human
ugcuguggucuguucaagugaucuuuucacuuauuugaaaaagagcauggaucaagagcuagauaccacagua

SEQ ID NO: 8500 - RNA, 129 nt, Human
ugcuguguucauccuaucauucaggcauauuuggaagacuagugauuuaaggcagggauuuauguauuuaugugagacaaucagggaacuucuaauaagaacugauuauaagggaaguugguugaagca

SEQ ID NO: 8501 - RNA, 74 nt, Human
ugcuuagucuaacucaaaagauccuuuuucauuuguuaccaaaaauguauuaggucccuguugaaggcuaggca

SEQ ID NO: 8502 - RNA, 71 nt, Human
ugcuucuuuauuaaugauuauaaaucaggaucuagcagcaggucuaguaacuucugucguuuugagaagca

SEQ ID NO: 8503 - RNA, 73 nt, Human
ugcuugaacacaguauuuucccaauagcacuuucauugccagugucuuucuuuggugccuuuccuguucagca

SEQ ID NO: 8504 - RNA, 74 nt, Human
ugcuuuagauuagacugucaugucucagugucuaucuguacuauauuacuuugauauucagagaaucuaaagca

SEQ ID NO: 8505 - RNA, 77 nt, Human
ugcuuugucguucaguugguuacuucuuuuaauguauucaaaaauguugaacacauacagaacugaauuaagaagca

SEQ ID NO: 8506 - RNA, 71 nt, Human
uggaaacuuuuggcuguggggaccccauuucacugaugauugaauggguccaccucugucaaaggaauuca

SEQ ID NO: 8507 - RNA, 88 nt, Human
uggaaauucaauacacugagaaguguuaaaaucauuaaccaaaauuacugaaugguagaauacugucucgaaauguacugaauucaca

SEQ ID NO: 8508 - RNA, 90 nt, Human
uggaacuggaggagcuguccugugucagccugaaauaaucaaaaggaucaaaaauccuguuuuaggcaacauaggaagacuccaacucua

SEQ ID NO: 8509 - RNA, 98 nt, Human
uggaagaggggcagcuguugaaggcauucuuguaucaagggagguaggagggcccucugaugccaaaggcagccuucucaggcuauugcuuucuucca

SEQ ID NO: 8510 - RNA, 78 nt, Human
uggaagccugaccuggccucucucugagaugaccagaauggguccuguccagccaggcagagcacagacaggcugcca

SEQ ID NO: 8511 - RNA, 81 nt, Human
uggaaggcgccuguggucguggaauuguuuauguuucccuuccuucuuggcaaaacguccuccucaggcaguugucaucca

SEQ ID NO: 8512 - RNA, 83 nt, Human
uggaagguuucacuugguggcuuggccuagggaccagcaagggcuggggugggaaggguggcucaaggaagccucuuucucca

SEQ ID NO: 8513 - RNA, 88 nt, Human
uggaagugaugacucuaaacagugcaaugaacaauuuauuuauguacuauuaaaagaacuguaaaugcaauguaaagacacacagcca

SEQ ID NO: 8514 - RNA, 102 nt, Human
uggaauucuucauugagucguugacuucucgacggaaugcugacagguucugggugaaccugucucuguuuuucguaagaagauuucgcucgaugccuucca

SEQ ID NO: 8515 - RNA, 60 nt, Human
uggaauuuucugagagaucuuuauucuuuauucaggaugugggaucgaucagcacugcca

SEQ ID NO: 8516 - RNA, 91 nt, Human
uggacacagacuugccaggcagccuggggcagagugaagagaagcccgugccugcugcgccugugcccagcccugguggacccugugccca

SEQ ID NO: 8517 - RNA, 81 nt, Human
uggacgucucaggauucccucuuuuggaacucugguuuaugggcggaagacuccgagggcaggaauguggagagacguuua

SEQ ID NO: 8518 - RNA, 73 nt, Human
uggacucugaguaugaggcaggcuguucugagguccccguggggugagccugucuguccucccucagagccca

SEQ ID NO: 8519 - RNA, 63 nt, Human
uggacucuggggggacaccaaagaugcccugugaccacuuuugguguugcccgaguuagucca

SEQ ID NO: 8520 - RNA, 75 nt, Human
uggagaaaaaggucauagucccgacaaucugguuucccugccuauuaucaagccaccuaacuccucacuuuucca

SEQ ID NO: 8521 - RNA, 81 nt, Human
uggagacugguagcuuauuaaagaaacuccguguuacucauuccuggaguuggggguuucuguaggcacuuuauuucucca

SEQ ID NO: 8522 - RNA, 75 nt, Human
uggagaguuuaaauaauuugcugaaugucucauggccaaaauccuauugaaguauuugcugggaucuucucucca

SEQ ID NO: 8523 - RNA, 72 nt, Human
uggagcacaugugccgccuggacauugauucaccacccaucacagcccggaacacuggcaucaucuguacca

SEQ ID NO: 8524 - RNA, 92 nt, Human
uggagcguggcgaacaggugcucugggccuggcgcugcugcugcugcucggccucggacuaggccuggaggccgccgcgagcccgcuuucca

SEQ ID NO: 8525 - RNA, 73 nt, Human
uggagggaacauucugcuuuucaggcaccagcugugaagaagaaaccaacaguaacuaaaggcagaucuucua

SEQ ID NO: 8526 - RNA, 88 nt, Human
uggaggggccggacucgucauacuccugcuugcugauccacaucugcuggaagguggacagcgaggccaggauggagccgccgaucca

SEQ ID NO: 8527 - RNA, 94 nt, Human
uggagggucucuaguuaauuggcauuccggugcuuaaggccacuuuuggguagagguuuggcaaggauggaguguccagaccuaugauccucua

SEQ ID NO: 8528 - RNA, 122 nt, Human
uggaguauuuaagagugacuuaaacaacagauguucauacucugccaguucuggagguuggaaaguccaagaucagggugcuggcagauuugguugcuguuggguucucuucuuggcucgca

SEQ ID NO: 8529 - RNA, 65 nt, Human
uggaguccguccggcacggggcuccggaugcaaggcgguacuggggcgucgggccacggaagcca

SEQ ID NO: 8530 - RNA, 85 nt, Human
uggaucaugggugguggugaacagcagaaagggauuauggaugaaucugcauuguucuagcugcuccccaugccacccgucuccg

SEQ ID NO: 8531 - RNA, 80 nt, Human
uggaugcagugacacaccaguagggagcuagcuggcugccccuugcagcccacuccccaaacuggcuacccaggcaucca

SEQ ID NO: 8532 - RNA, 74 nt, Human
uggcaagaaagugcucggugccuuuagugauggccugggcucaccugggacaaccucaagggcaccuuuugcca

SEQ ID NO: 8533 - RNA, 73 nt, Human
uggcaccacauccccauagcccacgguggucaugcucacugugccccaccaccagcaggcugggaugguguua

SEQ ID NO: 8534 - RNA, 96 nt, Human
uggcaccagcuuccaaagccaggaugaagaggaggagaaaggaugggguccacaccuuguuuucuccaccaucauccaggggcucugcugcugcua

SEQ ID NO: 8535 - RNA, 82 nt, Human
uggcagagagcugugcuucaaauacagcuguggucugagcaaacuuggcugcucuaaauacugaaugccaguuccuuugcca

SEQ ID NO: 8536 - RNA, 86 nt, Human
uggcaucccagauguugcaguugaagucgucguagccagcgagcagcagccguccgcugcgcgagaaggcaacagaggugaugcca

SEQ ID NO: 8537 - RNA, 75 nt, Human
uggcauggggaccagcuagaacaaugcagauucauccauaaucccuuucugcuguucaccaccacccaugaucca

SEQ ID NO: 8538 - RNA, 76 nt, Human
uggcauggugaaagggugcaaugggcuuauuuaaggacuagagcagugugcagccauaacacaagaaaucauguca

SEQ ID NO: 8539 - RNA, 97 nt, Human
uggccaugcacaguggcucgcaacuguaaucucagcacuuucggaagccaaggcggucagaucaccugaggucaggaguucgagaccagucuggcca

SEQ ID NO: 8540 - RNA, 76 nt, Human
uggccgggaggcugggcugggggagguaucucuucgaaggguccauccucaagccacgauaagagcuucugagcca

SEQ ID NO: 8541 - RNA, 102 nt, Human
uggccgugcccggagcgcucagcaaacaccccucucacauuccuauggcagacgcuggaggaugaagggcuggcuguugggucuguucuugcucuaaggcca

SEQ ID NO: 8542 - RNA, 67 nt, Human
uggccuggguaaggugccuggcaggaagcaagacaaggccucuggcagagagcaccuuagcaggcca

SEQ ID NO: 8543 - RNA, 93 nt, Human
uggccuuugggacucaaaacacaggaucugacuggugggcacaauaccaucuugaacgcccacaaaaagguuugguuuuguugccaaagggca

SEQ ID NO: 8544 - RNA, 79 nt, Human
uggcgacgccagugugccuguguggaguggucgugaagcgcgcaguguucacuccaggcuggacccaauggcacugcca

SEQ ID NO: 8545 - RNA, 65 nt, Human
uggcgcugcacagguggcuggacugucccaccuucuguggacagagccacuuggugcugcgacca

SEQ ID NO: 8546 - RNA, 90 nt, Human
uggcggacgggaccugucaggacgcggccaucgugggcuacaaggacucgcccuccgucugggccgccguccccgggaaaacguucguca

SEQ ID NO: 8547 - RNA, 79 nt, Human
uggcgggccagucccugcaggugucuugccccuaugacuccaugaagcacugggggaggcgcaaggccuggugccgcca

SEQ ID NO: 8548 - RNA, 85 nt, Human
uggcggugggucaguggcagagggccaugguuuccauguuaaggaagcggacgugcaucuuggucucaaugucgauccccugcca

SEQ ID NO: 8549 - RNA, 75 nt, Human
uggcuauuuaccaaaauuuaagcugagccaaacaugauuuacaggguucgagguucccuuuacuggcaauggcca

SEQ ID NO: 8550 - RNA, 60 nt, Human
uggcucaagcuauccucccgccucugccucacuaagagcugggauuacaggccugagcca

SEQ ID NO: 8551 - RNA, 60 nt, Human
uggcucaugcauauaaucccaacuaucuaggaggcugaggugggaggauuguaugagccg

SEQ ID NO: 8552 - RNA, 81 nt, Human
uggcugacggucgcagcaaauccagcugcugcugcggcggcuguggcggcggcagcggcggugacugaggauagagagcca

SEQ ID NO: 8553 - RNA, 74 nt, Human
uggcuggguugaauccggugcuugucgguacagguccuuaugacacaaaagcaccguaaaagaggcuccagcua

SEQ ID NO: 8554 - RNA, 76 nt, Human
uggcuucuccugcagugauauugaugaguguagcuacuccagcuaccucugucaguaccgcugcgucaacgagcca

SEQ ID NO: 8555 - RNA, 89 nt, Human
uggcuuucgccaguagcugaggacgcccuuguccaucauacgguagaguugaacacagagguggaucaggcugagugccaggaagacca

SEQ ID NO: 8556 - RNA, 66 nt, Human
uggcuuuucaagcuaugucauaccugccucccagagguacuuggaaaauauuggcuugacagcaca

SEQ ID NO: 8557 - RNA, 102 nt, Human
ugggaaagcuuucuuucugaguucauaccuuauucgacaccagaaaauccacacuggagagagaguguaugaauguaaggaaugugggaaagcguuucucca

SEQ ID NO: 8558 - RNA, 72 nt, Human
ugggaaaguuccauaggaagccuaagcacucaucuuaaccuuacuuagucuucucuuaacuggacuuuucua

SEQ ID NO: 8559 - RNA, 95 nt, Human
ugggacuuccagaacuuggaguaacuuggaguugauucccauuuuccuuuggaggugacuggcaaaugcaaucuuuaggaagcuccucugaccca

SEQ ID NO: 8560 - RNA, 74 nt, Human
ugggaugcccuggacuggaccaugcaggccuaugaacgcaacuucugggacccaucuccacaacuggacaccca

SEQ ID NO: 8561 - RNA, 78 nt, Human
ugggcaugugguguacaggugggggcaaguauaugucagaauccugagaugggagucccucaaauacacagcagacca

SEQ ID NO: 8562 - RNA, 85 nt, Human
ugggccaauguccacaaagaauuccuggucagcaccaccgauguccaaaggugcaauaucaaggaagggcaggcgugauggcuua

SEQ ID NO: 8563 - RNA, 63 nt, Human
ugggccacagaggcauaaggucuggguuaagaaauaucuaagacgugcucaaucuguguucca

SEQ ID NO: 8564 - RNA, 78 nt, Human
ugggccagauaguucucuguuguugggggauuucuugugcauugugggagauuucccaucuuuccucacuucuaccca

SEQ ID NO: 8565 - RNA, 95 nt, Human
ugggcuaccagucuugagaaguaggugagggcaugcaaauguaaaaaaguaauguguguucugggaucuacuaguucuugagaagcacaaguuca

SEQ ID NO: 8566 - RNA, 74 nt, Human
ugggcucaagcaguccucccacuuggccucccaaagugcugggauuacaagagugagccacugcacucagccca

SEQ ID NO: 8567 - RNA, 61 nt, Human
ugggcucaucauucccuuggagccuggaaggccgggugcuccaggggcgugacaacgucca

SEQ ID NO: 8568 - RNA, 73 nt, Human
ugggcuugaguggaggaaggcagaauauuucccccuggguccuucagauucgccagcucccacccugaaccca

SEQ ID NO: 8569 - RNA, 85 nt, Human
uggggcagagggcaggaaaagggcggccacauucucacaaacuucuggcgaaggguagcucccuccucgugaaggaccuggccca

SEQ ID NO: 8570 - RNA, 68 nt, Human
uggggccucacgcaaccuugguguuugguuaaauuugugccuuggcuccuguugcguuuaggcaccca

SEQ ID NO: 8571 - RNA, 99 nt, Human
uggggccuugguaauauaggaaaccuucuugccaauauaggaauauguugacauauuagcuauagcaaaaggcuuauauuagcaccgaaugaggcucug

SEQ ID NO: 8572 - RNA, 74 nt, Human
uggggcugagaggcgagacacugauggcacucuuacuucugucagcugccgcaaagucucguccacuugcugca

SEQ ID NO: 8573 - RNA, 61 nt, Human
ugggggaagaggaagagaggacagagaggccaaacaggccucuuccccuccucuucaccca

SEQ ID NO: 8574 - RNA, 98 nt, Human
ugggggaggaucgucugagcccaggaguuugaggcugcagugagcuacaaucacaccccugcacucaagccuggguuacagagugauaaccugucuca

SEQ ID NO: 8575 - RNA, 83 nt, Human
ugggggcacuggcuucugcucuugcucuuucuucuggaaacauuauucuguuccuuuggacaugggcaaggguccugucccua

SEQ ID NO: 8576 - RNA, 67 nt, Human
uggggugagaugagccgggacuugaaaacccuucucuuaacuuucagucucaacuccucccacucua

SEQ ID NO: 8577 - RNA, 78 nt, Human
uggggugcucaucuucuguaacuguugggaaggcucggugguccauuuucaccaguuaaagaauaugaggccagccca

SEQ ID NO: 8578 - RNA, 79 nt, Human
ugggguggcagguauuagggauaauauucauauagccuucugagcuaucugggcagacuuggugaccugucgaacucca

SEQ ID NO: 8579 - RNA, 85 nt, Human
uggguagcaugaacuaagguagauaaaggcuucacgugguguuuggcauggcguagguguagauuggaccucaguuuucugccca

SEQ ID NO: 8580 - RNA, 69 nt, Human
ugggucaauaauuccacuguugggccucacacaguaccggugaggcacgguagucuucacuuugaaaca

SEQ ID NO: 8581 - RNA, 85 nt, Human
ugggucagacgugcugucugccucaugaaauuggguccaaauugauugaacuacuuucaugagcaguuguagcaggcugaccaca

SEQ ID NO: 8582 - RNA, 104 nt, Human
uggguggcuaggagguuugguggccgggugguugguugaauggguguaaguccccauugcugaagugacaggccuccuugucagaaagcucuuuuugcuacuua

SEQ ID NO: 8583 - RNA, 60 nt, Human
uggguuccuggcaugcugauuugugacuuaagauuaaaaucacauugccagggauuacca

SEQ ID NO: 8584 - RNA, 88 nt, Human
uggguugcuguucaggucagcuuugcuccuaacaacacuggggaaaggaaguaaccaguugagugcaagguugaugggauccagccca

SEQ ID NO: 8585 - RNA, 94 nt, Human
ugguaacuaaguaauaucaggaaagaagaaauaaggaugcaagaugacaaacaaaaucuuuaugaaauacuuuugaucaugaacuuaucugcua

SEQ ID NO: 8586 - RNA, 87 nt, Human
ugguagaauggaaacagcagugacuacauggaaggcagaggaccucccauuccugugcagccauggagaagaugucccgugugacca

SEQ ID NO: 8587 - RNA, 69 nt, Human
uggucaccaucauccaucccgggaagggcuccaaggaggggcugcaccgggagggccggaucgagacca

SEQ ID NO: 8588 - RNA, 62 nt, Human
uggucacucgugacuuacuaguuugauaggcucucacuguggagcuagaagcagggugucca

SEQ ID NO: 8589 - RNA, 100 nt, Human
uggucacuguuagcccaugaacacgugugggccucggucacguggcuuugaagggcagucugaccaggcuagaccacacgugccgugacaggcggugcca

SEQ ID NO: 8590 - RNA, 73 nt, Human
uggucacuucguggcucagguaagaacgugcuuguggaagacaagucuguggcuuggugagucuguguggcca

SEQ ID NO: 8591 - RNA, 84 nt, Human
uggucgaugaacggcuagcuguggaugucuauugugagaugguaacuaugcgcacugaagaugccagagcuagcagugcgacca

SEQ ID NO: 8592 - RNA, 61 nt, Human
uggucucaagugauccacccaccuuggccucccaaagugccgggauuacagacaugagcca

SEQ ID NO: 8593 - RNA, 61 nt, Human
uggucucgccucucuccucuccuccccccaggaggaacuugaaaggaggguaaaaagacua

SEQ ID NO: 8594 - RNA, 103 nt, Human
uggucugaggcagagugugguucagucagggauguuggaagcuggaguagacaggauuauuucucaggugguggauccaaaacuuaaccacaucuucaggcca

SEQ ID NO: 8595 - RNA, 82 nt, Human
uggugaaguauuuuguuaccucagucuuguaucaaguugcuguauuuuucagcuuguuacauugauaauaauuauuucacua

SEQ ID NO: 8596 - RNA, 80 nt, Human
uggugagaugaguugcuuggcacagaucagcagaacaggacccuggugauaaggcaucuggcuuugcuaaccacuuauca

SEQ ID NO: 8597 - RNA, 60 nt, Human
uggugaggaauguaucaucuuuuugucucauauuacaaaugggccaauacggacuugcca

SEQ ID NO: 8598 - RNA, 84 nt, Human
uggugauagcauuacuauagagauggcgcagcggggauggcaccauauguuccucgugccuauccuggugguacucuagaacca

SEQ ID NO: 8599 - RNA, 65 nt, Human
uggugauuucugagacugagaugaagauacguuuccaaagagaguauuuacauuugaaucugcca

SEQ ID NO: 8600 - RNA, 99 nt, Human
ugguggcauaugcguguaaucccagcuacuugggaggcugaggcaggagaauugcuugaacccaggagguggagguuacagugagcagagauugcacca

SEQ ID NO: 8601 - RNA, 109 nt, Human
ugguggcuugguuuguguaccuauuuuucugcauuuguauuggaaaagguuucuuuuaagacauuuuccaaaaguggagaggaauauguguguucaggaagggcuuuca

SEQ ID NO: 8602 - RNA, 64 nt, Human
ugguggggucaguggaaguucugucacuggaucugguuucagugucucagaccuugccccacca

SEQ ID NO: 8603 - RNA, 69 nt, Human
ugguggugcuguaggguguggucugguacuuccgaaucaauuaccgccaauucuucacagcaccugcca

SEQ ID NO: 8604 - RNA, 76 nt, Human
ugguguggaggccuauguucugccccauacaccccacaggcccugcuuaugggaaggaacacaggccuccagccca

SEQ ID NO: 8605 - RNA, 78 nt, Human
ugguguggcgucagcccuaugugcgccccggaagugaugugaagcagugagggcaaaauggguugacgcgaagcacca

SEQ ID NO: 8606 - RNA, 123 nt, Human
ugguuauccgggagaauuccuguuguguggaagaugcuuugcccuuucuucaucuggaaaucauuuuuccauccuuuaggucacagcuuaaacaugauuuucccaggaauuuuucucugacca

SEQ ID NO: 8607 - RNA, 86 nt, Human
ugguucgccaguggucacuugccaacggcgccgggacuggucagguggcgagcuaggcgaguuagcaagggauccaggaagaacca

SEQ ID NO: 8608 - RNA, 24 nt, Human
ugagugugauagaagguggagugg

SEQ ID NO: 8609 - RNA, 24 nt, Human
ugagugugcgugagauaagaguug

SEQ ID NO: 8610 - RNA, 24 nt, Human
ugaguuagaauccaaaccagagcu

SEQ ID NO: 8611 - RNA, 24 nt, Human
ugaguuagcucuacgucuucugga

SEQ ID NO: 8612 - RNA, 24 nt, Human
ugaguuaucuuuuaaauaugucuu

SEQ ID NO: 8613 - RNA, 24 nt, Human
ugaguuauguguuagcggaguguc

SEQ ID NO: 8614 - RNA, 24 nt, Human
ugaguucacaauagauguauggau

SEQ ID NO: 8615 - RNA, 24 nt, Human
ugaguuccugcucgccgaugauag

SEQ ID NO: 8616 - RNA, 20 nt, Human
ugaguugaauacucagcucc

SEQ ID NO: 8617 - RNA, 24 nt, Human
ugaguugagaaugcuuugcuuuug

SEQ ID NO: 8618 - RNA, 18 nt, Human
ugaguuggcugcgagggg

SEQ ID NO: 8619 - RNA, 24 nt, Human
ugaguugguggaaaugugggcguu

SEQ ID NO: 8620 - RNA, 21 nt, Human
ugauaacacuaggaggguggu

SEQ ID NO: 8621 - RNA, 22 nt, Human
ugauauauaaucagcccaugau

SEQ ID NO: 8622 - RNA, 24 nt, Human
ugauaugauagauuuuuguauuga

SEQ ID NO: 8623 - RNA, 20 nt, Human
ugauaugcuccagaauaaag

SEQ ID NO: 8624 - RNA, 24 nt, Human
ugauauggcgaccuauuuugggcg

SEQ ID NO: 8625 - RNA, 22 nt, Human
ugauauguauaucaccuucaga

SEQ ID NO: 8626 - RNA, 22 nt, Human
ugauauguguuugacauccccc

SEQ ID NO: 8627 - RNA, 24 nt, Human
ugauauguuacucauuguaaagac

SEQ ID NO: 8628 - RNA, 22 nt, Human
ugauauguuguaugaugcucuc

SEQ ID NO: 8629 - RNA, 22 nt, Human
ugauauuuugauauauuuaugc

SEQ ID NO: 8630 - RNA, 23 nt, Human
ugaucacagcuacuuucucagca

SEQ ID NO: 8631 - RNA, 24 nt, Human
ugaucugagucuggaacugacaag

SEQ ID NO: 8632 - RNA, 22 nt, Human
ugaucugcuacagccugggccu

SEQ ID NO: 8633 - RNA, 22 nt, Human
ugaucugugggauuuauaccug

SEQ ID NO: 8634 - RNA, 24 nt, Human
ugaugagcaguugaaccugugccu

SEQ ID NO: 8635 - RNA, 24 nt, Human
ugaugaucuugaagaaagcugggc

SEQ ID NO: 8636 - RNA, 24 nt, Human
ugaugaugaugaaguuccagaucu

SEQ ID NO: 8637 - RNA, 24 nt, Human
ugaugcauaaacuggucaccugaa

SEQ ID NO: 8638 - RNA, 21 nt, Human
ugaugcgauuaagguagcagc

SEQ ID NO: 8639 - RNA, 24 nt, Human
ugaugcucacauagguugugccau

SEQ ID NO: 8640 - RNA, 23 nt, Human
ugaugcuucaggacgugacaggc

SEQ ID NO: 8641 - RNA, 22 nt, Human
ugaugcuugagcacaguaccuc

SEQ ID NO: 8642 - RNA, 24 nt, Human
ugauggaagcccgguucccugagg

SEQ ID NO: 8643 - RNA, 22 nt, Human
ugauggaucuguuggcggguuu

SEQ ID NO: 8644 - RNA, 24 nt, Human
ugaugggccugugaccauagagcu

SEQ ID NO: 8645 - RNA, 24 nt, Human
ugauggggcuccaacagccaggcu

SEQ ID NO: 8646 - RNA, 24 nt, Human
ugaugggugggcccagaagguggc

SEQ ID NO: 8647 - RNA, 24 nt, Human
ugauggguugaaaagagguugguc

SEQ ID NO: 8648 - RNA, 24 nt, Human
ugaugguggucggugaaucagguc

SEQ ID NO: 8649 - RNA, 24 nt, Human
ugaugugauugaagauuucagaga

SEQ ID NO: 8650 - RNA, 24 nt, Human
ugauguggaccauucuguauugag

SEQ ID NO: 8651 - RNA, 24 nt, Human
ugauguggacuucucuuuucuugg

SEQ ID NO: 8652 - RNA, 24 nt, Human
ugauguggguaguuauuuccgggu

SEQ ID NO: 8653 - RNA, 24 nt, Human
ugauguuggauucuguugccuggg

SEQ ID NO: 8654 - RNA, 24 nt, Human
ugauuagauuuacacagagcuuuu

SEQ ID NO: 8655 - RNA, 24 nt, Human
ugauucaagacaguggaagagaca

SEQ ID NO: 8656 - RNA, 24 nt, Human
ugauugaggaugcaauucgaaguc

SEQ ID NO: 8657 - RNA, 22 nt, Human
ugauuggcaaugguuaugacgg

SEQ ID NO: 8658 - RNA, 24 nt, Human
ugauuugaauauugugguacaacu

SEQ ID NO: 8659 - RNA, 24 nt, Human
ugauuuggggcauucuagcuugca

SEQ ID NO: 8660 - RNA, 24 nt, Human
ugauuuuaaaaauacagaaagauu

SEQ ID NO: 8661 - RNA, 22 nt, Human
ugcaaaaaaugucagucuauag

SEQ ID NO: 8662 - RNA, 24 nt, Human
ugcaaaaauucuuaagacuucugu

SEQ ID NO: 8663 - RNA, 22 nt, Human
ugcaaacacauuauguguuccu

SEQ ID NO: 8664 - RNA, 24 nt, Human
ugcaaagagaaacuaggggaaaau

SEQ ID NO: 8665 - RNA, 24 nt, Human
ugcaagauuccgauuaaugcuauu

SEQ ID NO: 8666 - RNA, 24 nt, Human
ugcaaggaggaguucuggagaccc

SEQ ID NO: 8667 - RNA, 22 nt, Human
ugcaaugcaaaaauagcccggc

SEQ ID NO: 8668 - RNA, 24 nt, Human
ugcacaagcuggaaguguccuugu

SEQ ID NO: 8669 - RNA, 22 nt, Human
ugcacacauacacuugcccagg

SEQ ID NO: 8670 - RNA, 24 nt, Human
ugcacagaucagugucagaagcau

SEQ ID NO: 8671 - RNA, 22 nt, Human
ugcaccacugcacuccagccug

SEQ ID NO: 8672 - RNA, 22 nt, Human
ugcaccauugcacuccagccug

SEQ ID NO: 8673 - RNA, 24 nt, Human
ugcaccuucacccgcugcucaagg

SEQ ID NO: 8674 - RNA, 22 nt, Human
ugcacgugcuuuauucacaaau

SEQ ID NO: 8675 - RNA, 24 nt, Human
ugcacguggccccaggccucccuc

SEQ ID NO: 8676 - RNA, 22 nt, Human
ugcacuccuuaugagaaucuaa

SEQ ID NO: 8677 - RNA, 24 nt, Human
ugcagaaggagaucaccgcccugg

SEQ ID NO: 8678 - RNA, 24 nt, Human
ugcagagaaucuuagaagacgcag

SEQ ID NO: 8679 - RNA, 22 nt, Human
ugcagagcugaauauccccuug

SEQ ID NO: 8680 - RNA, 22 nt, Human
ugcagauacauguguaacugaa

SEQ ID NO: 8681 - RNA, 24 nt, Human
ugcagaugcguuucgacgggcugc

SEQ ID NO: 8682 - RNA, 22 nt, Human
ugcagccuccaacuccugggcu

SEQ ID NO: 8683 - RNA, 24 nt, Human
ugcaguacucacgccccauggggg

SEQ ID NO: 8684 - RNA, 22 nt, Human
ugcagugauauugaugagugua

SEQ ID NO: 8685 - RNA, 24 nt, Human
ugcaugaagaaauuucgguuuccc

SEQ ID NO: 8686 - RNA, 24 nt, Human
ugcauguaacaagucuuuuuuaca

SEQ ID NO: 8687 - RNA, 24 nt, Human
ugcauguaauaauguugaguggca

SEQ ID NO: 8688 - RNA, 22 nt, Human
ugcaugucaagucaggaagcca

SEQ ID NO: 8689 - RNA, 22 nt, Human
ugcaugucugguacagauaaca

SEQ ID NO: 8690 - RNA, 21 nt, Human
ugcauguucuuguugccuguc

SEQ ID NO: 8691 - RNA, 24 nt, Human
ugcauuuggagucuaaggaaagga

SEQ ID NO: 8692 - RNA, 24 nt, Human
ugccaaagcaaagaaauucuaccu

SEQ ID NO: 8693 - RNA, 24 nt, Human
ugccaacguuaggagugaaaauag

SEQ ID NO: 8694 - RNA, 24 nt, Human
ugccaagaaagacugagccccucc

SEQ ID NO: 8695 - RNA, 24 nt, Human
ugccaaggauguggacuuggaguu

SEQ ID NO: 8696 - RNA, 24 nt, Human
ugccaagggcagcugcugaccgcc

SEQ ID NO: 8697 - RNA, 24 nt, Human
ugccaagggcugcggggaucugug

SEQ ID NO: 8698 - RNA, 24 nt, Human
ugccaaggguccugacggccucgu

SEQ ID NO: 8699 - RNA, 23 nt, Human
ugccaaguaugccucggcuuggc

SEQ ID NO: 8700 - RNA, 24 nt, Human
ugccaagugcugagcuaaaggagg

SEQ ID NO: 8701 - RNA, 24 nt, Human
ugccaauguaugcuuguacuccag

SEQ ID NO: 8702 - RNA, 24 nt, Human
ugccacagacugccaggcuccuac

SEQ ID NO: 8703 - RNA, 24 nt, Human
ugccagacuuccguugagucacau

SEQ ID NO: 8704 - RNA, 24 nt, Human
ugccagagcagcuuguccuccagg

SEQ ID NO: 8705 - RNA, 24 nt, Human
ugccagaugccagccagagcucuc

SEQ ID NO: 8706 - RNA, 24 nt, Human
ugccagcacggugguuaaagggga

SEQ ID NO: 8707 - RNA, 24 nt, Human
ugccagccggcuggaccugcagac

SEQ ID NO: 8708 - RNA, 17 nt, Human
ugccaggaaaagaugag

SEQ ID NO: 8709 - RNA, 24 nt, Human
ugccaggaauuccagguuggaggg

SEQ ID NO: 8710 - RNA, 24 nt, Human
ugccaggcagccuggggcagagug

SEQ ID NO: 8711 - RNA, 24 nt, Human
ugccaguagguuccaacuacuaca

SEQ ID NO: 8712 - RNA, 24 nt, Human
ugccaguggccuggcuugaacgga

SEQ ID NO: 8713 - RNA, 24 nt, Human
ugccauagggauucagggggcucc

SEQ ID NO: 8714 - RNA, 24 nt, Human
ugccauggaguccugcuguggaug

SEQ ID NO: 8715 - RNA, 24 nt, Human
ugccauggccaucuuuuucuuugu

SEQ ID NO: 8716 - RNA, 24 nt, Human
ugccaugguggugguucucucgag

SEQ ID NO: 8717 - RNA, 24 nt, Human
ugccauugaucugggcgaugaucu

SEQ ID NO: 8718 - RNA, 24 nt, Human
ugcccaggcuucugggaguacuug

SEQ ID NO: 8719 - RNA, 22 nt, Human
ugcccagguuggagugcaguga

SEQ ID NO: 8720 - RNA, 24 nt, Human
ugcccagugaccugggggagccug

SEQ ID NO: 8721 - RNA, 24 nt, Human
ugcccauugcucucccacuccacg

SEQ ID NO: 8722 - RNA, 23 nt, Human
ugccccaguacuuuguggguguu

SEQ ID NO: 8723 - RNA, 19 nt, Human
ugccccguuuaaggucagg

SEQ ID NO: 8724 - RNA, 24 nt, Human
ugcccgagccgcugcugcugcgcg

SEQ ID NO: 8725 - RNA, 24 nt, Human
ugcccgaggagaagcugguugagg

SEQ ID NO: 8726 - RNA, 24 nt, Human
ugcccgggccgugccagcggagcu

SEQ ID NO: 8727 - RNA, 24 nt, Human
ugcccggguucucugggugagggc

SEQ ID NO: 8728 - RNA, 24 nt, Human
ugcccuggagaaagagaggaauga

SEQ ID NO: 8729 - RNA, 24 nt, Human
ugcccuggggcgccuggcugaggc

SEQ ID NO: 8730 - RNA, 24 nt, Human
ugccgacgugauucccugggacgg

SEQ ID NO: 8731 - RNA, 24 nt, Human
ugccgagccgcugcugcugcgcgu

SEQ ID NO: 8732 - RNA, 24 nt, Human
ugccgagcggacggaggcuccggg

SEQ ID NO: 8733 - RNA, 24 nt, Human
ugccgauggguggguagggugugg

SEQ ID NO: 8734 - RNA, 24 nt, Human
ugccgcaggagcuuagcuugcugc

SEQ ID NO: 8735 - RNA, 24 nt, Human
ugccggaggaguggucgcaguggu

SEQ ID NO: 8736 - RNA, 24 nt, Human
ugccggcaccaagaagcaguucca

SEQ ID NO: 8737 - RNA, 24 nt, Human
ugccguagcuauggaauagaagca

SEQ ID NO: 8738 - RNA, 24 nt, Human
ugccgugacguaggguaugggccu

SEQ ID NO: 8739 - RNA, 24 nt, Human
ugccguggaggccuccuucaagug

SEQ ID NO: 8740 - RNA, 22 nt, Human
ugccuaggcaggacggaaugca

SEQ ID NO: 8741 - RNA, 22 nt, Human
ugccucagagaacuucugcagc

SEQ ID NO: 8742 - RNA, 24 nt, Human
ugccucaggggauucgccuucugu

SEQ ID NO: 8743 - RNA, 22 nt, Human
ugccucagugacagcagcauau

SEQ ID NO: 8744 - RNA, 24 nt, Human
ugccucugggcuuggcuugagcuc

SEQ ID NO: 8745 - RNA, 24 nt, Human
ugccucugucuuagaaaccuggag

SEQ ID NO: 8746 - RNA, 24 nt, Human
ugccugaagcuaaaaauauauacg

SEQ ID NO: 8747 - RNA, 24 nt, Human
ugccugaaguuuucagaaaagcug

SEQ ID NO: 8748 - RNA, 22 nt, Human
ugccugagccugcugcuagccc

SEQ ID NO: 8749 - RNA, 24 nt, Human
ugccugauaacagggugcaguguu

SEQ ID NO: 8750 - RNA, 24 nt, Human
ugccugggcugaggucuugggggc

SEQ ID NO: 8751 - RNA, 24 nt, Human
ugccuggggauccugaagauaaaa

SEQ ID NO: 8752 - RNA, 24 nt, Human
ugccugggguucccuuacucaucu

SEQ ID NO: 8753 - RNA, 24 nt, Human
ugccuggguaacuugcguauuuuc

SEQ ID NO: 8754 - RNA, 24 nt, Human
ugccuggucaaucaguccucggga

SEQ ID NO: 8755 - RNA, 22 nt, Human
ugccuguaaucccagcuacuca

SEQ ID NO: 8756 - RNA, 22 nt, Human
ugccuguuggaucugucuccau

SEQ ID NO: 8757 - RNA, 24 nt, Human
ugccuuaguaaaauccagcuggug

SEQ ID NO: 8758 - RNA, 24 nt, Human
ugccuuggacauggugauggugau

SEQ ID NO: 8759 - RNA, 22 nt, Human
ugccuuggauaaaugagugaag

SEQ ID NO: 8760 - RNA, 24 nt, Human
ugccuuuggguugugacuuggguu

SEQ ID NO: 8761 - RNA, 24 nt, Human
ugcgaaacuugccuuugcaguagg

SEQ ID NO: 8762 - RNA, 24 nt, Human
ugcgauggcacgccagugcuggag

SEQ ID NO: 8763 - RNA, 22 nt, Human
ugcgcaaacacaccaccugggc

SEQ ID NO: 8764 - RNA, 24 nt, Human
ugcgcagccuuaaaagggggcaca

SEQ ID NO: 8765 - RNA, 24 nt, Human
ugcgcuggacgcccgcuucuccug

SEQ ID NO: 8766 - RNA, 24 nt, Human
ugcgcuuuuggauuggggagucug

SEQ ID NO: 8767 - RNA, 24 nt, Human
ugcggcugcuaacuggcugcgcac

SEQ ID NO: 8768 - RNA, 24 nt, Human
ugcgggcaggcgucauagauaggg

SEQ ID NO: 8769 - RNA, 24 nt, Human
ugcgggcgccgggcugaagcuccg

SEQ ID NO: 8770 - RNA, 24 nt, Human
ugcgggugaacagaguugggccug

SEQ ID NO: 8771 - RNA, 23 nt, Human
ugcguggaagaauacaccggggc

SEQ ID NO: 8772 - RNA, 24 nt, Human
ugcuaagggggccccggauuccgg

SEQ ID NO: 8773 - RNA, 24 nt, Human
ugcuacacaaugggguugggaaag

SEQ ID NO: 8774 - RNA, 24 nt, Human
ugcuacagcuuuggcucugguggu

SEQ ID NO: 8775 - RNA, 24 nt, Human
ugcuagguggaguggauggaugau

SEQ ID NO: 8776 - RNA, 22 nt, Human
ugcuagguuuuuuccuuucccc

SEQ ID NO: 8777 - RNA, 24 nt, Human
ugcuaugagaaucuaaggcugcca

SEQ ID NO: 8778 - RNA, 22 nt, Human
ugcucacugcaagcuccgccuc

SEQ ID NO: 8779 - RNA, 24 nt, Human
ugcucagcaggcugaacccagaag

SEQ ID NO: 8780 - RNA, 24 nt, Human
ugcuccucaaucugcugcuuaguc

SEQ ID NO: 8781 - RNA, 24 nt, Human
ugcucgugcaguuugaguacugga

SEQ ID NO: 8782 - RNA, 22 nt, Human
ugcucugucuugccuuuugaug

SEQ ID NO: 8783 - RNA, 22 nt, Human
ugcucuugcucuuucuucugga

SEQ ID NO: 8784 - RNA, 24 nt, Human
ugcugaagucugaacuugggccuc

SEQ ID NO: 8785 - RNA, 24 nt, Human
ugcugagcccgcuucggccgggac

SEQ ID NO: 8786 - RNA, 24 nt, Human
ugcugcaguacaggggagcauagg

SEQ ID NO: 8787 - RNA, 24 nt, Human
ugcugccugcuugguccugccuug

SEQ ID NO: 8788 - RNA, 24 nt, Human
ugcuggaaucacuuuugccaaagg

SEQ ID NO: 8789 - RNA, 24 nt, Human
ugcuggaccaaggacguggaugag

SEQ ID NO: 8790 - RNA, 24 nt, Human
ugcuggagagagugcauggacaga

SEQ ID NO: 8791 - RNA, 24 nt, Human
ugcuggugggcgucgggcggcggc

SEQ ID NO: 8792 - RNA, 24 nt, Human
ugcuguagcagcucuuuagcugaa

SEQ ID NO: 8793 - RNA, 24 nt, Human
ugcuguaguccagucugauaugaa

SEQ ID NO: 8794 - RNA, 24 nt, Human
ugcugugcggccugggcgcuggcg

SEQ ID NO: 8795 - RNA, 22 nt, Human
ugcugugcuaaaggaaggauua

SEQ ID NO: 8796 - RNA, 22 nt, Human
ugcuguggaaaccgagccugua

SEQ ID NO: 8797 - RNA, 24 nt, Human
ugcugugugccccacuccaaccug

SEQ ID NO: 8798 - RNA, 22 nt, Human
ugcuuacauuaagcagaguaau

SEQ ID NO: 8799 - RNA, 22 nt, Human
ugcuuccugccauuguccacau

SEQ ID NO: 8800 - RNA, 24 nt, Human
ugcuugaauguaagagucagauga

SEQ ID NO: 8801 - RNA, 24 nt, Human
ugcuugaggccuggcagcugggcc

SEQ ID NO: 8802 - RNA, 24 nt, Human
ugcuuuguuuaccuacucaagccu

SEQ ID NO: 8803 - RNA, 24 nt, Human
ugcuuuguuuuuggcagucuuuau

SEQ ID NO: 8804 - RNA, 24 nt, Human
ugcuuuuuuauggaauacuauuuu

SEQ ID NO: 8805 - RNA, 24 nt, Human
uggaaaaacaguuagucuggagcc

SEQ ID NO: 8806 - RNA, 24 nt, Human
uggaaaaacuaagggaugcuuuag

SEQ ID NO: 8807 - RNA, 24 nt, Human
uggaaaaagcuaauuguaguuuuc

SEQ ID NO: 8808 - RNA, 24 nt, Human
uggaaaaauucagaggccuaaagu

SEQ ID NO: 8809 - RNA, 24 nt, Human
uggaaaaauuugagcagcaaacuc

SEQ ID NO: 8810 - RNA, 24 nt, Human
uggaaaacaacuauuuucucauca

SEQ ID NO: 8811 - RNA, 24 nt, Human
uggaaaacccccugaaauuuuaug

SEQ ID NO: 8812 - RNA, 24 nt, Human
uggaaaagugauguggguagccaa

SEQ ID NO: 8813 - RNA, 24 nt, Human
uggaaaaucuacuacagggaacaa

SEQ ID NO: 8814 - RNA, 23 nt, Human
uggaaaaugacaugauggucagc

SEQ ID NO: 8815 - RNA, 24 nt, Human
uggaaaccggaagcauguauucaa

SEQ ID NO: 8816 - RNA, 24 nt, Human
uggaaagaacucuucuuaugucca

SEQ ID NO: 8817 - RNA, 24 nt, Human
uggaaagagacuaagaacaagacu

SEQ ID NO: 8818 - RNA, 22 nt, Human
uggaaaggacagccaguccagc

SEQ ID NO: 8819 - RNA, 22 nt, Human
uggaaaguagaaagcacuacau

SEQ ID NO: 8820 - RNA, 24 nt, Human
uggaaaguucagcaagaucagcaa

SEQ ID NO: 8821 - RNA, 24 nt, Human
uggaacaacugaaagauugguuau

SEQ ID NO: 8822 - RNA, 24 nt, Human
uggaacaggaagguauguccuguc

SEQ ID NO: 8823 - RNA, 20 nt, Human
uggaacaguucaggucugag

SEQ ID NO: 8824 - RNA, 24 nt, Human
uggaaccaaagagagcugucucca

SEQ ID NO: 8825 - RNA, 24 nt, Human
uggaagaaaaagacauuccucuac

SEQ ID NO: 8826 - RNA, 24 nt, Human
uggaagaagagggaagucaucaag

SEQ ID NO: 8827 - RNA, 22 nt, Human
uggaagacagaaaccacacaca

SEQ ID NO: 8828 - RNA, 24 nt, Human
uggaagacccugggccccucaccg

SEQ ID NO: 8829 - RNA, 24 nt, Human
uggaagacucauuauucagagcug

SEQ ID NO: 8830 - RNA, 24 nt, Human
uggaagaggucaucacuccccgga

SEQ ID NO: 8831 - RNA, 24 nt, Human
uggaagauaagcuuaaaggagaaa

SEQ ID NO: 8832 - RNA, 24 nt, Human
uggaagaucuuagaauugccugcc

SEQ ID NO: 8833 - RNA, 24 nt, Human
uggaagcaaguggguucagugaag

SEQ ID NO: 8834 - RNA, 24 nt, Human
uggaagcagcggaggaaggagacg

SEQ ID NO: 8835 - RNA, 22 nt, Human
uggaaggaaagcaaguauauag

SEQ ID NO: 8836 - RNA, 24 nt, Human
uggaaggcgauggccccugcgagg

SEQ ID NO: 8837 - RNA, 24 nt, Human
uggaaggcugaagcggguagauca

SEQ ID NO: 8838 - RNA, 24 nt, Human
uggaaggggagacuuaguaucaua

SEQ ID NO: 8839 - RNA, 24 nt, Human
uggaagguaaauauauguuaagaa

SEQ ID NO: 8840 - RNA, 24 nt, Human
uggaaggugacuuuaucaccuuaa

SEQ ID NO: 8841 - RNA, 24 nt, Human
uggaagguggauuuccccuaucag

SEQ ID NO: 8842 - RNA, 24 nt, Human
uggaagugucuauacagaugugug

SEQ ID NO: 8843 - RNA, 24 nt, Human
uggaaguuggaacaauuuugcucc

SEQ ID NO: 8844 - RNA, 24 nt, Human
uggaauacaaguguaauuugaauc

SEQ ID NO: 8845 - RNA, 24 nt, Human
uggaauaugagaaaauagcagaaa

SEQ ID NO: 8846 - RNA, 21 nt, Human
uggaauccugguggucccacc

SEQ ID NO: 8847 - RNA, 24 nt, Human
uggaaucuccaggagugaggguuu

SEQ ID NO: 8848 - RNA, 24 nt, Human
uggaaugaagucugacuccuccag

SEQ ID NO: 8849 - RNA, 22 nt, Human
uggaaugacagaagaugagagc

SEQ ID NO: 8850 - RNA, 21 nt, Human
uggaaugagggacucuuucuc

SEQ ID NO: 8851 - RNA, 20 nt, Human
uggaaugccaucaccggaua

SEQ ID NO: 8852 - RNA, 24 nt, Human
uggaaugcuaaacguaugccauuu

SEQ ID NO: 8853 - RNA, 22 nt, Human
uggaauggcugaagacugugaa

SEQ ID NO: 8854 - RNA, 21 nt, Human
uggaauguucauaguguccuc

SEQ ID NO: 8855 - RNA, 24 nt, Human
uggaauucgagguaggccggccuc

SEQ ID NO: 8856 - RNA, 24 nt, Human
uggaauugaaaugucauuauugua

SEQ ID NO: 8857 - RNA, 21 nt, Human
uggaauugauagagcuccgug

SEQ ID NO: 8858 - RNA, 24 nt, Human
uggaauuuucagaaaaagauuguc

SEQ ID NO: 8859 - RNA, 24 nt, Human
uggacaacgcagccuaaggcagag

SEQ ID NO: 8860 - RNA, 24 nt, Human
uggacacugcccccgugggaccuc

SEQ ID NO: 8861 - RNA, 24 nt, Human
uggacuaguggaagggaugugggg

SEQ ID NO: 8862 - RNA, 24 nt, Human
uggacuggccgucagagcucguaa

SEQ ID NO: 8863 - RNA, 24 nt, Human
uggacuguccucuacagaaggaag

SEQ ID NO: 8864 - RNA, 22 nt, Human
uggagaaauuauauuuuacuaa

SEQ ID NO: 8865 - RNA, 22 nt, Human
uggagaauuaaaaaggguagug

SEQ ID NO: 8866 - RNA, 22 nt, Human
uggagaccugugugguuugugg

SEQ ID NO: 8867 - RNA, 22 nt, Human
uggagagaaaaugcaguauucu

SEQ ID NO: 8868 - RNA, 22 nt, Human
uggagagaaagcgaagauguag

SEQ ID NO: 8869 - RNA, 22 nt, Human
uggagagauaagccaaguaucc

SEQ ID NO: 8870 - RNA, 22 nt, Human
uggagagauagugauuuagcuc

SEQ ID NO: 8871 - RNA, 22 nt, Human
uggagagauucgugguguagcu

SEQ ID NO: 8872 - RNA, 22 nt, Human
uggagaggaagcacuguacuau

SEQ ID NO: 8873 - RNA, 22 nt, Human
uggagaguaaauggcagaauca

SEQ ID NO: 8874 - RNA, 22 nt, Human
uggagaguaggauuuucuugug

SEQ ID NO: 8875 - RNA, 22 nt, Human
uggagcagaaaggcaggagucc

SEQ ID NO: 8876 - RNA, 22 nt, Human
uggagccaagcuagaaggaaca

SEQ ID NO: 8877 - RNA, 22 nt, Human
uggaggacucaccaggcuugug

SEQ ID NO: 8878 - RNA, 24 nt, Human
uggaggaggaugacgaugaugagc

SEQ ID NO: 8879 - RNA, 24 nt, Human
uggaggcccaggcugggagguguc

SEQ ID NO: 8880 - RNA, 24 nt, Human
uggaggguguuguggucuccaauc

SEQ ID NO: 8881 - RNA, 22 nt, Human
uggaguaaaguaaugucuagga

SEQ ID NO: 8882 - RNA, 24 nt, Human
uggaguccuaaggcugguuggcga

SEQ ID NO: 8883 - RNA, 22 nt, Human
uggagugcugguuacuguuugg

SEQ ID NO: 8884 - RNA, 22 nt, Human
uggaguggccaauucuauucuc

SEQ ID NO: 8885 - RNA, 22 nt, Human
uggauacagccgcgaggcuaaa

SEQ ID NO: 8886 - RNA, 24 nt, Human
uggaucaccuaaggucaggaguug

SEQ ID NO: 8887 - RNA, 22 nt, Human
uggaucuuacuguccagagcac

SEQ ID NO: 8888 - RNA, 23 nt, Human
uggaugagcugcccagccuugca

SEQ ID NO: 8889 - RNA, 22 nt, Human
uggauggauaggaauacuucau

SEQ ID NO: 8890 - RNA, 22 nt, Human
uggauucguccagcuuuucgca

SEQ ID NO: 8891 - RNA, 24 nt, Human
uggauucuugggagcuggauacuc

SEQ ID NO: 8892 - RNA, 24 nt, Human
uggauuggugccccacuggcuuca

SEQ ID NO: 8893 - RNA, 22 nt, Human
uggcaaaaugucagucugagaa

SEQ ID NO: 8894 - RNA, 22 nt, Human
uggcaaagaugcugaccuacau

SEQ ID NO: 8895 - RNA, 24 nt, Human
uggcaaauuguagaagucaugggu

SEQ ID NO: 8896 - RNA, 24 nt, Human
uggcaagauugcagcaagaucaug

SEQ ID NO: 8897 - RNA, 24 nt, Human
uggcaagcagcuccaguccgagca

SEQ ID NO: 8898 - RNA, 22 nt, Human
uggcaaggaagaaaguguuccg

SEQ ID NO: 8899 - RNA, 24 nt, Human
uggcaaggagcugccaaaacugag

SEQ ID NO: 8900 - RNA, 24 nt, Human
uggcaaggagguaaggaaaugaaa

SEQ ID NO: 8901 - RNA, 24 nt, Human
uggcaaggcgagggcacccuggcc

SEQ ID NO: 8902 - RNA, 24 nt, Human
uggcaagggacagcacucacacuc

SEQ ID NO: 8903 - RNA, 24 nt, Human
uggcaagggucccuccauuaagca

SEQ ID NO: 8904 - RNA, 22 nt, Human
uggcaaggugugggcuagagau

SEQ ID NO: 8905 - RNA, 24 nt, Human
uggcaagucacuuggugcccgggg

SEQ ID NO: 8906 - RNA, 24 nt, Human
uggcaaguucuuuagccuuugccu

SEQ ID NO: 8907 - RNA, 24 nt, Human
uggcaauaaauacuaugggauugu

SEQ ID NO: 8908 - RNA, 24 nt, Human
uggcaauaucaaggaagggcaggc

SEQ ID NO: 8909 - RNA, 23 nt, Human
uggcaaucaacuuaguagaaguc

SEQ ID NO: 8910 - RNA, 24 nt, Human
uggcaauugggaagggugugucag

SEQ ID NO: 8911 - RNA, 24 nt, Human
uggcacagaaucugggaauuugua

SEQ ID NO: 8912 - RNA, 24 nt, Human
uggcacagacauuuuaaucuuguc

SEQ ID NO: 8913 - RNA, 22 nt, Human
uggcacagaucagcagaacagg

SEQ ID NO: 8914 - RNA, 22 nt, Human
uggcacauaguaaguguucagu

SEQ ID NO: 8915 - RNA, 24 nt, Human
uggcacgauggcggaugugaccuu

SEQ ID NO: 8916 - RNA, 24 nt, Human
uggcacgcucgaacuuccggcccu

SEQ ID NO: 8917 - RNA, 24 nt, Human
uggcacuaagcgguccugagcgcu

SEQ ID NO: 8918 - RNA, 24 nt, Human
uggcagagaauacagucagucagg

SEQ ID NO: 8919 - RNA, 22 nt, Human
uggcagagagcugugcuucaaa

SEQ ID NO: 8920 - RNA, 24 nt, Human
uggcagaggacuucgagcggcgcc

SEQ ID NO: 8921 - RNA, 24 nt, Human
uggcagagguggcggcggcggcau

SEQ ID NO: 8922 - RNA, 24 nt, Human
uggcagaguaaagauuauuccugu

SEQ ID NO: 8923 - RNA, 24 nt, Human
uggcagccucaucaagaugacuga

SEQ ID NO: 8924 - RNA, 22 nt, Human
uggcagccugagaagucagagc

SEQ ID NO: 8925 - RNA, 24 nt, Human
uggcagcggguaaccugcuuguuc

SEQ ID NO: 8926 - RNA, 24 nt, Human
uggcaggaacggagugguugguag

SEQ ID NO: 8927 - RNA, 24 nt, Human
uggcaggaaggggaggcaaggcca

SEQ ID NO: 8928 - RNA, 24 nt, Human
uggcaggaaugggaggcauccaga

SEQ ID NO: 8929 - RNA, 24 nt, Human
uggcaggagcugaggcagcugcag

SEQ ID NO: 8930 - RNA, 21 nt, Human
uggcaggcagugaagugggag

SEQ ID NO: 8931 - RNA, 24 nt, Human
uggcaggccaugggcccucaggau

SEQ ID NO: 8932 - RNA, 24 nt, Human
uggcaggccccucaaagccguggu

SEQ ID NO: 8933 - RNA, 24 nt, Human
uggcaggccugguaggcggaggcg

SEQ ID NO: 8934 - RNA, 24 nt, Human
uggcaggcugggaaaagacaagcc

SEQ ID NO: 8935 - RNA, 24 nt, Human
uggcaggggaggacagaacuuuga

SEQ ID NO: 8936 - RNA, 22 nt, Human
uggcagggucuugcuguguugc

SEQ ID NO: 8937 - RNA, 22 nt, Human
uggcagguguuaagcugguuuc

SEQ ID NO: 8938 - RNA, 24 nt, Human
uggcaguggguaaaaugguggaca

SEQ ID NO: 8939 - RNA, 24 nt, Human
uggcauaguggugauaauugacau

SEQ ID NO: 8940 - RNA, 24 nt, Human
uggcauagugucagauguaccuua

SEQ ID NO: 8941 - RNA, 21 nt, Human
uggcaucaagcaauccuccug

SEQ ID NO: 8942 - RNA, 22 nt, Human
uggcaucauccacauagaauga

SEQ ID NO: 8943 - RNA, 21 nt, Human
uggcaucuaauauuuuuggac

SEQ ID NO: 8944 - RNA, 24 nt, Human
uggcaucugguggcuaagcugguc

SEQ ID NO: 8945 - RNA, 22 nt, Human
uggcaugaagaaggaauagagc

SEQ ID NO: 8946 - RNA, 24 nt, Human
uggcaugcagcuccaguccgagca

SEQ ID NO: 8947 - RNA, 24 nt, Human
uggcaugccuuuuucacggcggcu

SEQ ID NO: 8948 - RNA, 24 nt, Human
uggcauggccuuccgugucccacu

SEQ ID NO: 8949 - RNA, 24 nt, Human
uggcauggggagcagcuagaacag

SEQ ID NO: 8950 - RNA, 24 nt, Human
uggcaugugcccagcgacguggcc

SEQ ID NO: 8951 - RNA, 20 nt, Human
uggcauguggauccuugaga

SEQ ID NO: 8952 - RNA, 24 nt, Human
uggccaaauccacuuguguauggg

SEQ ID NO: 8953 - RNA, 24 nt, Human
uggccaauuggaaccggguguugu

SEQ ID NO: 8954 - RNA, 24 nt, Human
uggccagagagaaggucuucuggg

SEQ ID NO: 8955 - RNA, 23 nt, Human
uggccagccacagcgcagugcug

SEQ ID NO: 8956 - RNA, 24 nt, Human
uggccaggaaugcagcggccgugc

SEQ ID NO: 8957 - RNA, 24 nt, Human
uggccaggccaccugcaccaggga

SEQ ID NO: 8958 - RNA, 24 nt, Human
uggccaggcuagacuggaaaaccg

SEQ ID NO: 8959 - RNA, 24 nt, Human
uggccaggcugcagcugaaugggc

SEQ ID NO: 8960 - RNA, 24 nt, Human
uggccaguguuggcuagggacacu

SEQ ID NO: 8961 - RNA, 24 nt, Human
uggcccggccugacccggucuggc

SEQ ID NO: 8962 - RNA, 24 nt, Human
uggccgcaguccuugcgaacuguu

SEQ ID NO: 8963 - RNA, 24 nt, Human
uggccggacauccgcgucugcaga

SEQ ID NO: 8964 - RNA, 22 nt, Human
uggccgugagccgcacccagga

SEQ ID NO: 8965 - RNA, 24 nt, Human
uggccuagucagugccucgaggag

SEQ ID NO: 8966 - RNA, 24 nt, Human
uggccugaugauccacagcggaga

SEQ ID NO: 8967 - RNA, 22 nt, Human
uggccugcuccggcugcuuguc

SEQ ID NO: 8968 - RNA, 24 nt, Human
uggccugggcaaucuuggcccugu

SEQ ID NO: 8969 - RNA, 24 nt, Human
uggccuugaaagcuccgcagaaau

SEQ ID NO: 8970 - RNA, 20 nt, Human
uggcgcagcuggcggacagc

SEQ ID NO: 8971 - RNA, 21 nt, Human
uggcggaggcagagagucuuc

SEQ ID NO: 8972 - RNA, 24 nt, Human
uggcgggacauguugcucaggagg

SEQ ID NO: 8973 - RNA, 24 nt, Human
uggcgguuccccccacuuuagccc

SEQ ID NO: 8974 - RNA, 20 nt, Human
uggcguauuagaauggugcc

SEQ ID NO: 8975 - RNA, 24 nt, Human
uggcuaaaauuuucuggacuucau

SEQ ID NO: 8976 - RNA, 24 nt, Human
uggcuaggcagccuaggauguggg

SEQ ID NO: 8977 - RNA, 22 nt, Human
uggcuagguacugguggcucac

SEQ ID NO: 8978 - RNA, 24 nt, Human
uggcucaugccuguaaucccagga

SEQ ID NO: 8979 - RNA, 20 nt, Human
uggcucggggcgagcggcgg

SEQ ID NO: 8980 - RNA, 24 nt, Human
uggcucugcccagguggggguggg

SEQ ID NO: 8981 - RNA, 22 nt, Human
uggcucugugguugcugguuau

SEQ ID NO: 8982 - RNA, 24 nt, Human
uggcugacuucgagugggugaugu

SEQ ID NO: 8983 - RNA, 24 nt, Human
uggcugagauucaggggaucuuug

SEQ ID NO: 8984 - RNA, 22 nt, Human
uggcuggacauaguaugucuua

SEQ ID NO: 8985 - RNA, 24 nt, Human
uggcuggaggacaugggagugacg

SEQ ID NO: 8986 - RNA, 24 nt, Human
uggcuggaggugcaguggcgugau

SEQ ID NO: 8987 - RNA, 24 nt, Human
uggcugggaccggccgcucuccuc

SEQ ID NO: 8988 - RNA, 24 nt, Human
uggcugggcagguggauuacaagg

SEQ ID NO: 8989 - RNA, 24 nt, Human
uggcuggguggaacugagucuuuu

SEQ ID NO: 8990 - RNA, 24 nt, Human
uggcuggguucaaaaagggagggg

SEQ ID NO: 8991 - RNA, 24 nt, Human
uggcuggguuuauagcuuggggcu

SEQ ID NO: 8992 - RNA, 24 nt, Human
uggcuuagcuugggcucaggggcc

SEQ ID NO: 8993 - RNA, 24 nt, Human
uggcuucggcagggucagccuugc

SEQ ID NO: 8994 - RNA, 21 nt, Human
uggcuucuggguuccacuccu

SEQ ID NO: 8995 - RNA, 22 nt, Human
uggcuucuggguuccacuccuu

SEQ ID NO: 8996 - RNA, 24 nt, Human
uggcuuggcuugggcucagaggcc

SEQ ID NO: 8997 - RNA, 24 nt, Human
uggcuuguuaugugagaaacacau

SEQ ID NO: 8998 - RNA, 24 nt, Human
uggcuuuucauugacaugguagag

SEQ ID NO: 8999 - RNA, 22 nt, Human
uggcuuuuuauucauaugugau

SEQ ID NO: 9000 - RNA, 19 nt, Human
ugggaaaaugcaggucugg

SEQ ID NO: 9001 - RNA, 24 nt, Human
ugggaacaggaagcucccuagggc

SEQ ID NO: 9002 - RNA, 24 nt, Human
ugggaacugaugaggagaguaaca

SEQ ID NO: 9003 - RNA, 24 nt, Human
ugggaagagcacccugcugaagag

SEQ ID NO: 9004 - RNA, 24 nt, Human
ugggaaggcgaugccugucgggag

SEQ ID NO: 9005 - RNA, 22 nt, Human
ugggaaggguggcucaaggaag

SEQ ID NO: 9006 - RNA, 24 nt, Human
ugggaagugcaagaccaagauaug

SEQ ID NO: 9007 - RNA, 24 nt, Human
ugggaagugguuaagugugcccac

SEQ ID NO: 9008 - RNA, 24 nt, Human
ugggaauggucaucuaugucucgu

SEQ ID NO: 9009 - RNA, 24 nt, Human
ugggacaauuucaguucuaauaau

SEQ ID NO: 9010 - RNA, 24 nt, Human
ugggacagaaaauaaaucuaaguu

SEQ ID NO: 9011 - RNA, 24 nt, Human
ugggacuccauccuucaucucucc

SEQ ID NO: 9012 - RNA, 24 nt, Human
ugggacucuggggccugcucccag

SEQ ID NO: 9013 - RNA, 24 nt, Human
ugggacuuugaccugcaauuaggu

SEQ ID NO: 9014 - RNA, 24 nt, Human
ugggagaaaggcgcugagcguggc

SEQ ID NO: 9015 - RNA, 22 nt, Human
ugggagaagcucaggagucuga

SEQ ID NO: 9016 - RNA, 24 nt, Human
ugggagcagcagccaaguccgcgg

SEQ ID NO: 9017 - RNA, 23 nt, Human
ugggagccaggaauggggcuggg

SEQ ID NO: 9018 - RNA, 24 nt, Human
ugggagcccugguuugggcauaau

SEQ ID NO: 9019 - RNA, 24 nt, Human
ugggagcgagaaaguaguugugaa

SEQ ID NO: 9020 - RNA, 23 nt, Human
ugggaggauggguuauuauaugg

SEQ ID NO: 9021 - RNA, 24 nt, Human
ugggaggcagggcuccgcugcgcc

SEQ ID NO: 9022 - RNA, 24 nt, Human
ugggaggccauggccuucgccagc

SEQ ID NO: 9023 - RNA, 24 nt, Human
ugggagggaggggcugucagaccu

SEQ ID NO: 9024 - RNA, 24 nt, Human
ugggagggccaggcgucggguuau

SEQ ID NO: 9025 - RNA, 24 nt, Human
ugggaggggagauccagaaugaaa

SEQ ID NO: 9026 - RNA, 24 nt, Human
ugggagggggcagcugggcugagc

SEQ ID NO: 9027 - RNA, 24 nt, Human
ugggaguaucggauguagcugagu

SEQ ID NO: 9028 - RNA, 21 nt, Human
ugggauaggaucagaaagcuc

SEQ ID NO: 9029 - RNA, 24 nt, Human
ugggauauccaauaaacugagaau

SEQ ID NO: 9030 - RNA, 24 nt, Human
ugggaucauucugacagccaguca

SEQ ID NO: 9031 - RNA, 24 nt, Human
ugggauccuggguccugaggccuu

SEQ ID NO: 9032 - RNA, 21 nt, Human
ugggaucgaucagcacugcca

SEQ ID NO: 9033 - RNA, 24 nt, Human
ugggaucucuccagauauggucgc

SEQ ID NO: 9034 - RNA, 22 nt, Human
ugggaucuuguuagaaugcaga

SEQ ID NO: 9035 - RNA, 24 nt, Human
ugggaugaccugugaacgagacag

SEQ ID NO: 9036 - RNA, 24 nt, Human
ugggauggaaaugaaauggccaaa

SEQ ID NO: 9037 - RNA, 24 nt, Human
ugggauggaggggaguguugggca

SEQ ID NO: 9038 - RNA, 22 nt, Human
ugggaugucauccuucaaugcu

SEQ ID NO: 9039 - RNA, 24 nt, Human
ugggauguccgcugcaaucugcuc

SEQ ID NO: 9040 - RNA, 24 nt, Human
ugggauguccugccugcggagggg

SEQ ID NO: 9041 - RNA, 22 nt, Human
ugggauguggccauucuugugg

SEQ ID NO: 9042 - RNA, 24 nt, Human
ugggauuacaggcaugagccacug

SEQ ID NO: 9043 - RNA, 22 nt, Human
ugggauuacagguguaagccac

SEQ ID NO: 9044 - RNA, 22 nt, Human
ugggauuggaagucuucagauu

SEQ ID NO: 9045 - RNA, 24 nt, Human
ugggcaaauuuagcuagugucgcc

SEQ ID NO: 9046 - RNA, 24 nt, Human
ugggcacggaagguggagagggau

SEQ ID NO: 9047 - RNA, 24 nt, Human
ugggcagacaaaaucagcaaugcc

SEQ ID NO: 9048 - RNA, 24 nt, Human
ugggcagacuuggugaccugucga

SEQ ID NO: 9049 - RNA, 24 nt, Human
ugggcagcuggcuugccugcgagu

SEQ ID NO: 9050 - RNA, 24 nt, Human
ugggcaggaaggaugugaggacuc

SEQ ID NO: 9051 - RNA, 24 nt, Human
ugggccagcugaguaccugggcgu

SEQ ID NO: 9052 - RNA, 24 nt, Human
ugggcggaggagagaggcggggac

SEQ ID NO: 9053 - RNA, 22 nt, Human
ugggcuauuuuacaacauugua

SEQ ID NO: 9054 - RNA, 22 nt, Human
ugggcuuaaacuacccaugaga

SEQ ID NO: 9055 - RNA, 24 nt, Human
uggggacaggugucuggguccccc

SEQ ID NO: 9056 - RNA, 22 nt, Human
uggggagagcuuuuccacugcc

SEQ ID NO: 9057 - RNA, 19 nt, Human
uggggagaugaacauugca

SEQ ID NO: 9058 - RNA, 24 nt, Human
uggggcacgucucgguugucgggu

SEQ ID NO: 9059 - RNA, 24 nt, Human
uggggccagaaagggguuacaaaa

SEQ ID NO: 9060 - RNA, 24 nt, Human
uggggcccaacgaggcgcuggugg

SEQ ID NO: 9061 - RNA, 22 nt, Human
uggggccuucuuugaguacuag

SEQ ID NO: 9062 - RNA, 24 nt, Human
ugggggccauguuugggggaaggg

SEQ ID NO: 9063 - RNA, 24 nt, Human
ugggggugcagggcuuggugacgc

SEQ ID NO: 9064 - RNA, 24 nt, Human
ugggguaaugaaguauuucaguuu

SEQ ID NO: 9065 - RNA, 24 nt, Human
uggggucagaaaagagaaaugacc

SEQ ID NO: 9066 - RNA, 24 nt, Human
uggggugggagcagaaggaaggcu

SEQ ID NO: 9067 - RNA, 24 nt, Human
ugggguuuccaccuccugccuccg

SEQ ID NO: 9068 - RNA, 22 nt, Human
ugggguuucuccauguugguca

SEQ ID NO: 9069 - RNA, 22 nt, Human
uggguaguuucuguugcugugu

SEQ ID NO: 9070 - RNA, 24 nt, Human
uggguccgcaucguauucccggaa

SEQ ID NO: 9071 - RNA, 24 nt, Human
uggguccugggcagauacagccuu

SEQ ID NO: 9072 - RNA, 24 nt, Human
ugggugaggaacaaaaaccggauu

SEQ ID NO: 9073 - RNA, 24 nt, Human
ugggugcccgcuggcuacgcuugc

SEQ ID NO: 9074 - RNA, 24 nt, Human
uggguggcugugguauaugggaaa

SEQ ID NO: 9075 - RNA, 23 nt, Human
ugggugggacggagccuggauuc

SEQ ID NO: 9076 - RNA, 24 nt, Human
uggguuaauuuguaauggucccag

SEQ ID NO: 9077 - RNA, 22 nt, Human
uggguuagugguugaauaguuu

SEQ ID NO: 9078 - RNA, 24 nt, Human
uggguugggaagaccaucaguucu

SEQ ID NO: 9079 - RNA, 22 nt, Human
uggguuucugaggguguuggua

SEQ ID NO: 9080 - RNA, 24 nt, Human
ugguaagcaaaauaaauuguauuu

SEQ ID NO: 9081 - RNA, 24 nt, Human
ugguacagaccaaguauguggaag

SEQ ID NO: 9082 - RNA, 24 nt, Human
ugguacgccugcagguaccggucc

SEQ ID NO: 9083 - RNA, 24 nt, Human
ugguacggcucaucccuugcaccc

SEQ ID NO: 9084 - RNA, 24 nt, Human
ugguagagugcugaucuuagcaug

SEQ ID NO: 9085 - RNA, 24 nt, Human
ugguaggcccuuggugguccucau

SEQ ID NO: 9086 - RNA, 24 nt, Human
ugguagguagggguagggccagag

SEQ ID NO: 9087 - RNA, 24 nt, Human
ugguaggugggccccucgcuuucu

SEQ ID NO: 9088 - RNA, 24 nt, Human
ugguaguucaugcaggccacggcc

SEQ ID NO: 9089 - RNA, 24 nt, Human
ugguauauuuucaccaugucucug

SEQ ID NO: 9090 - RNA, 22 nt, Human
ugguaugaauuuugcagccgga

SEQ ID NO: 9091 - RNA, 24 nt, Human
ugguaugcuaaggagucaguacuu

SEQ ID NO: 9092 - RNA, 24 nt, Human
ugguauguuguaucuuuguucucg

SEQ ID NO: 9093 - RNA, 24 nt, Human
ugguauuccaggugcaguguccau

SEQ ID NO: 9094 - RNA, 22 nt, Human
uggucauggaaauagaaugcac

SEQ ID NO: 9095 - RNA, 22 nt, Human
uggucucuuagugauggggaca

SEQ ID NO: 9096 - RNA, 22 nt, Human
uggucucuugaaagaggcucuu

SEQ ID NO: 9097 - RNA, 22 nt, Human
uggucuuucccuccacaccugc

SEQ ID NO: 9098 - RNA, 22 nt, Human
ugguggaugaaggguggauauu

SEQ ID NO: 9099 - RNA, 20 nt, Human
ugguggcagguagguggugc

SEQ ID NO: 9100 - RNA, 22 nt, Human
ugguggcaugcaccuguugucc

SEQ ID NO: 9101 - RNA, 22 nt, Human
uggugggaaucccugggaggau

SEQ ID NO: 9102 - RNA, 24 nt, Human
uggugguaaauauaaaugaguuuc

SEQ ID NO: 9103 - RNA, 24 nt, Human
ugguggucauccuggcagcuggug

SEQ ID NO: 9104 - RNA, 24 nt, Human
ugguggucuugagcuuuuggccug

SEQ ID NO: 9105 - RNA, 22 nt, Human
ugguggugcaugccuguauucc

SEQ ID NO: 9106 - RNA, 24 nt, Human
uggugucgaugggccggaaguagg

SEQ ID NO: 9107 - RNA, 24 nt, Human
ugguguggugauucgcuucugguu

SEQ ID NO: 9108 - RNA, 24 nt, Human
ugguguguggaacugcugcaagcu

SEQ ID NO: 9109 - RNA, 22 nt, Human
ugguucagcagggaagccaggu

SEQ ID NO: 9110 - RNA, 22 nt, Human
ugguugaaauucuuacauuuuc

SEQ ID NO: 9111 - RNA, 24 nt, Human
ugguugauauugcuaggguggcgc

SEQ ID NO: 9112 - RNA, 22 nt, Human
ugguuuaagaaauuccuacgug

SEQ ID NO: 9113 - RNA, 24 nt, Human
ugguuugugaauaugacaaugaaa

SEQ ID NO: 9114 - RNA, 22 nt, Human
uguaaacaucccacacacucag

SEQ ID NO: 9115 - RNA, 24 nt, Human
uguaaaguggcuggugcuucccgg

SEQ ID NO: 9116 - RNA, 24 nt, Human
uguaaaguucggaucucaguucca

SEQ ID NO: 9117 - RNA, 22 nt, Human
uguaacacugaacuccugggcu

SEQ ID NO: 9118 - RNA, 24 nt, Human
uguaagaucucuucgagagagcug

SEQ ID NO: 9119 - RNA, 24 nt, Human
uguaagauggauaauguguauaag

SEQ ID NO: 9120 - RNA, 24 nt, Human
uguaauacugaucuggagggaaaa

SEQ ID NO: 9121 - RNA, 24 nt, Human
uguaaucauaagcaucugcgaaug

SEQ ID NO: 9122 - RNA, 24 nt, Human
uguaaugaaaaggguugggaugaa

SEQ ID NO: 9123 - RNA, 24 nt, Human
uguaaugagaguaauguucugaga

SEQ ID NO: 9124 - RNA, 24 nt, Human
uguacacacacauauacauauaua

SEQ ID NO: 9125 - RNA, 24 nt, Human
uguacagucagugaaauugaagaa

SEQ ID NO: 9126 - RNA, 24 nt, Human
uguagaaucuuuauuaucucaaca

SEQ ID NO: 9127 - RNA, 24 nt, Human
uguagagacuuuaugauuagaaug

SEQ ID NO: 9128 - RNA, 24 nt, Human
uguaggacgguugcuccgagcguc

SEQ ID NO: 9129 - RNA, 24 nt, Human
uguagggauaaggcgugaccacag

SEQ ID NO: 9130 - RNA, 22 nt, Human
uguaggugguugagagaaugaa

SEQ ID NO: 9131 - RNA, 22 nt, Human
uguagugcaugggcagugugcg

SEQ ID NO: 9132 - RNA, 24 nt, Human
uguauagcaauaugcuuggagagg

SEQ ID NO: 9133 - RNA, 24 nt, Human
uguauaguaaagaagccaagccca

SEQ ID NO: 9134 - RNA, 24 nt, Human
uguaugaagguccacuuccuuccu

SEQ ID NO: 9135 - RNA, 24 nt, Human
uguauggaaugcuagauggccaag

SEQ ID NO: 9136 - RNA, 24 nt, Human
uguauggacuuucggcgugugcau

SEQ ID NO: 9137 - RNA, 22 nt, Human
uguauguagauagucagaucau

SEQ ID NO: 9138 - RNA, 24 nt, Human
uguauuauuauauaugugccgaga

SEQ ID NO: 9139 - RNA, 24 nt, Human
uguauugucuauggcugcuuuugu

SEQ ID NO: 9140 - RNA, 24 nt, Human
uguauuuauuauuggcgauuauaa

SEQ ID NO: 9141 - RNA, 24 nt, Human
ugucaaggaaugaagucucuagcc

SEQ ID NO: 9142 - RNA, 24 nt, Human
ugucaaguaaaacggaagagggau

SEQ ID NO: 9143 - RNA, 24 nt, Human
ugucaaguuacuaaucauuccucu

SEQ ID NO: 9144 - RNA, 24 nt, Human
ugucacacuggaggcuucauuuac

SEQ ID NO: 9145 - RNA, 23 nt, Human
ugucacagccacagauguugucc

SEQ ID NO: 9146 - RNA, 22 nt, Human
ugucacagucagugcacucagc

SEQ ID NO: 9147 - RNA, 24 nt, Human
ugucacaguucaugaggucagagg

SEQ ID NO: 9148 - RNA, 22 nt, Human
ugucacaucuugcuccagacgu

SEQ ID NO: 9149 - RNA, 22 nt, Human
ugucacccaggacuuuccggaa

SEQ ID NO: 9150 - RNA, 24 nt, Human
ugucacguaggucacacuagacuc

SEQ ID NO: 9151 - RNA, 24 nt, Human
ugucagaacaccggaggcauuuuc

SEQ ID NO: 9152 - RNA, 24 nt, Human
ugucagaauugagcuucacaauug

SEQ ID NO: 9153 - RNA, 24 nt, Human
ugucagagggaagucaaaguggag

SEQ ID NO: 9154 - RNA, 24 nt, Human
ugucagggagcugcugcaggucaa

SEQ ID NO: 9155 - RNA, 22 nt, Human
ugucaguuuuuuaaauacucag

SEQ ID NO: 9156 - RNA, 23 nt, Human
ugucauaaacugccccagcucuu

SEQ ID NO: 9157 - RNA, 24 nt, Human
ugucauacagcuucuucacagccu

SEQ ID NO: 9158 - RNA, 22 nt, Human
ugucauauagaauguucuauga

SEQ ID NO: 9159 - RNA, 24 nt, Human
ugucaugguguagaacuugaacac

SEQ ID NO: 9160 - RNA, 24 nt, Human
ugucaugugaugggugaugucaug

SEQ ID NO: 9161 - RNA, 22 nt, Human
ugucauguucuaccucuuauuc

SEQ ID NO: 9162 - RNA, 22 nt, Human
uguccaauacuuugugucuagg

SEQ ID NO: 9163 - RNA, 24 nt, Human
uguccagguguucagaccucuugg

SEQ ID NO: 9164 - RNA, 24 nt, Human
uguccaguagccgaacaguuuguu

SEQ ID NO: 9165 - RNA, 24 nt, Human
ugucccacauggaagacgcuauuc

SEQ ID NO: 9166 - RNA, 24 nt, Human
ugucccagaugaugagcuucccau

SEQ ID NO: 9167 - RNA, 24 nt, Human
ugucccggguggacucagugagga

SEQ ID NO: 9168 - RNA, 22 nt, Human
uguccggagauucggagcggcg

SEQ ID NO: 9169 - RNA, 24 nt, Human
uguccucgccaacccccgaccugc

SEQ ID NO: 9170 - RNA, 22 nt, Human
uguccugguucugcagucaaaa

SEQ ID NO: 9171 - RNA, 24 nt, Human
uguccugguuuauguuaccagcaa

SEQ ID NO: 9172 - RNA, 24 nt, Human
uguccuguuuuucuucaacuugcu

SEQ ID NO: 9173 - RNA, 23 nt, Human
ugucgcggucugugaguuugucu

SEQ ID NO: 9174 - RNA, 24 nt, Human
ugucguuuuuuccuugacacuugu

SEQ ID NO: 9175 - RNA, 24 nt, Human
ugucuaagucagagucuccuaaag

SEQ ID NO: 9176 - RNA, 24 nt, Human
ugucucaggcaccugaaucagacc

SEQ ID NO: 9177 - RNA, 22 nt, Human
ugucuccccuaccacagcccag

SEQ ID NO: 9178 - RNA, 24 nt, Human
ugucuggagccaaccuuggcaguu

SEQ ID NO: 9179 - RNA, 24 nt, Human
ugucugggaaagauaucggugaga

SEQ ID NO: 9180 - RNA, 22 nt, Human
ugucuucauccaggaaccacau

SEQ ID NO: 9181 - RNA, 22 nt, Human
ugucuugcacugcaaacauagc

SEQ ID NO: 9182 - RNA, 24 nt, Human
ugucuugggggaagugcaacugug

SEQ ID NO: 9183 - RNA, 24 nt, Human
ugugaaagaaagggcccagggugu

SEQ ID NO: 9184 - RNA, 24 nt, Human
ugugaaagaggaugcuuugguagc

SEQ ID NO: 9185 - RNA, 22 nt, Human
ugugaacagucucugaugaaag

SEQ ID NO: 9186 - RNA, 24 nt, Human
ugugaacggcgguuaguuacuaua

SEQ ID NO: 9187 - RNA, 23 nt, Human
ugugaagaauuccagcugaacaa

SEQ ID NO: 9188 - RNA, 24 nt, Human
ugugaaguauagggaagaacaaca

SEQ ID NO: 9189 - RNA, 24 nt, Human
ugugaauucuguugcuucuggggc

SEQ ID NO: 9190 - RNA, 22 nt, Human
ugugacacguucauucugcaag

SEQ ID NO: 9191 - RNA, 24 nt, Human
ugugaccaaagccuaagaagccag

SEQ ID NO: 9192 - RNA, 22 nt, Human
ugugaccuccagcaaacacaug

SEQ ID NO: 9193 - RNA, 24 nt, Human
ugugacuaugaauuacagaucuca

SEQ ID NO: 9194 - RNA, 24 nt, Human
ugugagaaguagauaggguuacug

SEQ ID NO: 9195 - RNA, 22 nt, Human
ugugagacgaaagacaguucac

SEQ ID NO: 9196 - RNA, 22 nt, Human
ugugagagaaauggcaaguugg

SEQ ID NO: 9197 - RNA, 22 nt, Human
ugugaggggguguggcacggga

SEQ ID NO: 9198 - RNA, 24 nt, Human
ugugaggggucccaccagcccagg

SEQ ID NO: 9199 - RNA, 24 nt, Human
ugugaggucucuaacuagcuguau

SEQ ID NO: 9200 - RNA, 22 nt, Human
ugugaguaggagaaauauugcu

SEQ ID NO: 9201 - RNA, 24 nt, Human
ugugauaagaaauguguacuugga

SEQ ID NO: 9202 - RNA, 24 nt, Human
ugugauaagauugacaaguuggug

SEQ ID NO: 9203 - RNA, 24 nt, Human
ugugauacuuagaauacuuuggcu

SEQ ID NO: 9204 - RNA, 24 nt, Human
ugugaucugauuggaggagggaca

SEQ ID NO: 9205 - RNA, 19 nt, Human
ugugaugaaaggaacaguc

SEQ ID NO: 9206 - RNA, 24 nt, Human
ugugaugauucuuuugcuuucuac

SEQ ID NO: 9207 - RNA, 24 nt, Human
ugugaugauuugaauuacaaaucc

SEQ ID NO: 9208 - RNA, 22 nt, Human
ugugcacaacaugcagguuugu

SEQ ID NO: 9209 - RNA, 24 nt, Human
ugugcagaagaaaugggaaggauu

SEQ ID NO: 9210 - RNA, 24 nt, Human
ugugcagaccucgugcagccgggg

SEQ ID NO: 9211 - RNA, 21 nt, Human
ugugcagaggguuagaggcca

SEQ ID NO: 9212 - RNA, 24 nt, Human
ugugcagccauggagaagaugucc

SEQ ID NO: 9213 - RNA, 22 nt, Human
ugugcaugcagaggagcugcuc

SEQ ID NO: 9214 - RNA, 24 nt, Human
ugugccaauacagcauucacaccu

SEQ ID NO: 9215 - RNA, 24 nt, Human
ugugccguggcacgauggcgagga

SEQ ID NO: 9216 - RNA, 22 nt, Human
ugugcucaccucccuaaacaga

SEQ ID NO: 9217 - RNA, 24 nt, Human
ugugcugaaacccauuggagucaa

SEQ ID NO: 9218 - RNA, 24 nt, Human
ugugcugccuuaacaucgagaguu

SEQ ID NO: 9219 - RNA, 22 nt, Human
ugugcugguugcccccgagggg

SEQ ID NO: 9220 - RNA, 24 nt, Human
ugugcugugcguagugccuacugc

SEQ ID NO: 9221 - RNA, 24 nt, Human
uguggagacaggaagucgucccag

SEQ ID NO: 9222 - RNA, 24 nt, Human
uguggagacgcugaccaugcugug

SEQ ID NO: 9223 - RNA, 18 nt, Human
uguggaggaucaaggcug

SEQ ID NO: 9224 - RNA, 24 nt, Human
uguggagucaggaacugaaagcug

SEQ ID NO: 9225 - RNA, 24 nt, Human
uguggagugggccagcugaguacc

SEQ ID NO: 9226 - RNA, 24 nt, Human
uguggagugggugggcaacgggcc

SEQ ID NO: 9227 - RNA, 24 nt, Human
uguggaugagagguuuccaggcug

SEQ ID NO: 9228 - RNA, 24 nt, Human
uguggcagugagagaauccuggca

SEQ ID NO: 9229 - RNA, 24 nt, Human
uguggcaguuacugauguggacca

SEQ ID NO: 9230 - RNA, 22 nt, Human
uguggcccaacuggaucaggca

SEQ ID NO: 9231 - RNA, 24 nt, Human
uguggcgguuacacggccgggcgc

SEQ ID NO: 9232 - RNA, 24 nt, Human
uguggcuccuccuggccaggucau

SEQ ID NO: 9233 - RNA, 22 nt, Human
uguggcuuaggugagcauguga

SEQ ID NO: 9234 - RNA, 24 nt, Human
uguggcuuuuggggagccagugug

SEQ ID NO: 9235 - RNA, 24 nt, Human
uguggggcuggaaggggaggguug

SEQ ID NO: 9236 - RNA, 22 nt, Human
uguggugcagcgggaacagcuu

SEQ ID NO: 9237 - RNA, 24 nt, Human
uguggugcuugauagggcaagaac

SEQ ID NO: 9238 - RNA, 24 nt, Human
ugugguggcaugagauucagcggu

SEQ ID NO: 9239 - RNA, 24 nt, Human
ugugguggcuggagguggccgaau

SEQ ID NO: 9240 - RNA, 24 nt, Human
ugugguuuguugguuucugcuucc

SEQ ID NO: 9241 - RNA, 24 nt, Human
ugugguuuuaaaagagucccucaa

SEQ ID NO: 9242 - RNA, 24 nt, Human
ugugguuuuagcaccuuggggaga

SEQ ID NO: 9243 - RNA, 24 nt, Human
uguguacagugccagcacccacaa

SEQ ID NO: 9244 - RNA, 24 nt, Human
uguguacguauguauauacacaua

SEQ ID NO: 9245 - RNA, 24 nt, Human
uguguaggcgugggaauggacagg

SEQ ID NO: 9246 - RNA, 24 nt, Human
uguguauacauauauguguguaua

SEQ ID NO: 9247 - RNA, 24 nt, Human
ugugucaacuguguccagggugug

SEQ ID NO: 9248 - RNA, 24 nt, Human
ugugucaggcaugacaugaauggu

SEQ ID NO: 9249 - RNA, 24 nt, Human
uguguccugaucuguacagugagu

SEQ ID NO: 9250 - RNA, 24 nt, Human
ugugucugguggucuggcugcggg

SEQ ID NO: 9251 - RNA, 22 nt, Human
ugugugaaaaggcuggccuacu

SEQ ID NO: 9252 - RNA, 24 nt, Human
ugugugaugagaacauguuugggc

SEQ ID NO: 9253 - RNA, 24 nt, Human
uguguggacccauguugaccuuga

SEQ ID NO: 9254 - RNA, 22 nt, Human
ugugugugacugcagacugcua

SEQ ID NO: 9255 - RNA, 22 nt, Human
uguguuagaagauggaccagag

SEQ ID NO: 9256 - RNA, 24 nt, Human
uguguuaggaaugucaacagagca

SEQ ID NO: 9257 - RNA, 24 nt, Human
uguguucuggugaggccauggggu

SEQ ID NO: 9258 - RNA, 24 nt, Human
uguguugcacauugguguacaucu

SEQ ID NO: 9259 - RNA, 22 nt, Human
uguguuggagcagaggcagggg

SEQ ID NO: 9260 - RNA, 24 nt, Human
uguuaaaaucugcuagaaaaguaa

SEQ ID NO: 9261 - RNA, 22 nt, Human
uguuaacauuuuggcuagauag

SEQ ID NO: 9262 - RNA, 21 nt, Human
uguuacagaggagcagaauca

SEQ ID NO: 9263 - RNA, 24 nt, Human
uguuacaugcaagacuguugccaa

SEQ ID NO: 9264 - RNA, 24 nt, Human
uguuacuggagaauucacuggcau

SEQ ID NO: 9265 - RNA, 24 nt, Human
uguuacuucuuugauaguucuuac

SEQ ID NO: 9266 - RNA, 24 nt, Human
uguuauggaggaauagauuugcuu

SEQ ID NO: 9267 - RNA, 24 nt, Human
uguuauggggauaagcuggugagg

SEQ ID NO: 9268 - RNA, 22 nt, Human
uguuauuuuguccaagagagag

SEQ ID NO: 9269 - RNA, 24 nt, Human
uguuccagaugacuucaaagguau

SEQ ID NO: 9270 - RNA, 24 nt, Human
uguucgaugccugucaaguucaug

SEQ ID NO: 9271 - RNA, 22 nt, Human
uguucuguuaccucugggcucu

SEQ ID NO: 9272 - RNA, 24 nt, Human
uguugagguauugccuaaggcugg

SEQ ID NO: 9273 - RNA, 24 nt, Human
uguugaguuugauuauagaagaga

SEQ ID NO: 9274 - RNA, 24 nt, Human
uguugaguuuugguuacuuguaca

SEQ ID NO: 9275 - RNA, 21 nt, Human
uguugcaggguauugcauggu

SEQ ID NO: 9276 - RNA, 24 nt, Human
uguugcuaggaaaugggaaaaggg

SEQ ID NO: 9277 - RNA, 24 nt, Human
uguugggaaaaugcugcuuaugag

SEQ ID NO: 9278 - RNA, 22 nt, Human
uguuggucaggcugguuuugaa

SEQ ID NO: 9279 - RNA, 22 nt, Human
uguuggugggaaccacaagggu

SEQ ID NO: 9280 - RNA, 24 nt, Human
uguugucuuucacccaaaauuugu

SEQ ID NO: 9281 - RNA, 24 nt, Human
uguuguuaccaaguucaguuugug

SEQ ID NO: 9282 - RNA, 24 nt, Human
uguuguuggcguuagcggcagcgg

SEQ ID NO: 9283 - RNA, 22 nt, Human
uguuuaaguagcuuauuuaucu

SEQ ID NO: 9284 - RNA, 24 nt, Human
uguuuaaugaaugcauaugaggug

SEQ ID NO: 9285 - RNA, 24 nt, Human
uguuuagacuacauguauuacaaa

SEQ ID NO: 9286 - RNA, 24 nt, Human
uguuuaguacuguauuguggaaua

SEQ ID NO: 9287 - RNA, 24 nt, Human
uguuuauuauuuauacguuauauu

SEQ ID NO: 9288 - RNA, 24 nt, Human
uguuucuuauagcaaacuguuguu

SEQ ID NO: 9289 - RNA, 24 nt, Human
uguuugauuucuuucugcuuugca

SEQ ID NO: 9290 - RNA, 22 nt, Human
uguuugcccguuuuucugugua

SEQ ID NO: 9291 - RNA, 22 nt, Human
uguuugugaggugcuuggagau

SEQ ID NO: 9292 - RNA, 24 nt, Human
uguuuuggucucuugggcaacauu

SEQ ID NO: 9293 - RNA, 24 nt, Human
uuaaaacaguagagcuagcaauga

SEQ ID NO: 9294 - RNA, 24 nt, Human
uuaaaacugcaagaaaaugcuaca

SEQ ID NO: 9295 - RNA, 23 nt, Human
uuaaaauugugguaaugaugccu

SEQ ID NO: 9296 - RNA, 22 nt, Human
uuaaagaucacuugacauggac

SEQ ID NO: 9297 - RNA, 24 nt, Human
uuaaagcacaguucuuggauccac

SEQ ID NO: 9298 - RNA, 24 nt, Human
uuaaagggccgucauuuccauuag

SEQ ID NO: 9299 - RNA, 24 nt, Human
uuaaagucaggcucauuuggggua

SEQ ID NO: 9300 - RNA, 24 nt, Human
uuaaaguuauaugaagucccugag

SEQ ID NO: 9301 - RNA, 24 nt, Human
uuaaaugugcauuaccugguuaca

SEQ ID NO: 9302 - RNA, 24 nt, Human
uuaaauuauggcaauauugcacuu

SEQ ID NO: 9303 - RNA, 24 nt, Human
uuaaauuguguuucuguuuugacc

SEQ ID NO: 9304 - RNA, 24 nt, Human
uuaacaaacuuacuggcagauugg

SEQ ID NO: 9305 - RNA, 24 nt, Human
uuaacaagaaagcaguuuggggcu

SEQ ID NO: 9306 - RNA, 24 nt, Human
uuaacauuucuccccucacucccu

SEQ ID NO: 9307 - RNA, 24 nt, Human
uuaacauuugcaguccuuguguca

SEQ ID NO: 9308 - RNA, 24 nt, Human
uuaaggcccacuuaggguccuggu

SEQ ID NO: 9309 - RNA, 22 nt, Human
uuaaggcguggaauuuguguaa

SEQ ID NO: 9310 - RNA, 24 nt, Human
uuaagggcuccuugauggaugcca

SEQ ID NO: 9311 - RNA, 22 nt, Human
uuaagucuuuucuuaagcaaag

SEQ ID NO: 9312 - RNA, 24 nt, Human
uuaauccaugaacaucauuauauc

SEQ ID NO: 9313 - RNA, 24 nt, Human
uuaaugaccagcagucacugagcg

SEQ ID NO: 9314 - RNA, 24 nt, Human
uuaauggaagaagaugaagaugcu

SEQ ID NO: 9315 - RNA, 24 nt, Human
uuaauguuauuaugagguuaaugu

SEQ ID NO: 9316 - RNA, 24 nt, Human
uuaauuggugacauccucaagagc

SEQ ID NO: 9317 - RNA, 24 nt, Human
uuacaaacaagaaaggaggugcuu

SEQ ID NO: 9318 - RNA, 24 nt, Human
uuacaaggcaauuuugugggcgag

SEQ ID NO: 9319 - RNA, 24 nt, Human
uuacagaagugaaacaaacuucua

SEQ ID NO: 9320 - RNA, 24 nt, Human
uuacagcgauuggucaaucucuau

SEQ ID NO: 9321 - RNA, 22 nt, Human
uuaccagcaacuguugcacggg

SEQ ID NO: 9322 - RNA, 21 nt, Human
uuaccagggguucgggacagc

SEQ ID NO: 9323 - RNA, 24 nt, Human
uuaccaugaagguuguuuugcuua

SEQ ID NO: 9324 - RNA, 22 nt, Human
uuaccauguuggccaggcuggu

SEQ ID NO: 9325 - RNA, 22 nt, Human
uuacccaggcuggagugcagug

SEQ ID NO: 9326 - RNA, 24 nt, Human
uuaccgguauuguaagaacaagcc

SEQ ID NO: 9327 - RNA, 24 nt, Human
uuacuacauuaagguacgagcagg

SEQ ID NO: 9328 - RNA, 23 nt, Human
uuacucuugagggaacaggucug

SEQ ID NO: 9329 - RNA, 24 nt, Human
uuacugcaagcuccgccuccuggg

SEQ ID NO: 9330 - RNA, 24 nt, Human
uuacugcagcuccagcagcugcuc

SEQ ID NO: 9331 - RNA, 24 nt, Human
uuacugcuagaacggagugaacgg

SEQ ID NO: 9332 - RNA, 24 nt, Human
uuacuggucccuuuacucuuccac

SEQ ID NO: 9333 - RNA, 24 nt, Human
uuagaaaaaguguuuuuccucauc

SEQ ID NO: 9334 - RNA, 24 nt, Human
uuagaacaccagauacaaagcuaa

SEQ ID NO: 9335 - RNA, 22 nt, Human
uuagaacauaacuugcugaagu

SEQ ID NO: 9336 - RNA, 24 nt, Human
uuagaauuaucuuucaaacacuua

SEQ ID NO: 9337 - RNA, 24 nt, Human
uuagaauuggaauuacuuccuuac

SEQ ID NO: 9338 - RNA, 22 nt, Human
uuagacacagcacaguccuuuu

SEQ ID NO: 9339 - RNA, 24 nt, Human
uuagaccagccacagugccugauu

SEQ ID NO: 9340 - RNA, 24 nt, Human
uuagaccucaagguugacuuguga

SEQ ID NO: 9341 - RNA, 24 nt, Human
uuagagacaagaguaccaaagcgg

SEQ ID NO: 9342 - RNA, 24 nt, Human
uuagagcuauuauaaauagugcug

SEQ ID NO: 9343 - RNA, 24 nt, Human
uuagaguguauuucugaaacuagc

SEQ ID NO: 9344 - RNA, 22 nt, Human
uuagaugcuuuguguuguauac

SEQ ID NO: 9345 - RNA, 24 nt, Human
uuagcaaaaaucugucuuaacuuu

SEQ ID NO: 9346 - RNA, 24 nt, Human
uuagcucgguaacuggugaccccu

SEQ ID NO: 9347 - RNA, 22 nt, Human
uuagcugaaaguuugagagcug

SEQ ID NO: 9348 - RNA, 24 nt, Human
uuagcuuucucgggaggaccgagc

SEQ ID NO: 9349 - RNA, 24 nt, Human
uuagggaaaaugcacugaguuuga

SEQ ID NO: 9350 - RNA, 24 nt, Human
uuaggucaaagaggcugcuuggag

SEQ ID NO: 9351 - RNA, 24 nt, Human
uuaguauacagacgacagugaacu

SEQ ID NO: 9352 - RNA, 24 nt, Human
uuagucacaaacaguuccccaguu

SEQ ID NO: 9353 - RNA, 24 nt, Human
uuagucccaguuccauuuucauga

SEQ ID NO: 9354 - RNA, 24 nt, Human
uuagugaagaagaggaggaugaug

SEQ ID NO: 9355 - RNA, 24 nt, Human
uuagugaggucuauguccagagaa

SEQ ID NO: 9356 - RNA, 24 nt, Human
uuagugaggugaacgacuucagau

SEQ ID NO: 9357 - RNA, 24 nt, Human
uuagugauuauuaagcacuucugu

SEQ ID NO: 9358 - RNA, 22 nt, Human
uuagugcaucccagccaagugu

SEQ ID NO: 9359 - RNA, 24 nt, Human
uuagugcaugguauuauaaaacaa

SEQ ID NO: 9360 - RNA, 22 nt, Human
uuaguguucaggcucaaaugaa

SEQ ID NO: 9361 - RNA, 24 nt, Human
uuaguuuugcaaacggcaugauuc

SEQ ID NO: 9362 - RNA, 24 nt, Human
uuauaaguggcucuuuguuuugaa

SEQ ID NO: 9363 - RNA, 22 nt, Human
uuauaggggguaacauauuaua

SEQ ID NO: 9364 - RNA, 24 nt, Human
uuauauucuuugaauccuagccca

SEQ ID NO: 9365 - RNA, 24 nt, Human
uuauauuguguuuuuugcguuggu

SEQ ID NO: 9366 - RNA, 24 nt, Human
uuaucaaguaagauucuauuuuca

SEQ ID NO: 9367 - RNA, 24 nt, Human
uuaucacguaagauucuauuuuca

SEQ ID NO: 9368 - RNA, 22 nt, Human
uuaugggcgaugcaaaccugau

SEQ ID NO: 9369 - RNA, 24 nt, Human
uuauuagaucucaaacucagcugc

SEQ ID NO: 9370 - RNA, 22 nt, Human
uuauucaaaccuccuuagagcu

SEQ ID NO: 9371 - RNA, 24 nt, Human
uuauucccacugccagauagaaaa

SEQ ID NO: 9372 - RNA, 22 nt, Human
uuauuggucaggguagauagag

SEQ ID NO: 9373 - RNA, 24 nt, Human
uucaaacauauucugaacauugau

SEQ ID NO: 9374 - RNA, 24 nt, Human
uucaaaccuuugcccccaguuggg

SEQ ID NO: 9375 - RNA, 24 nt, Human
uucaaagccuccacgacucuguuu

SEQ ID NO: 9376 - RNA, 24 nt, Human
uucaaaguuauuuuuuagucgcug

SEQ ID NO: 9377 - RNA, 22 nt, Human
uucaaauaacucaagauaagug

SEQ ID NO: 9378 - RNA, 24 nt, Human
uucaaaugaaucuucaaauuggaa

SEQ ID NO: 9379 - RNA, 24 nt, Human
uucaacacgauaauaccuguugcc

SEQ ID NO: 9380 - RNA, 21 nt, Human
uucaacagguauuuauugagc

SEQ ID NO: 9381 - RNA, 24 nt, Human
uucaacuccucguccuucaacucc

SEQ ID NO: 9382 - RNA, 24 nt, Human
uucaacuuugauguucaugacgau

SEQ ID NO: 9383 - RNA, 22 nt, Human
uucaagaaagccaagauggcug

SEQ ID NO: 9384 - RNA, 24 nt, Human
uucaagagccugggcuguguccau

SEQ ID NO: 9385 - RNA, 24 nt, Human
uucaagcaugcaaaacaguuuauu

SEQ ID NO: 9386 - RNA, 22 nt, Human
uucaaggauauguauggagcag

SEQ ID NO: 9387 - RNA, 21 nt, Human
uucaagggauggaaagucacc

SEQ ID NO: 9388 - RNA, 22 nt, Human
uucaagggauggaagucaccgu

SEQ ID NO: 9389 - RNA, 24 nt, Human
uucaagguacaaaaaccacgacuc

SEQ ID NO: 9390 - RNA, 19 nt, Human
uucaaugguacugcaguua

SEQ ID NO: 9391 - RNA, 24 nt, Human
uucacaccugaaauguuacugauu

SEQ ID NO: 9392 - RNA, 24 nt, Human
uucacaccuuugugcaguccggau

SEQ ID NO: 9393 - RNA, 24 nt, Human
uucacaggcauuuacucauggcug

SEQ ID NO: 9394 - RNA, 21 nt, Human
uucacagucugggacguggga

SEQ ID NO: 9395 - RNA, 22 nt, Human
uucacaguggcuaaguucugca

SEQ ID NO: 9396 - RNA, 23 nt, Human
uucacauuugaguguccuggaca

SEQ ID NO: 9397 - RNA, 22 nt, Human
uucacccaugaaaggguuugcu

SEQ ID NO: 9398 - RNA, 22 nt, Human
uucacccccgacuuccaggagu

SEQ ID NO: 9399 - RNA, 22 nt, Human
uucaccuucucucgaauaguag

SEQ ID NO: 9400 - RNA, 24 nt, Human
uucacgcaaucaaaaugacuaagc

SEQ ID NO: 9401 - RNA, 22 nt, Human
uucacggauggcaagucaccgu

SEQ ID NO: 9402 - RNA, 24 nt, Human
uucacgugcuccguuggaucaggu

SEQ ID NO: 9403 - RNA, 24 nt, Human
uucacuaucauuguaucugacaca

SEQ ID NO: 9404 - RNA, 24 nt, Human
uucacugucccuguuuagccaagg

SEQ ID NO: 9405 - RNA, 21 nt, Human
uucacugugaguuacugaugc

SEQ ID NO: 9406 - RNA, 24 nt, Human
uucagaagagguuggcuuuccaga

SEQ ID NO: 9407 - RNA, 24 nt, Human
uucagaaggaucuugucgcugcau

SEQ ID NO: 9408 - RNA, 24 nt, Human
uucagaaggcugauuauuaagcua

SEQ ID NO: 9409 - RNA, 24 nt, Human
uucagaaugcguuugcugucaucc

SEQ ID NO: 9410 - RNA, 24 nt, Human
uucagacuuagaauaauguugauu

SEQ ID NO: 9411 - RNA, 24 nt, Human
uucagaguagauguaagcacuaca

SEQ ID NO: 9412 - RNA, 24 nt, Human
uucagagucuuauugggguggggc

SEQ ID NO: 9413 - RNA, 24 nt, Human
uucagaucacucagcucuucgggg

SEQ ID NO: 9414 - RNA, 22 nt, Human
uucagcaaguuuuccugacauu

SEQ ID NO: 9415 - RNA, 22 nt, Human
uucagcgggagcugguccaucu

SEQ ID NO: 9416 - RNA, 24 nt, Human
uucagcugcaucugcgccaccugc

SEQ ID NO: 9417 - RNA, 24 nt, Human
uucaggcaaaggcaaguuuugcuu

SEQ ID NO: 9418 - RNA, 22 nt, Human
uucaggcaccaggcacuuugcc

SEQ ID NO: 9419 - RNA, 22 nt, Human
uucagucuuuuucucucuaugc

SEQ ID NO: 9420 - RNA, 22 nt, Human
uucaguugagcucaguaacauc

SEQ ID NO: 9421 - RNA, 24 nt, Human
uucauaaucuggucaugugggaau

SEQ ID NO: 9422 - RNA, 23 nt, Human
uucaucaguuuccucauccaucc

SEQ ID NO: 9423 - RNA, 24 nt, Human
uucaucaugcaaacaucauagagu

SEQ ID NO: 9424 - RNA, 24 nt, Human
uucaucuaggggcagcgcacgguc

SEQ ID NO: 9425 - RNA, 24 nt, Human
uucaugacaccacucuuuuuucuc

SEQ ID NO: 9426 - RNA, 24 nt, Human
uucauggucagcugcgugguguag

SEQ ID NO: 9427 - RNA, 24 nt, Human
uucauugucacuaacaucuggugu

SEQ ID NO: 9428 - RNA, 24 nt, Human
uuccaaaguuuauacgggaagaca

SEQ ID NO: 9429 - RNA, 23 nt, Human
uuccaaauucugggcugguuuuc

SEQ ID NO: 9430 - RNA, 22 nt, Human
uuccaagccuuccccgggauca

SEQ ID NO: 9431 - RNA, 24 nt, Human
uuccaccucucauccagcuucacg

SEQ ID NO: 9432 - RNA, 24 nt, Human
uuccagaaaccacugggugguccu

SEQ ID NO: 9433 - RNA, 22 nt, Human
uuccagacuaauccugaguccu

SEQ ID NO: 9434 - RNA, 23 nt, Human
uuccagaggaggagcagggaucu

SEQ ID NO: 9435 - RNA, 24 nt, Human
uuccagcgucucgggcuccuugca

SEQ ID NO: 9436 - RNA, 24 nt, Human
uuccagggcugaguguggguggau

SEQ ID NO: 9437 - RNA, 24 nt, Human
uuccagucucuucccccuuucuau

SEQ ID NO: 9438 - RNA, 24 nt, Human
uuccaguucaaagucgugucuuuc

SEQ ID NO: 9439 - RNA, 23 nt, Human
uuccaguugucacgggcgacagc

SEQ ID NO: 9440 - RNA, 24 nt, Human
uuccaugcagccuugcggaacucu

SEQ ID NO: 9441 - RNA, 24 nt, Human
uuccauugacauucuuagcacagc

SEQ ID NO: 9442 - RNA, 24 nt, Human
uuccauuggaagaaggugccgucu

SEQ ID NO: 9443 - RNA, 24 nt, Human
uucccagccagcccgggcccuggg

SEQ ID NO: 9444 - RNA, 24 nt, Human
uucccauccagaaaucucaggcga

SEQ ID NO: 9445 - RNA, 24 nt, Human
uucccaugcaccucuggguaggua

SEQ ID NO: 9446 - RNA, 24 nt, Human
uucccaugccaccaggcuccugca

SEQ ID NO: 9447 - RNA, 24 nt, Human
uucccaugccucccucucauugga

SEQ ID NO: 9448 - RNA, 22 nt, Human
uucccauguucuggcauuaaag

SEQ ID NO: 9449 - RNA, 22 nt, Human
uucccgauacaccuuacuuacu

SEQ ID NO: 9450 - RNA, 24 nt, Human
uucccguggagcagaauuauaaaa

SEQ ID NO: 9451 - RNA, 24 nt, Human
uucccgugugagaagggccagagg

SEQ ID NO: 9452 - RNA, 24 nt, Human
uucccuggauucgagcagccgcgu

SEQ ID NO: 9453 - RNA, 24 nt, Human
uucccuuuugggggccccuuuauu

SEQ ID NO: 9454 - RNA, 22 nt, Human
uuccggaucaccaugugggguu

SEQ ID NO: 9455 - RNA, 22 nt, Human
uuccucaggggugagguuuggg

SEQ ID NO: 9456 - RNA, 24 nt, Human
uuccucaucugggacacugcuggu

SEQ ID NO: 9457 - RNA, 24 nt, Human
uuccucuuauuugcaugaaaggac

SEQ ID NO: 9458 - RNA, 23 nt, Human
uuccugaccccugagaaagcagg

SEQ ID NO: 9459 - RNA, 20 nt, Human
uuccuggaaggguagauucu

SEQ ID NO: 9460 - RNA, 24 nt, Human
uuccuggccaguguggagucucua

SEQ ID NO: 9461 - RNA, 24 nt, Human
uuccugggcagccuuuccagccuc

SEQ ID NO: 9462 - RNA, 24 nt, Human
uuccuggggacucccuuuuaguac

SEQ ID NO: 9463 - RNA, 24 nt, Human
uuccuggucggguccagugugaaa

SEQ ID NO: 9464 - RNA, 22 nt, Human
uuccugguggaggcauucggag

SEQ ID NO: 9465 - RNA, 24 nt, Human
uuccuguauagacacuaaauuguu

SEQ ID NO: 9466 - RNA, 22 nt, Human
uuccugucucugucucucgggu

SEQ ID NO: 9467 - RNA, 22 nt, Human
uuccuguuauuuaauagucugc

SEQ ID NO: 9468 - RNA, 24 nt, Human
uuccuguucacucuugacucugug

SEQ ID NO: 9469 - RNA, 24 nt, Human
uuccuuacuccacugcaccuaauc

SEQ ID NO: 9470 - RNA, 24 nt, Human
uuccuucaguuaucggucaacaaa

SEQ ID NO: 9471 - RNA, 22 nt, Human
uuccuucaguucagggaacccu

SEQ ID NO: 9472 - RNA, 24 nt, Human
uuccuucguuaagucacaggaaac

SEQ ID NO: 9473 - RNA, 21 nt, Human
uuccuugggggaggagauggu

SEQ ID NO: 9474 - RNA, 24 nt, Human
uuccuuuggacaugggcaaggguc

SEQ ID NO: 9475 - RNA, 24 nt, Human
uuccuuuuuucucacauuugagag

SEQ ID NO: 9476 - RNA, 24 nt, Human
uucgaaguuaggacagcauggggg

SEQ ID NO: 9477 - RNA, 22 nt, Human
uucgaauagcagcucuuaaaga

SEQ ID NO: 9478 - RNA, 24 nt, Human
uucgagcacuggccuacuggcacu

SEQ ID NO: 9479 - RNA, 24 nt, Human
uucgcaacuaaaaaugguaucaaa

SEQ ID NO: 9480 - RNA, 24 nt, Human
uucgcgcguuacggcgccgccucc

SEQ ID NO: 9481 - RNA, 22 nt, Human
uucgggauucucuccaacugca

SEQ ID NO: 9482 - RNA, 24 nt, Human
uucggucagaguggugcugggaac

SEQ ID NO: 9483 - RNA, 24 nt, Human
uucgugcagucugaaauuuucccc

SEQ ID NO: 9484 - RNA, 24 nt, Human
uucgugguguuggcgggccugagg

SEQ ID NO: 9485 - RNA, 22 nt, Human
uucuacuagugguugauggccu

SEQ ID NO: 9486 - RNA, 22 nt, Human
uucucacugaauccuggaggcu

SEQ ID NO: 9487 - RNA, 24 nt, Human
uucucagugaugcgggccucgcgc

SEQ ID NO: 9488 - RNA, 22 nt, Human
uucuccaccaucauccaggggc

SEQ ID NO: 9489 - RNA, 22 nt, Human
uucucugcaucugccucaguac

SEQ ID NO: 9490 - RNA, 24 nt, Human
uucucuggguucugaaguucuggg

SEQ ID NO: 9491 - RNA, 24 nt, Human
uucugcugcacgugaagcggggcg

SEQ ID NO: 9492 - RNA, 20 nt, Human
uucuggguggcagugauggc

SEQ ID NO: 9493 - RNA, 22 nt, Human
uucuggugaggucucuauucau

SEQ ID NO: 9494 - RNA, 24 nt, Human
uucuguguccaauggccuuagcag

SEQ ID NO: 9495 - RNA, 24 nt, Human
uucuugaucacuguggcuggggac

SEQ ID NO: 9496 - RNA, 22 nt, Human
uucuuuacauauaggagauggg

SEQ ID NO: 9497 - RNA, 22 nt, Human
uucuuugcagaaauagaaaggc

SEQ ID NO: 9498 - RNA, 22 nt, Human
uucuuuggaaaacgcacgcacu

SEQ ID NO: 9499 - RNA, 22 nt, Human
uugaaaguucacucugucuuca

SEQ ID NO: 9500 - RNA, 24 nt, Human
uugaacagccgccuggaggagcag

SEQ ID NO: 9501 - RNA, 24 nt, Human
uugaacaguuugaauuggcugugg

SEQ ID NO: 9502 - RNA, 21 nt, Human
uugaacucaucaagauguucg

SEQ ID NO: 9503 - RNA, 24 nt, Human
uugaagaaaauaauauguuuuaag

SEQ ID NO: 9504 - RNA, 24 nt, Human
uugaagaagaaggcggcuccuccg

SEQ ID NO: 9505 - RNA, 24 nt, Human
uugaagaccuuaagaaguuucuaa

SEQ ID NO: 9506 - RNA, 24 nt, Human
uugaagauccugcgguaugggaug

SEQ ID NO: 9507 - RNA, 24 nt, Human
uugaagaugaugaugaugauuaug

SEQ ID NO: 9508 - RNA, 24 nt, Human
uugaagccaguaauuagagacauc

SEQ ID NO: 9509 - RNA, 24 nt, Human
uugaagccuaagcuuugaaugaag

SEQ ID NO: 9510 - RNA, 18 nt, Human
uugaaggagcgccaaaag

SEQ ID NO: 9511 - RNA, 22 nt, Human
uugaaguuacccaaccaaaugg

SEQ ID NO: 9512 - RNA, 24 nt, Human
uugaaguucacaagacgggaggcc

SEQ ID NO: 9513 - RNA, 24 nt, Human
uugaaucuuucuggaagaaauggu

SEQ ID NO: 9514 - RNA, 24 nt, Human
uugaaugauugccggaaagugcaa

SEQ ID NO: 9515 - RNA, 24 nt, Human
uugaaugcacaaaagcaacagguc

SEQ ID NO: 9516 - RNA, 24 nt, Human
uugaaugguagagaagaaacagca

SEQ ID NO: 9517 - RNA, 24 nt, Human
uugaaugguugcugcacuuugguc

SEQ ID NO: 9518 - RNA, 24 nt, Human
uugaauguaagugcaguagaaauu

SEQ ID NO: 9519 - RNA, 24 nt, Human
uugaauguuugauacaaaggaugg

SEQ ID NO: 9520 - RNA, 22 nt, Human
uugaauuuuuuacucucucuac

SEQ ID NO: 9521 - RNA, 24 nt, Human
uugacacaguggaucucugugcca

SEQ ID NO: 9522 - RNA, 22 nt, Human
uugagcaaaauaucugguuuca

SEQ ID NO: 9523 - RNA, 22 nt, Human
uugagcaaguuaccagaucucu

SEQ ID NO: 9524 - RNA, 22 nt, Human
uugagcacaguuugaggagugu

SEQ ID NO: 9525 - RNA, 24 nt, Human
uugagcagacagccacauugggca

SEQ ID NO: 9526 - RNA, 24 nt, Human
uugagcccagaaaguugaggcuac

SEQ ID NO: 9527 - RNA, 24 nt, Human
uugaggcuacugugaggaacugcu

SEQ ID NO: 9528 - RNA, 24 nt, Human
uugaucucacuuauauucugagug

SEQ ID NO: 9529 - RNA, 22 nt, Human
uugaugaacggcaggugaggga

SEQ ID NO: 9530 - RNA, 21 nt, Human
uugaugcgcccacuugggcuc

SEQ ID NO: 9531 - RNA, 24 nt, Human
uugauggugguccgcacauaggag

SEQ ID NO: 9532 - RNA, 22 nt, Human
uugauuggguccucuugguugc

SEQ ID NO: 9533 - RNA, 24 nt, Human
uugauuucuuuucagcuuucuuug

SEQ ID NO: 9534 - RNA, 24 nt, Human
uugcaaaggccuuuucgccgcgaa

SEQ ID NO: 9535 - RNA, 22 nt, Human
uugcacuccagccuggguaaca

SEQ ID NO: 9536 - RNA, 24 nt, Human
uugcacugacuaguacugaauaau

SEQ ID NO: 9537 - RNA, 24 nt, Human
uugcagacuugccauggccuccga

SEQ ID NO: 9538 - RNA, 22 nt, Human
uugcagccucugccucccaggu

SEQ ID NO: 9539 - RNA, 24 nt, Human
uugcaggaggccggcaggugauga

SEQ ID NO: 9540 - RNA, 22 nt, Human
uugcaggucugagaaaccucua

SEQ ID NO: 9541 - RNA, 24 nt, Human
uugcaguugaagucgucguagcca

SEQ ID NO: 9542 - RNA, 24 nt, Human
uugcauacaugccuggcaucuguc

SEQ ID NO: 9543 - RNA, 22 nt, Human
uugcaucagagaucauguaagg

SEQ ID NO: 9544 - RNA, 24 nt, Human
uugcaucuguuuuggguaucagca

SEQ ID NO: 9545 - RNA, 24 nt, Human
uugccaaggagacucugccaccgu

SEQ ID NO: 9546 - RNA, 24 nt, Human
uugccacuuuggccucagugugga

SEQ ID NO: 9547 - RNA, 24 nt, Human
uugccagucugcucauccauguau

SEQ ID NO: 9548 - RNA, 22 nt, Human
uugcccaggcuagagugcagug

SEQ ID NO: 9549 - RNA, 22 nt, Human
uugcccaggcuggagugcagua

SEQ ID NO: 9550 - RNA, 22 nt, Human
uugccuaggcuggagugcagug

SEQ ID NO: 9551 - RNA, 24 nt, Human
uugcucagcuucuggcucaaucug

SEQ ID NO: 9552 - RNA, 24 nt, Human
uugcucugagggguccugucuucc

SEQ ID NO: 9553 - RNA, 24 nt, Human
uugcucugcuucuucauguaucuu

SEQ ID NO: 9554 - RNA, 24 nt, Human
uugcugccacuuccaggugcuggc

SEQ ID NO: 9555 - RNA, 24 nt, Human
uugcugcucaaacgaacccccaau

SEQ ID NO: 9556 - RNA, 24 nt, Human
uugcuggagcuggccuggugucuc

SEQ ID NO: 9557 - RNA, 24 nt, Human
uugcuggcaaucaaacccgacacc

SEQ ID NO: 9558 - RNA, 24 nt, Human
uugcuggucuuugaucagcugcuc

SEQ ID NO: 9559 - RNA, 24 nt, Human
uugcuucccucugugauuuggacu

SEQ ID NO: 9560 - RNA, 19 nt, Human
uugcuuggcccugacugau

SEQ ID NO: 9561 - RNA, 24 nt, Human
uugcuuugucuacccgcuggacuu

SEQ ID NO: 9562 - RNA, 24 nt, Human
uugcuuuucauaagagggagaguu

SEQ ID NO: 9563 - RNA, 20 nt, Human
uugcuuuuucuguauucugu

SEQ ID NO: 9564 - RNA, 24 nt, Human
uuggaaagagaccagaaccgaagc

SEQ ID NO: 9565 - RNA, 24 nt, Human
uuggaaccccccgggcccaggccc

SEQ ID NO: 9566 - RNA, 24 nt, Human
uuggaacuaccaagcauguggcuc

SEQ ID NO: 9567 - RNA, 22 nt, Human
uuggaagagagauggggagaga

SEQ ID NO: 9568 - RNA, 23 nt, Human
uuggaagagcagcccaggugguc

SEQ ID NO: 9569 - RNA, 24 nt, Human
uuggaagccacagaaaugcagaau

SEQ ID NO: 9570 - RNA, 22 nt, Human
uuggaccaacuccgaaaguugu

SEQ ID NO: 9571 - RNA, 24 nt, Human
uuggaccacgaccagcuauccgga

SEQ ID NO: 9572 - RNA, 24 nt, Human
uuggacccagagaaccgggccggg

SEQ ID NO: 9573 - RNA, 22 nt, Human
uuggaccuggcggcaucagcug

SEQ ID NO: 9574 - RNA, 24 nt, Human
uuggacucuuuuggaccuauaaac

SEQ ID NO: 9575 - RNA, 24 nt, Human
uuggagacuugggcaaugugacug

SEQ ID NO: 9576 - RNA, 24 nt, Human
uuggagcaaaguucacgaaggcca

SEQ ID NO: 9577 - RNA, 24 nt, Human
uuggagccacugauuauaccucua

SEQ ID NO: 9578 - RNA, 24 nt, Human
uuggaggaccagaugggugggagc

SEQ ID NO: 9579 - RNA, 22 nt, Human
uuggaguaauucaguauagguu

SEQ ID NO: 9580 - RNA, 24 nt, Human
uuggauaugguuggaguggcacag

SEQ ID NO: 9581 - RNA, 21 nt, Human
uuggauauugggagacuuggc

SEQ ID NO: 9582 - RNA, 24 nt, Human
uuggaucuucaugcccuggguucu

SEQ ID NO: 9583 - RNA, 24 nt, Human
uuggauggaggccuggcaggaggg

SEQ ID NO: 9584 - RNA, 24 nt, Human
uuggauuuaagaaggauugguugc

SEQ ID NO: 9585 - RNA, 24 nt, Human
uuggcaaacguuucccgaagagga

SEQ ID NO: 9586 - RNA, 24 nt, Human
uuggcacacucuauccgaaauuug

SEQ ID NO: 9587 - RNA, 24 nt, Human
uuggcacauccuugcauuguucua

SEQ ID NO: 9588 - RNA, 24 nt, Human
uuggcaucuucuaccaggccugaa

SEQ ID NO: 9589 - RNA, 22 nt, Human
uuggccaucaauccgugucagu

SEQ ID NO: 9590 - RNA, 24 nt, Human
uuggcggggccuuggacuaccacu

SEQ ID NO: 9591 - RNA, 24 nt, Human
uuggcuccggggcauccuggauuu

SEQ ID NO: 9592 - RNA, 22 nt, Human
uugggagaggcagcagagucau

SEQ ID NO: 9593 - RNA, 22 nt, Human
uugggcaaugguggugaauaaa

SEQ ID NO: 9594 - RNA, 24 nt, Human
uuggggcuucaacaugggaauuua

SEQ ID NO: 9595 - RNA, 24 nt, Human
uugguacuugagucaaagacgaca

SEQ ID NO: 9596 - RNA, 22 nt, Human
uuggucaucaacuauuuucccu

SEQ ID NO: 9597 - RNA, 24 nt, Human
uuggucccuauccaauucuuccca

SEQ ID NO: 9598 - RNA, 24 nt, Human
uugguccugacuacuaccauuucg

SEQ ID NO: 9599 - RNA, 24 nt, Human
uuggucgauagcaaauauguagug

SEQ ID NO: 9600 - RNA, 24 nt, Human
uuggugaucuauccgaaaauugga

SEQ ID NO: 9601 - RNA, 22 nt, Human
uuggugcaaauggcauuuccau

SEQ ID NO: 9602 - RNA, 24 nt, Human
uuggugccaacuggagucuuggug

SEQ ID NO: 9603 - RNA, 24 nt, Human
uuggugcuuuguggcucaccacag

SEQ ID NO: 9604 - RNA, 24 nt, Human
uuggugggacucggcugccccucc

SEQ ID NO: 9605 - RNA, 24 nt, Human
uugguggugaagugaguagcugca

SEQ ID NO: 9606 - RNA, 23 nt, Human
uugguguugcccgaguuagucca

SEQ ID NO: 9607 - RNA, 24 nt, Human
uugguucaagggauggaaagucaa

SEQ ID NO: 9608 - RNA, 24 nt, Human
uugguucaagggauggcaaaguca

SEQ ID NO: 9609 - RNA, 24 nt, Human
uugguuccaagacgcguaggcgag

SEQ ID NO: 9610 - RNA, 23 nt, Human
uugguucccuuuaaaaguucugg

SEQ ID NO: 9611 - RNA, 24 nt, Human
uugguucuuucgucugcuacagug

SEQ ID NO: 9612 - RNA, 24 nt, Human
uugguugaauacauaguuaagaug

SEQ ID NO: 9613 - RNA, 22 nt, Human
uugguugcugaugagcuuugag

SEQ ID NO: 9614 - RNA, 24 nt, Human
uuguauccuuggccagaaacuggg

SEQ ID NO: 9615 - RNA, 24 nt, Human
uuguaugcagaaauagauaugaaa

SEQ ID NO: 9616 - RNA, 24 nt, Human
uuguauguguguugagcuggcccu

SEQ ID NO: 9617 - RNA, 24 nt, Human
uuguauuuccuagacuuuuauaua

SEQ ID NO: 9618 - RNA, 24 nt, Human
uuguccugugcuggggcugacagg

SEQ ID NO: 9619 - RNA, 22 nt, Human
uugugaaagagcccuuggcugg

SEQ ID NO: 9620 - RNA, 24 nt, Human
uugugggccugggcuuggcucugg

SEQ ID NO: 9621 - RNA, 22 nt, Human
uugugguuagcaguuuuugcca

SEQ ID NO: 9622 - RNA, 24 nt, Human
uugugugccauuuugcagcauuuu

SEQ ID NO: 9623 - RNA, 24 nt, Human
uugugugcugcuuuagauuuggcc

SEQ ID NO: 9624 - RNA, 22 nt, Human
uugugugcuggcguuucuugga

SEQ ID NO: 9625 - RNA, 22 nt, Human
uuguuaggugagagcauguuug

SEQ ID NO: 9626 - RNA, 22 nt, Human
uuguuccuaguuguccaucaca

SEQ ID NO: 9627 - RNA, 22 nt, Human
uuguucgucugagagguuucag

SEQ ID NO: 9628 - RNA, 22 nt, Human
uuguuucuguuucauggaaucu

SEQ ID NO: 9629 - RNA, 22 nt, Human
uuguuugacgauuuggagaaga

SEQ ID NO: 9630 - RNA, 22 nt, Human
uuguuuuagaagaaggucagaa

SEQ ID NO: 9631 - RNA, 24 nt, Human
uuuaaaauaaauucuuaaucagag

SEQ ID NO: 9632 - RNA, 24 nt, Human
uuuaaacugaggaaacggcaaaug

SEQ ID NO: 9633 - RNA, 24 nt, Human
uuuaaagcacuuuucuguaaaagc

SEQ ID NO: 9634 - RNA, 24 nt, Human
uuuaaaggacugacuugcuaucac

SEQ ID NO: 9635 - RNA, 22 nt, Human
uuuaaagucagcaacuuuucac

SEQ ID NO: 9636 - RNA, 22 nt, Human
uuuaaaguggcuacguucuagu

SEQ ID NO: 9637 - RNA, 21 nt, Human
uuuaaauguaaagaaguaugu

SEQ ID NO: 9638 - RNA, 23 nt, Human
uuuaacguuuucaugguaaugca

SEQ ID NO: 9639 - RNA, 24 nt, Human
uuuaagaaaugucuuugaccccau

SEQ ID NO: 9640 - RNA, 22 nt, Human
uuuaagcuauaguuccaggccc

SEQ ID NO: 9641 - RNA, 22 nt, Human
uuuacacgauaaaaauccuuuu

SEQ ID NO: 9642 - RNA, 22 nt, Human
uuuacagauggcaaagaucugg

SEQ ID NO: 9643 - RNA, 24 nt, Human
uuuacaguauauacagucaggccu

SEQ ID NO: 9644 - RNA, 24 nt, Human
uuuaccauaauguuccuuaguggu

SEQ ID NO: 9645 - RNA, 22 nt, Human
uuuacccugaggaaucuauuuu

SEQ ID NO: 9646 - RNA, 24 nt, Human
uuuacuacuucuaucuuuuugacu

SEQ ID NO: 9647 - RNA, 22 nt, Human
uuuaggcauaaccaguaucauu

SEQ ID NO: 9648 - RNA, 24 nt, Human
uuuauaggcaucuguauuaauugu

SEQ ID NO: 9649 - RNA, 24 nt, Human
uuuauaguaucaagugaggcuguu

SEQ ID NO: 9650 - RNA, 24 nt, Human
uuuaugcccccggaaccaagaccc

SEQ ID NO: 9651 - RNA, 21 nt, Human
uuucaacagguauuuauugag

SEQ ID NO: 9652 - RNA, 24 nt, Human
uuucaaggucgcugggcccgaggu

SEQ ID NO: 9653 - RNA, 24 nt, Human
uuucaaguauugccugggucuugg

SEQ ID NO: 9654 - RNA, 24 nt, Human
uuucacagaugaggaaacugaagc

SEQ ID NO: 9655 - RNA, 24 nt, Human
uuucacagcuaacauucauuuaau

SEQ ID NO: 9656 - RNA, 24 nt, Human
uuucacaguggauaugaccuugga

SEQ ID NO: 9657 - RNA, 24 nt, Human
uuucaccauguuggccaggcuggu

SEQ ID NO: 9658 - RNA, 22 nt, Human
uuucaugcucagaagugcccug

SEQ ID NO: 9659 - RNA, 22 nt, Human
uuuccaaacaugaaggcacguc

SEQ ID NO: 9660 - RNA, 24 nt, Human
uuuccagaucuacgcugugccuug

SEQ ID NO: 9661 - RNA, 24 nt, Human
uuuccagguacucaggaacuaggc

SEQ ID NO: 9662 - RNA, 24 nt, Human
uuuccagugaaauaaaacauguug

SEQ ID NO: 9663 - RNA, 24 nt, Human
uuuccaguggccacaaguuauugc

SEQ ID NO: 9664 - RNA, 24 nt, Human
uuuccauguaaaaucucuguugug

SEQ ID NO: 9665 - RNA, 24 nt, Human
uuucccaguaauaaaauuagguuu

SEQ ID NO: 9666 - RNA, 24 nt, Human
uuucccggaagcugcccggggggu

SEQ ID NO: 9667 - RNA, 24 nt, Human
uuuccugaaguuccuuugauugua

SEQ ID NO: 9668 - RNA, 24 nt, Human
uuucuagcuaugaucuuagcuucc

SEQ ID NO: 9669 - RNA, 24 nt, Human
uuucucaggauuacugugguuucu

SEQ ID NO: 9670 - RNA, 22 nt, Human
uuucucagggccuggaguccug

SEQ ID NO: 9671 - RNA, 24 nt, Human
uuucucaguacaaagaauccguga

SEQ ID NO: 9672 - RNA, 24 nt, Human
uuucugaucgauauuuuuguguaa

SEQ ID NO: 9673 - RNA, 22 nt, Human
uuucugcuuuguuggucagggu

SEQ ID NO: 9674 - RNA, 22 nt, Human
uuucugggagaugucucaggcu

SEQ ID NO: 9675 - RNA, 24 nt, Human
uuucugggugugucuguggggaug

SEQ ID NO: 9676 - RNA, 24 nt, Human
uuucugguucuagauccuugggga

SEQ ID NO: 9677 - RNA, 22 nt, Human
uuucuguugugaccugacucuu

SEQ ID NO: 9678 - RNA, 22 nt, Human
uuucuucccuggcuuccugcac

SEQ ID NO: 9679 - RNA, 23 nt, Human
uuucuugggguggguagagcaau

SEQ ID NO: 9680 - RNA, 24 nt, Human
uuucuugucgucugugcuugauuc

SEQ ID NO: 9681 - RNA, 24 nt, Human
uuugaaagaguccgauacacagug

SEQ ID NO: 9682 - RNA, 21 nt, Human
uuugaaaggcaugugcagacc

SEQ ID NO: 9683 - RNA, 24 nt, Human
uuugaaauuaaacagauggguaac

SEQ ID NO: 9684 - RNA, 24 nt, Human
uuugaaauuguguaauguuuauau

SEQ ID NO: 9685 - RNA, 23 nt, Human
uuugaaguaguggguuacaugcu

SEQ ID NO: 9686 - RNA, 24 nt, Human
uuugaaguauguuuagucagcaug

SEQ ID NO: 9687 - RNA, 22 nt, Human
uuugaaguggguccucgaaaug

SEQ ID NO: 9688 - RNA, 19 nt, Human
uuugacaaggaccaugaug

SEQ ID NO: 9689 - RNA, 24 nt, Human
uuugacaucuacccaucccuaaca

SEQ ID NO: 9690 - RNA, 22 nt, Human
uuugaccacuuccaccuaugaa

SEQ ID NO: 9691 - RNA, 24 nt, Human
uuugacccaggguugucuccccuc

SEQ ID NO: 9692 - RNA, 24 nt, Human
uuugaccugaccaugaugcccagg

SEQ ID NO: 9693 - RNA, 24 nt, Human
uuugagucucgacagaacgcuguu

SEQ ID NO: 9694 - RNA, 24 nt, Human
uuugagugucuucucauuccuuaa

SEQ ID NO: 9695 - RNA, 22 nt, Human
uuugaugcaugugaccugggau

SEQ ID NO: 9696 - RNA, 20 nt, Human
uuugauguugugaaagguuu

SEQ ID NO: 9697 - RNA, 24 nt, Human
uuugcaaagaaugaagaagugaau

SEQ ID NO: 9698 - RNA, 24 nt, Human
uuugcacaagcuugucagugacau

SEQ ID NO: 9699 - RNA, 24 nt, Human
uuugcacaguagaugcagaacuag

SEQ ID NO: 9700 - RNA, 22 nt, Human
uuugcaccugagacagauagcc

SEQ ID NO: 9701 - RNA, 22 nt, Human
uuugcacuguaauaccucgguc

SEQ ID NO: 9702 - RNA, 24 nt, Human
uuugcagauggcugucuuccuguu

SEQ ID NO: 9703 - RNA, 24 nt, Human
uuugcauaaggcauagggacauca

SEQ ID NO: 9704 - RNA, 24 nt, Human
uuugccaaaaccacgcuuguagau

SEQ ID NO: 9705 - RNA, 24 nt, Human
uuugccaaacauuugucgugguua

SEQ ID NO: 9706 - RNA, 19 nt, Human
uuugccagcuguagccuug

SEQ ID NO: 9707 - RNA, 24 nt, Human
uuugccccgggccaccucacucuc

SEQ ID NO: 9708 - RNA, 23 nt, Human
uuugccccuggcaaaugcacaca

SEQ ID NO: 9709 - RNA, 24 nt, Human
uuugcccucaucagguuuucgcau

SEQ ID NO: 9710 - RNA, 24 nt, Human
uuugcgcaaaauguggaaagaaag

SEQ ID NO: 9711 - RNA, 24 nt, Human
uuugcguaggccacuggguuuucu

SEQ ID NO: 9712 - RNA, 24 nt, Human
uuugcuauuucuucuagcaaauuu

SEQ ID NO: 9713 - RNA, 24 nt, Human
uuugcugaagcuucuugguggccc

SEQ ID NO: 9714 - RNA, 24 nt, Human
uuugcugaaggaggucaucccuug

SEQ ID NO: 9715 - RNA, 24 nt, Human
uuugcugcgguuaaagcuggccaa

SEQ ID NO: 9716 - RNA, 21 nt, Human
uuugcugggaucuucucucca

SEQ ID NO: 9717 - RNA, 22 nt, Human
uuuggaucaccugcuaucuaau

SEQ ID NO: 9718 - RNA, 24 nt, Human
uuuggcaaggauggaguguccaga

SEQ ID NO: 9719 - RNA, 22 nt, Human
uuuggcaauguguaaacuucac

SEQ ID NO: 9720 - RNA, 22 nt, Human
uuuggggucuccccagcaugca

SEQ ID NO: 9721 - RNA, 24 nt, Human
uuuggucguggacguggucagcca

SEQ ID NO: 9722 - RNA, 24 nt, Human
uuugguggucuuuccuuugcaagc

SEQ ID NO: 9723 - RNA, 24 nt, Human
uuugguugcuacauucugguguug

SEQ ID NO: 9724 - RNA, 24 nt, Human
uuugguugguggcaccaggggaca

SEQ ID NO: 9725 - RNA, 22 nt, Human
uuuguacaaacuaaaugaggug

SEQ ID NO: 9726 - RNA, 20 nt, Human
uuuguaguucugaauacaca

SEQ ID NO: 9727 - RNA, 22 nt, Human
uuuguauauuugaucauuugug

SEQ ID NO: 9728 - RNA, 24 nt, Human
uuuguauugguacugcguucugug

SEQ ID NO: 9729 - RNA, 24 nt, Human
uuugucaguggaaacuaugucagu

SEQ ID NO: 9730 - RNA, 24 nt, Human
uuugucccaguccagccuuuauca

SEQ ID NO: 9731 - RNA, 22 nt, Human
uuugugaaugguugaacuacag

SEQ ID NO: 9732 - RNA, 23 nt, Human
uuugugcugaggcaggacacagc

SEQ ID NO: 9733 - RNA, 24 nt, Human
uuuguggaguuuuccauagccucu

SEQ ID NO: 9734 - RNA, 24 nt, Human
uuugugguaguuggggugcacauu

SEQ ID NO: 9735 - RNA, 24 nt, Human
uuuguuaggauagaucuuaagcag

SEQ ID NO: 9736 - RNA, 24 nt, Human
uuuguuggguuuucugaaacuuaa

SEQ ID NO: 9737 - RNA, 24 nt, Human
uuuguuugccuuauugauguuuuu

SEQ ID NO: 9738 - RNA, 24 nt, Human
uuuguuuugagguuaguuugauua

SEQ ID NO: 9739 - RNA, 24 nt, Human
uuuuaaggaguuucaugaaagacg

SEQ ID NO: 9740 - RNA, 24 nt, Human
uuuuaauaaguuuaauguucuuca

SEQ ID NO: 9741 - RNA, 24 nt, Human
uuuuacaauauuccauguauaucc

SEQ ID NO: 9742 - RNA, 24 nt, Human
uuuuacagagauagguaagcaggg

SEQ ID NO: 9743 - RNA, 24 nt, Human
uuuuacucagugguggaguagacu

SEQ ID NO: 9744 - RNA, 24 nt, Human
uuuuaugaauaugugaauugaaag

SEQ ID NO: 9745 - RNA, 22 nt, Human
uuuucaauggcugacacugucu

SEQ ID NO: 9746 - RNA, 24 nt, Human
uuuucagacagcaaacagaaugau

SEQ ID NO: 9747 - RNA, 24 nt, Human
uuuucagaccacccaacuacucug

SEQ ID NO: 9748 - RNA, 24 nt, Human
uuuucagcacagccuucauguucc

SEQ ID NO: 9749 - RNA, 24 nt, Human
uuuucagcccggguauaagcugaa

SEQ ID NO: 9750 - RNA, 24 nt, Human
uuuucauagccucacggaugagcc

SEQ ID NO: 9751 - RNA, 24 nt, Human
uuuucaugcauuugacaaggaugg

SEQ ID NO: 9752 - RNA, 24 nt, Human
uuuuccccuauaauaggaaacaag

SEQ ID NO: 9753 - RNA, 24 nt, Human
uuuugaaggcucucuuuucugcaa

SEQ ID NO: 9754 - RNA, 22 nt, Human
uuuugcacaguaauaaguugac

SEQ ID NO: 9755 - RNA, 24 nt, Human
uuuugcgaaauguuguauuuacug

SEQ ID NO: 9756 - RNA, 24 nt, Human
uuuuguacccugguaaaugaugcc

SEQ ID NO: 9757 - RNA, 24 nt, Human
uuuuucagacaauuuugcagaaag

SEQ ID NO: 9758 - RNA, 24 nt, Human
uuuuucuuaaccuuauugcaaggg

SEQ ID NO: 9759 - RNA, 24 nt, Human
uuuuucuuagugccucugugcauu

SEQ ID NO: 9760 - RNA, 24 nt, Human
uuuuuggaucuuggacaaagaaaa

SEQ ID NO: 9761 - RNA, 24 nt, Human
uuuuuggcauuauuccaacaugcu

SEQ ID NO: 9762 - RNA, 24 nt, Human
uuuuuuguauucuuuaagauuuua

SEQ ID NO: 9763 - RNA, 22 nt, Human
aauuuaacagacagccacagcc

SEQ ID NO: 9764 - RNA, 24 nt, Human
aauuuuguaacucagaucuugcug

SEQ ID NO: 9765 - RNA, 24 nt, Human
acaaagcacagaaaaaccagauuc

SEQ ID NO: 9766 - RNA, 24 nt, Human
acaaagccugccaggcugagcccu

SEQ ID NO: 9767 - RNA, 24 nt, Human
acaaagucaguucucgaucaaggu

SEQ ID NO: 9768 - RNA, 22 nt, Human
acaaaucuaagucccaagauua

SEQ ID NO: 9769 - RNA, 24 nt, Human
acaaccuucagaugagaacugcuu

SEQ ID NO: 9770 - RNA, 22 nt, Human
acaacuguguaggcuguucuuu

SEQ ID NO: 9771 - RNA, 24 nt, Human
acaagcaagagaagaagcagagac

SEQ ID NO: 9772 - RNA, 22 nt, Human
acaagcccaagauagaugcuca

SEQ ID NO: 9773 - RNA, 24 nt, Human
acaaggauucauggauggaaaacu

SEQ ID NO: 9774 - RNA, 22 nt, Human
acaaggcagggcaggugucugu

SEQ ID NO: 9775 - RNA, 24 nt, Human
acaauggccauacucuguugagga

SEQ ID NO: 9776 - RNA, 22 nt, Human
acaauugguggaaugaaccaga

SEQ ID NO: 9777 - RNA, 22 nt, Human
acacaggucuuuugaaugcagg

SEQ ID NO: 9778 - RNA, 24 nt, Human
acaccagaccaccgccuuccguac

SEQ ID NO: 9779 - RNA, 24 nt, Human
acaccagagggaugggguaggagg

SEQ ID NO: 9780 - RNA, 24 nt, Human
acacugggcuuuuaacacaagacu

SEQ ID NO: 9781 - RNA, 24 nt, Human
acagaaaguuugagccuauaagcc

SEQ ID NO: 9782 - RNA, 24 nt, Human
acagaaauuuauuuucucacaguu

SEQ ID NO: 9783 - RNA, 22 nt, Human
acagaacauaagucagccaagu

SEQ ID NO: 9784 - RNA, 24 nt, Human
acagaaccugugguuugcaacccc

SEQ ID NO: 9785 - RNA, 24 nt, Human
acagaaguccuuuaagaggguuug

SEQ ID NO: 9786 - RNA, 24 nt, Human
acagacuacgagggaguuugacag

SEQ ID NO: 9787 - RNA, 21 nt, Human
acagagcgagacucugucuca

SEQ ID NO: 9788 - RNA, 21 nt, Human
acagaucacucuuuugacccc

SEQ ID NO: 9789 - RNA, 24 nt, Human
acagcaaagcgacccaaaggugga

SEQ ID NO: 9790 - RNA, 22 nt, Human
acagcaagucuuugucaaagcu

SEQ ID NO: 9791 - RNA, 20 nt, Human
acaggagcauggagaggcua

SEQ ID NO: 9792 - RNA, 24 nt, Human
acaggaucugacuggugggcacaa

SEQ ID NO: 9793 - RNA, 24 nt, Human
acaggaugcuacucgggcaccuag

SEQ ID NO: 9794 - RNA, 22 nt, Human
acaggcagacgugugcauucug

SEQ ID NO: 9795 - RNA, 24 nt, Human
acaggcuacaucuggauggggaca

SEQ ID NO: 9796 - RNA, 22 nt, Human
acagggguuggggaggcagagc

SEQ ID NO: 9797 - RNA, 24 nt, Human
acagguacauagguaaccaaagua

SEQ ID NO: 9798 - RNA, 24 nt, Human
acagguaggaggcugggcacaaaa

SEQ ID NO: 9799 - RNA, 22 nt, Human
acagugacuugcucuccaaugg

SEQ ID NO: 9800 - RNA, 24 nt, Human
acagugcagaaacuuacuuuugaa

SEQ ID NO: 9801 - RNA, 22 nt, Human
acaguugcguccagaggcuuuu

SEQ ID NO: 9802 - RNA, 22 nt, Human
acauacauauauauacauaugu

SEQ ID NO: 9803 - RNA, 24 nt, Human
acauaggugugaauuuauccauua

SEQ ID NO: 9804 - RNA, 22 nt, Human
acauaugcauaauuggauaagu

SEQ ID NO: 9805 - RNA, 22 nt, Human
acauauuuuucucucuccuuaa

SEQ ID NO: 9806 - RNA, 22 nt, Human
acaugaucuccucacucuagga

SEQ ID NO: 9807 - RNA, 22 nt, Human
acauuaccaaagaaaaguugga

SEQ ID NO: 9808 - RNA, 22 nt, Human
accaacuauuuugcagccccuc

SEQ ID NO: 9809 - RNA, 24 nt, Human
accaaugguuaagucaaaguuuug

SEQ ID NO: 9810 - RNA, 24 nt, Human
accacaguguggggcuuucucucu

SEQ ID NO: 9811 - RNA, 24 nt, Human
accacuuuugugcaccugucccca

SEQ ID NO: 9812 - RNA, 24 nt, Human
accagcuucaaguacauguccaca

SEQ ID NO: 9813 - RNA, 22 nt, Human
accaggacuggaguuaccugaa

SEQ ID NO: 9814 - RNA, 24 nt, Human
accaggauggucgcuuucugucuc

SEQ ID NO: 9815 - RNA, 22 nt, Human
accagggguucgggacagccua

SEQ ID NO: 9816 - RNA, 24 nt, Human
accagguaugucacagcuugugcu

SEQ ID NO: 9817 - RNA, 24 nt, Human
accaggugcugaaccgggugacag

SEQ ID NO: 9818 - RNA, 22 nt, Human
accaguuaaagaauaugaggcc

SEQ ID NO: 9819 - RNA, 24 nt, Human
accaucuuguauucaagugcugac

SEQ ID NO: 9820 - RNA, 24 nt, Human
accaugcgcacgugaggcucugug

SEQ ID NO: 9821 - RNA, 22 nt, Human
accauguaagccugaauuugug

SEQ ID NO: 9822 - RNA, 22 nt, Human
accauucuuccucuuguguuuu

SEQ ID NO: 9823 - RNA, 24 nt, Human
acccaaagauguuaacaguauuuu

SEQ ID NO: 9824 - RNA, 24 nt, Human
acccaagaagggagacaggcccug

SEQ ID NO: 9825 - RNA, 22 nt, Human
acccacccucugugaggaggau

SEQ ID NO: 9826 - RNA, 22 nt, Human
acccaggagguggaaguugcag

SEQ ID NO: 9827 - RNA, 24 nt, Human
acccaguauccacaugcggugggg

SEQ ID NO: 9828 - RNA, 24 nt, Human
accccaaucucugcccugccugca

SEQ ID NO: 9829 - RNA, 24 nt, Human
accccgauccugcugcgccgccuu

SEQ ID NO: 9830 - RNA, 22 nt, Human
accccucucagucuguaguaug

SEQ ID NO: 9831 - RNA, 24 nt, Human
acccggcucuccuggcccuguguu

SEQ ID NO: 9832 - RNA, 24 nt, Human
acccgggccuccggcccuggcagu

SEQ ID NO: 9833 - RNA, 22 nt, Human
acccugaccuacaagucggaac

SEQ ID NO: 9834 - RNA, 24 nt, Human
acccugagaguguggcuggggagu

SEQ ID NO: 9835 - RNA, 24 nt, Human
acccuggaucugcgcauugcugga

SEQ ID NO: 9836 - RNA, 24 nt, Human
acccugggugaugugcugcccucg

SEQ ID NO: 9837 - RNA, 24 nt, Human
acccugugucugauaagucucaga

SEQ ID NO: 9838 - RNA, 24 nt, Human
acccuuuaaacagagagaguuuau

SEQ ID NO: 9839 - RNA, 22 nt, Human
accgccauuuaaaaguguugga

SEQ ID NO: 9840 - RNA, 24 nt, Human
accggcucaaacccccggggguuu

SEQ ID NO: 9841 - RNA, 22 nt, Human
accuagguauuaagccccacau

SEQ ID NO: 9842 - RNA, 22 nt, Human
accuaguuccagguugagggcc

SEQ ID NO: 9843 - RNA, 24 nt, Human
accuccuugagacaaggcagggug

SEQ ID NO: 9844 - RNA, 24 nt, Human
accuggagggcaugaugagcgagg

SEQ ID NO: 9845 - RNA, 22 nt, Human
accuggccuguaggcaagucuu

SEQ ID NO: 9846 - RNA, 24 nt, Human
accugggguggcacacacacgcaa

SEQ ID NO: 9847 - RNA, 24 nt, Human
accuguuggguuccaucuaacgcc

SEQ ID NO: 9848 - RNA, 22 nt, Human
accuuggccucauuuguaucuu

SEQ ID NO: 9849 - RNA, 22 nt, Human
accuuuccuguacucuuacagg

SEQ ID NO: 9850 - RNA, 24 nt, Human
acgaaccccuccucagugcuuggu

SEQ ID NO: 9851 - RNA, 24 nt, Human
acgaagacauggauaguugcaagg

SEQ ID NO: 9852 - RNA, 22 nt, Human
acgaaggcaguggaugauacau

SEQ ID NO: 9853 - RNA, 23 nt, Human
acgaaguuauaguggaaacuagg

SEQ ID NO: 9854 - RNA, 22 nt, Human
acgaaguuuagggggaauuugc

SEQ ID NO: 9855 - RNA, 24 nt, Human
acgacggcgacgaggaggacgaaa

SEQ ID NO: 9856 - RNA, 24 nt, Human
acgaggcugggaauccuggagaac

SEQ ID NO: 9857 - RNA, 24 nt, Human
acgcaagcaggaggcgggggaguc

SEQ ID NO: 9858 - RNA, 24 nt, Human
acgcagauccuucggaccgggggg

SEQ ID NO: 9859 - RNA, 24 nt, Human
acgcagccguguccggagcgcccu

SEQ ID NO: 9860 - RNA, 24 nt, Human
acgccaugaaagcugccauggccu

SEQ ID NO: 9861 - RNA, 24 nt, Human
acgccaugaaagcugccaugugcc

SEQ ID NO: 9862 - RNA, 24 nt, Human
acgccgggaccgggaccgccgccg

SEQ ID NO: 9863 - RNA, 24 nt, Human
acgccuguaaucccagcacuuugg

SEQ ID NO: 9864 - RNA, 24 nt, Human
acgcggcccagcggggcucgggac

SEQ ID NO: 9865 - RNA, 24 nt, Human
acgcgguuuugggugcgugucgcc

SEQ ID NO: 9866 - RNA, 24 nt, Human
acgcguaguccacaagucgcagcu

SEQ ID NO: 9867 - RNA, 24 nt, Human
acgcgugggccagcagcugguggg

SEQ ID NO: 9868 - RNA, 24 nt, Human
acgcucccacgguggcacaugaac

SEQ ID NO: 9869 - RNA, 24 nt, Human
acgcucuuugugcuagggugaugu

SEQ ID NO: 9870 - RNA, 24 nt, Human
acgcugcccagcaggccggcuccu

SEQ ID NO: 9871 - RNA, 24 nt, Human
acgcugcggcgacugcgggaggcc

SEQ ID NO: 9872 - RNA, 24 nt, Human
acggacccagcucagugagcuucg

SEQ ID NO: 9873 - RNA, 24 nt, Human
acggagcaugaaaagacuuucccc

SEQ ID NO: 9874 - RNA, 22 nt, Human
acgugcugucugccucaugaaa

SEQ ID NO: 9875 - RNA, 24 nt, Human
acuagauuguaaagacuggggugg

SEQ ID NO: 9876 - RNA, 22 nt, Human
acuaggacugugugguguaaau

SEQ ID NO: 9877 - RNA, 24 nt, Human
acuaguagacugaugagcuggauu

SEQ ID NO: 9878 - RNA, 22 nt, Human
acuagugucauuuaggagcuua

SEQ ID NO: 9879 - RNA, 24 nt, Human
acuaugauguggaauggggcuaug

SEQ ID NO: 9880 - RNA, 22 nt, Human
acucacaugcaagcgauuuccu

SEQ ID NO: 9881 - RNA, 24 nt, Human
acucacucuagaaauagccugugu

SEQ ID NO: 9882 - RNA, 22 nt, Human
acucacugcaaccuccaccucc

SEQ ID NO: 9883 - RNA, 22 nt, Human
acucagagccauuccgcucagg

SEQ ID NO: 9884 - RNA, 22 nt, Human
acucaucaaagccuugguuuag

SEQ ID NO: 9885 - RNA, 22 nt, Human
acuccaacugggagagaugugu

SEQ ID NO: 9886 - RNA, 24 nt, Human
acuccauuguccccuccucuggcu

SEQ ID NO: 9887 - RNA, 24 nt, Human
acucgcgccaguggaggugacauc

SEQ ID NO: 9888 - RNA, 24 nt, Human
acucgcgcgggggguaauucgggg

SEQ ID NO: 9889 - RNA, 24 nt, Human
acucgcugcgaacacccucguggu

SEQ ID NO: 9890 - RNA, 24 nt, Human
acucugguuacugggcccgcgccg

SEQ ID NO: 9891 - RNA, 24 nt, Human
acucugguuuucugcucagggucu

SEQ ID NO: 9892 - RNA, 22 nt, Human
acugaccuucugugucauggca

SEQ ID NO: 9893 - RNA, 24 nt, Human
acugagcaccuggugaauggccgg

SEQ ID NO: 9894 - RNA, 24 nt, Human
acugaucugauuggaaaacaagac

SEQ ID NO: 9895 - RNA, 24 nt, Human
acugcacuacagccugggcaacag

SEQ ID NO: 9896 - RNA, 22 nt, Human
acugcacuccagccuaugggau

SEQ ID NO: 9897 - RNA, 22 nt, Human
acugcacuccagccugggcaac

SEQ ID NO: 9898 - RNA, 24 nt, Human
acugcacuccagccugggcaacag

SEQ ID NO: 9899 - RNA, 24 nt, Human
acugcacuccagccugggugacag

SEQ ID NO: 9900 - RNA, 22 nt, Human
acugcacuccaucgugggugac

SEQ ID NO: 9901 - RNA, 24 nt, Human
acugcagaagcacuuuacuuaaaa

SEQ ID NO: 9902 - RNA, 23 nt, Human
acugcagggagaggcgucuccag

SEQ ID NO: 9903 - RNA, 24 nt, Human
acugcaguaucuuauugauuuggg

SEQ ID NO: 9904 - RNA, 24 nt, Human
acugcauucuguguauguaugugc

SEQ ID NO: 9905 - RNA, 22 nt, Human
acugccacgggaggaaugacaa

SEQ ID NO: 9906 - RNA, 22 nt, Human
acuggacucagaggagaagaug

SEQ ID NO: 9907 - RNA, 22 nt, Human
acuggagagccacuugagguca

SEQ ID NO: 9908 - RNA, 24 nt, Human
acuggagucuuuugggaggccaau

SEQ ID NO: 9909 - RNA, 24 nt, Human
acuggcaugaggacuauuggucuu

SEQ ID NO: 9910 - RNA, 22 nt, Human
acuggccugcaugaauacaggg

SEQ ID NO: 9911 - RNA, 22 nt, Human
acugggaaugugccaucuuuac

SEQ ID NO: 9912 - RNA, 22 nt, Human
acuguacuccacccugggcgac

SEQ ID NO: 9913 - RNA, 22 nt, Human
acuguacuccauccugggugac

SEQ ID NO: 9914 - RNA, 22 nt, Human
acugucuggccccaucuucaga

SEQ ID NO: 9915 - RNA, 22 nt, Human
acuguuagcuaccuggaaaacc

SEQ ID NO: 9916 - RNA, 24 nt, Human
acuuaaguucaaaggaggccuguu

SEQ ID NO: 9917 - RNA, 22 nt, Human
acuuauuucuagguuucuuuca

SEQ ID NO: 9918 - RNA, 24 nt, Human
acuucaggcacaugugcugaugag

SEQ ID NO: 9919 - RNA, 24 nt, Human
acuucauucuuuuucuuaacaaaa

SEQ ID NO: 9920 - RNA, 22 nt, Human
acuuguguaacacagaaagaac

SEQ ID NO: 9921 - RNA, 22 nt, Human
acuuugacuuugguuugcugcu

SEQ ID NO: 9922 - RNA, 24 nt, Human
agaaaaagccaguuggaauuuuga

SEQ ID NO: 9923 - RNA, 24 nt, Human
agaaaagagccaggaucagccagg

SEQ ID NO: 9924 - RNA, 24 nt, Human
agaaagaccuccugacuccauguu

SEQ ID NO: 9925 - RNA, 24 nt, Human
agaaauauuauuacaagguuucag

SEQ ID NO: 9926 - RNA, 24 nt, Human
agaaauccucguugugguuucaug

SEQ ID NO: 9927 - RNA, 24 nt, Human
agaaauugcccaacucaugucccu

SEQ ID NO: 9928 - RNA, 24 nt, Human
agaacacauucuaugguuccagga

SEQ ID NO: 9929 - RNA, 24 nt, Human
agaacaguccccugguacacuguc

SEQ ID NO: 9930 - RNA, 24 nt, Human
agaagaaaauaaucuucucauuuu

SEQ ID NO: 9931 - RNA, 22 nt, Human
agaagaucccugcucugaguca

SEQ ID NO: 9932 - RNA, 24 nt, Human
agaagcccaaaggaauugcacugu

SEQ ID NO: 9933 - RNA, 22 nt, Human
agaaggguggaaacaguugugc

SEQ ID NO: 9934 - RNA, 24 nt, Human
agaaguauuuuuagaauaagaauu

SEQ ID NO: 9935 - RNA, 24 nt, Human
agaaugcugacaacgauugguucc

SEQ ID NO: 9936 - RNA, 24 nt, Human
agaaugcuguguuccuucgcugga

SEQ ID NO: 9937 - RNA, 22 nt, Human
agaauuccucaggcugcaagug

SEQ ID NO: 9938 - RNA, 22 nt, Human
agacacaguaggaguagaucuc

SEQ ID NO: 9939 - RNA, 24 nt, Human
agacaucauucaguuucuaauauu

SEQ ID NO: 9940 - RNA, 22 nt, Human
agacaucuccagccuuuggagu

SEQ ID NO: 9941 - RNA, 24 nt, Human
agaccuugucacugugcuugccca

SEQ ID NO: 9942 - RNA, 22 nt, Human
agacggagguuugagcugagua

SEQ ID NO: 9943 - RNA, 24 nt, Human
agacguaccgugcggacgagugga

SEQ ID NO: 9944 - RNA, 22 nt, Human
agacucuucuguuaccaccaag

SEQ ID NO: 9945 - RNA, 24 nt, Human
agacuggaaucaugagcaacaaug

SEQ ID NO: 9946 - RNA, 23 nt, Human
agacuggauacaugaacuguggc

SEQ ID NO: 9947 - RNA, 22 nt, Human
agacuggccucaagcucccaga

SEQ ID NO: 9948 - RNA, 22 nt, Human
agacuuaauuccaauuccaggu

SEQ ID NO: 9949 - RNA, 24 nt, Human
agagaaaagccuguuuaccaagga

SEQ ID NO: 9950 - RNA, 24 nt, Human
agagaagagacgagauguacaaga

SEQ ID NO: 9951 - RNA, 22 nt, Human
agagacggggccuugccauguu

SEQ ID NO: 9952 - RNA, 22 nt, Human
agagacugagcagaccauggug

SEQ ID NO: 9953 - RNA, 24 nt, Human
agagaggaugagaggcaggagagc

SEQ ID NO: 9954 - RNA, 24 nt, Human
agagaggggcaguuaguauuagug

SEQ ID NO: 9955 - RNA, 22 nt, Human
agagagugaggcacaacacaag

SEQ ID NO: 9956 - RNA, 22 nt, Human
agagauaaagagguuuaggcag

SEQ ID NO: 9957 - RNA, 24 nt, Human
agagaugcagcgccgggcugugug

SEQ ID NO: 9958 - RNA, 24 nt, Human
agagauggcagcagcagcugcagg

SEQ ID NO: 9959 - RNA, 22 nt, Human
agagauggguuucaccauguug

SEQ ID NO: 9960 - RNA, 24 nt, Human
agagcacauuuuuguauaaacaaa

SEQ ID NO: 9961 - RNA, 22 nt, Human
agagcagguucuucgugaguuc

SEQ ID NO: 9962 - RNA, 24 nt, Human
agagcagucaggagacaagcauaa

SEQ ID NO: 9963 - RNA, 24 nt, Human
agagcauaccuuccaagaaacugg

SEQ ID NO: 9964 - RNA, 22 nt, Human
agagccucuggcgucucuuucu

SEQ ID NO: 9965 - RNA, 22 nt, Human
agagcgagacuccaucucaaaa

SEQ ID NO: 9966 - RNA, 24 nt, Human
agagcgcgcacggcucgcuggagc

SEQ ID NO: 9967 - RNA, 24 nt, Human
agagcuacagccagggauagagca

SEQ ID NO: 9968 - RNA, 24 nt, Human
agaggaacuuaagaaguauggagu

SEQ ID NO: 9969 - RNA, 22 nt, Human
agaggaggcugcaaacccuuag

SEQ ID NO: 9970 - RNA, 24 nt, Human
agaggcagaccagcuuuauuuuug

SEQ ID NO: 9971 - RNA, 24 nt, Human
agaggcaggcgccagggggaaccc

SEQ ID NO: 9972 - RNA, 22 nt, Human
agaggcugcuuggagcaaaaua

SEQ ID NO: 9973 - RNA, 22 nt, Human
agaggcuggggaauggggguuc

SEQ ID NO: 9974 - RNA, 22 nt, Human
agagggaggaagggugggcaag

SEQ ID NO: 9975 - RNA, 22 nt, Human
agagggggaggaucugaaggaa

SEQ ID NO: 9976 - RNA, 24 nt, Human
agaggguaacucccggcggagggg

SEQ ID NO: 9977 - RNA, 24 nt, Human
agagguaguuugggagcauggggg

SEQ ID NO: 9978 - RNA, 24 nt, Human
agagguauaccugucucuaaagga

SEQ ID NO: 9979 - RNA, 24 nt, Human
agagguccugauucaguuuaucaa

SEQ ID NO: 9980 - RNA, 20 nt, Human
agagguggaaugugucuggc

SEQ ID NO: 9981 - RNA, 24 nt, Human
agaggugggguuucaucauggggg

SEQ ID NO: 9982 - RNA, 24 nt, Human
agagguucugcuggaacaagcugg

SEQ ID NO: 9983 - RNA, 24 nt, Human
agaguaagcucuauuaugaaauac

SEQ ID NO: 9984 - RNA, 22 nt, Human
agaguguaauuaguauuuauau

SEQ ID NO: 9985 - RNA, 24 nt, Human
agaguucaugggauagaccgcagg

SEQ ID NO: 9986 - RNA, 24 nt, Human
agaguuccagccagaagcuacagc

SEQ ID NO: 9987 - RNA, 24 nt, Human
agaguuguucauccaggagacagc

SEQ ID NO: 9988 - RNA, 22 nt, Human
agauagccagucuuggaauccc

SEQ ID NO: 9989 - RNA, 22 nt, Human
agauaguucucuguuguugggg

SEQ ID NO: 9990 - RNA, 24 nt, Human
agauauuugcaaaacuuuguucac

SEQ ID NO: 9991 - RNA, 22 nt, Human
agaucccacugagccccgccug

SEQ ID NO: 9992 - RNA, 24 nt, Human
agaugauugugugugcggucggcu

SEQ ID NO: 9993 - RNA, 24 nt, Human
agauguaccuaugguccuaguagg

SEQ ID NO: 9994 - RNA, 22 nt, Human
agcaaaagccaugcccaggaga

SEQ ID NO: 9995 - RNA, 24 nt, Human
agcaaacagaagcaauugcaccgu

SEQ ID NO: 9996 - RNA, 24 nt, Human
agcaagaugaacagaaucuguauu

SEQ ID NO: 9997 - RNA, 24 nt, Human
agcaaggugguaaaagauacaacc

SEQ ID NO: 9998 - RNA, 24 nt, Human
agcaagguugcagaucgguccuuc

SEQ ID NO: 9999 - RNA, 24 nt, Human
agcaaguggaaagacgcagcaauu

SEQ ID NO: 10000 - RNA, 22 nt, Human
agcaaguguugaaacagcuggu

SEQ ID NO: 10001 - RNA, 22 nt, Human
agcaauggguaacugaagcuuu

SEQ ID NO: 10002 - RNA, 22 nt, Human
agcaaugugugaagcuuucgga

SEQ ID NO: 10003 - RNA, 22 nt, Human
agcacagcguagaucuggaaag

SEQ ID NO: 10004 - RNA, 22 nt, Human
agcagcacucaauauuccacag

SEQ ID NO: 10005 - RNA, 22 nt, Human
agcagcuguaagugccauugcc

SEQ ID NO: 10006 - RNA, 24 nt, Human
agcaggacauggagaaguacaucc

SEQ ID NO: 10007 - RNA, 24 nt, Human
agcagguguguaaacagaggguuc

SEQ ID NO: 10008 - RNA, 22 nt, Human
agcagugugggugcuggauuga

SEQ ID NO: 10009 - RNA, 21 nt, Human
agcaucugaggcaguuuccua

SEQ ID NO: 10010 - RNA, 24 nt, Human
agcauguacauauugccgaucugg

SEQ ID NO: 10011 - RNA, 22 nt, Human
agcauuuucugugcuuugauca

SEQ ID NO: 10012 - RNA, 22 nt, Human
agccacaguguggcuauaauga

SEQ ID NO: 10013 - RNA, 24 nt, Human
agccagaaguagaauugcugauua

SEQ ID NO: 10014 - RNA, 24 nt, Human
agccagagaauaagcuuuuuccug

SEQ ID NO: 10015 - RNA, 22 nt, Human
agccagagauucggggcaguag

SEQ ID NO: 10016 - RNA, 22 nt, Human
agccagagcaauggugauguuc

SEQ ID NO: 10017 - RNA, 22 nt, Human
agccaguauuuuccaaaccgcg

SEQ ID NO: 10018 - RNA, 24 nt, Human
agccaguuuuuaucagcagcaaua

SEQ ID NO: 10019 - RNA, 24 nt, Human
agccaugcccuaacgacaggcugg

SEQ ID NO: 10020 - RNA, 24 nt, Human
agcccauuugcaacucugccucug

SEQ ID NO: 10021 - RNA, 22 nt, Human
agcccugaccguucugcauaug

SEQ ID NO: 10022 - RNA, 24 nt, Human
agcccuugccccacugaaugcugc

SEQ ID NO: 10023 - RNA, 24 nt, Human
agccguagaauuugaccuugcgaa

SEQ ID NO: 10024 - RNA, 24 nt, Human
agccucagcuucuccuggauuugc

SEQ ID NO: 10025 - RNA, 22 nt, Human
agccucuucgggaugucuucca

SEQ ID NO: 10026 - RNA, 22 nt, Human
agccugaaagugcucccauagc

SEQ ID NO: 10027 - RNA, 22 nt, Human
agccuggagugcaguggugcaa

SEQ ID NO: 10028 - RNA, 24 nt, Human
agccuggugacaagaaucggacug

SEQ ID NO: 10029 - RNA, 24 nt, Human
agccuuggguuucucgcauucagu

SEQ ID NO: 10030 - RNA, 22 nt, Human
agcggcaaagucuauggccuuu

SEQ ID NO: 10031 - RNA, 22 nt, Human
agcuaucccacaaucucuucuu

SEQ ID NO: 10032 - RNA, 22 nt, Human
agcuaucucaguauuugggguc

SEQ ID NO: 10033 - RNA, 24 nt, Human
agcuauugcuauucaauggagacg

SEQ ID NO: 10034 - RNA, 24 nt, Human
agcucgugaucaccaucgccaggg

SEQ ID NO: 10035 - RNA, 22 nt, Human
agcugcugauucuaaacugugg

SEQ ID NO: 10036 - RNA, 24 nt, Human
agcuggacuucuggcgggggccug

SEQ ID NO: 10037 - RNA, 22 nt, Human
agcugugagccugccuuccagu

SEQ ID NO: 10038 - RNA, 22 nt, Human
agcuuccuggugucugcccaga

SEQ ID NO: 10039 - RNA, 24 nt, Human
aggaaaaaagcuucugaaaugaag

SEQ ID NO: 10040 - RNA, 24 nt, Human
aggaaaacauaagcuugaagaagg

SEQ ID NO: 10041 - RNA, 24 nt, Human
aggaaauauauaaaaauguuuaca

SEQ ID NO: 10042 - RNA, 24 nt, Human
aggaaaugucaaaaaggcaaaaug

SEQ ID NO: 10043 - RNA, 22 nt, Human
aggaacuguaacuaugucucug

SEQ ID NO: 10044 - RNA, 24 nt, Human
aggaacuugaaaggaggguaaaaa

SEQ ID NO: 10045 - RNA, 24 nt, Human
aggaagaacaacacaguugagaca

SEQ ID NO: 10046 - RNA, 19 nt, Human
aggaagacgggaggauucu

SEQ ID NO: 10047 - RNA, 24 nt, Human
aggaagcaaaaaaggcuaagcaag

SEQ ID NO: 10048 - RNA, 24 nt, Human
aggaagcacagcuguugguugaag

SEQ ID NO: 10049 - RNA, 24 nt, Human
aggaagcgguacgaacuccacggc

SEQ ID NO: 10050 - RNA, 24 nt, Human
aggaaggaagucccaccaguguuu

SEQ ID NO: 10051 - RNA, 24 nt, Human
aggaaggacuaggcuacagaucag

SEQ ID NO: 10052 - RNA, 24 nt, Human
aggaaggagauuaggagacucuga

SEQ ID NO: 10053 - RNA, 22 nt, Human
aggaaggaugaaaggaaaggga

SEQ ID NO: 10054 - RNA, 24 nt, Human
aggaaggcacuaaggaaagaccac

SEQ ID NO: 10055 - RNA, 24 nt, Human
aggaaggcuggcaccucuggcucu

SEQ ID NO: 10056 - RNA, 24 nt, Human
aggaaggcuuuuucugauuuuuug

SEQ ID NO: 10057 - RNA, 24 nt, Human
aggaaguaugggagugacggacuu

SEQ ID NO: 10058 - RNA, 24 nt, Human
aggaagugccaaaaaugccuggac

SEQ ID NO: 10059 - RNA, 24 nt, Human
aggaagugguccccugauuccaaa

SEQ ID NO: 10060 - RNA, 24 nt, Human
aggaauauuacaguguuaacugcc

SEQ ID NO: 10061 - RNA, 24 nt, Human
aggaaucagggacacacagugugg

SEQ ID NO: 10062 - RNA, 24 nt, Human
aggaaucccuacgaucucgauaua

SEQ ID NO: 10063 - RNA, 24 nt, Human
aggaaugcuaaaaguauggggagu

SEQ ID NO: 10064 - RNA, 24 nt, Human
aggaaugucccgcagggcuuugcg

SEQ ID NO: 10065 - RNA, 22 nt, Human
aggagacaauuccuuggagcuc

SEQ ID NO: 10066 - RNA, 24 nt, Human
aggaggaagaaauguuuucuuagg

SEQ ID NO: 10067 - RNA, 22 nt, Human
aggaggacagaacaaaccagug

SEQ ID NO: 10068 - RNA, 24 nt, Human
aggaggagagaaaagcugguccuc

SEQ ID NO: 10069 - RNA, 24 nt, Human
aggaggccauccagcucaucgcuc

SEQ ID NO: 10070 - RNA, 24 nt, Human
aggagguugagguugcagugagcu

SEQ ID NO: 10071 - RNA, 24 nt, Human
aggaguagggagagcugagacuag

SEQ ID NO: 10072 - RNA, 22 nt, Human
aggaugcuggggcagaaagaug

SEQ ID NO: 10073 - RNA, 24 nt, Human
aggaugugcucaagaguaugaagc

SEQ ID NO: 10074 - RNA, 24 nt, Human
aggcaaaaccauuuauauuuugaa

SEQ ID NO: 10075 - RNA, 22 nt, Human
aggcaagagguugcagugagcu

SEQ ID NO: 10076 - RNA, 24 nt, Human
aggcaccugccuggcccuaaaaag

SEQ ID NO: 10077 - RNA, 24 nt, Human
aggcacguccagagcccuggcuac

SEQ ID NO: 10078 - RNA, 24 nt, Human
aggcacugcuuauuccagugcagc

SEQ ID NO: 10079 - RNA, 24 nt, Human
aggcagaagccagugccauccuua

SEQ ID NO: 10080 - RNA, 24 nt, Human
aggcagacauccgacuucuugccc

SEQ ID NO: 10081 - RNA, 24 nt, Human
aggcagaggcccuguuguggucug

SEQ ID NO: 10082 - RNA, 24 nt, Human
aggcagagggagaguuggcuccuu

SEQ ID NO: 10083 - RNA, 24 nt, Human
aggcagagucucacucugucaccc

SEQ ID NO: 10084 - RNA, 24 nt, Human
aggcagaucguugucuauuucuuc

SEQ ID NO: 10085 - RNA, 24 nt, Human
aggcagcaaauguuacagguccug

SEQ ID NO: 10086 - RNA, 24 nt, Human
aggcagcagaggcaugagcagcga

SEQ ID NO: 10087 - RNA, 24 nt, Human
aggcagcaguugcggccgcuuuua

SEQ ID NO: 10088 - RNA, 24 nt, Human
aggcagcaucugauugugauuugg

SEQ ID NO: 10089 - RNA, 24 nt, Human
aggcagccagaaaccugcggaaaa

SEQ ID NO: 10090 - RNA, 24 nt, Human
aggcagccuggggaacgugguugg

SEQ ID NO: 10091 - RNA, 24 nt, Human
aggcagcuggagaaguuuguccgc

SEQ ID NO: 10092 - RNA, 24 nt, Human
aggcagcuuugccuucucuccccu

SEQ ID NO: 10093 - RNA, 22 nt, Human
aggcaggacucggcugagggcc

SEQ ID NO: 10094 - RNA, 24 nt, Human
aggcaggagaaucgcuuaaacccg

SEQ ID NO: 10095 - RNA, 24 nt, Human
aggcaggagaaucgcuugaaccug

SEQ ID NO: 10096 - RNA, 24 nt, Human
aggcaggauagugacaguggcucg

SEQ ID NO: 10097 - RNA, 24 nt, Human
aggcaggcuuagcagcuaagggag

SEQ ID NO: 10098 - RNA, 24 nt, Human
aggcaguaccauacuuggaguuca

SEQ ID NO: 10099 - RNA, 22 nt, Human
aggcagucuggggcagcugguu

SEQ ID NO: 10100 - RNA, 24 nt, Human
aggcaguggcaagagggguucagg

SEQ ID NO: 10101 - RNA, 22 nt, Human
aggcaguguuguuccugauugc

SEQ ID NO: 10102 - RNA, 24 nt, Human
aggcaucccguaaaguuguaguug

SEQ ID NO: 10103 - RNA, 24 nt, Human
aggcauccugcaguacguggcucg

SEQ ID NO: 10104 - RNA, 24 nt, Human
aggcaugacuaagggguaaggguu

SEQ ID NO: 10105 - RNA, 24 nt, Human
aggcauggacgcuuucaugggugg

SEQ ID NO: 10106 - RNA, 24 nt, Human
aggcauggaggagcugugugguca

SEQ ID NO: 10107 - RNA, 24 nt, Human
aggcauguguuggcaaaggcuguu

SEQ ID NO: 10108 - RNA, 22 nt, Human
aggccagagaggacucucuuuu

SEQ ID NO: 10109 - RNA, 24 nt, Human
aggccauuaacuguuugaugcgag

SEQ ID NO: 10110 - RNA, 24 nt, Human
aggccuuuguggaucuucaugccc

SEQ ID NO: 10111 - RNA, 24 nt, Human
aggcgaggcuaggugagccguggg

SEQ ID NO: 10112 - RNA, 24 nt, Human
aggcgaggggaacuggccgcguga

SEQ ID NO: 10113 - RNA, 24 nt, Human
aggcgaucaggagucugugccuug

SEQ ID NO: 10114 - RNA, 24 nt, Human
aggcggcguggacagcggccccgg

SEQ ID NO: 10115 - RNA, 24 nt, Human
aggcguucacucccgccgggccga

SEQ ID NO: 10116 - RNA, 23 nt, Human
aggcguuggggacacugcugggu

SEQ ID NO: 10117 - RNA, 22 nt, Human
aggcuacugcuguuagaaagcu

SEQ ID NO: 10118 - RNA, 22 nt, Human
aggcuagagugcaguggcuauu

SEQ ID NO: 10119 - RNA, 22 nt, Human
aggcugacaucugaggacucug

SEQ ID NO: 10120 - RNA, 22 nt, Human
aggcuggauuccaccuacaaaa

SEQ ID NO: 10121 - RNA, 24 nt, Human
aggcuguagaaccugccagacugu

SEQ ID NO: 10122 - RNA, 24 nt, Human
aggcuucgcugggagcugagaaca

SEQ ID NO: 10123 - RNA, 24 nt, Human
aggcuuguuuggcuuuuuguuuau

SEQ ID NO: 10124 - RNA, 24 nt, Human
aggcuuuuccauucaaacuuuguc

SEQ ID NO: 10125 - RNA, 24 nt, Human
agggaagcccagggguccuguuug

SEQ ID NO: 10126 - RNA, 22 nt, Human
agggaagggagguggaagcuca

SEQ ID NO: 10127 - RNA, 24 nt, Human
agggaaguauaccuguccugccag

SEQ ID NO: 10128 - RNA, 24 nt, Human
agggaaguugggacgaagcccagg

SEQ ID NO: 10129 - RNA, 24 nt, Human
agggaauaacaugauuuaagguug

SEQ ID NO: 10130 - RNA, 24 nt, Human
agggacaccucacgucgcugacag

SEQ ID NO: 10131 - RNA, 24 nt, Human
agggaccaaaucuccaacuuuuuu

SEQ ID NO: 10132 - RNA, 24 nt, Human
agggaccaggagcugcugcgaacu

SEQ ID NO: 10133 - RNA, 22 nt, Human
agggaccuaccaucuaacacca

SEQ ID NO: 10134 - RNA, 24 nt, Human
agggagaagacaggcgcagucagc

SEQ ID NO: 10135 - RNA, 24 nt, Human
agggagacaugaggugguucuaug

SEQ ID NO: 10136 - RNA, 24 nt, Human
agggagacuuuguacauuucaggc

SEQ ID NO: 10137 - RNA, 24 nt, Human
agggagaucuggaguucuguuucc

SEQ ID NO: 10138 - RNA, 24 nt, Human
agggagccccgcugggcccagacc

SEQ ID NO: 10139 - RNA, 22 nt, Human
agggagccucaaauggcacggu

SEQ ID NO: 10140 - RNA, 24 nt, Human
agggagcgcaggcaagauuugaau

SEQ ID NO: 10141 - RNA, 21 nt, Human
agggagcuguguaaauggacc

SEQ ID NO: 10142 - RNA, 24 nt, Human
agggaggacagcaggcuggggcgg

SEQ ID NO: 10143 - RNA, 24 nt, Human
agggaggcacaaaccuaacuguac

SEQ ID NO: 10144 - RNA, 24 nt, Human
agggauaggcucacuuuguuaaua

SEQ ID NO: 10145 - RNA, 24 nt, Human
agggauggacccacuuucuccacc

SEQ ID NO: 10146 - RNA, 23 nt, Human
agggauguucaggacucugcagc

SEQ ID NO: 10147 - RNA, 24 nt, Human
agggauuaucuacaccuucacuuu

SEQ ID NO: 10148 - RNA, 24 nt, Human
agggauugagccaagaggugaggg

SEQ ID NO: 10149 - RNA, 24 nt, Human
agggcgcuguggacgcggugagga

SEQ ID NO: 10150 - RNA, 24 nt, Human
agggcgugaugaccggcacuuugu

SEQ ID NO: 10151 - RNA, 24 nt, Human
agggcuguaccagcuggucagggu

SEQ ID NO: 10152 - RNA, 24 nt, Human
aggggcucacggaggaagugcugc

SEQ ID NO: 10153 - RNA, 22 nt, Human
aggggcuuaauagcgcggugag

SEQ ID NO: 10154 - RNA, 24 nt, Human
agggggcagcugugccaucagugg

SEQ ID NO: 10155 - RNA, 24 nt, Human
agggggcugcuggcugagccccaa

SEQ ID NO: 10156 - RNA, 24 nt, Human
agggggugggaggugugcauaaga

SEQ ID NO: 10157 - RNA, 24 nt, Human
agggguaggcugggaggggcugcc

SEQ ID NO: 10158 - RNA, 24 nt, Human
aggggucguuguaaagccagacuc

SEQ ID NO: 10159 - RNA, 24 nt, Human
agggucccuggaaaaggguggagu

SEQ ID NO: 10160 - RNA, 22 nt, Human
agggucuacauuucucugggag

SEQ ID NO: 10161 - RNA, 24 nt, Human
agggugagcccccgacuggagaga

SEQ ID NO: 10162 - RNA, 22 nt, Human
aggguuguuaguuuuuugguug

SEQ ID NO: 10163 - RNA, 24 nt, Human
agguaagaauucucauuugcuaaa

SEQ ID NO: 10164 - RNA, 22 nt, Human
agguauugccuucucuggaagg

SEQ ID NO: 10165 - RNA, 24 nt, Human
agguauuuggugucauguuuugga

SEQ ID NO: 10166 - RNA, 24 nt, Human
aggucagcccugagcuguugugca

SEQ ID NO: 10167 - RNA, 22 nt, Human
agguccaggucuucacuagggg

SEQ ID NO: 10168 - RNA, 22 nt, Human
agguccucacacacagcucugc

SEQ ID NO: 10169 - RNA, 22 nt, Human
aggucugagcuugaggaggacu

SEQ ID NO: 10170 - RNA, 22 nt, Human
aggucuggacagugcaaguugc

SEQ ID NO: 10171 - RNA, 24 nt, Human
agguguguauuuguuauucugaaa

SEQ ID NO: 10172 - RNA, 22 nt, Human
aggugugugcauuugccagggg

SEQ ID NO: 10173 - RNA, 24 nt, Human
agguguuguaggcauagucacaga

SEQ ID NO: 10174 - RNA, 22 nt, Human
agguuauuuugucucucugucu

SEQ ID NO: 10175 - RNA, 22 nt, Human
aguaauuuagggagcagcccua

SEQ ID NO: 10176 - RNA, 22 nt, Human
aguagcgagggaauggugccgc

SEQ ID NO: 10177 - RNA, 22 nt, Human
agucaacagggagccccagggu

SEQ ID NO: 10178 - RNA, 24 nt, Human
agucaaguugcaggaucagcaggu

SEQ ID NO: 10179 - RNA, 24 nt, Human
agucaccaacagcacugucugguc

SEQ ID NO: 10180 - RNA, 24 nt, Human
agucauggcaaauagaauugggcu

SEQ ID NO: 10181 - RNA, 24 nt, Human
agucauuauauaaauuagcaucua

SEQ ID NO: 10182 - RNA, 24 nt, Human
agucauugaagauacuuggcacua

SEQ ID NO: 10183 - RNA, 24 nt, Human
agucauuguauguagagguggagu

SEQ ID NO: 10184 - RNA, 21 nt, Human
aguccaguugacaugcuauua

SEQ ID NO: 10185 - RNA, 22 nt, Human
agucuccugaguagcugggguu

SEQ ID NO: 10186 - RNA, 24 nt, Human
agucugaagaugggcauuaugcaa

SEQ ID NO: 10187 - RNA, 24 nt, Human
agucugauuaguugcugggauggu

SEQ ID NO: 10188 - RNA, 22 nt, Human
agucugggauguucuaccauac

SEQ ID NO: 10189 - RNA, 24 nt, Human
agugaagaaagguacaucccaagg

SEQ ID NO: 10190 - RNA, 24 nt, Human
agugaagaauuuccagaagagguu

SEQ ID NO: 10191 - RNA, 24 nt, Human
agugaagagaaccagaaaaagucu

SEQ ID NO: 10192 - RNA, 24 nt, Human
agugaguucagaauauccuacacc

SEQ ID NO: 10193 - RNA, 24 nt, Human
agugauggggaacgccaaggagaa

SEQ ID NO: 10194 - RNA, 22 nt, Human
agugauucuccugcuucagccu

SEQ ID NO: 10195 - RNA, 24 nt, Human
agugcagaaacuuacuuugaaagu

SEQ ID NO: 10196 - RNA, 24 nt, Human
agugcagagggcucauugggaaaa

SEQ ID NO: 10197 - RNA, 22 nt, Human
agugcagauuggacgguuaauu

SEQ ID NO: 10198 - RNA, 24 nt, Human
agugcaguggcgcaaucuuggcuc

SEQ ID NO: 10199 - RNA, 24 nt, Human
agugcaguucucaaauggcugccu

SEQ ID NO: 10200 - RNA, 24 nt, Human
agugcauagugaggccacugcugc

SEQ ID NO: 10201 - RNA, 24 nt, Human
aguggaagagaagaacuugaaccc

SEQ ID NO: 10202 - RNA, 24 nt, Human
aguggacagcagccacccauuuga

SEQ ID NO: 10203 - RNA, 24 nt, Human
aguggaccagagccuucgucugga

SEQ ID NO: 10204 - RNA, 24 nt, Human
aguggcacagaccuaugggcuugg

SEQ ID NO: 10205 - RNA, 22 nt, Human
aguggcauaggagggauuaaaa

SEQ ID NO: 10206 - RNA, 24 nt, Human
aguggcuaaugacacaaucauuac

SEQ ID NO: 10207 - RNA, 24 nt, Human
aguggcucagcuucucuuauggug

SEQ ID NO: 10208 - RNA, 24 nt, Human
aguggcugauugacacccucuaug

SEQ ID NO: 10209 - RNA, 22 nt, Human
aguggguuggugcaaaaguaau

SEQ ID NO: 10210 - RNA, 24 nt, Human
agugguuagaauacagggugacuc

SEQ ID NO: 10211 - RNA, 22 nt, Human
aguguagugggaagccuuccuc

SEQ ID NO: 10212 - RNA, 22 nt, Human
aguguaucauucuccuuaugug

SEQ ID NO: 10213 - RNA, 22 nt, Human
aguguggagucgugcugcucca

SEQ ID NO: 10214 - RNA, 24 nt, Human
aguuaggaggugcugcuccuccuc

SEQ ID NO: 10215 - RNA, 22 nt, Human
aguuaucagagaaauccuuuug

SEQ ID NO: 10216 - RNA, 22 nt, Human
aguuaugugaugcuuugaagca

SEQ ID NO: 10217 - RNA, 22 nt, Human
aguucacauuaugcaucucagg

SEQ ID NO: 10218 - RNA, 24 nt, Human
aguucugcucgcucucagucucca

SEQ ID NO: 10219 - RNA, 22 nt, Human
aguucuucuccugaaacuggac

SEQ ID NO: 10220 - RNA, 24 nt, Human
aguugcagaaaggaaugucaguca

SEQ ID NO: 10221 - RNA, 24 nt, Human
aguuggagguuacagugagccgag

SEQ ID NO: 10222 - RNA, 24 nt, Human
aguuggugacuaaucccaugugga

SEQ ID NO: 10223 - RNA, 21 nt, Human
aguuguuuuacuccauccugu

SEQ ID NO: 10224 - RNA, 22 nt, Human
auaagacugccagugaccaagc

SEQ ID NO: 10225 - RNA, 22 nt, Human
auaagauauuuacaagacaacc

SEQ ID NO: 10226 - RNA, 24 nt, Human
auaagauuguaauggagcuguaaa

SEQ ID NO: 10227 - RNA, 22 nt, Human
auaaggcaguggguuuggcuga

SEQ ID NO: 10228 - RNA, 22 nt, Human
auaaucccaguccuuagguagu

SEQ ID NO: 10229 - RNA, 24 nt, Human
auacaaagacagcacccucaucau

SEQ ID NO: 10230 - RNA, 22 nt, Human
auacaugugccauguuggugug

SEQ ID NO: 10231 - RNA, 22 nt, Human
auaccagcacaguggaugggga

SEQ ID NO: 10232 - RNA, 24 nt, Human
auacugaagacaauaccucuccag

SEQ ID NO: 10233 - RNA, 22 nt, Human
auacugagagaaaaagcuuguc

SEQ ID NO: 10234 - RNA, 22 nt, Human
auagacuguccaguguaggugg

SEQ ID NO: 10235 - RNA, 22 nt, Human
auagcaacucugcuuccuugcc

SEQ ID NO: 10236 - RNA, 22 nt, Human
auagcaguaauaccagcauaau

SEQ ID NO: 10237 - RNA, 24 nt, Human
auaggccagugagcccaggccccu

SEQ ID NO: 10238 - RNA, 22 nt, Human
auagggguucugcuucucggcu

SEQ ID NO: 10239 - RNA, 24 nt, Human
auagugaaugaccagcuggcugua

SEQ ID NO: 10240 - RNA, 22 nt, Human
auagugcgaagggacucagggu

SEQ ID NO: 10241 - RNA, 22 nt, Human
auauuggugaaaugcuagcaaa

SEQ ID NO: 10242 - RNA, 22 nt, Human
auauuguguauucaggauagca

SEQ ID NO: 10243 - RNA, 23 nt, Human
aucaaggcaugggacauuggggu

SEQ ID NO: 10244 - RNA, 22 nt, Human
aucacagaggcuuaagugcuga

SEQ ID NO: 10245 - RNA, 21 nt, Human
aucacaguuacuuucucagca

SEQ ID NO: 10246 - RNA, 22 nt, Human
aucacauugccagugauuaccc

SEQ ID NO: 10247 - RNA, 24 nt, Human
aucacauuucaucaagcucagaug

SEQ ID NO: 10248 - RNA, 24 nt, Human
aucagcuccgacuuuggacgggca

SEQ ID NO: 10249 - RNA, 24 nt, Human
aucagguccuccucccccuccacc

SEQ ID NO: 10250 - RNA, 24 nt, Human
aucaucugagcuaucuaauuuuua

SEQ ID NO: 10251 - RNA, 24 nt, Human
aucaugcuuaaugggagaaaacug

SEQ ID NO: 10252 - RNA, 24 nt, Human
aucauuuugagcaaaauaucuguu

SEQ ID NO: 10253 - RNA, 22 nt, Human
auccacauuuuuugcucuacug

SEQ ID NO: 10254 - RNA, 22 nt, Human
auccaggcuggagugcaguggu

SEQ ID NO: 10255 - RNA, 24 nt, Human
aucccgggcacaggcagaggccag

SEQ ID NO: 10256 - RNA, 24 nt, Human
auccgggugaagaagcaggucugg

SEQ ID NO: 10257 - RNA, 24 nt, Human
auccugaggccgaagauugggcug

SEQ ID NO: 10258 - RNA, 24 nt, Human
auccugccuuuccacuguaccacu

SEQ ID NO: 10259 - RNA, 22 nt, Human
auccuuaaagugggauuuacca

SEQ ID NO: 10260 - RNA, 24 nt, Human
aucgaacuucgcuucuuggugaua

SEQ ID NO: 10261 - RNA, 22 nt, Human
aucuacugucaguguggcauga

SEQ ID NO: 10262 - RNA, 22 nt, Human
aucuagagaggcagucuggcca

SEQ ID NO: 10263 - RNA, 24 nt, Human
aucuauauauaaaaagucccacac

SEQ ID NO: 10264 - RNA, 22 nt, Human
aucuccauguaucuuugggacc

SEQ ID NO: 10265 - RNA, 22 nt, Human
aucugcccgccucguccuccca

SEQ ID NO: 10266 - RNA, 22 nt, Human
aucugguuagggcccacuuccu

SEQ ID NO: 10267 - RNA, 22 nt, Human
aucuucagugcucuugggggau

SEQ ID NO: 10268 - RNA, 22 nt, Human
aucuuugccuuuaugccucuag

SEQ ID NO: 10269 - RNA, 24 nt, Human
aucuuuguacugucaacuuuuugg

SEQ ID NO: 10270 - RNA, 24 nt, Human
augaagcagaaccuggaugagcuu

SEQ ID NO: 10271 - RNA, 24 nt, Human
augaagccagcuaccagccccucg

SEQ ID NO: 10272 - RNA, 24 nt, Human
augaagcgagauggcaguuugugc

SEQ ID NO: 10273 - RNA, 24 nt, Human
augaagcuagauaccuaaagcuac

SEQ ID NO: 10274 - RNA, 24 nt, Human
augaagcuagcaacugaaagucua

SEQ ID NO: 10275 - RNA, 22 nt, Human
augaaggauuccugcaucacug

SEQ ID NO: 10276 - RNA, 24 nt, Human
augaauuuuccgaugucgugcaag

SEQ ID NO: 10277 - RNA, 22 nt, Human
augacacaguggggccaguugg

SEQ ID NO: 10278 - RNA, 24 nt, Human
augacccguuaccuggaguccugg

SEQ ID NO: 10279 - RNA, 24 nt, Human
augacuguagcagaaaucucccag

SEQ ID NO: 10280 - RNA, 24 nt, Human
augagauuaucaaaagauguguua

SEQ ID NO: 10281 - RNA, 22 nt, Human
augagccugauccucauaaaca

SEQ ID NO: 10282 - RNA, 24 nt, Human
augaggccuuuguucgggaggugc

SEQ ID NO: 10283 - RNA, 22 nt, Human
augaucauguaugauacugcaa

SEQ ID NO: 10284 - RNA, 22 nt, Human
augaugccguauuuaccaagag

SEQ ID NO: 10285 - RNA, 24 nt, Human
augaugucagcuugaacagucaug

SEQ ID NO: 10286 - RNA, 24 nt, Human
augcaagccuuuuucaguucaaga

SEQ ID NO: 10287 - RNA, 22 nt, Human
augcacccaguuacacucucca

SEQ ID NO: 10288 - RNA, 22 nt, Human
augcacugguauaauucacugg

SEQ ID NO: 10289 - RNA, 24 nt, Human
augcacuuuaguuuuuggucuguu

SEQ ID NO: 10290 - RNA, 24 nt, Human
augcagcaggugucacagaaggac

SEQ ID NO: 10291 - RNA, 24 nt, Human
augcagcuuuucccuacugucacc

SEQ ID NO: 10292 - RNA, 22 nt, Human
augcauagggagagucucuaaa

SEQ ID NO: 10293 - RNA, 24 nt, Human
augcauuuguauguucauauaaca

SEQ ID NO: 10294 - RNA, 24 nt, Human
augccugguagagccccacacaug

SEQ ID NO: 10295 - RNA, 22 nt, Human
augccuguaaucccagcauuuu

SEQ ID NO: 10296 - RNA, 24 nt, Human
augccuguaaucccagcauuuuga

SEQ ID NO: 10297 - RNA, 24 nt, Human
augccuuucuccacauaagcauca

SEQ ID NO: 10298 - RNA, 24 nt, Human
augccuuugcccuccagccugggc

SEQ ID NO: 10299 - RNA, 22 nt, Human
augcucgguuuaagguacacug

SEQ ID NO: 10300 - RNA, 22 nt, Human
augcugcacuuccacaugaagu

SEQ ID NO: 10301 - RNA, 24 nt, Human
augcugccgggcacuuggcgggcc

SEQ ID NO: 10302 - RNA, 22 nt, Human
augcuggaauauuccuaacauu

SEQ ID NO: 10303 - RNA, 24 nt, Human
augcugucggggauucugcugggc

SEQ ID NO: 10304 - RNA, 24 nt, Human
auggaacgcucggaggagcucaac

SEQ ID NO: 10305 - RNA, 19 nt, Human
auggaaguaaucugcuuaa

SEQ ID NO: 10306 - RNA, 24 nt, Human
auggaccgcuagggcccggccuag

SEQ ID NO: 10307 - RNA, 21 nt, Human
auggagacaaggugguggcag

SEQ ID NO: 10308 - RNA, 24 nt, Human
auggagccacaaaguuuccagaug

SEQ ID NO: 10309 - RNA, 23 nt, Human
auggagcccugaauguugaccug

SEQ ID NO: 10310 - RNA, 24 nt, Human
auggagcugugaguuccuggaugg

SEQ ID NO: 10311 - RNA, 22 nt, Human
auggaggaagaaccccuuggau

SEQ ID NO: 10312 - RNA, 24 nt, Human
auggaucacagggucuaagggugg

SEQ ID NO: 10313 - RNA, 22 nt, Human
auggcucugaggaaucugugug

SEQ ID NO: 10314 - RNA, 22 nt, Human
auggcugugugcuucagcggcu

SEQ ID NO: 10315 - RNA, 22 nt, Human
auggcuuauuccauggccauca

SEQ ID NO: 10316 - RNA, 22 nt, Human
auggcuucugucuuggaaauuu

SEQ ID NO: 10317 - RNA, 22 nt, Human
augggagaugaaaguggagggg

SEQ ID NO: 10318 - RNA, 24 nt, Human
augggucagcgaucuccugacuca

SEQ ID NO: 10319 - RNA, 22 nt, Human
auggguuuccugugacauuuug

SEQ ID NO: 10320 - RNA, 22 nt, Human
augguacugagagaguaugugu

SEQ ID NO: 10321 - RNA, 24 nt, Human
auggugcagcagcuccuggaggcu

SEQ ID NO: 10322 - RNA, 24 nt, Human
augguuucuaaaucaguuauuuuc

SEQ ID NO: 10323 - RNA, 22 nt, Human
auguaagcuuuguuaccaucug

SEQ ID NO: 10324 - RNA, 24 nt, Human
auguaccagugcugccacgggagc

SEQ ID NO: 10325 - RNA, 22 nt, Human
augucagugaagaggucuggca

SEQ ID NO: 10326 - RNA, 22 nt, Human
augugcaaacuugggcaaagcc

SEQ ID NO: 10327 - RNA, 24 nt, Human
augugccccagcucuuccgggagc

SEQ ID NO: 10328 - RNA, 22 nt, Human
augugccuccugaggugugucg

SEQ ID NO: 10329 - RNA, 22 nt, Human
auguggcuuuggauuucuggag

SEQ ID NO: 10330 - RNA, 22 nt, Human
auguguauguucugccauuucc

SEQ ID NO: 10331 - RNA, 24 nt, Human
auguugcacccuuguuucuacacc

SEQ ID NO: 10332 - RNA, 24 nt, Human
auuaagcagauagggagaagggaa

SEQ ID NO: 10333 - RNA, 22 nt, Human
auuacagguaugagccagcaug

SEQ ID NO: 10334 - RNA, 22 nt, Human
auuaccuguugccacuuggaau

SEQ ID NO: 10335 - RNA, 22 nt, Human
auuacuuuugcaccaaucuaau

SEQ ID NO: 10336 - RNA, 22 nt, Human
auuagauugucauaggagugca

SEQ ID NO: 10337 - RNA, 22 nt, Human
auuagcuauagcaaaaggcuua

SEQ ID NO: 10338 - RNA, 22 nt, Human
auuauaucucuccugaaauccu

SEQ ID NO: 10339 - RNA, 22 nt, Human
auucacuuccugaaacgugcac

SEQ ID NO: 10340 - RNA, 22 nt, Human
auucaguucuaaggucagugcc

SEQ ID NO: 10341 - RNA, 24 nt, Human
auucuaccaagcagagauggagga

SEQ ID NO: 10342 - RNA, 22 nt, Human
auucuuacuuugaauggcuuau

SEQ ID NO: 10343 - RNA, 22 nt, Human
auucuuuucuaagcccuacuug

SEQ ID NO: 10344 - RNA, 22 nt, Human
auugauuauaacacacagcuga

SEQ ID NO: 10345 - RNA, 24 nt, Human
auugcacuccagccugggccacag

SEQ ID NO: 10346 - RNA, 22 nt, Human
auuggagagagcacgauuuauu

SEQ ID NO: 10347 - RNA, 22 nt, Human
auuggagagccacuugagguca

SEQ ID NO: 10348 - RNA, 22 nt, Human
auuggugcccucgaagaccuca

SEQ ID NO: 10349 - RNA, 24 nt, Human
auuguacaaauaagugugcaguau

SEQ ID NO: 10350 - RNA, 24 nt, Human
auuguucugcuguucuuuguccaa

SEQ ID NO: 10351 - RNA, 24 nt, Human
auuuaagcaaggcaaaggagauag

SEQ ID NO: 10352 - RNA, 22 nt, Human
auuuacucaggccggguguggu

SEQ ID NO: 10353 - RNA, 22 nt, Human
auuuauuuucccucaaguaccu

SEQ ID NO: 10354 - RNA, 22 nt, Human
auuuccacaaugucugugaacu

SEQ ID NO: 10355 - RNA, 22 nt, Human
auuuggaaggagcugcacagca

SEQ ID NO: 10356 - RNA, 22 nt, Human
auuuggggaaauguguuucugg

SEQ ID NO: 10357 - RNA, 22 nt, Human
auuuuugguaucuguggguugg

SEQ ID NO: 10358 - RNA, 22 nt, Human
caaaaaauucaccuuugggcuu

SEQ ID NO: 10359 - RNA, 22 nt, Human
caaaaguacuugccgcucuacc

SEQ ID NO: 10360 - RNA, 24 nt, Human
caaaaguuuuauacacagauauuu

SEQ ID NO: 10361 - RNA, 22 nt, Human
caaaccuguuaacuaccuccug

SEQ ID NO: 10362 - RNA, 22 nt, Human
caaagaggagcuccuacaaggu

SEQ ID NO: 10363 - RNA, 24 nt, Human
caaagcacaguaacaguugaaaag

SEQ ID NO: 10364 - RNA, 24 nt, Human
caaagccgugcggagauuggaggc

SEQ ID NO: 10365 - RNA, 22 nt, Human
caaagugcugagauuacaggca

SEQ ID NO: 10366 - RNA, 22 nt, Human
caacaagcgcucagagcaaagc

SEQ ID NO: 10367 - RNA, 22 nt, Human
caacacagcacccuccuccugu

SEQ ID NO: 10368 - RNA, 21 nt, Human
caacauagugagacucugucu

SEQ ID NO: 10369 - RNA, 21 nt, Human
caacauggugaaaccccaucu

SEQ ID NO: 10370 - RNA, 22 nt, Human
caacauggugaaaccccaucuc

SEQ ID NO: 10371 - RNA, 20 nt, Human
caacaugucuucggcuccgg

SEQ ID NO: 10372 - RNA, 23 nt, Human
caacgcaacggcaacgccacgcg

SEQ ID NO: 10373 - RNA, 22 nt, Human
caacgugugagcugccucuugc

SEQ ID NO: 10374 - RNA, 21 nt, Human
caacuacuguuagaguccacc

SEQ ID NO: 10375 - RNA, 24 nt, Human
caacucaggcucuagcuucuccag

SEQ ID NO: 10376 - RNA, 22 nt, Human
caacuccaggggaugcuguuca

SEQ ID NO: 10377 - RNA, 22 nt, Human
caacuuaccuguugccacuugg

SEQ ID NO: 10378 - RNA, 24 nt, Human
caagaagccccggaggcuauccua

SEQ ID NO: 10379 - RNA, 22 nt, Human
caagaauagcacuucccguuaa

SEQ ID NO: 10380 - RNA, 24 nt, Human
caagacacaaauguaacuucugag

SEQ ID NO: 10381 - RNA, 24 nt, Human
caagacacagguaagaugcaggug

SEQ ID NO: 10382 - RNA, 24 nt, Human
caagacaugauuuugcuggcuuua

SEQ ID NO: 10383 - RNA, 24 nt, Human
caagagaagcacgguuuucucuuu

SEQ ID NO: 10384 - RNA, 24 nt, Human
caagagcaagaagcaguucuuugu

SEQ ID NO: 10385 - RNA, 24 nt, Human
caagauuaggccucucaaaagagc

SEQ ID NO: 10386 - RNA, 22 nt, Human
caagauuauucccacuugucuu

SEQ ID NO: 10387 - RNA, 24 nt, Human
caagccaacugugaacauggguca

SEQ ID NO: 10388 - RNA, 24 nt, Human
caagcugagcuggaugggcuaccu

SEQ ID NO: 10389 - RNA, 22 nt, Human
caaggaaaugucagaaaggcaa

SEQ ID NO: 10390 - RNA, 24 nt, Human
caaggacuucuuugcagguaucug

SEQ ID NO: 10391 - RNA, 24 nt, Human
caaggcaacacuugcugaugagca

SEQ ID NO: 10392 - RNA, 24 nt, Human
caagguaaccuuuuccuuugaggc

SEQ ID NO: 10393 - RNA, 22 nt, Human
caagucccuaaaaugaccugaa

SEQ ID NO: 10394 - RNA, 22 nt, Human
caagugcuaacaugucuggguu

SEQ ID NO: 10395 - RNA, 21 nt, Human
caaguggaugguaagauaggg

SEQ ID NO: 10396 - RNA, 24 nt, Human
caaugccacuauccuucccaucuc

SEQ ID NO: 10397 - RNA, 22 nt, Human
caaugccaggaaccugggggaa

SEQ ID NO: 10398 - RNA, 24 nt, Human
caauggagggaaaugucagccaug

SEQ ID NO: 10399 - RNA, 24 nt, Human
caaugggugaucgggcaugacccc

SEQ ID NO: 10400 - RNA, 22 nt, Human
caauguacagaagccacgugua

SEQ ID NO: 10401 - RNA, 22 nt, Human
caaugucaguccagccagcugc

SEQ ID NO: 10402 - RNA, 22 nt, Human
cacacagucguguaguuuugcg

SEQ ID NO: 10403 - RNA, 24 nt, Human
cacacccaaacaaacccaagucaa

SEQ ID NO: 10404 - RNA, 22 nt, Human
cacaccugcacuacaguaaccc

SEQ ID NO: 10405 - RNA, 22 nt, Human
cacaccuugcuuucccacuaau

SEQ ID NO: 10406 - RNA, 24 nt, Human
cacacugcaggacaucguucuccc

SEQ ID NO: 10407 - RNA, 24 nt, Human
cacagcaagcccaggcucuaccag

SEQ ID NO: 10408 - RNA, 24 nt, Human
cacaggacacugccugccagucac

SEQ ID NO: 10409 - RNA, 23 nt, Human
cacaugggauccaugggcuuggc

SEQ ID NO: 10410 - RNA, 24 nt, Human
caccaaaguacuaauucgguauca

SEQ ID NO: 10411 - RNA, 24 nt, Human
caccaagucuggaugaccacuacc

SEQ ID NO: 10412 - RNA, 24 nt, Human
caccagcacugcacccuaaucaaa

SEQ ID NO: 10413 - RNA, 24 nt, Human
caccagggaggacagcugcuggca

SEQ ID NO: 10414 - RNA, 24 nt, Human
caccaguagggagcuagcuggcug

SEQ ID NO: 10415 - RNA, 24 nt, Human
caccauggugacgcuugcugaacu

SEQ ID NO: 10416 - RNA, 22 nt, Human
caccaugucugugagcucugca

SEQ ID NO: 10417 - RNA, 24 nt, Human
caccaugugaagaguagagagaau

SEQ ID NO: 10418 - RNA, 24 nt, Human
cacccagaugccugcucaguguug

SEQ ID NO: 10419 - RNA, 24 nt, Human
cacccauuguccauagccuucuca

SEQ ID NO: 10420 - RNA, 24 nt, Human
caccccaugccaucugacagaugg

SEQ ID NO: 10421 - RNA, 24 nt, Human
caccccggggaagggggaagagca

SEQ ID NO: 10422 - RNA, 24 nt, Human
cacccggaagaugaggcucgccgu

SEQ ID NO: 10423 - RNA, 19 nt, Human
cacccggggcggcaucgcg

SEQ ID NO: 10424 - RNA, 24 nt, Human
cacccggggcuccacccaagcgcc

SEQ ID NO: 10425 - RNA, 24 nt, Human
cacccguuagaaagagcgugggac

SEQ ID NO: 10426 - RNA, 22 nt, Human
cacccuaaagaagcauauaauc

SEQ ID NO: 10427 - RNA, 24 nt, Human
cacccuggcaagcagcagugaugg

SEQ ID NO: 10428 - RNA, 24 nt, Human
cacccuguaaugguugggaccagg

SEQ ID NO: 10429 - RNA, 22 nt, Human
cacccuuugggaucuugggcuu

SEQ ID NO: 10430 - RNA, 21 nt, Human
caccgagucgccucacucgag

SEQ ID NO: 10431 - RNA, 24 nt, Human
caccgagucgccucacucgagcgc

SEQ ID NO: 10432 - RNA, 24 nt, Human
caccgcaagggccuggcagugugc

SEQ ID NO: 10433 - RNA, 24 nt, Human
caccgcauaacaccccugugggca

SEQ ID NO: 10434 - RNA, 23 nt, Human
caccgccuagugccaacagccuu

SEQ ID NO: 10435 - RNA, 22 nt, Human
caccgcgccccuuuuccagccc

SEQ ID NO: 10436 - RNA, 24 nt, Human
caccgcguauaacuuuccagccca

SEQ ID NO: 10437 - RNA, 24 nt, Human
caccggacacgguggcucacgccu

SEQ ID NO: 10438 - RNA, 24 nt, Human
caccgggagggccggaucgagacc

SEQ ID NO: 10439 - RNA, 24 nt, Human
caccguguccgcgcucuuuucgcg

SEQ ID NO: 10440 - RNA, 24 nt, Human
caccguuaaaacccugaguggaug

SEQ ID NO: 10441 - RNA, 23 nt, Human
caccucacccugaucuccuccaa

SEQ ID NO: 10442 - RNA, 24 nt, Human
caccucaggccagaaggggaugac

SEQ ID NO: 10443 - RNA, 24 nt, Human
caccuccucagcuggugccaggau

SEQ ID NO: 10444 - RNA, 24 nt, Human
caccugcacagcaguuaacagcag

SEQ ID NO: 10445 - RNA, 24 nt, Human
caccugcagccgggcaugagccug

SEQ ID NO: 10446 - RNA, 24 nt, Human
caccugcuccuugaaugacagcgc

SEQ ID NO: 10447 - RNA, 24 nt, Human
caccuggguaccuacaguagucga

SEQ ID NO: 10448 - RNA, 24 nt, Human
caccuguaaucccagcuacuccga

SEQ ID NO: 10449 - RNA, 24 nt, Human
caccuguccugcagaggagucguu

SEQ ID NO: 10450 - RNA, 24 nt, Human
caccugucugcauagaaaggcaga

SEQ ID NO: 10451 - RNA, 24 nt, Human
caccuguuggggaccugcuuguug

SEQ ID NO: 10452 - RNA, 22 nt, Human
caccuguuucuuggcaugucau

SEQ ID NO: 10453 - RNA, 20 nt, Human
caccuugcucacacugcagu

SEQ ID NO: 10454 - RNA, 24 nt, Human
cacgaggugcacacguucgugucc

SEQ ID NO: 10455 - RNA, 24 nt, Human
cacgcuguagaacacgcggccgug

SEQ ID NO: 10456 - RNA, 24 nt, Human
cacgcugugucgcgccucuccucc

SEQ ID NO: 10457 - RNA, 24 nt, Human
cacgggccgaggaggauguggagc

SEQ ID NO: 10458 - RNA, 24 nt, Human
cacgguagucuucacuuugaaaca

SEQ ID NO: 10459 - RNA, 24 nt, Human
cacguagugguaagcggcauuugg

SEQ ID NO: 10460 - RNA, 24 nt, Human
cacuaaacaacugaccauuucuac

SEQ ID NO: 10461 - RNA, 24 nt, Human
cacuacaggccagggcugcggggc

SEQ ID NO: 10462 - RNA, 24 nt, Human
cacuaugucgccuuuggguagcaa

SEQ ID NO: 10463 - RNA, 22 nt, Human
cacucaagcugagguucuugcu

SEQ ID NO: 10464 - RNA, 24 nt, Human
cacuccccagcaugcuggcaucca

SEQ ID NO: 10465 - RNA, 22 nt, Human
cacucgguguacguccuggagg

SEQ ID NO: 10466 - RNA, 22 nt, Human
cacugagacccggaaucaguuc

SEQ ID NO: 10467 - RNA, 22 nt, Human
cacugcaaccucugccaccugg

SEQ ID NO: 10468 - RNA, 22 nt, Human
cacugcaaccucugccuccugg

SEQ ID NO: 10469 - RNA, 22 nt, Human
cacugcacccuccucuuggguu

SEQ ID NO: 10470 - RNA, 22 nt, Human
cacugcacuccaaccuggacaa

SEQ ID NO: 10471 - RNA, 24 nt, Human
cacugcacuccagccugggcaaca

SEQ ID NO: 10472 - RNA, 24 nt, Human
cacugcacuccagccugggugaca

SEQ ID NO: 10473 - RNA, 24 nt, Human
cacugcuucuccgucagugagucg

SEQ ID NO: 10474 - RNA, 24 nt, Human
cacugggccugcugagcgccgugg

SEQ ID NO: 10475 - RNA, 24 nt, Human
cacugggcuucuuuucaugccgcu

SEQ ID NO: 10476 - RNA, 24 nt, Human
cacuggguggcccugugagcuccc

SEQ ID NO: 10477 - RNA, 21 nt, Human
cacuguauagcaggagaaaac

SEQ ID NO: 10478 - RNA, 24 nt, Human
cacuucugguuggccucggggcgc

SEQ ID NO: 10479 - RNA, 24 nt, Human
cacuuuaugggggcagaauggaac

SEQ ID NO: 10480 - RNA, 22 nt, Human
cacuuucagagaugcccugagu

SEQ ID NO: 10481 - RNA, 22 nt, Human
cacuuuccaccacugucagccu

SEQ ID NO: 10482 - RNA, 24 nt, Human
cagaacucagguggcaaugcuuac

SEQ ID NO: 10483 - RNA, 24 nt, Human
cagaacuuguucacgaacgugaca

SEQ ID NO: 10484 - RNA, 24 nt, Human
cagaagaagggauucacucaguac

SEQ ID NO: 10485 - RNA, 24 nt, Human
cagaauccccgcguagccgcugcu

SEQ ID NO: 10486 - RNA, 22 nt, Human
cagaaucuguuuuuucccaagc

SEQ ID NO: 10487 - RNA, 22 nt, Human
cagacugaggauguccuggagg

SEQ ID NO: 10488 - RNA, 22 nt, Human
cagagauccagaaaguggguag

SEQ ID NO: 10489 - RNA, 24 nt, Human
cagagcuaggagaaggagaggggg

SEQ ID NO: 10490 - RNA, 24 nt, Human
cagaggacucagaggggaucaguc

SEQ ID NO: 10491 - RNA, 22 nt, Human
cagaggaugcggcugggaacgg

SEQ ID NO: 10492 - RNA, 22 nt, Human
cagagucuccagccacuacuuc

SEQ ID NO: 10493 - RNA, 24 nt, Human
cagagugcugaagacgggguagcc

SEQ ID NO: 10494 - RNA, 22 nt, Human
cagaugaagaagaugaagcccg

SEQ ID NO: 10495 - RNA, 22 nt, Human
cagauggccauuauguagguuu

SEQ ID NO: 10496 - RNA, 24 nt, Human
cagcaacccacaguagguaggaaa

SEQ ID NO: 10497 - RNA, 24 nt, Human
cagcacaacugucaaugcagguca

SEQ ID NO: 10498 - RNA, 22 nt, Human
cagcacagcuggguucugugcu

SEQ ID NO: 10499 - RNA, 24 nt, Human
cagcacaggaaccugggcaggcag

SEQ ID NO: 10500 - RNA, 24 nt, Human
cagcaccgugguuugugguuagcu

SEQ ID NO: 10501 - RNA, 24 nt, Human
cagcagaaccugugucaggccgcu

SEQ ID NO: 10502 - RNA, 21 nt, Human
cagcagauuacucgggauuuc

SEQ ID NO: 10503 - RNA, 24 nt, Human
cagcagcaagaaggggugcaggug

SEQ ID NO: 10504 - RNA, 24 nt, Human
cagcagcaggcaaaagaggucagc

SEQ ID NO: 10505 - RNA, 24 nt, Human
cagcagcagggaggggaggacugg

SEQ ID NO: 10506 - RNA, 24 nt, Human
cagcagccacagcagccgcuucug

SEQ ID NO: 10507 - RNA, 24 nt, Human
cagcagcccaagcugucaggaucu

SEQ ID NO: 10508 - RNA, 18 nt, Human
cagcagccggaguguggc

SEQ ID NO: 10509 - RNA, 24 nt, Human
cagcagccucaacaguaugguauu

SEQ ID NO: 10510 - RNA, 24 nt, Human
cagcagcgagaggacgcgucacuc

SEQ ID NO: 10511 - RNA, 24 nt, Human
cagcaggaagugcuggugaccccg

SEQ ID NO: 10512 - RNA, 24 nt, Human
cagcaggaucccguugagcugccc

SEQ ID NO: 10513 - RNA, 21 nt, Human
cagcaggguggacaaauaagc

SEQ ID NO: 10514 - RNA, 24 nt, Human
cagcaguaccaacaccugcccucg

SEQ ID NO: 10515 - RNA, 24 nt, Human
cagcaguaggggcugggcuuccag

SEQ ID NO: 10516 - RNA, 23 nt, Human
cagcaguaugcaucugaucugag

SEQ ID NO: 10517 - RNA, 24 nt, Human
cagcauaacuucagaguaagggua

SEQ ID NO: 10518 - RNA, 24 nt, Human
cagcauccacuguucugcccagua

SEQ ID NO: 10519 - RNA, 23 nt, Human
cagcaucugcacauauuuccugc

SEQ ID NO: 10520 - RNA, 24 nt, Human
cagcauggaggacugugacugaug

SEQ ID NO: 10521 - RNA, 21 nt, Human
cagccagccgcggggcguccc

SEQ ID NO: 10522 - RNA, 22 nt, Human
cagccauauuuuucuucucgca

SEQ ID NO: 10523 - RNA, 24 nt, Human
cagcccagagacacgugugcaccu

SEQ ID NO: 10524 - RNA, 24 nt, Human
cagccgcugccagcccugcuccug

SEQ ID NO: 10525 - RNA, 24 nt, Human
cagccuccaagcugggggaguuug

SEQ ID NO: 10526 - RNA, 24 nt, Human
cagccuccugcucucccgagggcu

SEQ ID NO: 10527 - RNA, 24 nt, Human
cagccuggcccucaccggucgccc

SEQ ID NO: 10528 - RNA, 24 nt, Human
cagccuuagauuuuauauuuggau

SEQ ID NO: 10529 - RNA, 22 nt, Human
cagccuuauccucagggucuga

SEQ ID NO: 10530 - RNA, 24 nt, Human
cagccuuucuugccugagagaaga

SEQ ID NO: 10531 - RNA, 23 nt, Human
cagcgcaggaauaucucuggaag

SEQ ID NO: 10532 - RNA, 24 nt, Human
cagcgccgcgucuuccagcccucg

SEQ ID NO: 10533 - RNA, 24 nt, Human
cagcggccccccuccagguccccg

SEQ ID NO: 10534 - RNA, 22 nt, Human
cagcgugugagcuuccaaauaa

SEQ ID NO: 10535 - RNA, 22 nt, Human
cagcuaauuuuuguauuuuugg

SEQ ID NO: 10536 - RNA, 22 nt, Human
cagcuacuuucgcuucuacuua

SEQ ID NO: 10537 - RNA, 22 nt, Human
cagcuauucaggagcuugaggu

SEQ ID NO: 10538 - RNA, 24 nt, Human
cagcucagaccucguaacgcgacg

SEQ ID NO: 10539 - RNA, 24 nt, Human
cagcuccaccccucacuaacuguu

SEQ ID NO: 10540 - RNA, 24 nt, Human
cagcuccuaguggagaccucgggc

SEQ ID NO: 10541 - RNA, 24 nt, Human
cagcugaaucagaaccacacacuu

SEQ ID NO: 10542 - RNA, 23 nt, Human
cagcugacauuuaggagggcuuu

SEQ ID NO: 10543 - RNA, 24 nt, Human
cagcugcaucugcgccaccugcug

SEQ ID NO: 10544 - RNA, 24 nt, Human
cagcugguccugacucguggagau

SEQ ID NO: 10545 - RNA, 24 nt, Human
cagcugguuaauuuuucuccaaua

SEQ ID NO: 10546 - RNA, 24 nt, Human
cagcuguaacuuucuuugacugug

SEQ ID NO: 10547 - RNA, 24 nt, Human
cagcuucaccaacacggccgagcg

SEQ ID NO: 10548 - RNA, 24 nt, Human
cagcuucaccaccacggccgagcg

SEQ ID NO: 10549 - RNA, 24 nt, Human
cagcuuccuuuccuguguguacuc

SEQ ID NO: 10550 - RNA, 22 nt, Human
caggaacacaaugagucucaaa

SEQ ID NO: 10551 - RNA, 24 nt, Human
caggacccucugugacauucuuua

SEQ ID NO: 10552 - RNA, 20 nt, Human
caggagccagcgaggcagag

SEQ ID NO: 10553 - RNA, 23 nt, Human
caggagucagaugaggaccauua

SEQ ID NO: 10554 - RNA, 24 nt, Human
caggaucgcgaggcagcagcgacc

SEQ ID NO: 10555 - RNA, 24 nt, Human
caggccaagauaagggcccugaag

SEQ ID NO: 10556 - RNA, 24 nt, Human
caggcccaucgucggaggguucag

SEQ ID NO: 10557 - RNA, 24 nt, Human
caggcccccuccacucggccuucu

SEQ ID NO: 10558 - RNA, 22 nt, Human
caggcuggagugcaguggugcg

SEQ ID NO: 10559 - RNA, 22 nt, Human
caggcuuccugcagacuguaua

SEQ ID NO: 10560 - RNA, 24 nt, Human
cagggcccaggugcugucuuccug

SEQ ID NO: 10561 - RNA, 24 nt, Human
caggggcugguaggaguacgcagu

SEQ ID NO: 10562 - RNA, 22 nt, Human
caggggguaaagugucauccuu

SEQ ID NO: 10563 - RNA, 22 nt, Human
caggguaaugcauuugcaagga

SEQ ID NO: 10564 - RNA, 24 nt, Human
caggguacaggcucgcaccugggg

SEQ ID NO: 10565 - RNA, 22 nt, Human
caggguuagaugacugcgggaa

SEQ ID NO: 10566 - RNA, 22 nt, Human
cagguauaugugugucuaauac

SEQ ID NO: 10567 - RNA, 23 nt, Human
caggucacaggucaccaugggga

SEQ ID NO: 10568 - RNA, 24 nt, Human
caggugaagagugagguugucaug

SEQ ID NO: 10569 - RNA, 24 nt, Human
caggugccucugccccacgcggug

SEQ ID NO: 10570 - RNA, 22 nt, Human
cagguggucuccucugacuuca

SEQ ID NO: 10571 - RNA, 24 nt, Human
caguacaugcuuuuuaaugggacc

SEQ ID NO: 10572 - RNA, 22 nt, Human
caguacgcccaguuccacugga

SEQ ID NO: 10573 - RNA, 22 nt, Human
caguagaguaacgugcuauaca

SEQ ID NO: 10574 - RNA, 22 nt, Human
caguagaugucuguacuaucau

SEQ ID NO: 10575 - RNA, 24 nt, Human
caguagccugggguuggugcagag

SEQ ID NO: 10576 - RNA, 22 nt, Human
caguagguguuaguaugguugc

SEQ ID NO: 10577 - RNA, 22 nt, Human
caguaucuccgugauuaccuuc

SEQ ID NO: 10578 - RNA, 24 nt, Human
caguaugagaacuugaaagcugca

SEQ ID NO: 10579 - RNA, 24 nt, Human
cagucugugcugaggaccucaggg

SEQ ID NO: 10580 - RNA, 21 nt, Human
cagucuuuuucucucucacuu

SEQ ID NO: 10581 - RNA, 24 nt, Human
cagugcucuucgccagaaguuggc

SEQ ID NO: 10582 - RNA, 22 nt, Human
cagugcugaguaugaaaggccc

SEQ ID NO: 10583 - RNA, 24 nt, Human
caguggaccugccucggauagcag

SEQ ID NO: 10584 - RNA, 21 nt, Human
caguguaccagaacauaugua

SEQ ID NO: 10585 - RNA, 22 nt, Human
caguguaucauuagugugauga

SEQ ID NO: 10586 - RNA, 24 nt, Human
caguguccgcugcagccagucgga

SEQ ID NO: 10587 - RNA, 22 nt, Human
cagugucuugucaaaucuagcu

SEQ ID NO: 10588 - RNA, 18 nt, Human
caguucagaagccaggcu

SEQ ID NO: 10589 - RNA, 24 nt, Human
cauacuuuucuagcuaccuucugc

SEQ ID NO: 10590 - RNA, 22 nt, Human
cauaucuccagguucugcugga

SEQ ID NO: 10591 - RNA, 22 nt, Human
caucaauuaacuucuacagugg

SEQ ID NO: 10592 - RNA, 24 nt, Human
caucaggaugcaucacgaucauua

SEQ ID NO: 10593 - RNA, 22 nt, Human
caucauagucuauuucuugcua

SEQ ID NO: 10594 - RNA, 24 nt, Human
cauccauuguucagcuugaugucu

SEQ ID NO: 10595 - RNA, 22 nt, Human
caucccagcaguguugaucagu

SEQ ID NO: 10596 - RNA, 24 nt, Human
cauccuguuccacaauccugagua

SEQ ID NO: 10597 - RNA, 24 nt, Human
caucguggcugaggugcuggugcu

SEQ ID NO: 10598 - RNA, 22 nt, Human
caucucagguuuguucugagac

SEQ ID NO: 10599 - RNA, 24 nt, Human
caucucaguccuauuuuugaguuu

SEQ ID NO: 10600 - RNA, 24 nt, Human
caucuccuucccagccacuggcug

SEQ ID NO: 10601 - RNA, 23 nt, Human
caucugcaaucugggccccauuu

SEQ ID NO: 10602 - RNA, 24 nt, Human
caucugcacugccaagacugagug

SEQ ID NO: 10603 - RNA, 24 nt, Human
caucugcugccuacauuccugcuc

SEQ ID NO: 10604 - RNA, 22 nt, Human
caucugguccucagacauggga

SEQ ID NO: 10605 - RNA, 24 nt, Human
caucugguucagacucugcucauc

SEQ ID NO: 10606 - RNA, 24 nt, Human
caucuucaaaagacugggacugcu

SEQ ID NO: 10607 - RNA, 22 nt, Human
caucuuccaauagagaucacug

SEQ ID NO: 10608 - RNA, 22 nt, Human
caucuugaaacugcugcagcca

SEQ ID NO: 10609 - RNA, 24 nt, Human
caucuuuuucugaccuguaugaug

SEQ ID NO: 10610 - RNA, 24 nt, Human
caugaaggaagaagugggguuccu

SEQ ID NO: 10611 - RNA, 24 nt, Human
caugagaauuuggaaugacaguau

SEQ ID NO: 10612 - RNA, 23 nt, Human
caugagcauaacacgcacgggca

SEQ ID NO: 10613 - RNA, 24 nt, Human
caugaggccgcgccuguguccagc

SEQ ID NO: 10614 - RNA, 24 nt, Human
caugauccucgcuuacugacuucc

SEQ ID NO: 10615 - RNA, 24 nt, Human
caugcccccuuuggcuugggggcc

SEQ ID NO: 10616 - RNA, 24 nt, Human
cauggcacaucgggcuauuugaac

SEQ ID NO: 10617 - RNA, 24 nt, Human
cauggcacuuacccaagcaccgaa

SEQ ID NO: 10618 - RNA, 18 nt, Human
cauggcccagcccugggg

SEQ ID NO: 10619 - RNA, 24 nt, Human
cauggcccguguguggggacuugc

SEQ ID NO: 10620 - RNA, 24 nt, Human
cauggcgucuaguucuggagaucu

SEQ ID NO: 10621 - RNA, 24 nt, Human
caugggaagccacuuugacaggca

SEQ ID NO: 10622 - RNA, 22 nt, Human
caugguacugccacagaagagu

SEQ ID NO: 10623 - RNA, 24 nt, Human
cauguaaccucggggucugaggcc

SEQ ID NO: 10624 - RNA, 22 nt, Human
caugucccgugguuccagcgcc

SEQ ID NO: 10625 - RNA, 24 nt, Human
caugugaacgcuacuuaugugaac

SEQ ID NO: 10626 - RNA, 24 nt, Human
cauguugugcacguguacccuaga

SEQ ID NO: 10627 - RNA, 22 nt, Human
cauguuuguuguguacauaugu

SEQ ID NO: 10628 - RNA, 24 nt, Human
cauuaacuuuaaacauggucugcg

SEQ ID NO: 10629 - RNA, 24 nt, Human
cauuacuuuuaaccaaaacauuca

SEQ ID NO: 10630 - RNA, 24 nt, Human
cauuaucucuuuaccaguauuaaa

SEQ ID NO: 10631 - RNA, 24 nt, Human
cauucagagacagaguuucaccgu

SEQ ID NO: 10632 - RNA, 22 nt, Human
cauucgcuugucccggcuuacu

SEQ ID NO: 10633 - RNA, 24 nt, Human
cauucgggagaucuuccggaccaa

SEQ ID NO: 10634 - RNA, 24 nt, Human
cauugaaacuucccccaaaucuga

SEQ ID NO: 10635 - RNA, 23 nt, Human
cauugauaucugcaucaugcugc

SEQ ID NO: 10636 - RNA, 22 nt, Human
cauugcaccguuuuagugagaa

SEQ ID NO: 10637 - RNA, 22 nt, Human
cauugcacuccacccuaggcaa

SEQ ID NO: 10638 - RNA, 24 nt, Human
cauugcacuccacccugggcaaca

SEQ ID NO: 10639 - RNA, 22 nt, Human
cauugcacuccagccugggcaa

SEQ ID NO: 10640 - RNA, 24 nt, Human
cauugcacuccagccugggcaaca

SEQ ID NO: 10641 - RNA, 24 nt, Human
cauugcacuccagccugggugaaa

SEQ ID NO: 10642 - RNA, 24 nt, Human
cauugcacuccagccuggucaaca

SEQ ID NO: 10643 - RNA, 24 nt, Human
cauugcacuccggccugggcaaca

SEQ ID NO: 10644 - RNA, 24 nt, Human
cauugcccagaguugcacuugcug

SEQ ID NO: 10645 - RNA, 24 nt, Human
cauugcuuaagacaguagaacaca

SEQ ID NO: 10646 - RNA, 22 nt, Human
cauugcuuugcgaauucuuaug

SEQ ID NO: 10647 - RNA, 22 nt, Human
cauuggaauucugaaggcuuga

SEQ ID NO: 10648 - RNA, 24 nt, Human
cauuguggcuggaggugcuggugc

SEQ ID NO: 10649 - RNA, 24 nt, Human
cauugugggcuacguggaaacccu

SEQ ID NO: 10650 - RNA, 24 nt, Human
cauuucgccauguugcccagcacu

SEQ ID NO: 10651 - RNA, 24 nt, Human
cauuuggguguaaagcaguaaaug

SEQ ID NO: 10652 - RNA, 23 nt, Human
ccaacauugugaaaccccgucuc

SEQ ID NO: 10653 - RNA, 24 nt, Human
ccaacgcgaugcuugguaugccgg

SEQ ID NO: 10654 - RNA, 24 nt, Human
ccaagggggccuuggccgggcggg

SEQ ID NO: 10655 - RNA, 24 nt, Human
ccacaagugaaaaacaugguucag

SEQ ID NO: 10656 - RNA, 22 nt, Human
ccacagugauucacuuuugaag

SEQ ID NO: 10657 - RNA, 22 nt, Human
ccacaugagcucaagagauccu

SEQ ID NO: 10658 - RNA, 18 nt, Human
ccacauguuguucccagg

SEQ ID NO: 10659 - RNA, 24 nt, Human
ccaccagagcauggcuguaggggc

SEQ ID NO: 10660 - RNA, 24 nt, Human
ccaccagcaggcugggaugguguu

SEQ ID NO: 10661 - RNA, 22 nt, Human
ccacgccucucugaccacuuuu

SEQ ID NO: 10662 - RNA, 24 nt, Human
ccacggccgcggugcauguucgcc

SEQ ID NO: 10663 - RNA, 24 nt, Human
ccacugcacuccacccugggcaac

SEQ ID NO: 10664 - RNA, 22 nt, Human
ccacugcacuccagcacuccag

SEQ ID NO: 10665 - RNA, 24 nt, Human
ccacugcacuccagccuggcgacu

SEQ ID NO: 10666 - RNA, 24 nt, Human
ccacugcacuccagccugggcaag

SEQ ID NO: 10667 - RNA, 24 nt, Human
ccacugcacuccagccugggcgac

SEQ ID NO: 10668 - RNA, 24 nt, Human
ccacugggauagcuccugcaagua

SEQ ID NO: 10669 - RNA, 24 nt, Human
ccacugggcgaguaucuggaggag

SEQ ID NO: 10670 - RNA, 22 nt, Human
ccagaaacagaggaagaagaag

SEQ ID NO: 10671 - RNA, 24 nt, Human
ccagaacacagucacgaggauaau

SEQ ID NO: 10672 - RNA, 24 nt, Human
ccagaaccuucuucuuguccgacu

SEQ ID NO: 10673 - RNA, 24 nt, Human
ccagaagcaccuagcagagcugaa

SEQ ID NO: 10674 - RNA, 24 nt, Human
ccagacagcccuaccugugccaga

SEQ ID NO: 10675 - RNA, 22 nt, Human
ccagaggugagucuugauuuug

SEQ ID NO: 10676 - RNA, 24 nt, Human
ccagcaccaugccguccaugcugc

SEQ ID NO: 10677 - RNA, 24 nt, Human
ccagcacccuugacgucugggucc

SEQ ID NO: 10678 - RNA, 24 nt, Human
ccagccaacaggaugggaggaagg

SEQ ID NO: 10679 - RNA, 24 nt, Human
ccagccuagccuuguggggagcaa

SEQ ID NO: 10680 - RNA, 24 nt, Human
ccagccuucgagagcuaugagucc

SEQ ID NO: 10681 - RNA, 23 nt, Human
ccagcgaauuacaggcggcggaa

SEQ ID NO: 10682 - RNA, 22 nt, Human
ccaggaggaauuggaaagaaga

SEQ ID NO: 10683 - RNA, 24 nt, Human
ccaggcaaggcaaagugauggugg

SEQ ID NO: 10684 - RNA, 22 nt, Human
ccaggcaggaacaccuuuugcu

SEQ ID NO: 10685 - RNA, 24 nt, Human
ccaggccaaaaaggcucaacauuu

SEQ ID NO: 10686 - RNA, 24 nt, Human
ccaggccacggugcuucuaguguc

SEQ ID NO: 10687 - RNA, 22 nt, Human
ccaggcuggaggagugcagugg

SEQ ID NO: 10688 - RNA, 22 nt, Human
ccagggaacacucaguuucccu

SEQ ID NO: 10689 - RNA, 24 nt, Human
ccagggagucaucaagcauuggag

SEQ ID NO: 10690 - RNA, 24 nt, Human
ccaggguggccacggguggugagg

SEQ ID NO: 10691 - RNA, 22 nt, Human
ccauaagauuauaauggagcau

SEQ ID NO: 10692 - RNA, 22 nt, Human
ccauauuauggggaaaaaacug

SEQ ID NO: 10693 - RNA, 22 nt, Human
ccaucgugaauguauugagcca

SEQ ID NO: 10694 - RNA, 22 nt, Human
ccaucucucuaaguucucuuau

SEQ ID NO: 10695 - RNA, 22 nt, Human
ccauggucucacacuagugcug

SEQ ID NO: 10696 - RNA, 22 nt, Human
ccaugucuuaaccagcaggugu

SEQ ID NO: 10697 - RNA, 22 nt, Human
ccauucacaacuucguggaggu

SEQ ID NO: 10698 - RNA, 24 nt, Human
cccaagagcucccuuggcccuguu

SEQ ID NO: 10699 - RNA, 22 nt, Human
cccaagagguggagguugcagu

SEQ ID NO: 10700 - RNA, 24 nt, Human
cccaaguagcugggauuacaggcu

SEQ ID NO: 10701 - RNA, 24 nt, Human
cccacaguucugagacaagcuuua

SEQ ID NO: 10702 - RNA, 22 nt, Human
cccagcuggggagaaccauuac

SEQ ID NO: 10703 - RNA, 22 nt, Human
cccaggagauggaaguugcagu

SEQ ID NO: 10704 - RNA, 22 nt, Human
cccaggaggcggagguugcagu

SEQ ID NO: 10705 - RNA, 22 nt, Human
cccaggagguggagguugcagu

SEQ ID NO: 10706 - RNA, 24 nt, Human
cccaggagugucugcccuacgcgg

SEQ ID NO: 10707 - RNA, 22 nt, Human
cccauccguggcaagccgguag

SEQ ID NO: 10708 - RNA, 22 nt, Human
cccaugaccucagauguuuauc

SEQ ID NO: 10709 - RNA, 22 nt, Human
cccaugcagcaaaugcuacgca

SEQ ID NO: 10710 - RNA, 22 nt, Human
cccauuauaaauaaaggguggu

SEQ ID NO: 10711 - RNA, 22 nt, Human
ccccaaggagcagugggcuuug

SEQ ID NO: 10712 - RNA, 22 nt, Human
ccccaccccaguggagcucacc

SEQ ID NO: 10713 - RNA, 24 nt, Human
ccccaggucgcaggugucugaggc

SEQ ID NO: 10714 - RNA, 24 nt, Human
ccccagguuugcuuccucuguccc

SEQ ID NO: 10715 - RNA, 24 nt, Human
ccccaguagaagugaugggcugcu

SEQ ID NO: 10716 - RNA, 22 nt, Human
ccccagucaaugcuucucucca

SEQ ID NO: 10717 - RNA, 24 nt, Human
ccccagucucggagagcaacagaa

SEQ ID NO: 10718 - RNA, 24 nt, Human
ccccaguuguccccuggaguuugg

SEQ ID NO: 10719 - RNA, 24 nt, Human
ccccccgugcccugggccacugug

SEQ ID NO: 10720 - RNA, 22 nt, Human
ccccccuuuucaacuuuccuac

SEQ ID NO: 10721 - RNA, 24 nt, Human
cccccggacaugcuggcagagcag

SEQ ID NO: 10722 - RNA, 24 nt, Human
cccccgguaacaggcccaggcggu

SEQ ID NO: 10723 - RNA, 24 nt, Human
cccccuggaggggcagggcaggca

SEQ ID NO: 10724 - RNA, 24 nt, Human
ccccgcagguccgggcacuagcac

SEQ ID NO: 10725 - RNA, 24 nt, Human
ccccggccagcccgccugagauga

SEQ ID NO: 10726 - RNA, 24 nt, Human
ccccgggaagucagaaaucgauca

SEQ ID NO: 10727 - RNA, 24 nt, Human
ccccgguuuucuuuguuccaaggg

SEQ ID NO: 10728 - RNA, 24 nt, Human
ccccucggccuccaggugaggcug

SEQ ID NO: 10729 - RNA, 24 nt, Human
ccccugagggagaggaaaggugaa

SEQ ID NO: 10730 - RNA, 24 nt, Human
ccccuguagcccaggacuaugcug

SEQ ID NO: 10731 - RNA, 24 nt, Human
ccccugugcaccguggacguguga

SEQ ID NO: 10732 - RNA, 24 nt, Human
ccccuuuucaacauaagcucucug

SEQ ID NO: 10733 - RNA, 24 nt, Human
cccgcuccguggccuccuuccucc

SEQ ID NO: 10734 - RNA, 22 nt, Human
cccgcugcuauugauaaggucg

SEQ ID NO: 10735 - RNA, 24 nt, Human
cccgcugggggcuguugggggccc

SEQ ID NO: 10736 - RNA, 24 nt, Human
cccgggguccggccucucacucgc

SEQ ID NO: 10737 - RNA, 24 nt, Human
cccgugccggagccgcccaaggag

SEQ ID NO: 10738 - RNA, 24 nt, Human
cccgugcgcccgcgccuguccugg

SEQ ID NO: 10739 - RNA, 24 nt, Human
cccguuaggacagaagaggcuuuu

SEQ ID NO: 10740 - RNA, 22 nt, Human
cccuauaaaacugauuuguguu

SEQ ID NO: 10741 - RNA, 22 nt, Human
cccuccguuuaaggcugugguc

SEQ ID NO: 10742 - RNA, 24 nt, Human
cccugagugagcaccugguuacca

SEQ ID NO: 10743 - RNA, 22 nt, Human
cccugaucuugcuaucccagca

SEQ ID NO: 10744 - RNA, 22 nt, Human
cccuggagguggagguugcagu

SEQ ID NO: 10745 - RNA, 22 nt, Human
cccugucaucucugcugagaaa

SEQ ID NO: 10746 - RNA, 24 nt, Human
ccgaagauacucaagagcucccaa

SEQ ID NO: 10747 - RNA, 24 nt, Human
ccgcaaguuccugguguuuguggc

SEQ ID NO: 10748 - RNA, 22 nt, Human
ccgcagccgcuggcccaggugc

SEQ ID NO: 10749 - RNA, 24 nt, Human
ccgcagcugcuugccguuaagccg

SEQ ID NO: 10750 - RNA, 24 nt, Human
ccgcaggcuccaagguccgagguc

SEQ ID NO: 10751 - RNA, 24 nt, Human
ccgcaggcugaucccgccguccac

SEQ ID NO: 10752 - RNA, 24 nt, Human
ccgccagccuucacagcggguucu

SEQ ID NO: 10753 - RNA, 20 nt, Human
ccgcccaugcugcuggcgcu

SEQ ID NO: 10754 - RNA, 24 nt, Human
ccgccgccaugacugagcagauga

SEQ ID NO: 10755 - RNA, 19 nt, Human
ccgccuggacagccugcac

SEQ ID NO: 10756 - RNA, 24 nt, Human
ccgcugggcggccauggccacggc

SEQ ID NO: 10757 - RNA, 24 nt, Human
ccgcuggugcuguggucgagugac

SEQ ID NO: 10758 - RNA, 23 nt, Human
ccgcuguggugacuccgacgugc

SEQ ID NO: 10759 - RNA, 22 nt, Human
ccggaaagcauuggggaugacg

SEQ ID NO: 10760 - RNA, 24 nt, Human
ccggaagcuggcacugggcccgcc

SEQ ID NO: 10761 - RNA, 24 nt, Human
ccggacucuauggggcgggacccu

SEQ ID NO: 10762 - RNA, 24 nt, Human
ccggccccgccguuccgacccccg

SEQ ID NO: 10763 - RNA, 24 nt, Human
ccgggcccucucucccacuuuuuc

SEQ ID NO: 10764 - RNA, 22 nt, Human
ccggggcuguugguacuguuuu

SEQ ID NO: 10765 - RNA, 24 nt, Human
ccgggggugugggccccgggcagg

SEQ ID NO: 10766 - RNA, 24 nt, Human
ccggucccccgaggguggcucgga

SEQ ID NO: 10767 - RNA, 24 nt, Human
ccgguccugggcuuaucccugcaa

SEQ ID NO: 10768 - RNA, 24 nt, Human
ccggugcgggcgcccgcggagagg

SEQ ID NO: 10769 - RNA, 22 nt, Human
ccguaaaauguucaaauguuuu

SEQ ID NO: 10770 - RNA, 24 nt, Human
ccguguauguucagaacgugguca

SEQ ID NO: 10771 - RNA, 22 nt, Human
ccguucuguauuuaugucgcca

SEQ ID NO: 10772 - RNA, 24 nt, Human
ccuaaaacaguucuguauauucuu

SEQ ID NO: 10773 - RNA, 24 nt, Human
ccuaaccccuggcuccauggaggu

SEQ ID NO: 10774 - RNA, 24 nt, Human
ccuacaaucccagcaauuuaggag

SEQ ID NO: 10775 - RNA, 24 nt, Human
ccuagcucugacugcccguggugg

SEQ ID NO: 10776 - RNA, 24 nt, Human
ccuauagccaauauaagcagucac

SEQ ID NO: 10777 - RNA, 24 nt, Human
ccucaagauguugcaaaggagcug

SEQ ID NO: 10778 - RNA, 22 nt, Human
ccucaaggcgggaguugccggc

SEQ ID NO: 10779 - RNA, 24 nt, Human
ccucaaugauguuugcaaaggagc

SEQ ID NO: 10780 - RNA, 22 nt, Human
ccucauggacugaguucuggga

SEQ ID NO: 10781 - RNA, 24 nt, Human
ccuccagcuagucauccguaacga

SEQ ID NO: 10782 - RNA, 24 nt, Human
ccuccaggucaccuuggcuugcug

SEQ ID NO: 10783 - RNA, 24 nt, Human
ccuccauuccauuuaguuuccacc

SEQ ID NO: 10784 - RNA, 24 nt, Human
ccucccagcauucggguagugguc

SEQ ID NO: 10785 - RNA, 22 nt, Human
ccucccccuacaccccccaaca

SEQ ID NO: 10786 - RNA, 24 nt, Human
ccucccgucacuccacgcagcugg

SEQ ID NO: 10787 - RNA, 22 nt, Human
ccuccucucugucuucauuaug

SEQ ID NO: 10788 - RNA, 22 nt, Human
ccuccuuucaucaaauucgagu

SEQ ID NO: 10789 - RNA, 22 nt, Human
ccucgcgccgccuggggccacg

SEQ ID NO: 10790 - RNA, 24 nt, Human
ccucggcagggaggaugacggagc

SEQ ID NO: 10791 - RNA, 24 nt, Human
ccucggugauguggaugugaauga

SEQ ID NO: 10792 - RNA, 22 nt, Human
ccucucccuaagcaguagcaag

SEQ ID NO: 10793 - RNA, 24 nt, Human
ccucuccgguguggggcgcccgcg

SEQ ID NO: 10794 - RNA, 22 nt, Human
ccucugaagucuuacuuggaag

SEQ ID NO: 10795 - RNA, 24 nt, Human
ccucugcuuucauuucuaugguua

SEQ ID NO: 10796 - RNA, 22 nt, Human
ccucuuccagcaaccacagaua

SEQ ID NO: 10797 - RNA, 22 nt, Human
ccucuuuuccuuccuccucuuu

SEQ ID NO: 10798 - RNA, 24 nt, Human
ccugaaaggcaggguucuguggaa

SEQ ID NO: 10799 - RNA, 24 nt, Human
ccugaagcauuacagugacuuccu

SEQ ID NO: 10800 - RNA, 24 nt, Human
ccugaaggcaaggccacgggagac

SEQ ID NO: 10801 - RNA, 24 nt, Human
ccugaccucaggugaucugccugc

SEQ ID NO: 10802 - RNA, 24 nt, Human
ccugcaacuuaaaugaacaagcuu

SEQ ID NO: 10803 - RNA, 24 nt, Human
ccugcaaucccagcacuuagggag

SEQ ID NO: 10804 - RNA, 24 nt, Human
ccugcacaggucgcaucaagaagg

SEQ ID NO: 10805 - RNA, 24 nt, Human
ccugcacauugccagacuuccaaa

SEQ ID NO: 10806 - RNA, 24 nt, Human
ccugcacuacugacaauggagcag

SEQ ID NO: 10807 - RNA, 24 nt, Human
ccugcagcuucgagccaaugguga

SEQ ID NO: 10808 - RNA, 24 nt, Human
ccugcaggucucgggggugacgcu

SEQ ID NO: 10809 - RNA, 24 nt, Human
ccugcauugggcaccaaguaucca

SEQ ID NO: 10810 - RNA, 22 nt, Human
ccugccauaaaguugauaggcu

SEQ ID NO: 10811 - RNA, 22 nt, Human
ccugcccauccugccuccacca

SEQ ID NO: 10812 - RNA, 24 nt, Human
ccugccgccggaauccugaagccc

SEQ ID NO: 10813 - RNA, 24 nt, Human
ccugccguugcccugagcugcagc

SEQ ID NO: 10814 - RNA, 24 nt, Human
ccugccucaugagggcuccaaugu

SEQ ID NO: 10815 - RNA, 24 nt, Human
ccugccugauguuucugucucaga

SEQ ID NO: 10816 - RNA, 24 nt, Human
ccugccuggugacagcuucuacau

SEQ ID NO: 10817 - RNA, 24 nt, Human
ccugccuuaauucuagaaucagcu

SEQ ID NO: 10818 - RNA, 24 nt, Human
ccugcgccucaccgaggccgacua

SEQ ID NO: 10819 - RNA, 24 nt, Human
ccuggacaacagaccucuguuugg

SEQ ID NO: 10820 - RNA, 24 nt, Human
ccuggagagaaggcugugaggcag

SEQ ID NO: 10821 - RNA, 22 nt, Human
ccuggagguggagguugcagug

SEQ ID NO: 10822 - RNA, 24 nt, Human
ccuggcaggcuuuggugacucuag

SEQ ID NO: 10823 - RNA, 22 nt, Human
ccuggcugcacauuggaagcac

SEQ ID NO: 10824 - RNA, 24 nt, Human
ccuggcuuguccuucccagaaggu

SEQ ID NO: 10825 - RNA, 22 nt, Human
ccugggaaguggagguugcagu

SEQ ID NO: 10826 - RNA, 22 nt, Human
ccugggagguggggauugcagu

SEQ ID NO: 10827 - RNA, 22 nt, Human
ccugggggcaaaaugucuaacu

SEQ ID NO: 10828 - RNA, 22 nt, Human
ccugggggccacuuugcacagg

SEQ ID NO: 10829 - RNA, 22 nt, Human
ccuggguaguaguuaguugaca

SEQ ID NO: 10830 - RNA, 22 nt, Human
ccuguaaucucagcuacucagg

SEQ ID NO: 10831 - RNA, 24 nt, Human
ccugucuaaccucuucuguggagu

SEQ ID NO: 10832 - RNA, 24 nt, Human
ccugucuuggucuaaacauguuga

SEQ ID NO: 10833 - RNA, 22 nt, Human
ccugugagugcccucagcccua

SEQ ID NO: 10834 - RNA, 24 nt, Human
ccuguggacagcaggaugauugag

SEQ ID NO: 10835 - RNA, 24 nt, Human
ccuguguacucauaauuauugaga

SEQ ID NO: 10836 - RNA, 24 nt, Human
ccuuaugugguucauuccuucaau

SEQ ID NO: 10837 - RNA, 24 nt, Human
ccuuauuguuuggggcaaagggcc

SEQ ID NO: 10838 - RNA, 24 nt, Human
ccuucccaacaguugcgcagccug

SEQ ID NO: 10839 - RNA, 24 nt, Human
ccuugagucucggcuucgguccca

SEQ ID NO: 10840 - RNA, 24 nt, Human
ccuugcaagcgacggcgccaugag

SEQ ID NO: 10841 - RNA, 24 nt, Human
ccuugcucaucuccuugugcccuu

SEQ ID NO: 10842 - RNA, 24 nt, Human
ccuugcucuguggcuuuucccaac

SEQ ID NO: 10843 - RNA, 24 nt, Human
ccuugcucuguugcucaggcugaa

SEQ ID NO: 10844 - RNA, 24 nt, Human
ccuuugguuucugccggccucggg

SEQ ID NO: 10845 - RNA, 24 nt, Human
cgacgcguucauugcagccggcga

SEQ ID NO: 10846 - RNA, 24 nt, Human
cgacggaaagaucggggaaacucc

SEQ ID NO: 10847 - RNA, 22 nt, Human
cgacucuugaccauggcugggg

SEQ ID NO: 10848 - RNA, 24 nt, Human
cgacuggugaggacaaguggagcc

SEQ ID NO: 10849 - RNA, 24 nt, Human
cgagaggcacagaaggagcuggag

SEQ ID NO: 10850 - RNA, 24 nt, Human
cgagcagccucucgccauuucccg

SEQ ID NO: 10851 - RNA, 23 nt, Human
cgagcagcucagaccaugucgcc

SEQ ID NO: 10852 - RNA, 24 nt, Human
cgagcgggcgcuggcaccgaggcc

SEQ ID NO: 10853 - RNA, 24 nt, Human
cgagggcaacgugguaaacugggg

SEQ ID NO: 10854 - RNA, 24 nt, Human
cgagggcgacgugugggccuucgc

SEQ ID NO: 10855 - RNA, 24 nt, Human
cgaggugggccaucacacucugcu

SEQ ID NO: 10856 - RNA, 24 nt, Human
cgagguuuuuccuagggcugucug

SEQ ID NO: 10857 - RNA, 22 nt, Human
cgcaggucaggcacugcucuga

SEQ ID NO: 10858 - RNA, 24 nt, Human
cgccccaggcaccagggcgugaug

SEQ ID NO: 10859 - RNA, 24 nt, Human
cgccgggacagcagacugccggua

SEQ ID NO: 10860 - RNA, 24 nt, Human
cgccugggcacuugggcuccgggc

SEQ ID NO: 10861 - RNA, 24 nt, Human
cgcggagcccugcgagccgcgggu

SEQ ID NO: 10862 - RNA, 22 nt, Human
cgcuauguuggccaggcugguc

SEQ ID NO: 10863 - RNA, 22 nt, Human
cgcucgaggauugcuguuuuca

SEQ ID NO: 10864 - RNA, 22 nt, Human
cgcugcugucuggguucuuuuu

SEQ ID NO: 10865 - RNA, 21 nt, Human
cgcugcuuaaaaaccgagaug

SEQ ID NO: 10866 - RNA, 24 nt, Human
cgcugggaaaguccuugcugugaa

SEQ ID NO: 10867 - RNA, 24 nt, Human
cggaagcucacacggacagucaca

SEQ ID NO: 10868 - RNA, 24 nt, Human
cggaaugggccaacucacucggug

SEQ ID NO: 10869 - RNA, 24 nt, Human
cggaggugucacccucaauggcuu

SEQ ID NO: 10870 - RNA, 22 nt, Human
cggauuaugugauaccagcuca

SEQ ID NO: 10871 - RNA, 22 nt, Human
cggcaacuucuacucuuucuuc

SEQ ID NO: 10872 - RNA, 22 nt, Human
cggcaagaugccggagugcugg

SEQ ID NO: 10873 - RNA, 24 nt, Human
cggcaagguuuuauguacauaugu

SEQ ID NO: 10874 - RNA, 21 nt, Human
cggcacagccucugugagacu

SEQ ID NO: 10875 - RNA, 24 nt, Human
cggcagaggaggggaugagucuga

SEQ ID NO: 10876 - RNA, 24 nt, Human
cggcagccucagcggcucugaguc

SEQ ID NO: 10877 - RNA, 24 nt, Human
cggcagggaacggccugggacaac

SEQ ID NO: 10878 - RNA, 24 nt, Human
cggcagggcuccgagaccucggcu

SEQ ID NO: 10879 - RNA, 24 nt, Human
cggcaguagaaauagcacaggccu

SEQ ID NO: 10880 - RNA, 24 nt, Human
cggcgaccgccuccgcggcgcccc

SEQ ID NO: 10881 - RNA, 24 nt, Human
cggcgcggcaguggccucgcaggg

SEQ ID NO: 10882 - RNA, 24 nt, Human
cggcggcgaacagugucaaaugga

SEQ ID NO: 10883 - RNA, 24 nt, Human
cggcggcgaacggugucaaaugga

SEQ ID NO: 10884 - RNA, 24 nt, Human
cggcggcggcggcggcgggguggu

SEQ ID NO: 10885 - RNA, 24 nt, Human
cggcgggaaugaccacuuccggcc

SEQ ID NO: 10886 - RNA, 24 nt, Human
cggcgggcucugcgcuccgccccu

SEQ ID NO: 10887 - RNA, 24 nt, Human
cggcgggcugucguuggcuggagc

SEQ ID NO: 10888 - RNA, 24 nt, Human
cggcggggcuaacugcagcgcgga

SEQ ID NO: 10889 - RNA, 22 nt, Human
cggcguggggguuuguagacuu

SEQ ID NO: 10890 - RNA, 24 nt, Human
cggcucgugccgauucggcacgag

SEQ ID NO: 10891 - RNA, 24 nt, Human
cggcugcaggacccugucccagcg

SEQ ID NO: 10892 - RNA, 24 nt, Human
cggcugcgggaaacacaacucgcc

SEQ ID NO: 10893 - RNA, 24 nt, Human
cggcuuuuucgcggggggaaagaa

SEQ ID NO: 10894 - RNA, 24 nt, Human
cgggaccagugcuucggggaccgc

SEQ ID NO: 10895 - RNA, 24 nt, Human
cgggaggaggcgcagcgcguggcc

SEQ ID NO: 10896 - RNA, 24 nt, Human
cgggaucgggcacggagaagacau

SEQ ID NO: 10897 - RNA, 24 nt, Human
cggguucucacgcaacaacggagg

SEQ ID NO: 10898 - RNA, 24 nt, Human
cgguccgacuugucauggccccug

SEQ ID NO: 10899 - RNA, 24 nt, Human
cgucauuggacacguagauucggg

SEQ ID NO: 10900 - RNA, 24 nt, Human
cguccagagcccagguaauccggg

SEQ ID NO: 10901 - RNA, 24 nt, Human
cgucgggaggcgucguccuccagc

SEQ ID NO: 10902 - RNA, 24 nt, Human
cgucuauaacaggacuaaguucac

SEQ ID NO: 10903 - RNA, 24 nt, Human
cgucuggugggaugcgcacccccu

SEQ ID NO: 10904 - RNA, 22 nt, Human
cgucuucagcaaggaucaguuu

SEQ ID NO: 10905 - RNA, 24 nt, Human
cgugcagagggcccgcuggggccc

SEQ ID NO: 10906 - RNA, 24 nt, Human
cgugcagcuggagauccgggggug

SEQ ID NO: 10907 - RNA, 24 nt, Human
cgugcaguaccaguucgagaugga

SEQ ID NO: 10908 - RNA, 24 nt, Human
cgugcuggacaccccucggagccg

SEQ ID NO: 10909 - RNA, 24 nt, Human
cguggcagaaauccagaaaucagu

SEQ ID NO: 10910 - RNA, 24 nt, Human
cguggcagcugguuggacuagggg

SEQ ID NO: 10911 - RNA, 22 nt, Human
cguggcggcgcgcucucuucca

SEQ ID NO: 10912 - RNA, 24 nt, Human
cgugggcacuccggacgugauuaa

SEQ ID NO: 10913 - RNA, 22 nt, Human
cguggucauugguugcauaauu

SEQ ID NO: 10914 - RNA, 22 nt, Human
cguguucaguauggugggagau

SEQ ID NO: 10915 - RNA, 22 nt, Human
cguguuuucuuuaggauacaga

SEQ ID NO: 10916 - RNA, 22 nt, Human
cguucauugcuguguccuggca

SEQ ID NO: 10917 - RNA, 24 nt, Human
cguuccgagcccccgccgccgucg

SEQ ID NO: 10918 - RNA, 21 nt, Human
cguuguacuuggucuugcccc

SEQ ID NO: 10919 - RNA, 24 nt, Human
cguuugaucuucccaaaauuuucc

SEQ ID NO: 10920 - RNA, 22 nt, Human
cuaaacgagggcugguggugag

SEQ ID NO: 10921 - RNA, 24 nt, Human
cuaaagcucaaauugcucuuaaac

SEQ ID NO: 10922 - RNA, 22 nt, Human
cuaaaugaccuuagaccacuua

SEQ ID NO: 10923 - RNA, 22 nt, Human
cuaauuguuccugcagguagua

SEQ ID NO: 10924 - RNA, 22 nt, Human
cuacagccugccccugacugug

SEQ ID NO: 10925 - RNA, 24 nt, Human
cuacauggcaaucgggggcuaugu

SEQ ID NO: 10926 - RNA, 24 nt, Human
cuaccaggucucuaggggccugag

SEQ ID NO: 10927 - RNA, 23 nt, Human
cuacucccgagucuggcccucug

SEQ ID NO: 10928 - RNA, 24 nt, Human
cuacugcauuccagccugggcaac

SEQ ID NO: 10929 - RNA, 23 nt, Human
cuacuuugcugagagucuccauc

SEQ ID NO: 10930 - RNA, 24 nt, Human
cuagaaccacaggagaauggcgug

SEQ ID NO: 10931 - RNA, 24 nt, Human
cuagacagaaagggcugcuuguag

SEQ ID NO: 10932 - RNA, 22 nt, Human
cuagacggagggcccucgaggg

SEQ ID NO: 10933 - RNA, 24 nt, Human
cuagaguugugagaaaaccagaga

SEQ ID NO: 10934 - RNA, 22 nt, Human
cuagaugaggaggaggaagaug

SEQ ID NO: 10935 - RNA, 24 nt, Human
cuagcaccuuugauuuuucucagu

SEQ ID NO: 10936 - RNA, 22 nt, Human
cuagccuuaaucuuuggcaagc

SEQ ID NO: 10937 - RNA, 22 nt, Human
cuaggaagugcaagaucaaggu

SEQ ID NO: 10938 - RNA, 24 nt, Human
cuaguaacgucauggaggaugaac

SEQ ID NO: 10939 - RNA, 24 nt, Human
cuaguagcuuuucugugucucaag

SEQ ID NO: 10940 - RNA, 24 nt, Human
cuagucuuuugggacagaugggac

SEQ ID NO: 10941 - RNA, 24 nt, Human
cuagugccaguuuucuuguuugcc

SEQ ID NO: 10942 - RNA, 24 nt, Human
cuauugggaaaauacuguguucaa

SEQ ID NO: 10943 - RNA, 24 nt, Human
cucaagcgacccuccugcuucagc

SEQ ID NO: 10944 - RNA, 22 nt, Human
cucaagugaucaggauagugug

SEQ ID NO: 10945 - RNA, 24 nt, Human
cucaaguuucauuugugaaguugg

SEQ ID NO: 10946 - RNA, 22 nt, Human
cucaccaguuacucuccaguug

SEQ ID NO: 10947 - RNA, 22 nt, Human
cucaccccucaccuccucaguu

SEQ ID NO: 10948 - RNA, 22 nt, Human
cucacugcaaccuccgccuccc

SEQ ID NO: 10949 - RNA, 24 nt, Human
cucacugcaagcuccgccuccugg

SEQ ID NO: 10950 - RNA, 22 nt, Human
cucaggaggcgggggcugcaau

SEQ ID NO: 10951 - RNA, 22 nt, Human
cucaggucuucugagcucaauc

SEQ ID NO: 10952 - RNA, 22 nt, Human
cucagugugaagaacuacgggu

SEQ ID NO: 10953 - RNA, 24 nt, Human
cuccaacaacagcaaggaggaugc

SEQ ID NO: 10954 - RNA, 23 nt, Human
cuccaggggcgugacaacgucca

SEQ ID NO: 10955 - RNA, 24 nt, Human
cuccaucauggaggagugcggcgg

SEQ ID NO: 10956 - RNA, 22 nt, Human
cuccauguuggucaggcugguc

SEQ ID NO: 10957 - RNA, 24 nt, Human
cucccagacuaguggugcugggau

SEQ ID NO: 10958 - RNA, 24 nt, Human
cuccccauccuacacaccuccuca

SEQ ID NO: 10959 - RNA, 24 nt, Human
cuccccuucucccggccuuccucu

SEQ ID NO: 10960 - RNA, 24 nt, Human
cucccguaauuaggaauuuuccau

SEQ ID NO: 10961 - RNA, 24 nt, Human
cucccuacgucacacuccggaggg

SEQ ID NO: 10962 - RNA, 22 nt, Human
cucccuccacuucugaggacgu

SEQ ID NO: 10963 - RNA, 22 nt, Human
cuccgcuccgaugugaagucua

SEQ ID NO: 10964 - RNA, 24 nt, Human
cuccggguauucaucugcagagca

SEQ ID NO: 10965 - RNA, 24 nt, Human
cuccggguccccagccaaccuggc

SEQ ID NO: 10966 - RNA, 24 nt, Human
cuccuaaucccagauguaccgcga

SEQ ID NO: 10967 - RNA, 21 nt, Human
cuccuacaacugacucucugg

SEQ ID NO: 10968 - RNA, 22 nt, Human
cuccuacaacugacucucugga

SEQ ID NO: 10969 - RNA, 24 nt, Human
cuccucaggcugggguaaggugug

SEQ ID NO: 10970 - RNA, 24 nt, Human
cuccucccagacaguuugaugcau

SEQ ID NO: 10971 - RNA, 24 nt, Human
cuccugcgucauccggaagcggac

SEQ ID NO: 10972 - RNA, 21 nt, Human
cuccugggucccacugguucu

SEQ ID NO: 10973 - RNA, 23 nt, Human
cuccuguugcguuuaggcaccca

SEQ ID NO: 10974 - RNA, 24 nt, Human
cuccuugucucgcucccggcuccg

SEQ ID NO: 10975 - RNA, 24 nt, Human
cuccuuguggccuuccuugaggag

SEQ ID NO: 10976 - RNA, 22 nt, Human
cuccuuugggggcucuaaggga

SEQ ID NO: 10977 - RNA, 22 nt, Human
cucgacggaaugcugacagguu

SEQ ID NO: 10978 - RNA, 24 nt, Human
cucgagguugcaggacucuuucug

SEQ ID NO: 10979 - RNA, 22 nt, Human
cucgaguagcugggauuacagg

SEQ ID NO: 10980 - RNA, 23 nt, Human
cucgcgugggucuuaacacaguu

SEQ ID NO: 10981 - RNA, 23 nt, Human
cucggcgcccugcgcgagcuccc

SEQ ID NO: 10982 - RNA, 24 nt, Human
cucguaguguucuggcgggcaguu

SEQ ID NO: 10983 - RNA, 24 nt, Human
cucgucuugaauuccugaccccag

SEQ ID NO: 10984 - RNA, 24 nt, Human
cucguggggccugagaaccucacc

SEQ ID NO: 10985 - RNA, 24 nt, Human
cucuaaguacaaagacuuauuucu

SEQ ID NO: 10986 - RNA, 24 nt, Human
cucucugcauggcucuggccaucc

SEQ ID NO: 10987 - RNA, 24 nt, Human
cucugcuccuggugccagugcugc

SEQ ID NO: 10988 - RNA, 22 nt, Human
cucuggaucuugagcugguuua

SEQ ID NO: 10989 - RNA, 22 nt, Human
cucugucuuucuaggaguaugu

SEQ ID NO: 10990 - RNA, 22 nt, Human
cucuuuuauaugcuagauuuca

SEQ ID NO: 10991 - RNA, 24 nt, Human
cugaauccuuugccuguggguagg

SEQ ID NO: 10992 - RNA, 24 nt, Human
cugacucaugaacagguggaggaa

SEQ ID NO: 10993 - RNA, 22 nt, Human
cugagcaagagguggugagguu

SEQ ID NO: 10994 - RNA, 22 nt, Human
cugagccccggcacugccuggc

SEQ ID NO: 10995 - RNA, 24 nt, Human
cugauccuuuaaccccuucucagg

SEQ ID NO: 10996 - RNA, 22 nt, Human
cugauguucacucagguaggau

SEQ ID NO: 10997 - RNA, 24 nt, Human
cugcaaccuccaccucuggaguuc

SEQ ID NO: 10998 - RNA, 22 nt, Human
cugcaauuuccccuaagccagg

SEQ ID NO: 10999 - RNA, 24 nt, Human
cugcacccaggucccgucuuagag

SEQ ID NO: 11000 - RNA, 24 nt, Human
cugcacccuagccugggcgauaga

SEQ ID NO: 11001 - RNA, 24 nt, Human
cugcacgacgcacuggcccaggac

SEQ ID NO: 11002 - RNA, 22 nt, Human
cugcacuagaaggcacuauguu

SEQ ID NO: 11003 - RNA, 24 nt, Human
cugcagaugcaucccaauaaucag

SEQ ID NO: 11004 - RNA, 24 nt, Human
cugcagcagcaugcacuucuuggu

SEQ ID NO: 11005 - RNA, 24 nt, Human
cugcagcccaugggucaaagagua

SEQ ID NO: 11006 - RNA, 24 nt, Human
cugcagcgaccacagaccugggcu

SEQ ID NO: 11007 - RNA, 22 nt, Human
cugcagcucccaaggacacaag

SEQ ID NO: 11008 - RNA, 24 nt, Human
cugcagugagccaagaucgugcca

SEQ ID NO: 11009 - RNA, 24 nt, Human
cugcaucguccacuccggucggcg

SEQ ID NO: 11010 - RNA, 22 nt, Human
cugcauggagguggucuaugag

SEQ ID NO: 11011 - RNA, 22 nt, Human
cugccacaguagcucaaccaag

SEQ ID NO: 11012 - RNA, 22 nt, Human
cugccauuuccaggagaucacc

SEQ ID NO: 11013 - RNA, 22 nt, Human
cugcccagcgugaccaguggcc

SEQ ID NO: 11014 - RNA, 24 nt, Human
cugccccagcugcugcaggggccu

SEQ ID NO: 11015 - RNA, 24 nt, Human
cugccccuucaggguuuggaggag

SEQ ID NO: 11016 - RNA, 24 nt, Human
cugcccgcugcucucccacuccac

SEQ ID NO: 11017 - RNA, 24 nt, Human
cugccgggaaagagcuccugaagu

SEQ ID NO: 11018 - RNA, 22 nt, Human
cugccuaaggcacuggguauau

SEQ ID NO: 11019 - RNA, 22 nt, Human
cugccucaggagcuaugugucc

SEQ ID NO: 11020 - RNA, 24 nt, Human
cugcucugcgucggucccgcgcgc

SEQ ID NO: 11021 - RNA, 24 nt, Human
cugcugcgccuguaagagugagac

SEQ ID NO: 11022 - RNA, 24 nt, Human
cugcugcuccccagcccaccagug

SEQ ID NO: 11023 - RNA, 24 nt, Human
cugcuguaggcugggcuacaggga

SEQ ID NO: 11024 - RNA, 24 nt, Human
cuggaacugagggacaaagguuuu

SEQ ID NO: 11025 - RNA, 24 nt, Human
cuggaccaggccgagggcaggccu

SEQ ID NO: 11026 - RNA, 20 nt, Human
cuggacccaaggugugagcc

SEQ ID NO: 11027 - RNA, 22 nt, Human
cuggagccucuacuuauuaccc

SEQ ID NO: 11028 - RNA, 23 nt, Human
cuggagccucuacuuauuacccu

SEQ ID NO: 11029 - RNA, 22 nt, Human
cuggagcucagcccagguucca

SEQ ID NO: 11030 - RNA, 24 nt, Human
cuggagcuggauccgccagccccc

SEQ ID NO: 11031 - RNA, 24 nt, Human
cuggaugcccagcguggaagaaaa

SEQ ID NO: 11032 - RNA, 24 nt, Human
cuggaugggcugcuccucccaggg

SEQ ID NO: 11033 - RNA, 24 nt, Human
cuggauuccaguaagcucuuuauu

SEQ ID NO: 11034 - RNA, 24 nt, Human
cuggccccagccccaucaccgaaa

SEQ ID NO: 11035 - RNA, 24 nt, Human
cuggcccccagaucugccccucca

SEQ ID NO: 11036 - RNA, 22 nt, Human
cuggccccucaucugguuucau

SEQ ID NO: 11037 - RNA, 24 nt, Human
cuggccggccagggagcccacagu

SEQ ID NO: 11038 - RNA, 22 nt, Human
cuggcuaauuuucuugaguuuu

SEQ ID NO: 11039 - RNA, 24 nt, Human
cuggcucccggagcggucgccucu

SEQ ID NO: 11040 - RNA, 22 nt, Human
cuggcucccucucuucucuccc

SEQ ID NO: 11041 - RNA, 22 nt, Human
cuggcucuacccucucacuuca

SEQ ID NO: 11042 - RNA, 24 nt, Human
cuggcuguuuuuuggaccuaaggg

SEQ ID NO: 11043 - RNA, 24 nt, Human
cugggacccaucuccacaacugga

SEQ ID NO: 11044 - RNA, 22 nt, Human
cugggaggcagagguuguugca

SEQ ID NO: 11045 - RNA, 22 nt, Human
cugggauuacaggugugaacca

SEQ ID NO: 11046 - RNA, 24 nt, Human
cugggcccagauggccccuucuga

SEQ ID NO: 11047 - RNA, 22 nt, Human
cugggcgugugaggcggcugug

SEQ ID NO: 11048 - RNA, 22 nt, Human
cugggcucaguggcucacaccu

SEQ ID NO: 11049 - RNA, 24 nt, Human
cugggcuuggccagucggcaguga

SEQ ID NO: 11050 - RNA, 22 nt, Human
cuggggaaauguugcugguuga

SEQ ID NO: 11051 - RNA, 24 nt, Human
cuggggcccuauguuguagauucu

SEQ ID NO: 11052 - RNA, 24 nt, Human
cuggggcgucgggccacggaagcc

SEQ ID NO: 11053 - RNA, 22 nt, Human
cuggggcuccucuacuggaucu

SEQ ID NO: 11054 - RNA, 22 nt, Human
cuggguggccuucaguccauga

SEQ ID NO: 11055 - RNA, 23 nt, Human
cugguaccagugcaagaaugggg

SEQ ID NO: 11056 - RNA, 24 nt, Human
cugguccgagcgcgggaaacggcg

SEQ ID NO: 11057 - RNA, 24 nt, Human
cuggugcuaguguuucuaucagau

SEQ ID NO: 11058 - RNA, 24 nt, Human
cuggugcugcugacggagcugcug

SEQ ID NO: 11059 - RNA, 24 nt, Human
cugguuuuaggagauuuuuaugac

SEQ ID NO: 11060 - RNA, 24 nt, Human
cuguacccauguuaugugacucuc

SEQ ID NO: 11061 - RNA, 24 nt, Human
cugucacacccacaagcuccuugg

SEQ ID NO: 11062 - RNA, 24 nt, Human
cugucaucugcagguuccugguag

SEQ ID NO: 11063 - RNA, 22 nt, Human
cugucgcgguguguaucuuuug

SEQ ID NO: 11064 - RNA, 24 nt, Human
cugugacucuucucucaaccuugg

SEQ ID NO: 11065 - RNA, 22 nt, Human
cugugagcuauuuguuuugguu

SEQ ID NO: 11066 - RNA, 24 nt, Human
cugugccacgcguggcugcggaag

SEQ ID NO: 11067 - RNA, 22 nt, Human
cugugcccagccagggcugugu

SEQ ID NO: 11068 - RNA, 23 nt, Human
cugugccugcagaggagcugcuc

SEQ ID NO: 11069 - RNA, 24 nt, Human
cugugcuuucaaaacugugcaguc

SEQ ID NO: 11070 - RNA, 22 nt, Human
cuguggauacugagagaugacu

SEQ ID NO: 11071 - RNA, 22 nt, Human
cuguggauuuacuugagaagcu

SEQ ID NO: 11072 - RNA, 22 nt, Human
cuguucagaucugugugcauuu

SEQ ID NO: 11073 - RNA, 22 nt, Human
cuuaagaucacagagcuaauga

SEQ ID NO: 11074 - RNA, 22 nt, Human
cuuaggucuaguucuccugggg

SEQ ID NO: 11075 - RNA, 22 nt, Human
cuucaaugcuugagaagucgua

SEQ ID NO: 11076 - RNA, 22 nt, Human
cuucacagcaugcucagguaac

SEQ ID NO: 11077 - RNA, 24 nt, Human
cuucagcgugacgucuggugggca

SEQ ID NO: 11078 - RNA, 22 nt, Human
cuucauggcuauucaggcucag

SEQ ID NO: 11079 - RNA, 22 nt, Human
cuucauucaaguucgcuauagu

SEQ ID NO: 11080 - RNA, 24 nt, Human
cuucauuuuugauggcuggcucug

SEQ ID NO: 11081 - RNA, 24 nt, Human
cuuccaccauucccagaacugauc

SEQ ID NO: 11082 - RNA, 22 nt, Human
cuuccagaugacuugauuggau

SEQ ID NO: 11083 - RNA, 24 nt, Human
cuucccaaagcuagggccguuccc

SEQ ID NO: 11084 - RNA, 24 nt, Human
cuuccccgaugagaacuucaaacu

SEQ ID NO: 11085 - RNA, 22 nt, Human
cuucccuaagggacuggcauag

SEQ ID NO: 11086 - RNA, 24 nt, Human
cuucccucaguuugaaguguuagg

SEQ ID NO: 11087 - RNA, 24 nt, Human
cuuccuccguguuggagaccuggu

SEQ ID NO: 11088 - RNA, 24 nt, Human
cuuccuggaguugauggaauaaag

SEQ ID NO: 11089 - RNA, 21 nt, Human
cuuccugucccaaaggaagug

SEQ ID NO: 11090 - RNA, 24 nt, Human
cuuccugugcccucugaaagcuaa

SEQ ID NO: 11091 - RNA, 24 nt, Human
cuucgaggaccugucccaugugca

SEQ ID NO: 11092 - RNA, 24 nt, Human
cuucgcgggggcggcgggcggccc

SEQ ID NO: 11093 - RNA, 24 nt, Human
cuucguguccaacccucuugcccu

SEQ ID NO: 11094 - RNA, 24 nt, Human
cuucugguucuccgcuccgccucg

SEQ ID NO: 11095 - RNA, 24 nt, Human
cuucuuggucucggcgugccccau

SEQ ID NO: 11096 - RNA, 22 nt, Human
cuugauucauuuaagguuggag

SEQ ID NO: 11097 - RNA, 24 nt, Human
cuugcagcccacagggcuggagaa

SEQ ID NO: 11098 - RNA, 23 nt, Human
cuugcccuucauagaaguccaag

SEQ ID NO: 11099 - RNA, 22 nt, Human
cuugcucuguuuaucugugagg

SEQ ID NO: 11100 - RNA, 24 nt, Human
cuuggagaccucccucucagucaa

SEQ ID NO: 11101 - RNA, 24 nt, Human
cuuggagcuguccauugcagacca

SEQ ID NO: 11102 - RNA, 21 nt, Human
cuuggcacuggccgucguuuu

SEQ ID NO: 11103 - RNA, 24 nt, Human
cuuggcucuggccuuggcucuggc

SEQ ID NO: 11104 - RNA, 23 nt, Human
cuugucccaaggaaagucuagau

SEQ ID NO: 11105 - RNA, 20 nt, Human
cuugucucacuuuacucugu

SEQ ID NO: 11106 - RNA, 22 nt, Human
cuugucugaaagucgugcuuua

SEQ ID NO: 11107 - RNA, 22 nt, Human
cuuguugggaacaccuggauag

SEQ ID NO: 11108 - RNA, 22 nt, Human
cuuuaagaacagacagcuccag

SEQ ID NO: 11109 - RNA, 22 nt, Human
cuuuagugcuucucagucaaca

SEQ ID NO: 11110 - RNA, 24 nt, Human
cuuuaugucucacauucaugucau

SEQ ID NO: 11111 - RNA, 22 nt, Human
cuuucacacaggucagaaggau

SEQ ID NO: 11112 - RNA, 24 nt, Human
cuuucaggcccgucucaagagcug

SEQ ID NO: 11113 - RNA, 24 nt, Human
cuuucaguggaggcauuaaaguac

SEQ ID NO: 11114 - RNA, 24 nt, Human
cuuuccaaaaacugauauagucca

SEQ ID NO: 11115 - RNA, 24 nt, Human
cuuuccagccacuggacgaguaag

SEQ ID NO: 11116 - RNA, 24 nt, Human
cuuuccuggagaggaggcuaaggu

SEQ ID NO: 11117 - RNA, 22 nt, Human
cuuucuaggguuuccaggcaag

SEQ ID NO: 11118 - RNA, 24 nt, Human
cuuucuugacgccaagguagcuua

SEQ ID NO: 11119 - RNA, 24 nt, Human
cuuugaagacucuguccgaaaguu

SEQ ID NO: 11120 - RNA, 22 nt, Human
cuuugaauuucacacgggggca

SEQ ID NO: 11121 - RNA, 24 nt, Human
cuuugagauacuccacacugagca

SEQ ID NO: 11122 - RNA, 24 nt, Human
cuuugaguuucacaaacuccucuu

SEQ ID NO: 11123 - RNA, 24 nt, Human
cuuugggaugcaaggcaguuguuc

SEQ ID NO: 11124 - RNA, 23 nt, Human
cuuugggccuggccuguucuguu

SEQ ID NO: 11125 - RNA, 24 nt, Human
cuuugugcuugggguagaucuucu

SEQ ID NO: 11126 - RNA, 24 nt, Human
cuuuguguacagagguccgggucu

SEQ ID NO: 11127 - RNA, 22 nt, Human
cuuuuauugacagugacuuugc

SEQ ID NO: 11128 - RNA, 22 nt, Human
cuuuucaucagaugccacaucu

SEQ ID NO: 11129 - RNA, 22 nt, Human
cuuuuccaagcuauucaggcac

SEQ ID NO: 11130 - RNA, 22 nt, Human
cuuuuugggcugggguugcuga

SEQ ID NO: 11131 - RNA, 24 nt, Human
gaaaauuuuaaauggccgggaccu

SEQ ID NO: 11132 - RNA, 24 nt, Human
gaaacgccaacuauaaccccuccc

SEQ ID NO: 11133 - RNA, 22 nt, Human
gaaaguaguaaguuguauaguu

SEQ ID NO: 11134 - RNA, 22 nt, Human
gaaagugaggaggugguucagg

SEQ ID NO: 11135 - RNA, 22 nt, Human
gaacagcuccagucuacagccc

SEQ ID NO: 11136 - RNA, 24 nt, Human
gaacagguuggaaguguggaguca

SEQ ID NO: 11137 - RNA, 24 nt, Human
gaacauuggggugaggggcaaaau

SEQ ID NO: 11138 - RNA, 22 nt, Human
gaacauuuggcuuggcaggugc

SEQ ID NO: 11139 - RNA, 24 nt, Human
gaacgcgcgcucaccgugcgcgcu

SEQ ID NO: 11140 - RNA, 24 nt, Human
gaacuggaagauugcucuccgagu

SEQ ID NO: 11141 - RNA, 24 nt, Human
gaacugugcacaggaacagcuucc

SEQ ID NO: 11142 - RNA, 24 nt, Human
gaacuuggccucaguacgucuggg

SEQ ID NO: 11143 - RNA, 22 nt, Human
gaacuuuacauaugugagauag

SEQ ID NO: 11144 - RNA, 24 nt, Human
gaagaccagggaauuuaucagagc

SEQ ID NO: 11145 - RNA, 24 nt, Human
gaaggacugccaaccucuacuccc

SEQ ID NO: 11146 - RNA, 24 nt, Human
gaaggcaaacauguucagaaguca

SEQ ID NO: 11147 - RNA, 24 nt, Human
gaagggcagaaucaggcuaucucu

SEQ ID NO: 11148 - RNA, 24 nt, Human
gaagugaaaauuguucaguccaag

SEQ ID NO: 11149 - RNA, 24 nt, Human
gaagugauuugcuccuuaaagggg

SEQ ID NO: 11150 - RNA, 22 nt, Human
gaauauagcagcacccagugag

SEQ ID NO: 11151 - RNA, 22 nt, Human
gaaucauuggucagccacagug

SEQ ID NO: 11152 - RNA, 24 nt, Human
gaaugcgccucuucgcugugccgg

SEQ ID NO: 11153 - RNA, 24 nt, Human
gaaugcuuuuaacucugucccauu

SEQ ID NO: 11154 - RNA, 22 nt, Human
gaauuagcuauucuauacucua

SEQ ID NO: 11155 - RNA, 24 nt, Human
gacaauggucaccgucucuucagc

SEQ ID NO: 11156 - RNA, 23 nt, Human
gacaauguggaaaaaacccuaaa

SEQ ID NO: 11157 - RNA, 24 nt, Human
gacaccucuggccuccagcccugc

SEQ ID NO: 11158 - RNA, 24 nt, Human
gacacgccagaggaggaggccggg

SEQ ID NO: 11159 - RNA, 24 nt, Human
gacacgggcuguggggcccccggg

SEQ ID NO: 11160 - RNA, 21 nt, Human
gacagcuucccuuccugggac

SEQ ID NO: 11161 - RNA, 22 nt, Human
gacaggaucugugccucaaccc

SEQ ID NO: 11162 - RNA, 24 nt, Human
gacaguaggccaggggccuguggu

SEQ ID NO: 11163 - RNA, 22 nt, Human
gacaugauguagcagaugaugg

SEQ ID NO: 11164 - RNA, 24 nt, Human
gacauggucugggacuucuggagc

SEQ ID NO: 11165 - RNA, 24 nt, Human
gacauuguuggcuucacagcauug

SEQ ID NO: 11166 - RNA, 24 nt, Human
gaccagcacccacacucaggcucu

SEQ ID NO: 11167 - RNA, 22 nt, Human
gaccagccauccugguuuacau

SEQ ID NO: 11168 - RNA, 24 nt, Human
gaccaggcagggucaggcugaccu

SEQ ID NO: 11169 - RNA, 24 nt, Human
gaccaguaacugucaauggcuaaa

SEQ ID NO: 11170 - RNA, 24 nt, Human
gaccccaccucuucccugccgacc

SEQ ID NO: 11171 - RNA, 24 nt, Human
gaccccagcgucucgguccauccc

SEQ ID NO: 11172 - RNA, 22 nt, Human
gacccuguguucaagguuaggg

SEQ ID NO: 11173 - RNA, 24 nt, Human
gaccgcuucccugcagugccccga

SEQ ID NO: 11174 - RNA, 24 nt, Human
gaccgguccgaccuggcguccucc

SEQ ID NO: 11175 - RNA, 24 nt, Human
gaccugaggcagaacuggggugga

SEQ ID NO: 11176 - RNA, 24 nt, Human
gaccugggaagcgaagaagaggag

SEQ ID NO: 11177 - RNA, 24 nt, Human
gaccuugacucuugugcuggucuu

SEQ ID NO: 11178 - RNA, 23 nt, Human
gaccuuuucaaaaaagcaagcuc

SEQ ID NO: 11179 - RNA, 24 nt, Human
gacuaguuuucuuucuuuugcuac

SEQ ID NO: 11180 - RNA, 24 nt, Human
gacucuggucgguuacugauacgg

SEQ ID NO: 11181 - RNA, 24 nt, Human
gacucuuucugcaagauaccugua

SEQ ID NO: 11182 - RNA, 24 nt, Human
gacugcguggcuagcuugggcaug

SEQ ID NO: 11183 - RNA, 24 nt, Human
gacugggaggaaacagcuggccaa

SEQ ID NO: 11184 - RNA, 24 nt, Human
gacuucgugcuccuucaggaggcc

SEQ ID NO: 11185 - RNA, 24 nt, Human
gacuuuagucacuagguucuagga

SEQ ID NO: 11186 - RNA, 21 nt, Human
gagaaaaucauucagcagcug

SEQ ID NO: 11187 - RNA, 24 nt, Human
gagaaucaacaacguggagaccua

SEQ ID NO: 11188 - RNA, 21 nt, Human
gagaaucugagacaucuugcc

SEQ ID NO: 11189 - RNA, 23 nt, Human
gagacuguugaaugugagaugau

SEQ ID NO: 11190 - RNA, 23 nt, Human
gagacuuuuuauuauugcuuuga

SEQ ID NO: 11191 - RNA, 22 nt, Human
gagagagguagaggggagcaga

SEQ ID NO: 11192 - RNA, 22 nt, Human
gagagaguuuucuuguucagga

SEQ ID NO: 11193 - RNA, 22 nt, Human
gagaucagauggaauggaggcu

SEQ ID NO: 11194 - RNA, 24 nt, Human
gagcacagagauuuuugcuuuuuu

SEQ ID NO: 11195 - RNA, 23 nt, Human
gagcacagcgcagcgcgggcggc

SEQ ID NO: 11196 - RNA, 24 nt, Human
gagcagauaaccauuguuucucgg

SEQ ID NO: 11197 - RNA, 24 nt, Human
gagcagcguccacccucggcccuc

SEQ ID NO: 11198 - RNA, 24 nt, Human
gagcagcugccuucaggcccugcg

SEQ ID NO: 11199 - RNA, 24 nt, Human
gagcaggaaaccccagugagugca

SEQ ID NO: 11200 - RNA, 24 nt, Human
gagcaggccggaaguggcuuuccg

SEQ ID NO: 11201 - RNA, 24 nt, Human
gagcaggcgaguccaggaggggcc

SEQ ID NO: 11202 - RNA, 24 nt, Human
gagcaggugugaguugccuuccau

SEQ ID NO: 11203 - RNA, 24 nt, Human
gagcagguguucugggccccuuca

SEQ ID NO: 11204 - RNA, 24 nt, Human
gagcagugcguacaugguugugcg

SEQ ID NO: 11205 - RNA, 24 nt, Human
gagcaucuucucucggacucggga

SEQ ID NO: 11206 - RNA, 24 nt, Human
gagcauggggaggggugugguggg

SEQ ID NO: 11207 - RNA, 22 nt, Human
gagcaugguggugcgcgccugu

SEQ ID NO: 11208 - RNA, 24 nt, Human
gagcaugugguucgcaccacuucu

SEQ ID NO: 11209 - RNA, 22 nt, Human
gagcauguuuucauuugcacaa

SEQ ID NO: 11210 - RNA, 24 nt, Human
gagcauugaccggggcugugcugg

SEQ ID NO: 11211 - RNA, 24 nt, Human
gagcauugacuuccuuucucuccc

SEQ ID NO: 11212 - RNA, 22 nt, Human
gagcggcagaaccagaguucga

SEQ ID NO: 11213 - RNA, 22 nt, Human
gagcuaaggauagaggugagga

SEQ ID NO: 11214 - RNA, 24 nt, Human
gagcuagcauaauaguauuuauua

SEQ ID NO: 11215 - RNA, 24 nt, Human
gagcucaucaccagguuccucccg

SEQ ID NO: 11216 - RNA, 24 nt, Human
gagcugguacaccguccggaaggc

SEQ ID NO: 11217 - RNA, 22 nt, Human
gagcuuccgcgccgacuucucu

SEQ ID NO: 11218 - RNA, 21 nt, Human
gaggacgucaggaggcccugc

SEQ ID NO: 11219 - RNA, 24 nt, Human
gaggacucccaacccuggcuuggu

SEQ ID NO: 11220 - RNA, 24 nt, Human
gaggagcagcucaguccagcguga

SEQ ID NO: 11221 - RNA, 24 nt, Human
gaggagcaguugucugaugaagag

SEQ ID NO: 11222 - RNA, 24 nt, Human
gaggaguccugaacccugggugca

SEQ ID NO: 11223 - RNA, 24 nt, Human
gaggaucacuuuugcccaggaguu

SEQ ID NO: 11224 - RNA, 23 nt, Human
gaggauccuaaugaaauaccuga

SEQ ID NO: 11225 - RNA, 24 nt, Human
gaggaugaagggcuggcuguuggg

SEQ ID NO: 11226 - RNA, 24 nt, Human
gaggauguucuggaagagcugaca

SEQ ID NO: 11227 - RNA, 23 nt, Human
gaggcccaguccugcccgggccc

SEQ ID NO: 11228 - RNA, 24 nt, Human
gaggcgccugcuuuuccuuggccu

SEQ ID NO: 11229 - RNA, 22 nt, Human
gagggagauagugaggggaggg

SEQ ID NO: 11230 - RNA, 22 nt, Human
gaggggcagggucaccaucuca

SEQ ID NO: 11231 - RNA, 22 nt, Human
gagguggagaaauagcccgggc

SEQ ID NO: 11232 - RNA, 24 nt, Human
gagguuauaaggaucuuggcucua

SEQ ID NO: 11233 - RNA, 24 nt, Human
gagguuccuccuuguccuugaugg

SEQ ID NO: 11234 - RNA, 22 nt, Human
gaguacaaaugaagucuguggg

SEQ ID NO: 11235 - RNA, 22 nt, Human
gagucccuguuguucugcaaca

SEQ ID NO: 11236 - RNA, 22 nt, Human
gagucgagaaagagaaaaugga

SEQ ID NO: 11237 - RNA, 24 nt, Human
gagugcaccugggguugggggcac

SEQ ID NO: 11238 - RNA, 24 nt, Human
gagugcccagggcugaggguggcu

SEQ ID NO: 11239 - RNA, 22 nt, Human
gaguuuuaucaccuuaugcagg

SEQ ID NO: 11240 - RNA, 22 nt, Human
gauaucaugggaagguguacuu

SEQ ID NO: 11241 - RNA, 23 nt, Human
gaucacaguuacuuucucagcaa

SEQ ID NO: 11242 - RNA, 22 nt, Human
gaucacuuuagcuuucuccugg

SEQ ID NO: 11243 - RNA, 24 nt, Human
gaucaggcugcaaggaaauggagg

SEQ ID NO: 11244 - RNA, 23 nt, Human
gaucccauauuguuuccaucuuu

SEQ ID NO: 11245 - RNA, 24 nt, Human
gaucccucccccagcucugcuggg

SEQ ID NO: 11246 - RNA, 22 nt, Human
gaucgcuuccugauagaagaug

SEQ ID NO: 11247 - RNA, 24 nt, Human
gaucuggacuccgacccggcgcca

SEQ ID NO: 11248 - RNA, 22 nt, Human
gaugaacagugagagauuccca

SEQ ID NO: 11249 - RNA, 24 nt, Human
gaugaagccagugauuaggguguu

SEQ ID NO: 11250 - RNA, 18 nt, Human
gaugaggcagcacuuggg

SEQ ID NO: 11251 - RNA, 24 nt, Human
gaugauacaugucagugcugugga

SEQ ID NO: 11252 - RNA, 24 nt, Human
gaugcuguuugugccagaagcugg

SEQ ID NO: 11253 - RNA, 24 nt, Human
gauggcaagaacugcuggagacac

SEQ ID NO: 11254 - RNA, 24 nt, Human
gauggugugcccucgguugggucc

SEQ ID NO: 11255 - RNA, 22 nt, Human
gauguugaugagcuugugugca

SEQ ID NO: 11256 - RNA, 24 nt, Human
gauuacagaugugagccaccaugg

SEQ ID NO: 11257 - RNA, 23 nt, Human
gauuacaggaugauaggcugcgu

SEQ ID NO: 11258 - RNA, 24 nt, Human
gauuacaggcaugagccacugcac

SEQ ID NO: 11259 - RNA, 24 nt, Human
gauuacaggcaugagucaccauac

SEQ ID NO: 11260 - RNA, 24 nt, Human
gauuacaggugugagccacugugc

SEQ ID NO: 11261 - RNA, 22 nt, Human
gcaauauuucuauauauguguc

SEQ ID NO: 11262 - RNA, 24 nt, Human
gcacaaguugcggcagcugccuga

SEQ ID NO: 11263 - RNA, 22 nt, Human
gcaccugcuguguacgguauau

SEQ ID NO: 11264 - RNA, 24 nt, Human
gcacgguggugacuguccgggaug

SEQ ID NO: 11265 - RNA, 24 nt, Human
gcagaagagggaaagacaggggaa

SEQ ID NO: 11266 - RNA, 24 nt, Human
gcagaccugacauccaguacccug

SEQ ID NO: 11267 - RNA, 24 nt, Human
gcagagcguccuggcacuaacuca

SEQ ID NO: 11268 - RNA, 22 nt, Human
gcagcucccuauuccaugacag

SEQ ID NO: 11269 - RNA, 22 nt, Human
gcaggaagauugcagaaggcug

SEQ ID NO: 11270 - RNA, 24 nt, Human
gcaggccaaggcagugcugagcgc

SEQ ID NO: 11271 - RNA, 22 nt, Human
gcaguauuguguguggucaugg

SEQ ID NO: 11272 - RNA, 22 nt, Human
gcauuucaccaggcauucuuua

SEQ ID NO: 11273 - RNA, 24 nt, Human
gccaaauuuccacuuucagcaguu

SEQ ID NO: 11274 - RNA, 20 nt, Human
gccaaguuccaguucaucuu

SEQ ID NO: 11275 - RNA, 24 nt, Human
gccacaggguuccuacucgccccu

SEQ ID NO: 11276 - RNA, 22 nt, Human
gccaccaugcccagcuaauacc

SEQ ID NO: 11277 - RNA, 24 nt, Human
gccacuggccuugccuuuggcaca

SEQ ID NO: 11278 - RNA, 24 nt, Human
gccagguuuccgauugucgauuca

SEQ ID NO: 11279 - RNA, 22 nt, Human
gccaugcggagcuucuagaugc

SEQ ID NO: 11280 - RNA, 24 nt, Human
gccauguugccucggcuggucuag

SEQ ID NO: 11281 - RNA, 22 nt, Human
gccauuccucuauaagcgggug

SEQ ID NO: 11282 - RNA, 22 nt, Human
gccauugcacuccagccugggu

SEQ ID NO: 11283 - RNA, 24 nt, Human
gcccagaggugcaaggagcugggu

SEQ ID NO: 11284 - RNA, 24 nt, Human
gcccagagucugagucccagcccu

SEQ ID NO: 11285 - RNA, 24 nt, Human
gccccaggugauccacccacuuua

SEQ ID NO: 11286 - RNA, 24 nt, Human
gccccgaggaggcggcuccucuuc

SEQ ID NO: 11287 - RNA, 24 nt, Human
gccccggauaccuggacugcuuag

SEQ ID NO: 11288 - RNA, 24 nt, Human
gccccgggagaaacacgccagggg

SEQ ID NO: 11289 - RNA, 24 nt, Human
gccccgguagcaagcauggcaggg

SEQ ID NO: 11290 - RNA, 24 nt, Human
gccccugugacuccaaguauaagg

SEQ ID NO: 11291 - RNA, 24 nt, Human
gcccggaagaucaagucgugcucc

SEQ ID NO: 11292 - RNA, 24 nt, Human
gcccggagcaccuccaugccucag

SEQ ID NO: 11293 - RNA, 23 nt, Human
gcccgggggccccucaagugugu

SEQ ID NO: 11294 - RNA, 22 nt, Human
gcccuagaaaauuaauauguga

SEQ ID NO: 11295 - RNA, 24 nt, Human
gcccugggcagcaacaagcugggu

SEQ ID NO: 11296 - RNA, 22 nt, Human
gcccuguugaccagaauuuguu

SEQ ID NO: 11297 - RNA, 24 nt, Human
gcccuguuugauuaugaucggacu

SEQ ID NO: 11298 - RNA, 22 nt, Human
gccgccuuuucagaagcggugc

SEQ ID NO: 11299 - RNA, 22 nt, Human
gccgucagucucccacuagcug

SEQ ID NO: 11300 - RNA, 24 nt, Human
gccgugcgcacccaggagaaggag

SEQ ID NO: 11301 - RNA, 22 nt, Human
gccuaggccagugcaguccagu

SEQ ID NO: 11302 - RNA, 22 nt, Human
gccucaaaaguguuguagaggg

SEQ ID NO: 11303 - RNA, 22 nt, Human
gccucagucucccgaguagcug

SEQ ID NO: 11304 - RNA, 22 nt, Human
gccuccuucauggaauucagug

SEQ ID NO: 11305 - RNA, 22 nt, Human
gccuggccuuccuguguuuuac

SEQ ID NO: 11306 - RNA, 22 nt, Human
gccugggaggacaagccgaguu

SEQ ID NO: 11307 - RNA, 24 nt, Human
gcgaaaagcuuucagaaacacugg

SEQ ID NO: 11308 - RNA, 24 nt, Human
gcgaaggguagcucccuccucgug

SEQ ID NO: 11309 - RNA, 24 nt, Human
gcgaccgccuccgcggcgccccug

SEQ ID NO: 11310 - RNA, 24 nt, Human
gcgagccagagcggggaggccggc

SEQ ID NO: 11311 - RNA, 24 nt, Human
gcgccuggcgggacgugugggccg

SEQ ID NO: 11312 - RNA, 24 nt, Human
gcgcgggucaaccuggccacgugc

SEQ ID NO: 11313 - RNA, 24 nt, Human
gcgcguugcugcggccgugguccg

SEQ ID NO: 11314 - RNA, 24 nt, Human
gcggaucgagugagcgccggcggc

SEQ ID NO: 11315 - RNA, 22 nt, Human
gcggggugacuuggccagucug

SEQ ID NO: 11316 - RNA, 24 nt, Human
gcuaaaguugaacaaucccgguac

SEQ ID NO: 11317 - RNA, 24 nt, Human
gcuaagcuugagcauggcugagca

SEQ ID NO: 11318 - RNA, 24 nt, Human
gcuaagucauuugauucaguagaa

SEQ ID NO: 11319 - RNA, 24 nt, Human
gcucaaggagaagaagcuggugaa

SEQ ID NO: 11320 - RNA, 22 nt, Human
gcucacugcaaccucugccucc

SEQ ID NO: 11321 - RNA, 22 nt, Human
gcucagaauuagccacacugac

SEQ ID NO: 11322 - RNA, 22 nt, Human
gcucagaauucagaccagcugg

SEQ ID NO: 11323 - RNA, 24 nt, Human
gcucaucguguggcugcuggugaa

SEQ ID NO: 11324 - RNA, 24 nt, Human
gcucauuuugcaguuguugaaauu

SEQ ID NO: 11325 - RNA, 22 nt, Human
gcuccauugucuguggcuuucu

SEQ ID NO: 11326 - RNA, 22 nt, Human
gcucuuauagucccagcauguu

SEQ ID NO: 11327 - RNA, 22 nt, Human
gcucuucacuugugucaggcug

SEQ ID NO: 11328 - RNA, 24 nt, Human
gcugaagagguauuuaaauauuuu

SEQ ID NO: 11329 - RNA, 24 nt, Human
gcugacaucugaggacucugcugu

SEQ ID NO: 11330 - RNA, 22 nt, Human
gcugaguuucucauuuguagua

SEQ ID NO: 11331 - RNA, 22 nt, Human
gcugcaguuccugaacggccac

SEQ ID NO: 11332 - RNA, 24 nt, Human
gcugcaguuggaacgauggcggcu

SEQ ID NO: 11333 - RNA, 22 nt, Human
gcuguucugugcauuguuggau

SEQ ID NO: 11334 - RNA, 22 nt, Human
gcuguuguuaagggcacuuggg

SEQ ID NO: 11335 - RNA, 22 nt, Human
gcuucacgaagcacagagauaa

SEQ ID NO: 11336 - RNA, 24 nt, Human
gcuucaguggagcccuacugugcu

SEQ ID NO: 11337 - RNA, 22 nt, Human
gcuucuccuguccccucccuac

SEQ ID NO: 11338 - RNA, 22 nt, Human
gcuugauuugcuuggugaccga

SEQ ID NO: 11339 - RNA, 24 nt, Human
gcuugcuccuaaaugugauccugc

SEQ ID NO: 11340 - RNA, 24 nt, Human
gcuuguuuuuccaccagaccccga

SEQ ID NO: 11341 - RNA, 22 nt, Human
gcuuugggguuaagcgucaucu

SEQ ID NO: 11342 - RNA, 24 nt, Human
gcuuuggugcugacaucggaaugg

SEQ ID NO: 11343 - RNA, 22 nt, Human
gcuuuguguguuugugugugca

SEQ ID NO: 11344 - RNA, 24 nt, Human
gcuuuugggaagcaggacguucuc

SEQ ID NO: 11345 - RNA, 22 nt, Human
ggaaacuuuuuccaaaguggcu

SEQ ID NO: 11346 - RNA, 24 nt, Human
ggaaagaguuuaaaagacuugaau

SEQ ID NO: 11347 - RNA, 24 nt, Human
ggaaaguuccauaggaagccuaag

SEQ ID NO: 11348 - RNA, 22 nt, Human
ggaaauccucugggguggacgg

SEQ ID NO: 11349 - RNA, 22 nt, Human
ggaaccuuuucaguucauacac

SEQ ID NO: 11350 - RNA, 22 nt, Human
ggaagaaugugcuuuuguuguu

SEQ ID NO: 11351 - RNA, 22 nt, Human
ggaaggcagauuagacaucgag

SEQ ID NO: 11352 - RNA, 22 nt, Human
ggaauguaaacaaauauuguau

SEQ ID NO: 11353 - RNA, 24 nt, Human
ggacaagggcugcccgcgugucca

SEQ ID NO: 11354 - RNA, 22 nt, Human
ggacaagggggauccguuugga

SEQ ID NO: 11355 - RNA, 23 nt, Human
ggacacgaagcaaaugaugagua

SEQ ID NO: 11356 - RNA, 24 nt, Human
ggacaugugcuucagaaccuggau

SEQ ID NO: 11357 - RNA, 22 nt, Human
ggaccaagauaugauuauaucu

SEQ ID NO: 11358 - RNA, 24 nt, Human
ggaccugcgagcuggccuaaugug

SEQ ID NO: 11359 - RNA, 24 nt, Human
ggacuacaggcauaagccaucaug

SEQ ID NO: 11360 - RNA, 23 nt, Human
ggacucggccccccaggccucgc

SEQ ID NO: 11361 - RNA, 22 nt, Human
ggacugguagugcaggcuggcu

SEQ ID NO: 11362 - RNA, 22 nt, Human
ggacuugaauggaugaugucac

SEQ ID NO: 11363 - RNA, 24 nt, Human
ggagaaagugaccuagagauugca

SEQ ID NO: 11364 - RNA, 24 nt, Human
ggagaagacgaauauuuggacaac

SEQ ID NO: 11365 - RNA, 24 nt, Human
ggagacagaugagaaaugagaaca

SEQ ID NO: 11366 - RNA, 21 nt, Human
ggagagcauguugcauuugcc

SEQ ID NO: 11367 - RNA, 23 nt, Human
ggagagcuaguaggagccaggca

SEQ ID NO: 11368 - RNA, 24 nt, Human
ggagaggaaugaccuguuucuuuc

SEQ ID NO: 11369 - RNA, 24 nt, Human
ggagaggagggcggagguccugcu

SEQ ID NO: 11370 - RNA, 24 nt, Human
ggagcacggggugacuugcuuggg

SEQ ID NO: 11371 - RNA, 20 nt, Human
ggagcagguuggaauaugca

SEQ ID NO: 11372 - RNA, 24 nt, Human
ggagcggagugggucgggcggggc

SEQ ID NO: 11373 - RNA, 22 nt, Human
ggagguagggugaggaaaugaa

SEQ ID NO: 11374 - RNA, 22 nt, Human
ggaggugacuguuacagaucgg

SEQ ID NO: 11375 - RNA, 22 nt, Human
ggagguggagguugcagugagc

SEQ ID NO: 11376 - RNA, 24 nt, Human
ggagguuucggcaguggcauccgg

SEQ ID NO: 11377 - RNA, 24 nt, Human
ggaguccagcagggccaguccugc

SEQ ID NO: 11378 - RNA, 22 nt, Human
ggagugccugaaaccuguacug

SEQ ID NO: 11379 - RNA, 22 nt, Human
ggaguuaugauagcaguggagg

SEQ ID NO: 11380 - RNA, 24 nt, Human
ggaguucgauacuagccugggcaa

SEQ ID NO: 11381 - RNA, 24 nt, Human
ggaucaggguauguuugcgagcgg

SEQ ID NO: 11382 - RNA, 22 nt, Human
ggauccuucagcacugaggugu

SEQ ID NO: 11383 - RNA, 22 nt, Human
ggcaaaagggcauuuucuaccu

SEQ ID NO: 11384 - RNA, 24 nt, Human
ggcaaaauaucugccuuauacaug

SEQ ID NO: 11385 - RNA, 22 nt, Human
ggcaacaagagcgaaacuccau

SEQ ID NO: 11386 - RNA, 22 nt, Human
ggcaagucuugcauccacugcu

SEQ ID NO: 11387 - RNA, 24 nt, Human
ggcaauaaauacugauggccaagc

SEQ ID NO: 11388 - RNA, 22 nt, Human
ggcaauauuccaggauaggcug

SEQ ID NO: 11389 - RNA, 22 nt, Human
ggcaggaucauagcucacugca

SEQ ID NO: 11390 - RNA, 22 nt, Human
ggcagugucauuagcugauugu

SEQ ID NO: 11391 - RNA, 22 nt, Human
ggcaugaaugcuggcauauuga

SEQ ID NO: 11392 - RNA, 22 nt, Human
ggcaugauggagaggguggaga

SEQ ID NO: 11393 - RNA, 22 nt, Human
ggcaugugugagcagcugcagg

SEQ ID NO: 11394 - RNA, 22 nt, Human
ggcauucaauuaaacacccucc

SEQ ID NO: 11395 - RNA, 24 nt, Human
ggccaacacugccuuuuuccaggg

SEQ ID NO: 11396 - RNA, 22 nt, Human
ggccacuuagaaggccugaguu

SEQ ID NO: 11397 - RNA, 22 nt, Human
ggccauucagucucaggcccuc

SEQ ID NO: 11398 - RNA, 22 nt, Human
ggcccaggagggggagaaaggc

SEQ ID NO: 11399 - RNA, 24 nt, Human
ggcccgggcggccggggcuucugg

SEQ ID NO: 11400 - RNA, 24 nt, Human
ggccgaggagcuacccccuccagg

SEQ ID NO: 11401 - RNA, 24 nt, Human
ggccgaguggcgacugauguuccu

SEQ ID NO: 11402 - RNA, 22 nt, Human
ggccgggugguugguugaaugg

SEQ ID NO: 11403 - RNA, 24 nt, Human
ggccgugguggugaagcuguagcc

SEQ ID NO: 11404 - RNA, 24 nt, Human
ggccuagcggggguacguggcgca

SEQ ID NO: 11405 - RNA, 24 nt, Human
ggccucugauuuccccaucuguau

SEQ ID NO: 11406 - RNA, 22 nt, Human
ggccugagaccuggauugagcc

SEQ ID NO: 11407 - RNA, 22 nt, Human
ggccugaggucagcaguagagg

SEQ ID NO: 11408 - RNA, 24 nt, Human
ggccugaguuugaugacuccgggg

SEQ ID NO: 11409 - RNA, 24 nt, Human
ggccuggaagaagaccccugaggu

SEQ ID NO: 11410 - RNA, 24 nt, Human
ggccuuagucgccagucccgcgcu

SEQ ID NO: 11411 - RNA, 17 nt, Human
ggccuugggaacuugga

SEQ ID NO: 11412 - RNA, 24 nt, Human
ggcgagugaaaggguuccaaccgg

SEQ ID NO: 11413 - RNA, 22 nt, Human
ggcgccgacagcauauucugaa

SEQ ID NO: 11414 - RNA, 24 nt, Human
ggcuaguagggcgcacuuggcggg

SEQ ID NO: 11415 - RNA, 22 nt, Human
ggcucccacuuccuucucccag

SEQ ID NO: 11416 - RNA, 24 nt, Human
ggcucuguugcgggcgcacgacgc

SEQ ID NO: 11417 - RNA, 24 nt, Human
ggcugguggccugagcgggaggcc

SEQ ID NO: 11418 - RNA, 22 nt, Human
ggcuugauuuugcuuggugacc

SEQ ID NO: 11419 - RNA, 24 nt, Human
gggaaagaaagcagagacuaacuc

SEQ ID NO: 11420 - RNA, 24 nt, Human
gggaagaucuaggagaagaggaag

SEQ ID NO: 11421 - RNA, 23 nt, Human
gggaaggaaaagggaguacagac

SEQ ID NO: 11422 - RNA, 24 nt, Human
gggaaggaaaggggccugagcugg

SEQ ID NO: 11423 - RNA, 24 nt, Human
gggaaggacuccggaccgcugggg

SEQ ID NO: 11424 - RNA, 24 nt, Human
gggaaggaucuuuggccuagggga

SEQ ID NO: 11425 - RNA, 24 nt, Human
gggaagggagaaagggauguagga

SEQ ID NO: 11426 - RNA, 22 nt, Human
gggaagggauacagagcuuggu

SEQ ID NO: 11427 - RNA, 24 nt, Human
gggaagggggaccugcuguuuggc

SEQ ID NO: 11428 - RNA, 24 nt, Human
gggaagguauuuauugauccacac

SEQ ID NO: 11429 - RNA, 24 nt, Human
gggaaugccuggcagaaguugcgc

SEQ ID NO: 11430 - RNA, 24 nt, Human
gggaauguagacgccagcuguaca

SEQ ID NO: 11431 - RNA, 22 nt, Human
gggaccucagggcuuggaguca

SEQ ID NO: 11432 - RNA, 22 nt, Human
gggaggauccuugcucaacuua

SEQ ID NO: 11433 - RNA, 24 nt, Human
gggcaaccucagggggauauuuau

SEQ ID NO: 11434 - RNA, 22 nt, Human
gggcaagacaauggaguuagac

SEQ ID NO: 11435 - RNA, 24 nt, Human
gggcaagaguuucgccggcgcauc

SEQ ID NO: 11436 - RNA, 24 nt, Human
gggcacugaagaugaugcgaccca

SEQ ID NO: 11437 - RNA, 24 nt, Human
gggcacugaggcccgggauguagg

SEQ ID NO: 11438 - RNA, 24 nt, Human
gggcagagcacgacggguaggcug

SEQ ID NO: 11439 - RNA, 24 nt, Human
gggcagagcugagaagccaagggg

SEQ ID NO: 11440 - RNA, 24 nt, Human
gggcaggaugaaaucaccuagggu

SEQ ID NO: 11441 - RNA, 24 nt, Human
gggcagggccugaaguguuggggg

SEQ ID NO: 11442 - RNA, 24 nt, Human
gggcagguguuuagguggaagagc

SEQ ID NO: 11443 - RNA, 24 nt, Human
gggcaucaggaaacuuggccacag

SEQ ID NO: 11444 - RNA, 24 nt, Human
gggcaucgucugcaccagccccau

SEQ ID NO: 11445 - RNA, 24 nt, Human
gggcauggccgcguguguggcagc

SEQ ID NO: 11446 - RNA, 24 nt, Human
gggcauuggggcuuuccagcucuc

SEQ ID NO: 11447 - RNA, 24 nt, Human
gggccaucucccucccggagucgc

SEQ ID NO: 11448 - RNA, 24 nt, Human
gggccuggugguugggagucaccu

SEQ ID NO: 11449 - RNA, 23 nt, Human
gggcguggaggccgcggaggccg

SEQ ID NO: 11450 - RNA, 22 nt, Human
gggcugaugaguugaccguggu

SEQ ID NO: 11451 - RNA, 22 nt, Human
gggcugcaucucucuggauugc

SEQ ID NO: 11452 - RNA, 21 nt, Human
gggcuggaagaagcuucccug

SEQ ID NO: 11453 - RNA, 22 nt, Human
gggcuggucucaucauaucuaa

SEQ ID NO: 11454 - RNA, 24 nt, Human
gggcuggugggugaaccccuaggg

SEQ ID NO: 11455 - RNA, 24 nt, Human
gggcuugucaaugaugcagaucau

SEQ ID NO: 11456 - RNA, 24 nt, Human
gggcuuguggccuuagacgccagu

SEQ ID NO: 11457 - RNA, 24 nt, Human
ggggaccacgccccacacccgggg

SEQ ID NO: 11458 - RNA, 24 nt, Human
ggggacuacaaugugccacgucgg

SEQ ID NO: 11459 - RNA, 24 nt, Human
ggggagcgagcacgucgcuccgca

SEQ ID NO: 11460 - RNA, 24 nt, Human
ggggagggugagugucuguguagg

SEQ ID NO: 11461 - RNA, 24 nt, Human
ggggauccagagccaugucggacc

SEQ ID NO: 11462 - RNA, 22 nt, Human
aauuccauuucuucugaacuga

SEQ ID NO: 11463 - RNA, 22 nt, Human
aauugcaaaauaagcaaaugua

SEQ ID NO: 11464 - RNA, 22 nt, Human
aauugcuugaacccaggaagug

SEQ ID NO: 11465 - RNA, 24 nt, Human
aauuguguuauccaggauuuucca

SEQ ID NO: 11466 - RNA, 22 nt, Human
aauuuagaaucguuucugauag

SEQ ID NO: 11467 - RNA, 22 nt, Human
aauuucuuuuguacaagauugu

SEQ ID NO: 11468 - RNA, 22 nt, Human
acaaaagccacacuagaucuuc

SEQ ID NO: 11469 - RNA, 24 nt, Human
acaaagaugaaaagcuuggccaca

SEQ ID NO: 11470 - RNA, 22 nt, Human
acaacgacaggauugacagauu

SEQ ID NO: 11471 - RNA, 24 nt, Human
acaagggucacauuggaugcgagu

SEQ ID NO: 11472 - RNA, 24 nt, Human
acaagguuucaccauguugcccgg

SEQ ID NO: 11473 - RNA, 22 nt, Human
acacaggcccagagaggcagug

SEQ ID NO: 11474 - RNA, 22 nt, Human
acacaguggcagaauugcucuc

SEQ ID NO: 11475 - RNA, 22 nt, Human
acacaucuaauggcugugcuga

SEQ ID NO: 11476 - RNA, 24 nt, Human
acaccaaaauguauuuauuacauc

SEQ ID NO: 11477 - RNA, 24 nt, Human
acaccacugcacuccagccugggc

SEQ ID NO: 11478 - RNA, 24 nt, Human
acaccagccuguuacuaacagccu

SEQ ID NO: 11479 - RNA, 22 nt, Human
acacugggguccccaaagaagu

SEQ ID NO: 11480 - RNA, 24 nt, Human
acagagcugacgcuucaucacgug

SEQ ID NO: 11481 - RNA, 22 nt, Human
acagauucaucaccacgaucug

SEQ ID NO: 11482 - RNA, 24 nt, Human
acagcaaaguguggugcgaucucu

SEQ ID NO: 11483 - RNA, 24 nt, Human
acagcgaucucucucuucuccuau

SEQ ID NO: 11484 - RNA, 24 nt, Human
acagcucuuuuacaaacaaguuau

SEQ ID NO: 11485 - RNA, 22 nt, Human
acaggccuggguucaaauuugg

SEQ ID NO: 11486 - RNA, 24 nt, Human
acaggguuuugccauguugcucag

SEQ ID NO: 11487 - RNA, 24 nt, Human
acagucuuugaguaacaucuguuc

SEQ ID NO: 11488 - RNA, 24 nt, Human
acagugagggcuauacaugguagc

SEQ ID NO: 11489 - RNA, 24 nt, Human
acagugcccugccuuggcugucag

SEQ ID NO: 11490 - RNA, 24 nt, Human
acagugcugcaggcugagcugaca

SEQ ID NO: 11491 - RNA, 22 nt, Human
acauaucuagguacauacacau

SEQ ID NO: 11492 - RNA, 22 nt, Human
acaucuacuuaacuggcacaau

SEQ ID NO: 11493 - RNA, 22 nt, Human
acaugaauucaaugaagggggc

SEQ ID NO: 11494 - RNA, 22 nt, Human
acauuuccaauguuuggggaca

SEQ ID NO: 11495 - RNA, 24 nt, Human
accaagaggauuugccagaggucu

SEQ ID NO: 11496 - RNA, 22 nt, Human
accacagugucacagaguccau

SEQ ID NO: 11497 - RNA, 22 nt, Human
accacuuuguagucccuaccag

SEQ ID NO: 11498 - RNA, 22 nt, Human
accagcugcauccugcaaacuu

SEQ ID NO: 11499 - RNA, 24 nt, Human
accagcugcccgguggggcagacc

SEQ ID NO: 11500 - RNA, 22 nt, Human
accagcugugugaacuuaggaa

SEQ ID NO: 11501 - RNA, 24 nt, Human
accaggcaaauucuuaguccuacu

SEQ ID NO: 11502 - RNA, 24 nt, Human
accagguacaugcacuggguaccc

SEQ ID NO: 11503 - RNA, 22 nt, Human
accaucuucccuuucucgagua

SEQ ID NO: 11504 - RNA, 22 nt, Human
accauucauaucccuuacccuc

SEQ ID NO: 11505 - RNA, 24 nt, Human
accauuuuacuuaugauguucagg

SEQ ID NO: 11506 - RNA, 24 nt, Human
acccauucagccccuuccgcuguc

SEQ ID NO: 11507 - RNA, 24 nt, Human
accccaggucaaaaagggcccgaa

SEQ ID NO: 11508 - RNA, 24 nt, Human
accccgggaccagaugucccuccc

SEQ ID NO: 11509 - RNA, 24 nt, Human
acccggacucucuggcaagggacu

SEQ ID NO: 11510 - RNA, 24 nt, Human
acccucuuggccauccgggcccca

SEQ ID NO: 11511 - RNA, 24 nt, Human
acccugaaaucuucugcuguccca

SEQ ID NO: 11512 - RNA, 24 nt, Human
acccugggagggcccauccagcua

SEQ ID NO: 11513 - RNA, 24 nt, Human
acccugggcuccucgaacucagcc

SEQ ID NO: 11514 - RNA, 24 nt, Human
acccugggggccaaaagguguggg

SEQ ID NO: 11515 - RNA, 24 nt, Human
acccuuuuggcauuguugccacca

SEQ ID NO: 11516 - RNA, 22 nt, Human
accgagugugcuacuucuaucc

SEQ ID NO: 11517 - RNA, 24 nt, Human
accggaagggcagaauuuauuuuu

SEQ ID NO: 11518 - RNA, 24 nt, Human
accuaguacuuugagaaaguuaua

SEQ ID NO: 11519 - RNA, 24 nt, Human
accucggucuuguggcaaauggug

SEQ ID NO: 11520 - RNA, 22 nt, Human
accugagaagcgagguuucugg

SEQ ID NO: 11521 - RNA, 24 nt, Human
accugcugagacucccccuggagc

SEQ ID NO: 11522 - RNA, 24 nt, Human
accugcugccugucucccugaccc

SEQ ID NO: 11523 - RNA, 24 nt, Human
accugggugcagccgcaguccaag

SEQ ID NO: 11524 - RNA, 22 nt, Human
accugguaauuuauuggaaguc

SEQ ID NO: 11525 - RNA, 24 nt, Human
accuggugguguuugucugugguc

SEQ ID NO: 11526 - RNA, 22 nt, Human
accuucuugccaauauaggaau

SEQ ID NO: 11527 - RNA, 24 nt, Human
accuugucacagggcuaugucuug

SEQ ID NO: 11528 - RNA, 24 nt, Human
acgaaccgguguacacuugucagg

SEQ ID NO: 11529 - RNA, 24 nt, Human
acgaacuaguggcuugcauauugg

SEQ ID NO: 11530 - RNA, 24 nt, Human
acgaagccauugaaacagaugauc

SEQ ID NO: 11531 - RNA, 22 nt, Human
acgaauggaugauccuggugga

SEQ ID NO: 11532 - RNA, 24 nt, Human
acgagccccagaugcagucuacac

SEQ ID NO: 11533 - RNA, 24 nt, Human
acgagccuccccuguaugccugcu

SEQ ID NO: 11534 - RNA, 24 nt, Human
acgagguuuagggucgcggcuaca

SEQ ID NO: 11535 - RNA, 24 nt, Human
acgcaccugugagucguccagcuc

SEQ ID NO: 11536 - RNA, 24 nt, Human
acgcaguguccuguguuggcuccu

SEQ ID NO: 11537 - RNA, 24 nt, Human
acgcaguuucaucucagggaggcc

SEQ ID NO: 11538 - RNA, 24 nt, Human
acgcauagccaaggggaagcgcga

SEQ ID NO: 11539 - RNA, 24 nt, Human
acgccacucugcuccagccugggu

SEQ ID NO: 11540 - RNA, 24 nt, Human
acgccagugugccuguguggagug

SEQ ID NO: 11541 - RNA, 24 nt, Human
acgccaugaaagcggccauggccu

SEQ ID NO: 11542 - RNA, 24 nt, Human
acgccaugaaagcugcauggccug

SEQ ID NO: 11543 - RNA, 24 nt, Human
acgccaugaaagcugccuuggccc

SEQ ID NO: 11544 - RNA, 24 nt, Human
acgcuccuccgccagcuugcucgc

SEQ ID NO: 11545 - RNA, 24 nt, Human
acgcucuaugacaccaccaagguc

SEQ ID NO: 11546 - RNA, 24 nt, Human
acgcugccgcugcucugcgccggg

SEQ ID NO: 11547 - RNA, 24 nt, Human
acgcuuuguacgcucugcguuccc

SEQ ID NO: 11548 - RNA, 24 nt, Human
acgcuuugucaugcuucuucagua

SEQ ID NO: 11549 - RNA, 24 nt, Human
acggagcaggagcugcuggcgcug

SEQ ID NO: 11550 - RNA, 22 nt, Human
acgggauccaguucuaugagcg

SEQ ID NO: 11551 - RNA, 24 nt, Human
acggggccuucucguacccuggcc

SEQ ID NO: 11552 - RNA, 24 nt, Human
acgggguuucaccauguuggucag

SEQ ID NO: 11553 - RNA, 24 nt, Human
acgguccuggucaugugccacacg

SEQ ID NO: 11554 - RNA, 22 nt, Human
acguaucaccuagguauuaagc

SEQ ID NO: 11555 - RNA, 22 nt, Human
acgugguuuacuagaaguggcc

SEQ ID NO: 11556 - RNA, 24 nt, Human
acguuuccaauuucuaaauuuuaa

SEQ ID NO: 11557 - RNA, 24 nt, Human
acuaaguaauaucaggaaagaaga

SEQ ID NO: 11558 - RNA, 24 nt, Human
acuacauaaucgcugcacgugccc

SEQ ID NO: 11559 - RNA, 24 nt, Human
acuacuguucgaagauuuuuggaa

SEQ ID NO: 11560 - RNA, 24 nt, Human
acuauggugguugacuacagaacc

SEQ ID NO: 11561 - RNA, 22 nt, Human
acuauuaaaauagcggagugga

SEQ ID NO: 11562 - RNA, 22 nt, Human
acucacaguucugcauggcuga

SEQ ID NO: 11563 - RNA, 22 nt, Human
acucacugcauccucugccuuc

SEQ ID NO: 11564 - RNA, 24 nt, Human
acucagcuggagcugaaggggaac

SEQ ID NO: 11565 - RNA, 19 nt, Human
ucccuaagggaaaaggagg

SEQ ID NO: 11566 - RNA, 22 nt, Human
ucccucagcuccuguccuuugu

SEQ ID NO: 11567 - RNA, 24 nt, Human
ucccucagugauccuuuuacucuc

SEQ ID NO: 11568 - RNA, 24 nt, Human
ucccugagacuuccuuagguuguc

SEQ ID NO: 11569 - RNA, 22 nt, Human
ucccugagcccugaaggguguu

SEQ ID NO: 11570 - RNA, 22 nt, Human
ucccugaggagaaagguguggc

SEQ ID NO: 11571 - RNA, 24 nt, Human
ucccugaguggcugcaucucuucu

SEQ ID NO: 11572 - RNA, 22 nt, Human
ucccugauggggaccaugacuu

SEQ ID NO: 11573 - RNA, 24 nt, Human
ucccugcaggugucuugccccuau

SEQ ID NO: 11574 - RNA, 24 nt, Human
ucccugccaagaaaaauguagaug

SEQ ID NO: 11575 - RNA, 22 nt, Human
ucccugcucucuucucugcugg

SEQ ID NO: 11576 - RNA, 20 nt, Human
ucccuggccagguccauccg

SEQ ID NO: 11577 - RNA, 22 nt, Human
ucccugggacaacuuucuuauu

SEQ ID NO: 11578 - RNA, 22 nt, Human
ucccugggccacuguuguacua

SEQ ID NO: 11579 - RNA, 23 nt, Human
ucccugggcgacguggguuucug

SEQ ID NO: 11580 - RNA, 24 nt, Human
ucccuggggggccacccaaaucgg

SEQ ID NO: 11581 - RNA, 24 nt, Human
ucccuggggucagccgcucuggcu

SEQ ID NO: 11582 - RNA, 24 nt, Human
ucccuggucaaggccacggcuuuu

SEQ ID NO: 11583 - RNA, 24 nt, Human
ucccuguaaugcccgucuuuccug

SEQ ID NO: 11584 - RNA, 24 nt, Human
ucccugugaaaggcaggcucgggu

SEQ ID NO: 11585 - RNA, 24 nt, Human
ucccugugcacaggugggcugacc

SEQ ID NO: 11586 - RNA, 24 nt, Human
ucccugugcgugaacgaggugccc

SEQ ID NO: 11587 - RNA, 24 nt, Human
ucccuguggccuguacccgucccu

SEQ ID NO: 11588 - RNA, 24 nt, Human
ucccuuagaaacuugggccaaacc

SEQ ID NO: 11589 - RNA, 22 nt, Human
ucccuuccuuccuccucuuggg

SEQ ID NO: 11590 - RNA, 24 nt, Human
ucccuugcaguuguucgccccucu

SEQ ID NO: 11591 - RNA, 24 nt, Human
ucccuuggggguggcuugccccca

SEQ ID NO: 11592 - RNA, 22 nt, Human
ucccuuugaagccagguuccag

SEQ ID NO: 11593 - RNA, 24 nt, Human
ucccuuuuccccucaaaggagaac

SEQ ID NO: 11594 - RNA, 24 nt, Human
uccgcagaguuugggcgccaggcg

SEQ ID NO: 11595 - RNA, 24 nt, Human
uccgcaggaaaguugagagcauca

SEQ ID NO: 11596 - RNA, 24 nt, Human
uccgccccacuugugucgggaagc

SEQ ID NO: 11597 - RNA, 22 nt, Human
uccgccucccccaaaccucacc

SEQ ID NO: 11598 - RNA, 23 nt, Human
uccgcgcgccgggagccggccgc

SEQ ID NO: 11599 - RNA, 22 nt, Human
uccgcuuucaggaagacauuau

SEQ ID NO: 11600 - RNA, 24 nt, Human
uccggcaugugcaaagcugguuuu

SEQ ID NO: 11601 - RNA, 24 nt, Human
uccgggguagcaggggcugcucug

SEQ ID NO: 11602 - RNA, 24 nt, Human
uccguagucuauucuuucccucau

SEQ ID NO: 11603 - RNA, 24 nt, Human
uccguagucuggugggccucugua

SEQ ID NO: 11604 - RNA, 22 nt, Human
uccguccucccagucucgagac

SEQ ID NO: 11605 - RNA, 24 nt, Human
uccgugacuggcuccccagcaauc

SEQ ID NO: 11606 - RNA, 23 nt, Human
uccgugcgcguugcugcggccgu

SEQ ID NO: 11607 - RNA, 24 nt, Human
uccguggauacagaaaucucugca

SEQ ID NO: 11608 - RNA, 24 nt, Human
uccguuggcccaaccagucccagc

SEQ ID NO: 11609 - RNA, 22 nt, Human
uccuacauguucucaaaacaca

SEQ ID NO: 11610 - RNA, 22 nt, Human
uccucaccaaaagcacucacuu

SEQ ID NO: 11611 - RNA, 22 nt, Human
uccucaucuuugagucccagcg

SEQ ID NO: 11612 - RNA, 22 nt, Human
uccucauuaauuuuccucauga

SEQ ID NO: 11613 - RNA, 24 nt, Human
uccucggucuccgcccugcccccg

SEQ ID NO: 11614 - RNA, 22 nt, Human
uccucgugccuauccugguggu

SEQ ID NO: 11615 - RNA, 24 nt, Human
uccucugucucucgaggaacuagg

SEQ ID NO: 11616 - RNA, 22 nt, Human
uccugauggacaucgagcaggu

SEQ ID NO: 11617 - RNA, 22 nt, Human
uccugcuaugacuaggcagacu

SEQ ID NO: 11618 - RNA, 24 nt, Human
uccuggaagcaaggcggcucuagc

SEQ ID NO: 11619 - RNA, 24 nt, Human
uccuggguuaaccuuuguuggcug

SEQ ID NO: 11620 - RNA, 22 nt, Human
uccuuaggaccuagagguagua

SEQ ID NO: 11621 - RNA, 24 nt, Human
uccuucacuccaguuaauggcacu

SEQ ID NO: 11622 - RNA, 24 nt, Human
uccuucaugcacuaaacuggacag

SEQ ID NO: 11623 - RNA, 22 nt, Human
uccuucuguagucuuuuagggg

SEQ ID NO: 11624 - RNA, 22 nt, Human
uccuucuuuucgccggaguuga

SEQ ID NO: 11625 - RNA, 24 nt, Human
uccuugaccucugacccgccgacc

SEQ ID NO: 11626 - RNA, 24 nt, Human
uccuugguuccagaacccagcaau

SEQ ID NO: 11627 - RNA, 22 nt, Human
uccuuuggacaugggcaagggu

SEQ ID NO: 11628 - RNA, 24 nt, Human
ucgaacaugucuucuccacgaggu

SEQ ID NO: 11629 - RNA, 24 nt, Human
ucgaagacacuaccauaugcuaaa

SEQ ID NO: 11630 - RNA, 24 nt, Human
ucgaagagcuggagaccaaggccg

SEQ ID NO: 11631 - RNA, 24 nt, Human
ucgaaggguaaccaagcugcaauc

SEQ ID NO: 11632 - RNA, 18 nt, Human
ucgaagguguguguaaau

SEQ ID NO: 11633 - RNA, 24 nt, Human
ucgaauggacacauuaccagugaa

SEQ ID NO: 11634 - RNA, 24 nt, Human
ucgaaugggucacguauugucuac

SEQ ID NO: 11635 - RNA, 24 nt, Human
ucgacaguaaagggcacgucugga

SEQ ID NO: 11636 - RNA, 23 nt, Human
ucgaccccaaaagccaagucugu

SEQ ID NO: 11637 - RNA, 24 nt, Human
ucgaccuugcaggcagcggcagga

SEQ ID NO: 11638 - RNA, 24 nt, Human
ucgauaguuguuaggugucagcuu

SEQ ID NO: 11639 - RNA, 24 nt, Human
ucgauggaggacgggaggccuuug

SEQ ID NO: 11640 - RNA, 24 nt, Human
ucgaugggcaaaguauuuguagca

SEQ ID NO: 11641 - RNA, 24 nt, Human
ucgcagagauccugagugucuacc

SEQ ID NO: 11642 - RNA, 24 nt, Human
ucgcagcagcccggacaggaagau

SEQ ID NO: 11643 - RNA, 24 nt, Human
ucgcagcgccagggguuggcgccc

SEQ ID NO: 11644 - RNA, 24 nt, Human
ucgcagcugccuuccagaaacaac

SEQ ID NO: 11645 - RNA, 24 nt, Human
ucgcaggaauaacgguagagggga

SEQ ID NO: 11646 - RNA, 24 nt, Human
ucgccacaacgugcuccaccucug

SEQ ID NO: 11647 - RNA, 24 nt, Human
ucgcccagaucaaggcucauguag

SEQ ID NO: 11648 - RNA, 22 nt, Human
ucgcccaggcugaauugcagug

SEQ ID NO: 11649 - RNA, 24 nt, Human
ucgcgcugccgccgccacugcugc

SEQ ID NO: 11650 - RNA, 24 nt, Human
ucgcucaaaccagccuuucagaau

SEQ ID NO: 11651 - RNA, 24 nt, Human
ucgcucuggaccucacugcugguc

SEQ ID NO: 11652 - RNA, 24 nt, Human
ucgcucuuguugcccaagcuggag

SEQ ID NO: 11653 - RNA, 24 nt, Human
ucgcuggggggacacuagaagcac

SEQ ID NO: 11654 - RNA, 24 nt, Human
ucgcuguguugcccaggcuggucu

SEQ ID NO: 11655 - RNA, 24 nt, Human
ucggaacgccauucuauccccaaa

SEQ ID NO: 11656 - RNA, 24 nt, Human
ucggaguuaaggcgaauuguucaa

SEQ ID NO: 11657 - RNA, 24 nt, Human
ucggcaguggcauucggggccggg

SEQ ID NO: 11658 - RNA, 24 nt, Human
ucggcucugcuacuucaagaaggc

SEQ ID NO: 11659 - RNA, 24 nt, Human
ucgggccggcuggccgggcgcggg

SEQ ID NO: 11660 - RNA, 22 nt, Human
ucgggcuuuuacgaaaggcaug

SEQ ID NO: 11661 - RNA, 24 nt, Human
ucggggcggugaggacgcuguggg

SEQ ID NO: 11662 - RNA, 22 nt, Human
ucgggguucuccggggaauccu

SEQ ID NO: 11663 - RNA, 22 nt, Human
ucgggguucuccggggaauucu

SEQ ID NO: 11664 - RNA, 24 nt, Human
ucggucagcgggcagcagcugcgc

SEQ ID NO: 11665 - RNA, 24 nt, Human
ucggugccgguugcgucaucuucc

SEQ ID NO: 11666 - RNA, 22 nt, Human
ucguagcgaucuccaauuccaa

SEQ ID NO: 11667 - RNA, 22 nt, Human
ucgucaugaccaacgugauccu

SEQ ID NO: 11668 - RNA, 22 nt, Human
ucgucccuacugcagaggaagu

SEQ ID NO: 11669 - RNA, 22 nt, Human
ucgucuaugagaaaagccaacu

SEQ ID NO: 11670 - RNA, 22 nt, Human
ucguugaagaggaggugcucug

SEQ ID NO: 11671 - RNA, 24 nt, Human
ucuaaaauaaauaaauaggccggg

SEQ ID NO: 11672 - RNA, 24 nt, Human
ucuaaagcuugucuuguagguucg

SEQ ID NO: 11673 - RNA, 22 nt, Human
ucuaacacugacuucuauucca

SEQ ID NO: 11674 - RNA, 24 nt, Human
ucuaacuacuuauauuugugcugc

SEQ ID NO: 11675 - RNA, 24 nt, Human
ucuaaguauuccaaauaaguugac

SEQ ID NO: 11676 - RNA, 24 nt, Human
ucuaagucagagucuccuaaagag

SEQ ID NO: 11677 - RNA, 24 nt, Human
ucuaaucuccucucagucuguacu

SEQ ID NO: 11678 - RNA, 24 nt, Human
ucuaauuuagccaaguaauugcug

SEQ ID NO: 11679 - RNA, 24 nt, Human
ucuacagaagaugaagaagauagg

SEQ ID NO: 11680 - RNA, 24 nt, Human
ucuacagacacgggcccucuccuc

SEQ ID NO: 11681 - RNA, 24 nt, Human
ucuacagccucaagacccgcgagg

SEQ ID NO: 11682 - RNA, 24 nt, Human
ucuacaguaucccacugugucugg

SEQ ID NO: 11683 - RNA, 24 nt, Human
ucuacaucuagacacaauauugua

SEQ ID NO: 11684 - RNA, 24 nt, Human
ucuaccagcuaacacauccaccac

SEQ ID NO: 11685 - RNA, 24 nt, Human
ucuaccuauaaaugucuaaauauu

SEQ ID NO: 11686 - RNA, 24 nt, Human
ucuacuguaauuaauugggucuau

SEQ ID NO: 11687 - RNA, 24 nt, Human
ucuagagucuguugccaacauguu

SEQ ID NO: 11688 - RNA, 24 nt, Human
ucuagcauaacaccagggaugugg

SEQ ID NO: 11689 - RNA, 24 nt, Human
ucuagcuugcuuggacuuucagug

SEQ ID NO: 11690 - RNA, 24 nt, Human
ucuaggauauaaugauuuagugac

SEQ ID NO: 11691 - RNA, 21 nt, Human
ucuagugggaauguguccuuu

SEQ ID NO: 11692 - RNA, 21 nt, Human
ucuauaguccacugucagcug

SEQ ID NO: 11693 - RNA, 24 nt, Human
ucuaucacuuucauguaacaaugg

SEQ ID NO: 11694 - RNA, 24 nt, Human
ucuaugaaucucaucagacucugg

SEQ ID NO: 11695 - RNA, 24 nt, Human
ucuaugagucugucuuaucuucug

SEQ ID NO: 11696 - RNA, 24 nt, Human
ucuauggugguaggagaguacagg

SEQ ID NO: 11697 - RNA, 24 nt, Human
ucuauugccacugauuggagcuga

SEQ ID NO: 11698 - RNA, 24 nt, Human
ucucaaaacucaaauacucuuuau

SEQ ID NO: 11699 - RNA, 24 nt, Human
ucucaagaaccauggacuccuggg

SEQ ID NO: 11700 - RNA, 17 nt, Human
ucucaaggggcaccuuu

SEQ ID NO: 11701 - RNA, 24 nt, Human
ucucaaguagcugggacuacaggc

SEQ ID NO: 11702 - RNA, 24 nt, Human
ucucacacuggcaggcgguggcuc

SEQ ID NO: 11703 - RNA, 24 nt, Human
ucucacagaccaugacccacaggg

SEQ ID NO: 11704 - RNA, 24 nt, Human
ucucacagaccccaaaacagcugc

SEQ ID NO: 11705 - RNA, 23 nt, Human
ucucacaguucugggcuaggacu

SEQ ID NO: 11706 - RNA, 24 nt, Human
ucucacccuagagugacagcuauc

SEQ ID NO: 11707 - RNA, 24 nt, Human
ucucacuuugucacccaggcugga

SEQ ID NO: 11708 - RNA, 24 nt, Human
ucucagacaaccaucucaugggcc

SEQ ID NO: 11709 - RNA, 24 nt, Human
ucucagauuacuucauugcucacc

SEQ ID NO: 11710 - RNA, 24 nt, Human
ucucaggcagagcagggugguccg

SEQ ID NO: 11711 - RNA, 23 nt, Human
ucucaggggcccuggcccugacc

SEQ ID NO: 11712 - RNA, 24 nt, Human
ucucaguaaagaucgcaacuuuca

SEQ ID NO: 11713 - RNA, 22 nt, Human
ucucauauagcuggguugcagc

SEQ ID NO: 11714 - RNA, 24 nt, Human
ucucauggcucuggggcugggucc

SEQ ID NO: 11715 - RNA, 24 nt, Human
ucucauguggcugcugcaccucca

SEQ ID NO: 11716 - RNA, 24 nt, Human
ucuccaaaaauucggagaaaagag

SEQ ID NO: 11717 - RNA, 24 nt, Human
ucuccaaaaauuuggagaaagagc

SEQ ID NO: 11718 - RNA, 23 nt, Human
ucuccaaguaacacaucaaguac

SEQ ID NO: 11719 - RNA, 22 nt, Human
ucuccaggacuccucacucaac

SEQ ID NO: 11720 - RNA, 24 nt, Human
ucuccaggcccaagucgugcucuc

SEQ ID NO: 11721 - RNA, 24 nt, Human
ucuccaguuccaguacgcucauca

SEQ ID NO: 11722 - RNA, 24 nt, Human
ucuccaugagcgucccugacugcc

SEQ ID NO: 11723 - RNA, 24 nt, Human
ucuccauucccaggcucagugcag

SEQ ID NO: 11724 - RNA, 22 nt, Human
ucucccaaaucuuucuagcaca

SEQ ID NO: 11725 - RNA, 20 nt, Human
ucucccagccaccuccuccc

SEQ ID NO: 11726 - RNA, 24 nt, Human
ucucccauucugagaaucuggguu

SEQ ID NO: 11727 - RNA, 22 nt, Human
ucuccuuacccugagaugugcu

SEQ ID NO: 11728 - RNA, 24 nt, Human
ucucgaacuccugagcucaagcag

SEQ ID NO: 11729 - RNA, 22 nt, Human
ucucgauguuaucagucaacaa

SEQ ID NO: 11730 - RNA, 24 nt, Human
ucucgcgcucggccgccgcccgcu

SEQ ID NO: 11731 - RNA, 24 nt, Human
ucucgcucugucacccaggcugga

SEQ ID NO: 11732 - RNA, 24 nt, Human
ucucggccuuggcaacggccgucg

SEQ ID NO: 11733 - RNA, 24 nt, Human
ucucuaggucacuuucuccgcuug

SEQ ID NO: 11734 - RNA, 24 nt, Human
ucucuaggucccuauuccugcuug

SEQ ID NO: 11735 - RNA, 24 nt, Human
ucucucacccuugcugugcaugua

SEQ ID NO: 11736 - RNA, 24 nt, Human
ucucucacgacucucaaagaugaa

SEQ ID NO: 11737 - RNA, 22 nt, Human
ucucugaacucuuuaacugugg

SEQ ID NO: 11738 - RNA, 24 nt, Human
ucucugauaaccagugaugaugag

SEQ ID NO: 11739 - RNA, 24 nt, Human
ucucugcaaaaugucauagcuuau

SEQ ID NO: 11740 - RNA, 22 nt, Human
ucucugcagcuaggaguggcca

SEQ ID NO: 11741 - RNA, 24 nt, Human
ucucugcagcuggaccuggacagg

SEQ ID NO: 11742 - RNA, 22 nt, Human
ucucuggugacaguuuaccugg

SEQ ID NO: 11743 - RNA, 24 nt, Human
ucucuuaggcccucaggcccuugc

SEQ ID NO: 11744 - RNA, 22 nt, Human
ucucuuccaaccacugccuaca

SEQ ID NO: 11745 - RNA, 24 nt, Human
ucucuucggcugagacucccgcca

SEQ ID NO: 11746 - RNA, 22 nt, Human
ucucuugaaccuuaauuuuuag

SEQ ID NO: 11747 - RNA, 24 nt, Human
ucucuuggcacuucaaggguuguu

SEQ ID NO: 11748 - RNA, 24 nt, Human
ucucuuguaaaggagcaagguuuu

SEQ ID NO: 11749 - RNA, 24 nt, Human
ucugaacuugacugaggauaaugu

SEQ ID NO: 11750 - RNA, 24 nt, Human
ucugaagacugaugguuugggcau

SEQ ID NO: 11751 - RNA, 24 nt, Human
ucugaagagugcuucagcugaugg

SEQ ID NO: 11752 - RNA, 24 nt, Human
ucugaagaucucacaaagagaagu

SEQ ID NO: 11753 - RNA, 24 nt, Human
ucugagaaaagggggguucuauug

SEQ ID NO: 11754 - RNA, 22 nt, Human
ucugagcccaggaguuugaggc

SEQ ID NO: 11755 - RNA, 22 nt, Human
ucugaucagccugguguucauu

SEQ ID NO: 11756 - RNA, 23 nt, Human
ucugauccuacguucuacuucug

SEQ ID NO: 11757 - RNA, 22 nt, Human
ucugaucucaguugcugcucaa

SEQ ID NO: 11758 - RNA, 23 nt, Human
ucugcaaauuuugugcucacagc

SEQ ID NO: 11759 - RNA, 24 nt, Human
ucugcaacaguuuguuuguuuguu

SEQ ID NO: 11760 - RNA, 24 nt, Human
ucugcaauucuuauucucuuauag

SEQ ID NO: 11761 - RNA, 24 nt, Human
ucugcacaaaugccaaggcuaagu

SEQ ID NO: 11762 - RNA, 24 nt, Human
ucugcagcugcagauucugcuguu

SEQ ID NO: 11763 - RNA, 24 nt, Human
ucugcaggagugcaaugcuauggc

SEQ ID NO: 11764 - RNA, 24 nt, Human
ucugcagucuuauccaggcucucc

SEQ ID NO: 11765 - RNA, 24 nt, Human
ucugcauuuuaucucuuuaaggua

SEQ ID NO: 11766 - RNA, 24 nt, Human
ucugccaauuucuggauuucuuua

SEQ ID NO: 11767 - RNA, 22 nt, Human
ucugccagagggaggguguuac

SEQ ID NO: 11768 - RNA, 24 nt, Human
ucugccuccuccucccuuucuccc

SEQ ID NO: 11769 - RNA, 22 nt, Human
ucugccuccuggguucacucca

SEQ ID NO: 11770 - RNA, 23 nt, Human
ucugcuggucucccaccucccgc

SEQ ID NO: 11771 - RNA, 24 nt, Human
ucugcuggucucugaguccuagcu

SEQ ID NO: 11772 - RNA, 22 nt, Human
ucugcugugauggacacuugua

SEQ ID NO: 11773 - RNA, 22 nt, Human
ucugcugugcuggcuucccaug

SEQ ID NO: 11774 - RNA, 24 nt, Human
ucuggauaccuccacaugguccga

SEQ ID NO: 11775 - RNA, 24 nt, Human
ucuggauaccuuuauuuuugcuuc

SEQ ID NO: 11776 - RNA, 22 nt, Human
ucuggcccugcuaggcccaaag

SEQ ID NO: 11777 - RNA, 24 nt, Human
ucuggccuaaaauuucucagucuu

SEQ ID NO: 11778 - RNA, 24 nt, Human
ucuggccuacuuccuaacaauguc

SEQ ID NO: 11779 - RNA, 24 nt, Human
ucuggcgccguucgguuucucuua

SEQ ID NO: 11780 - RNA, 24 nt, Human
ucuggcuaaggcucuucauuuccc

SEQ ID NO: 11781 - RNA, 22 nt, Human
ucugggaggcggagguugcagu

SEQ ID NO: 11782 - RNA, 22 nt, Human
ucugggauuaccauguuguuuu

SEQ ID NO: 11783 - RNA, 22 nt, Human
ucugggccagaucuagggaucu

SEQ ID NO: 11784 - RNA, 22 nt, Human
ucuggggcuagggccucagugc

SEQ ID NO: 11785 - RNA, 24 nt, Human
ucuggugugugaaggucggugggu

SEQ ID NO: 11786 - RNA, 22 nt, Human
ucuguaaaggaaaaggcagggu

SEQ ID NO: 11787 - RNA, 22 nt, Human
ucuguaaaucugaauguugccu

SEQ ID NO: 11788 - RNA, 20 nt, Human
ucuguacugagcucuguuuu

SEQ ID NO: 11789 - RNA, 24 nt, Human
ucuguaggccagaacaugaaguua

SEQ ID NO: 11790 - RNA, 24 nt, Human
ucuguaguggauguacuacagcuc

SEQ ID NO: 11791 - RNA, 22 nt, Human
ucugucauuuuucucuuuccau

SEQ ID NO: 11792 - RNA, 24 nt, Human
ucugucccacgcccgcccgccugg

SEQ ID NO: 11793 - RNA, 24 nt, Human
ucugucccuaaagaacugguggca

SEQ ID NO: 11794 - RNA, 23 nt, Human
ucuguccucuguagcacuuuuag

SEQ ID NO: 11795 - RNA, 24 nt, Human
ucuguccuucagaaggaagugauu

SEQ ID NO: 11796 - RNA, 24 nt, Human
ucuguccuucuacaggagguguuc

SEQ ID NO: 11797 - RNA, 24 nt, Human
ucuguccuuucccagcucgcaggc

SEQ ID NO: 11798 - RNA, 24 nt, Human
ucugucuauccugcccuggucucc

SEQ ID NO: 11799 - RNA, 24 nt, Human
ucugucucuucucuguucuccccc

SEQ ID NO: 11800 - RNA, 24 nt, Human
ucugugaagaaagucaugguggcu

SEQ ID NO: 11801 - RNA, 23 nt, Human
ucugugagccccagccugagcca

SEQ ID NO: 11802 - RNA, 22 nt, Human
ucugugcuagagagugguaacc

SEQ ID NO: 11803 - RNA, 24 nt, Human
ucugugcugcgguguguccagggg

SEQ ID NO: 11804 - RNA, 24 nt, Human
ucugugcuucgugaagcuaaucaa

SEQ ID NO: 11805 - RNA, 24 nt, Human
ucuguggacauugacucggagcug

SEQ ID NO: 11806 - RNA, 24 nt, Human
ucuguggcuuggugagucugugug

SEQ ID NO: 11807 - RNA, 23 nt, Human
ucuguggggaguaacaagggcuc

SEQ ID NO: 11808 - RNA, 22 nt, Human
ucugugguaugacagaacuggg

SEQ ID NO: 11809 - RNA, 21 nt, Human
ucugugguuggggaaaaggug

SEQ ID NO: 11810 - RNA, 22 nt, Human
ucugugugugcacugcagacac

SEQ ID NO: 11811 - RNA, 24 nt, Human
ucuguguguguagugagagugugu

SEQ ID NO: 11812 - RNA, 24 nt, Human
ucuguguugcccaagcuggacuug

SEQ ID NO: 11813 - RNA, 24 nt, Human
ucuguuaugauuuuauuucuucaa

SEQ ID NO: 11814 - RNA, 24 nt, Human
ucuguuauugcaaaguugguaaau

SEQ ID NO: 11815 - RNA, 24 nt, Human
ucuguugagagccugguaaggggu

SEQ ID NO: 11816 - RNA, 24 nt, Human
ucuguuguuccuuuuuuaauuccc

SEQ ID NO: 11817 - RNA, 24 nt, Human
ucuuaaguucaaaauggcuaaacu

SEQ ID NO: 11818 - RNA, 24 nt, Human
ucuuaaguuguuuuauuaaguuaa

SEQ ID NO: 11819 - RNA, 24 nt, Human
ucuuagugugauagacuaccacgc

SEQ ID NO: 11820 - RNA, 22 nt, Human
ucuuauucucccuguucccagc

SEQ ID NO: 11821 - RNA, 22 nt, Human
ucuucacuccuccuuuucuuca

SEQ ID NO: 11822 - RNA, 24 nt, Human
ucuucaguuccaacaaaaggucug

SEQ ID NO: 11823 - RNA, 24 nt, Human
ucuucaguuguagaaguuuuuccu

SEQ ID NO: 11824 - RNA, 24 nt, Human
ucuucauuggaggguugagcuuug

SEQ ID NO: 11825 - RNA, 22 nt, Human
ucuuccccagcauugcucccuu

SEQ ID NO: 11826 - RNA, 24 nt, Human
ucuuccgcuggccugggcuccgca

SEQ ID NO: 11827 - RNA, 22 nt, Human
ucuucuaaauacuuccuaacuu

SEQ ID NO: 11828 - RNA, 22 nt, Human
ucuugaagaaaguugggcgugu

SEQ ID NO: 11829 - RNA, 24 nt, Human
ucuugaguuugggaguuaauuuug

SEQ ID NO: 11830 - RNA, 24 nt, Human
ucuugggcugcuaagaugggccuu

SEQ ID NO: 11831 - RNA, 24 nt, Human
ucuuggguuaucuguggggugaga

SEQ ID NO: 11832 - RNA, 22 nt, Human
ucuuggugcuuuugcuggauga

SEQ ID NO: 11833 - RNA, 24 nt, Human
ucuugguucuagcuucugggccuc

SEQ ID NO: 11834 - RNA, 24 nt, Human
ucuugguucucuauucaaaguguu

SEQ ID NO: 11835 - RNA, 24 nt, Human
ucuuguugaacaguguguagacua

SEQ ID NO: 11836 - RNA, 24 nt, Human
ucuuguuugaucuucacguuaaga

SEQ ID NO: 11837 - RNA, 24 nt, Human
ucuuucuuucugccuuucagaugg

SEQ ID NO: 11838 - RNA, 22 nt, Human
ucuuugaucucuuccggggcuu

SEQ ID NO: 11839 - RNA, 22 nt, Human
ucuuugauggaugcauuuccau

SEQ ID NO: 11840 - RNA, 24 nt, Human
ucuuuggucuuuggaagugggcag

SEQ ID NO: 11841 - RNA, 24 nt, Human
ucuuuggugccuuuccuguucagc

SEQ ID NO: 11842 - RNA, 24 nt, Human
ucuuugguguucagagcacagccg

SEQ ID NO: 11843 - RNA, 22 nt, Human
ucuuuuuccaauguggccuggg

SEQ ID NO: 11844 - RNA, 22 nt, Human
ucuuuuuugggagacggagucg

SEQ ID NO: 11845 - RNA, 22 nt, Human
ugaaaacaaggacgggcgaauu

SEQ ID NO: 11846 - RNA, 24 nt, Human
ugaaaaccggcaggguguuaggcu

SEQ ID NO: 11847 - RNA, 24 nt, Human
ugaaaagugccagggcaauuucuu

SEQ ID NO: 11848 - RNA, 24 nt, Human
ugaaacaauucagguuuucuaggg

SEQ ID NO: 11849 - RNA, 24 nt, Human
ugaaacagcguuaucucuuugugu

SEQ ID NO: 11850 - RNA, 24 nt, Human
ugaaacgaacaaggcuugagaauc

SEQ ID NO: 11851 - RNA, 24 nt, Human
ugaaagaaaaugagagcagaaagu

SEQ ID NO: 11852 - RNA, 24 nt, Human
ugaaagaagccaugaucaagcuug

SEQ ID NO: 11853 - RNA, 24 nt, Human
ugaaagcacuggcagccaggaaca

SEQ ID NO: 11854 - RNA, 24 nt, Human
ugaaagcagcaauaucaugucuug

SEQ ID NO: 11855 - RNA, 24 nt, Human
ugaaagcuuuugaacagcugagaa

SEQ ID NO: 11856 - RNA, 21 nt, Human
ugaaaggauuagagaaggauu

SEQ ID NO: 11857 - RNA, 24 nt, Human
ugaaaguaauuaauuuaugacaua

SEQ ID NO: 11858 - RNA, 24 nt, Human
ugaaaguuauaauguaguaggaga

SEQ ID NO: 11859 - RNA, 24 nt, Human
ugaaaguugucaccaguuuauugu

SEQ ID NO: 11860 - RNA, 24 nt, Human
ugaaauaacaaguuuagugcuuua

SEQ ID NO: 11861 - RNA, 22 nt, Human
ugaaauauuuucaagcugauua

SEQ ID NO: 11862 - RNA, 24 nt, Human
ugaaaucagcaaagagcagaugca

SEQ ID NO: 11863 - RNA, 24 nt, Human
ugaaaugcacuuucccgugcagca

SEQ ID NO: 11864 - RNA, 24 nt, Human
ugaaaugccuaaagaagucacagg

SEQ ID NO: 11865 - RNA, 24 nt, Human
ugaaauggcugcaccaugucggcc

SEQ ID NO: 11866 - RNA, 24 nt, Human
ugaacagacuauaacuaggaaagg

SEQ ID NO: 11867 - RNA, 24 nt, Human
ugaaccaggaaaacugaagcaccu

SEQ ID NO: 11868 - RNA, 22 nt, Human
ugaacugcugaaugcuauuccu

SEQ ID NO: 11869 - RNA, 24 nt, Human
ugaagaaauggaagucuggagagg

SEQ ID NO: 11870 - RNA, 24 nt, Human
ugaagacaaccuugaggagggagc

SEQ ID NO: 11871 - RNA, 24 nt, Human
ugaagagacgagcuguggggaucu

SEQ ID NO: 11872 - RNA, 24 nt, Human
ugaagagaugcauuggccuguccc

SEQ ID NO: 11873 - RNA, 24 nt, Human
ugaagagccacccuguggcaucga

SEQ ID NO: 11874 - RNA, 24 nt, Human
ugaagcaagcuccggagacuucuu

SEQ ID NO: 11875 - RNA, 24 nt, Human
ugaagcuagauaccuaaagcuacc

SEQ ID NO: 11876 - RNA, 22 nt, Human
ugaagcuggguggcuuggcuca

SEQ ID NO: 11877 - RNA, 24 nt, Human
ugaaggaagugagcacauuauuug

SEQ ID NO: 11878 - RNA, 24 nt, Human
ugaaggacucguggauaucuaaca

SEQ ID NO: 11879 - RNA, 22 nt, Human
ugaaggagacgaauguauuugg

SEQ ID NO: 11880 - RNA, 24 nt, Human
ugaaggcaaggcagguagacggug

SEQ ID NO: 11881 - RNA, 22 nt, Human
ugaaggcauucuuguaucaagg

SEQ ID NO: 11882 - RNA, 24 nt, Human
ugaaggcuucauggaggugauugu

SEQ ID NO: 11883 - RNA, 22 nt, Human
ugaagggagagaagggugggug

SEQ ID NO: 11884 - RNA, 24 nt, Human
ugaagguaccuuaacauggggaau

SEQ ID NO: 11885 - RNA, 22 nt, Human
ugaaguguaugugauauugugu

SEQ ID NO: 11886 - RNA, 24 nt, Human
ugaaguguccucaaauguaaugcu

SEQ ID NO: 11887 - RNA, 24 nt, Human
ugaauaagauuaauauucucaugg

SEQ ID NO: 11888 - RNA, 24 nt, Human
ugaauacacaucucugucagugug

SEQ ID NO: 11889 - RNA, 24 nt, Human
ugaaugacaacuuuauuuuucuua

SEQ ID NO: 11890 - RNA, 21 nt, Human
ugaaugccaguuccuuugcca

SEQ ID NO: 11891 - RNA, 22 nt, Human
ugaaugccaguuccuuugccaa

SEQ ID NO: 11892 - RNA, 24 nt, Human
ugaaugcgcuaaagcuggacucca

SEQ ID NO: 11893 - RNA, 24 nt, Human
ugaaugggaagugguuaaagccug

SEQ ID NO: 11894 - RNA, 24 nt, Human
ugaauggugcuugcauuuuagggu

SEQ ID NO: 11895 - RNA, 24 nt, Human
ugaaugugcaaauugugaguaaaa

SEQ ID NO: 11896 - RNA, 24 nt, Human
ugaauuaggagguuaggcaggagu

SEQ ID NO: 11897 - RNA, 24 nt, Human
ugaauuauuuaauauauucuaagu

SEQ ID NO: 11898 - RNA, 24 nt, Human
ugaauuuacuuuuaaaaugggcaa

SEQ ID NO: 11899 - RNA, 24 nt, Human
ugacaaacaagucauuucuguaag

SEQ ID NO: 11900 - RNA, 24 nt, Human
ugacaagagcaaccggucuacaac

SEQ ID NO: 11901 - RNA, 24 nt, Human
ugacaagcaguagccaugggggag

SEQ ID NO: 11902 - RNA, 24 nt, Human
ugacaaguacauguuccuuuggga

SEQ ID NO: 11903 - RNA, 24 nt, Human
ugacaagugccguggguugggcuu

SEQ ID NO: 11904 - RNA, 24 nt, Human
ugacagaaaaacauucucaggacu

SEQ ID NO: 11905 - RNA, 24 nt, Human
ugacagagauuccaucuaucuaac

SEQ ID NO: 11906 - RNA, 22 nt, Human
ugacagagugagacccuguuga

SEQ ID NO: 11907 - RNA, 24 nt, Human
ugacagccaacaggguuaugauac

SEQ ID NO: 11908 - RNA, 24 nt, Human
ugacaggaucaagcgugcuuuccu

SEQ ID NO: 11909 - RNA, 24 nt, Human
ugacaggucuuuccccuaugucau

SEQ ID NO: 11910 - RNA, 23 nt, Human
ugacaucaaugugggaauuugag

SEQ ID NO: 11911 - RNA, 24 nt, Human
ugacaugaaccucucggagucccu

SEQ ID NO: 11912 - RNA, 22 nt, Human
ugacaugcacagaaguggagag

SEQ ID NO: 11913 - RNA, 23 nt, Human
ugacaugcuggugcacugcaccc

SEQ ID NO: 11914 - RNA, 24 nt, Human
ugacaugggcucaaacuuggccua

SEQ ID NO: 11915 - RNA, 24 nt, Human
ugacauggugugagugugugggug

SEQ ID NO: 11916 - RNA, 19 nt, Human
ugacauguauacuugcugc

SEQ ID NO: 11917 - RNA, 24 nt, Human
ugacauguuucuuuguuuuggaca

SEQ ID NO: 11918 - RNA, 24 nt, Human
ugaccagacuuuuccagaagugcc

SEQ ID NO: 11919 - RNA, 24 nt, Human
ugaccagcagcuucuuacaguagc

SEQ ID NO: 11920 - RNA, 24 nt, Human
ugaccaggaaauacaacgagcugc

SEQ ID NO: 11921 - RNA, 24 nt, Human
ugaccauaaugcguacagguguuu

SEQ ID NO: 11922 - RNA, 24 nt, Human
ugacccagaucauaguaaugauga

SEQ ID NO: 11923 - RNA, 24 nt, Human
ugacccguguaauccauaaguuuc

SEQ ID NO: 11924 - RNA, 24 nt, Human
ugaccgggaucgauuugacagagc

SEQ ID NO: 11925 - RNA, 22 nt, Human
ugaccgugggcugucuggcccc

SEQ ID NO: 11926 - RNA, 24 nt, Human
ugaccucaagugauccgcucgcuc

SEQ ID NO: 11927 - RNA, 22 nt, Human
ugaccucaggugauacgcccgc

SEQ ID NO: 11928 - RNA, 24 nt, Human
ugaccugcggaagcuggcugugaa

SEQ ID NO: 11929 - RNA, 24 nt, Human
ugaccuggccgucaggcagcucgu

SEQ ID NO: 11930 - RNA, 24 nt, Human
ugaccugguguuugucugcacucu

SEQ ID NO: 11931 - RNA, 22 nt, Human
ugaccuugugcaucccugagag

SEQ ID NO: 11932 - RNA, 24 nt, Human
ugaccuuucgccuuaacagagccu

SEQ ID NO: 11933 - RNA, 22 nt, Human
ugacgaggagaagaggccaagg

SEQ ID NO: 11934 - RNA, 24 nt, Human
ugacgcaaagggauaugugaagcc

SEQ ID NO: 11935 - RNA, 24 nt, Human
ugacgcucaagagcaggauucccc

SEQ ID NO: 11936 - RNA, 24 nt, Human
ugacgucacucacucugagaccua

SEQ ID NO: 11937 - RNA, 24 nt, Human
ugacgugccaucgaggacugcugc

SEQ ID NO: 11938 - RNA, 24 nt, Human
ugacuacaagucuugugcucauga

SEQ ID NO: 11939 - RNA, 24 nt, Human
ugacuacauacauagauggguagc

SEQ ID NO: 11940 - RNA, 21 nt, Human
ugacuagaugccuuguguauc

SEQ ID NO: 11941 - RNA, 24 nt, Human
ugacuaggaccccuucaaacgucu

SEQ ID NO: 11942 - RNA, 24 nt, Human
ugacuauaaaacaaaccuguguug

SEQ ID NO: 11943 - RNA, 24 nt, Human
ugacuauaucaucaaccaguuuuc

SEQ ID NO: 11944 - RNA, 24 nt, Human
ugacucagugcucaggaucuuaug

SEQ ID NO: 11945 - RNA, 24 nt, Human
ugacucgccugaggccacaucucc

SEQ ID NO: 11946 - RNA, 24 nt, Human
ugacugaaauucaccauccagggc

SEQ ID NO: 11947 - RNA, 24 nt, Human
ugacugacacgucugaccccugag

SEQ ID NO: 11948 - RNA, 24 nt, Human
ugacugcucugccauguugcuuug

SEQ ID NO: 11949 - RNA, 22 nt, Human
ugacuggaggaagggagguaag

SEQ ID NO: 11950 - RNA, 24 nt, Human
ugacuggagugaauucagugguca

SEQ ID NO: 11951 - RNA, 22 nt, Human
ugacuggcgcugaagucaccgg

SEQ ID NO: 11952 - RNA, 24 nt, Human
ugacuggggcagguuguagagaaa

SEQ ID NO: 11953 - RNA, 24 nt, Human
ugacuggggcuggggugagagagg

SEQ ID NO: 11954 - RNA, 24 nt, Human
ugacuggguuguccuuuggcuaga

SEQ ID NO: 11955 - RNA, 24 nt, Human
ugacugguggauauagaacgaggg

SEQ ID NO: 11956 - RNA, 24 nt, Human
ugacuguccauagugguuauugau

SEQ ID NO: 11957 - RNA, 22 nt, Human
ugacuguucucaaaguuugaag

SEQ ID NO: 11958 - RNA, 22 nt, Human
ugacuuaaccucucugggucuc

SEQ ID NO: 11959 - RNA, 24 nt, Human
ugacuucccuauggacaaccucau

SEQ ID NO: 11960 - RNA, 24 nt, Human
ugacuugaauccaaaguguauaca

SEQ ID NO: 11961 - RNA, 24 nt, Human
ugacuugguugacuuaggccaggc

SEQ ID NO: 11962 - RNA, 24 nt, Human
ugacuuuagguaaguuacuuaacc

SEQ ID NO: 11963 - RNA, 24 nt, Human
ugacuuuauacuuagaauugcugu

SEQ ID NO: 11964 - RNA, 22 nt, Human
ugacuuugaacagggaauuucu

SEQ ID NO: 11965 - RNA, 19 nt, Human
ugacuuugguguauagugc

SEQ ID NO: 11966 - RNA, 24 nt, Human
ugagaaaacagauuuagagaaaua

SEQ ID NO: 11967 - RNA, 24 nt, Human
ugagaaaagacagacuugggguag

SEQ ID NO: 11968 - RNA, 24 nt, Human
ugagaaagaaaagaaauaugagcc

SEQ ID NO: 11969 - RNA, 22 nt, Human
ugagaaaugaaaucaaugguua

SEQ ID NO: 11970 - RNA, 24 nt, Human
ugagaacuccucaugcacccugug

SEQ ID NO: 11971 - RNA, 22 nt, Human
ugagaacugguuacaugaguuu

SEQ ID NO: 11972 - RNA, 22 nt, Human
ugagaagacaagugauuuucuu

SEQ ID NO: 11973 - RNA, 24 nt, Human
ugagaagaccauuuuguucacuug

SEQ ID NO: 11974 - RNA, 24 nt, Human
ugagaaggagaugagauucaguac

SEQ ID NO: 11975 - RNA, 24 nt, Human
ugagaaggcugguacccagugcuu

SEQ ID NO: 11976 - RNA, 24 nt, Human
ugagaaguagcuucuggauguguu

SEQ ID NO: 11977 - RNA, 24 nt, Human
ugagaaucuggaggagcuacagag

SEQ ID NO: 11978 - RNA, 24 nt, Human
ugagaccuggcagaacaggcuguc

SEQ ID NO: 11979 - RNA, 22 nt, Human
ugagacgaagacuguggcugag

SEQ ID NO: 11980 - RNA, 24 nt, Human
ugagacuggguucccaucgcugga

SEQ ID NO: 11981 - RNA, 24 nt, Human
ugagagaauguaagaacauauaga

SEQ ID NO: 11982 - RNA, 24 nt, Human
ugagagacugcuccccauugcaga

SEQ ID NO: 11983 - RNA, 24 nt, Human
ugagagaggagauggaaaccuggu

SEQ ID NO: 11984 - RNA, 24 nt, Human
ugagagauugggcgaagaaacaac

SEQ ID NO: 11985 - RNA, 22 nt, Human
ugagagcaaagucgcaguucug

SEQ ID NO: 11986 - RNA, 24 nt, Human
ugagagcccugcagugugccugcg

SEQ ID NO: 11987 - RNA, 23 nt, Human
ugagaggaacgcaagcgaggggu

SEQ ID NO: 11988 - RNA, 24 nt, Human
ugagaggaaguuagaggggcuaga

SEQ ID NO: 11989 - RNA, 24 nt, Human
ugagaggcccagguccuagagcag

SEQ ID NO: 11990 - RNA, 18 nt, Human
ugagaguggagaucugga

SEQ ID NO: 11991 - RNA, 24 nt, Human
ugagagugguggagccugguucca

SEQ ID NO: 11992 - RNA, 24 nt, Human
ugagauaaagugccagucugccag

SEQ ID NO: 11993 - RNA, 24 nt, Human
ugagauaaauagaaaaguaaacau

SEQ ID NO: 11994 - RNA, 24 nt, Human
ugagauaacugaaagggaagcaga

SEQ ID NO: 11995 - RNA, 22 nt, Human
ugagauaaguacuuuguacaug

SEQ ID NO: 11996 - RNA, 24 nt, Human
ugagauagccaggcugaagaagcc

SEQ ID NO: 11997 - RNA, 22 nt, Human
ugagaucaagggaggauggaga

SEQ ID NO: 11998 - RNA, 24 nt, Human
ugagaucaagugcuaggacuggau

SEQ ID NO: 11999 - RNA, 22 nt, Human
ugagaucaucguuacaagcagc

SEQ ID NO: 12000 - RNA, 24 nt, Human
ugagauccaucugacugcugccau

SEQ ID NO: 12001 - RNA, 17 nt, Human
ugagaucggcuuuuucc

SEQ ID NO: 12002 - RNA, 21 nt, Human
ugagaugauugauugacauga

SEQ ID NO: 12003 - RNA, 23 nt, Human
ugagaugcaguuugcaggugggu

SEQ ID NO: 12004 - RNA, 21 nt, Human
ugagaugggguggggacacag

SEQ ID NO: 12005 - RNA, 24 nt, Human
ugagauuauuaugagcagaauggu

SEQ ID NO: 12006 - RNA, 24 nt, Human
ugagauucuugcucaccgucuggg

SEQ ID NO: 12007 - RNA, 24 nt, Human
ugagauugcacaagcuguggaaga

SEQ ID NO: 12008 - RNA, 24 nt, Human
ugagauugcuguccucccaaaggu

SEQ ID NO: 12009 - RNA, 24 nt, Human
ugagcaaagaacugaagaagcaag

SEQ ID NO: 12010 - RNA, 24 nt, Human
ugagcaacgccccgcccuuuguug

SEQ ID NO: 12011 - RNA, 24 nt, Human
ugagcaauuggaggcuccuggagg

SEQ ID NO: 12012 - RNA, 24 nt, Human
ugagcacaggaguuccagaccagc

SEQ ID NO: 12013 - RNA, 24 nt, Human
ugagcacugguaaacaaucugcuu

SEQ ID NO: 12014 - RNA, 24 nt, Human
ugagcacuuuaacuggcacauucu

SEQ ID NO: 12015 - RNA, 21 nt, Human
ugagcagcaagucccaagauc

SEQ ID NO: 12016 - RNA, 24 nt, Human
ugagcagguccaccggccccuaca

SEQ ID NO: 12017 - RNA, 23 nt, Human
ugagcagucuguggcucaacugg

SEQ ID NO: 12018 - RNA, 24 nt, Human
ugagcaguggggaagcagguuuua

SEQ ID NO: 12019 - RNA, 24 nt, Human
ugagcaguuauuggaggaagagag

SEQ ID NO: 12020 - RNA, 24 nt, Human
ugagcaguuggugaguuuagaugg

SEQ ID NO: 12021 - RNA, 24 nt, Human
ugagcauaaguaaagaaaggugga

SEQ ID NO: 12022 - RNA, 24 nt, Human
ugagcaucauggaccuuccucccu

SEQ ID NO: 12023 - RNA, 24 nt, Human
ugagcccagaacgaaggaacacgg

SEQ ID NO: 12024 - RNA, 24 nt, Human
ugagccugaagaguguucgcguug

SEQ ID NO: 12025 - RNA, 24 nt, Human
ugagcgcgcagcugcgcgaggccg

SEQ ID NO: 12026 - RNA, 24 nt, Human
ugagcuggauugacauagcccuug

SEQ ID NO: 12027 - RNA, 24 nt, Human
ugagcugugccuucgccaccccuu

SEQ ID NO: 12028 - RNA, 24 nt, Human
ugaggaacuaacugauuaguuguu

SEQ ID NO: 12029 - RNA, 22 nt, Human
ugaggacagacacucagggaau

SEQ ID NO: 12030 - RNA, 22 nt, Human
ugaggacaggagguugugaguu

SEQ ID NO: 12031 - RNA, 24 nt, Human
ugaggacugggacagguacgugca

SEQ ID NO: 12032 - RNA, 24 nt, Human
ugaggagaaagcuguggagaaguu

SEQ ID NO: 12033 - RNA, 24 nt, Human
ugaggagaagcugaaauguguggg

SEQ ID NO: 12034 - RNA, 24 nt, Human
ugaggagaggacgagcaaggacgg

SEQ ID NO: 12035 - RNA, 22 nt, Human
ugaggagggacaaggugagggg

SEQ ID NO: 12036 - RNA, 22 nt, Human
ugaggaggugcuaccagcgucu

SEQ ID NO: 12037 - RNA, 22 nt, Human
ugaggaucuuuucccuucucuc

SEQ ID NO: 12038 - RNA, 24 nt, Human
ugaggcagacaaaggaaagguaau

SEQ ID NO: 12039 - RNA, 24 nt, Human
ugaggcagacgccugaacagggac

SEQ ID NO: 12040 - RNA, 22 nt, Human
ugaggcagcuggccuuuguaga

SEQ ID NO: 12041 - RNA, 24 nt, Human
ugaggcaggcaggguguacagaug

SEQ ID NO: 12042 - RNA, 22 nt, Human
ugaggcaggggaaugggagaag

SEQ ID NO: 12043 - RNA, 23 nt, Human
ugaggccagcgcgcagcacuuuu

SEQ ID NO: 12044 - RNA, 24 nt, Human
ugaggcccguuuagauaccauggc

SEQ ID NO: 12045 - RNA, 24 nt, Human
ugaggcgcagacagguucgguuac

SEQ ID NO: 12046 - RNA, 24 nt, Human
ugaggcgcggcugccccggggagg

SEQ ID NO: 12047 - RNA, 24 nt, Human
ugaggcuugcggaauuuagcuaga

SEQ ID NO: 12048 - RNA, 24 nt, Human
ugagggacugggagccaggcaaga

SEQ ID NO: 12049 - RNA, 24 nt, Human
ugagggaggggaugcugcagaugu

SEQ ID NO: 12050 - RNA, 24 nt, Human
ugagggcaaaauggguugacgcga

SEQ ID NO: 12051 - RNA, 24 nt, Human
ugagggcagccaucaccuucagcu

SEQ ID NO: 12052 - RNA, 24 nt, Human
ugaggggaucuuggccucacggug

SEQ ID NO: 12053 - RNA, 24 nt, Human
ugaggggguucgugcggcucccag

SEQ ID NO: 12054 - RNA, 24 nt, Human
ugaggggucaggcagaauauggug

SEQ ID NO: 12055 - RNA, 24 nt, Human
ugaggguaguagcuuuucaugcac

SEQ ID NO: 12056 - RNA, 22 nt, Human
ugagguaggcagugcuauacag

SEQ ID NO: 12057 - RNA, 24 nt, Human
ugagguaggcuguuuccuucuuuc

SEQ ID NO: 12058 - RNA, 24 nt, Human
ugagguaugauaauugccugaacc

SEQ ID NO: 12059 - RNA, 24 nt, Human
ugaggucaccaagaaguucuacuc

SEQ ID NO: 12060 - RNA, 24 nt, Human
ugaggucaggaaaggggaaggacg

SEQ ID NO: 12061 - RNA, 24 nt, Human
ugaggucauauuugguauuguauu

SEQ ID NO: 12062 - RNA, 24 nt, Human
ugaggucccuccuugagucucaug

SEQ ID NO: 12063 - RNA, 24 nt, Human
ugagguccuggaugccucaucccu

SEQ ID NO: 12064 - RNA, 24 nt, Human
ugagguccuucaaggcugacucca

SEQ ID NO: 12065 - RNA, 24 nt, Human
ugaggugaacaagugcagccgcug

SEQ ID NO: 12066 - RNA, 24 nt, Human
ugagguggaccccaagccugagcc

SEQ ID NO: 12067 - RNA, 24 nt, Human
ugagguggagaauggcgugcagga

SEQ ID NO: 12068 - RNA, 23 nt, Human
ugagguggcuaggcuugacacac

SEQ ID NO: 12069 - RNA, 22 nt, Human
ugaggugggaggauuguaugag

SEQ ID NO: 12070 - RNA, 24 nt, Human
ugagguggguggaucacaagguca

SEQ ID NO: 12071 - RNA, 24 nt, Human
ugagguggguggaucaccugaggu

SEQ ID NO: 12072 - RNA, 22 nt, Human
ugagguuaguaguuugagacca

SEQ ID NO: 12073 - RNA, 24 nt, Human
ugagguugucuaugaggcaggggc

SEQ ID NO: 12074 - RNA, 24 nt, Human
ugagguugugcaauggguugugaa

SEQ ID NO: 12075 - RNA, 24 nt, Human
ugaguagaaguaaauacauuauag

SEQ ID NO: 12076 - RNA, 23 nt, Human
ugaguagacgggaggggagggug

SEQ ID NO: 12077 - RNA, 24 nt, Human
ugaguagauuuacaguugugugga

SEQ ID NO: 12078 - RNA, 22 nt, Human
ugaguagcucuggaauaagagc

SEQ ID NO: 12079 - RNA, 24 nt, Human
ugaguagcugggauucacgggugc

SEQ ID NO: 12080 - RNA, 22 nt, Human
ugaguauucaccaggugcuggg

SEQ ID NO: 12081 - RNA, 24 nt, Human
ugagucacuagaugaggaggagga

SEQ ID NO: 12082 - RNA, 24 nt, Human
ugagucacuccacccuggggccua

SEQ ID NO: 12083 - RNA, 24 nt, Human
ugagucuaggagaauuuuugauuu

SEQ ID NO: 12084 - RNA, 22 nt, Human
ugagucuauagaggcaguaggc

SEQ ID NO: 12085 - RNA, 22 nt, Human
ugagucuguugcuagggggaau

SEQ ID NO: 12086 - RNA, 18 nt, Human
ugagugaaagaagcagcc

SEQ ID NO: 12087 - RNA, 24 nt, Human
ugagugaaaugaguuauggaucua

SEQ ID NO: 12088 - RNA, 24 nt, Human
ugagugaaccuagagacaaaugcu

SEQ ID NO: 12089 - RNA, 24 nt, Human
ugagugcaagguugaugggaucca

SEQ ID NO: 12090 - RNA, 24 nt, Human
ugagugcaauauaauagucaugaa

SEQ ID NO: 12091 - RNA, 24 nt, Human
ugagugcccccaggaggggcuggg

SEQ ID NO: 12092 - RNA, 24 nt, Human
ugagugcccccagggaggggcugg

SEQ ID NO: 12093 - RNA, 24 nt, Human
ugagugcccccagggagggugcug

SEQ ID NO: 12094 - RNA, 24 nt, Human
ugagugcgcgggagccccugugag

SEQ ID NO: 12095 - RNA, 24 nt, Human
ugagugcuaaauuuggaagacagc

SEQ ID NO: 12096 - RNA, 22 nt, Human
ugagugcuuuaaauguuauuuu

SEQ ID NO: 12097 - RNA, 24 nt, Human
ugagugggauuuaugaguuacugu

SEQ ID NO: 12098 - RNA, 24 nt, Human
ugagugggugucgacccggugcug

SEQ ID NO: 12099 - RNA, 22 nt, Human
cuaauuuuuguauuuuugguag

SEQ ID NO: 12100 - RNA, 22 nt, Human
cuacagcugccccuauuuacug

SEQ ID NO: 12101 - RNA, 24 nt, Human
cuacagguugcaacauaaaacgga

SEQ ID NO: 12102 - RNA, 22 nt, Human
cuacuguacuacuuggaucuuu

SEQ ID NO: 12103 - RNA, 22 nt, Human
cuacuuguuccucucaccucaa

SEQ ID NO: 12104 - RNA, 24 nt, Human
cuagaccuggcauuugcucgggac

SEQ ID NO: 12105 - RNA, 22 nt, Human
cuagacucuaagcuccuugaga

SEQ ID NO: 12106 - RNA, 22 nt, Human
cuagacugaagcuccuugagga

SEQ ID NO: 12107 - RNA, 22 nt, Human
cuagaucaguccgauguggacu

SEQ ID NO: 12108 - RNA, 22 nt, Human
cuagccuguuuguccucacccc

SEQ ID NO: 12109 - RNA, 24 nt, Human
cuaggaaaaccgagguguugagag

SEQ ID NO: 12110 - RNA, 22 nt, Human
cuaggaucaugucacauauaca

SEQ ID NO: 12111 - RNA, 22 nt, Human
cuaggcauugugcaagguguua

SEQ ID NO: 12112 - RNA, 24 nt, Human
cuaggggcuggccucagcccugug

SEQ ID NO: 12113 - RNA, 24 nt, Human
cuagucaaggucaaauucaugggu

SEQ ID NO: 12114 - RNA, 24 nt, Human
cuagucaaguauugagggacucag

SEQ ID NO: 12115 - RNA, 24 nt, Human
cuagucgccggaugaagugagggc

SEQ ID NO: 12116 - RNA, 24 nt, Human
cuaucccucaaugugacgcaguga

SEQ ID NO: 12117 - RNA, 24 nt, Human
cuaugugucucagcuuggggcugg

SEQ ID NO: 12118 - RNA, 21 nt, Human
cucaaguuucauuugugaagc

SEQ ID NO: 12119 - RNA, 24 nt, Human
cucacgccuguaaucccagcacuu

SEQ ID NO: 12120 - RNA, 24 nt, Human
cucacugcaaccuccgccucccgg

SEQ ID NO: 12121 - RNA, 22 nt, Human
cucacugcaaccuccgccugcc

SEQ ID NO: 12122 - RNA, 22 nt, Human
cucacugcaaccucugccuccc

SEQ ID NO: 12123 - RNA, 24 nt, Human
cucacugcaaccucugccucccgg

SEQ ID NO: 12124 - RNA, 24 nt, Human
cucacugcaagcuccggcuuggua

SEQ ID NO: 12125 - RNA, 24 nt, Human
cucacuguaaccucugccucccgg

SEQ ID NO: 12126 - RNA, 22 nt, Human
cucaggcaucucaacaagcagc

SEQ ID NO: 12127 - RNA, 22 nt, Human
cucaggugauacacccaucucg

SEQ ID NO: 12128 - RNA, 22 nt, Human
cucaguggcuauugaguuaccc

SEQ ID NO: 12129 - RNA, 24 nt, Human
cucaugauguacgcgcaguccaaa

SEQ ID NO: 12130 - RNA, 22 nt, Human
cuccaccucacccuaguuccua

SEQ ID NO: 12131 - RNA, 24 nt, Human
cuccagggcagguggcugccuccc

SEQ ID NO: 12132 - RNA, 24 nt, Human
cuccccuacucggggcacaggggu

SEQ ID NO: 12133 - RNA, 24 nt, Human
cucccgcaucuugaccuccuucuc

SEQ ID NO: 12134 - RNA, 21 nt, Human
cucccgcugcccaccaacacc

SEQ ID NO: 12135 - RNA, 24 nt, Human
cucccggcuuggguggcgcggccg

SEQ ID NO: 12136 - RNA, 24 nt, Human
cucccgggccuacagcggcugcgg

SEQ ID NO: 12137 - RNA, 24 nt, Human
cucccuggcacagacauugcggcg

SEQ ID NO: 12138 - RNA, 24 nt, Human
cucccugguacacaggcuucugug

SEQ ID NO: 12139 - RNA, 24 nt, Human
cuccggucauugugcgggccucug

SEQ ID NO: 12140 - RNA, 22 nt, Human
cuccuaggcuggagugcagugg

SEQ ID NO: 12141 - RNA, 22 nt, Human
cuccucaaugccacugcacuga

SEQ ID NO: 12142 - RNA, 24 nt, Human
cuccugguccuccaaaaugcgcuu

SEQ ID NO: 12143 - RNA, 24 nt, Human
cuccuguaccucuuaucagauuua

SEQ ID NO: 12144 - RNA, 24 nt, Human
cuccugugucuucucacucuuggu

SEQ ID NO: 12145 - RNA, 24 nt, Human
cuccuucgcggucccugccgccac

SEQ ID NO: 12146 - RNA, 22 nt, Human
cuccuugagagcauacucuuuc

SEQ ID NO: 12147 - RNA, 24 nt, Human
cuccuuuuguggcuguggacaccu

SEQ ID NO: 12148 - RNA, 24 nt, Human
cucgcugggacccgaguuuggagg

SEQ ID NO: 12149 - RNA, 24 nt, Human
cucguauugucucuccuuucgcca

SEQ ID NO: 12150 - RNA, 22 nt, Human
cucuauagcaauguuucuaacu

SEQ ID NO: 12151 - RNA, 24 nt, Human
cucucagauggcaacucccagggc

SEQ ID NO: 12152 - RNA, 22 nt, Human
cucucagcaaaugcucuuuuuu

SEQ ID NO: 12153 - RNA, 24 nt, Human
cucugcaggggaggaagcaccugg

SEQ ID NO: 12154 - RNA, 24 nt, Human
cucugcaucucgcggcgccgcgac

SEQ ID NO: 12155 - RNA, 22 nt, Human
cucugcccucccaauucuauua

SEQ ID NO: 12156 - RNA, 22 nt, Human
cucuggaagcagcgagggaaaa

SEQ ID NO: 12157 - RNA, 24 nt, Human
cucugguuuaggcgcccgaaaggc

SEQ ID NO: 12158 - RNA, 22 nt, Human
cucuucuggggcagauguggca

SEQ ID NO: 12159 - RNA, 22 nt, Human
cucuugaaggaguauuuguguu

SEQ ID NO: 12160 - RNA, 24 nt, Human
cugaaauucuuaaaggaugggagu

SEQ ID NO: 12161 - RNA, 24 nt, Human
cugaaccuccugacagaguacauu

SEQ ID NO: 12162 - RNA, 24 nt, Human
cugaacgcagguacucugggcccc

SEQ ID NO: 12163 - RNA, 24 nt, Human
cugaagcugucugggggagaugau

SEQ ID NO: 12164 - RNA, 24 nt, Human
cugaagcuuugaaucauucagugg

SEQ ID NO: 12165 - RNA, 22 nt, Human
cugaaggguucuuggacauggg

SEQ ID NO: 12166 - RNA, 22 nt, Human
cugacgguaagcuccuugagga

SEQ ID NO: 12167 - RNA, 24 nt, Human
cugagcaccagccauaucuuugcu

SEQ ID NO: 12168 - RNA, 22 nt, Human
cugagcucaagugauccuccca

SEQ ID NO: 12169 - RNA, 22 nt, Human
cugaggucaggaguucgagacc

SEQ ID NO: 12170 - RNA, 22 nt, Human
cugagucugugggucaucuagc

SEQ ID NO: 12171 - RNA, 22 nt, Human
cugaugcacuuuaguuuuuggu

SEQ ID NO: 12172 - RNA, 22 nt, Human
cugauugaaccauucacuuuau

SEQ ID NO: 12173 - RNA, 22 nt, Human
cugcaaccuccaccucccgggc

SEQ ID NO: 12174 - RNA, 22 nt, Human
cugcaaccuccacuuccugggu

SEQ ID NO: 12175 - RNA, 24 nt, Human
cugcaaccucugccucccggguuc

SEQ ID NO: 12176 - RNA, 24 nt, Human
cugcaaggccccaggacugaaguc

SEQ ID NO: 12177 - RNA, 24 nt, Human
cugcaaggcuucuggcuacaucuu

SEQ ID NO: 12178 - RNA, 24 nt, Human
cugcacagguggcuggacuguccc

SEQ ID NO: 12179 - RNA, 24 nt, Human
cugcaccccgugcggggcuuuggc

SEQ ID NO: 12180 - RNA, 22 nt, Human
cugcagauuuugggguccacag

SEQ ID NO: 12181 - RNA, 24 nt, Human
cugcagcaauuuucagugagacag

SEQ ID NO: 12182 - RNA, 21 nt, Human
cugcagccaugcagcccccgc

SEQ ID NO: 12183 - RNA, 24 nt, Human
cugcaggccccgagcccggccccc

SEQ ID NO: 12184 - RNA, 24 nt, Human
cugcagugccuccaagaccacagc

SEQ ID NO: 12185 - RNA, 22 nt, Human
cugcaguggugauguguuguca

SEQ ID NO: 12186 - RNA, 24 nt, Human
cugcauccccuuucugcugcagga

SEQ ID NO: 12187 - RNA, 24 nt, Human
cugcauccugucagcaaugcccgg

SEQ ID NO: 12188 - RNA, 24 nt, Human
cugcaugcaucugcugcuggaggc

SEQ ID NO: 12189 - RNA, 23 nt, Human
cugcauugaaugauaguucugcu

SEQ ID NO: 12190 - RNA, 22 nt, Human
cugccagcucugaugagagauc

SEQ ID NO: 12191 - RNA, 24 nt, Human
cugccccccuccagcccugucagg

SEQ ID NO: 12192 - RNA, 22 nt, Human
cugcccccucugcugacgcccc

SEQ ID NO: 12193 - RNA, 24 nt, Human
cugccuccucugaggcuggcaguu

SEQ ID NO: 12194 - RNA, 24 nt, Human
cugccucuucucugaaaugccccu

SEQ ID NO: 12195 - RNA, 24 nt, Human
cugccuguugcuuugcugugugca

SEQ ID NO: 12196 - RNA, 24 nt, Human
cugccuguuguuuccucuggaagc

SEQ ID NO: 12197 - RNA, 24 nt, Human
cugcgcagggcagggguagggcac

SEQ ID NO: 12198 - RNA, 20 nt, Human
cugcgcccccuccugccagg

SEQ ID NO: 12199 - RNA, 24 nt, Human
cugcgguaucccaaucacagacac

SEQ ID NO: 12200 - RNA, 22 nt, Human
cugcuaucagacuucuucugug

SEQ ID NO: 12201 - RNA, 24 nt, Human
cugcucgggaucaaggcccaggug

SEQ ID NO: 12202 - RNA, 24 nt, Human
cugcucugcgccggggccuggcuc

SEQ ID NO: 12203 - RNA, 24 nt, Human
cugcugcacuggccgccaaguaug

SEQ ID NO: 12204 - RNA, 24 nt, Human
cugcugcaggcagauuccuucugc

SEQ ID NO: 12205 - RNA, 22 nt, Human
cugcugccuuucucucagagau

SEQ ID NO: 12206 - RNA, 24 nt, Human
cugcugcugcuggccggggccggg

SEQ ID NO: 12207 - RNA, 22 nt, Human
cugcuggccauuuucuucaugg

SEQ ID NO: 12208 - RNA, 24 nt, Human
cugcuggccugccgccaccugccc

SEQ ID NO: 12209 - RNA, 24 nt, Human
cugcuucccggugcuguucaccua

SEQ ID NO: 12210 - RNA, 24 nt, Human
cugcuuccugcccagacuggauac

SEQ ID NO: 12211 - RNA, 24 nt, Human
cugcuuugugccucugaccugcug

SEQ ID NO: 12212 - RNA, 23 nt, Human
cuggaaccagcugucuguggaga

SEQ ID NO: 12213 - RNA, 22 nt, Human
cuggaaccucaacagcaggauu

SEQ ID NO: 12214 - RNA, 23 nt, Human
cuggaacucacucucagccacag

SEQ ID NO: 12215 - RNA, 24 nt, Human
cuggaagugcaaaugguguguuug

SEQ ID NO: 12216 - RNA, 24 nt, Human
cuggacccagagucuguggagcug

SEQ ID NO: 12217 - RNA, 24 nt, Human
cuggagcagagccucuugggaaau

SEQ ID NO: 12218 - RNA, 24 nt, Human
cuggagcgcaugaagcggcgcagc

SEQ ID NO: 12219 - RNA, 24 nt, Human
cuggagggcuggagggucucgucu

SEQ ID NO: 12220 - RNA, 24 nt, Human
cuggaggugggcuuuggcauggcc

SEQ ID NO: 12221 - RNA, 22 nt, Human
cuggaguagaguuccugguugc

SEQ ID NO: 12222 - RNA, 22 nt, Human
cuggaguucagugguaugauca

SEQ ID NO: 12223 - RNA, 24 nt, Human
cuggaucccacaccugccacgggu

SEQ ID NO: 12224 - RNA, 24 nt, Human
cuggauggcagaguugaauaguug

SEQ ID NO: 12225 - RNA, 24 nt, Human
cuggcagacagccugaugguucag

SEQ ID NO: 12226 - RNA, 24 nt, Human
cuggcagacggcucgcuuuucgua

SEQ ID NO: 12227 - RNA, 24 nt, Human
cuggcgcagagcguccuugcagcc

SEQ ID NO: 12228 - RNA, 23 nt, Human
cuggcgccgggggucugcgggcg

SEQ ID NO: 12229 - RNA, 22 nt, Human
cuggcucugccacccccugggc

SEQ ID NO: 12230 - RNA, 24 nt, Human
cuggcucuuuccaguccuagcagg

SEQ ID NO: 12231 - RNA, 22 nt, Human
cugggaggcagaaguugcagug

SEQ ID NO: 12232 - RNA, 22 nt, Human
cugggauggaggagaauuagag

SEQ ID NO: 12233 - RNA, 22 nt, Human
cugggcaaccugaguggguaga

SEQ ID NO: 12234 - RNA, 22 nt, Human
cugggcaguaauguaguugaga

SEQ ID NO: 12235 - RNA, 24 nt, Human
cugggccaggccacaucugcggug

SEQ ID NO: 12236 - RNA, 24 nt, Human
cugggcccugggcgcuccauuuug

SEQ ID NO: 12237 - RNA, 24 nt, Human
cugggccucaaggcuaaaguuuua

SEQ ID NO: 12238 - RNA, 22 nt, Human
cugggcucuggucuguagguuu

SEQ ID NO: 12239 - RNA, 24 nt, Human
cuggggacggaaccgucagagcag

SEQ ID NO: 12240 - RNA, 24 nt, Human
cuggucccuggcacacucgugggc

SEQ ID NO: 12241 - RNA, 22 nt, Human
cuggugagagccugcugugugc

SEQ ID NO: 12242 - RNA, 24 nt, Human
cuggugcagcgagcccgggaguug

SEQ ID NO: 12243 - RNA, 24 nt, Human
cuggugccaauggucguggucagc

SEQ ID NO: 12244 - RNA, 24 nt, Human
cuguaccucugcaccccuggaaag

SEQ ID NO: 12245 - RNA, 22 nt, Human
cuguaucucagucugauccugg

SEQ ID NO: 12246 - RNA, 22 nt, Human
cugucaccaggcuacagugcag

SEQ ID NO: 12247 - RNA, 22 nt, Human
cuguccucuaaagcuacagaaa

SEQ ID NO: 12248 - RNA, 22 nt, Human
cuguccugugucagccugaaau

SEQ ID NO: 12249 - RNA, 24 nt, Human
cugugccccuggccgccagugggu

SEQ ID NO: 12250 - RNA, 22 nt, Human
cugugccugugacgagggauga

SEQ ID NO: 12251 - RNA, 22 nt, Human
cugugcgugugaacacgugugu

SEQ ID NO: 12252 - RNA, 24 nt, Human
cugugcuccaggucggccugggcc

SEQ ID NO: 12253 - RNA, 24 nt, Human
cugugcugccccuuucacaucaaa

SEQ ID NO: 12254 - RNA, 22 nt, Human
cuguucacuauuggcuggucug

SEQ ID NO: 12255 - RNA, 22 nt, Human
cuguuccugagagaaggcucau

SEQ ID NO: 12256 - RNA, 22 nt, Human
cuuauugugucuuugaauaagu

SEQ ID NO: 12257 - RNA, 24 nt, Human
cuucaaagcccaugcaguaguugu

SEQ ID NO: 12258 - RNA, 24 nt, Human
cuucaaguguagggacuccucgca

SEQ ID NO: 12259 - RNA, 24 nt, Human
cuucaccauuuuguuuucauuuug

SEQ ID NO: 12260 - RNA, 24 nt, Human
cuucaucggccucugcuggcugcu

SEQ ID NO: 12261 - RNA, 22 nt, Human
cuucauggugcuggaugggaga

SEQ ID NO: 12262 - RNA, 24 nt, Human
cuuccacaaggguugaacuaauuu

SEQ ID NO: 12263 - RNA, 24 nt, Human
cuuccaguccucggcugccacgcg

SEQ ID NO: 12264 - RNA, 24 nt, Human
cuuccaucucagacauccuuuucu

SEQ ID NO: 12265 - RNA, 22 nt, Human
cuuccauguccagaggaagcca

SEQ ID NO: 12266 - RNA, 22 nt, Human
cuuccccaugccucaguuugcu

SEQ ID NO: 12267 - RNA, 24 nt, Human
cuucccgccugcgucccggacccg

SEQ ID NO: 12268 - RNA, 24 nt, Human
cuuccgugauggucuacgaugaca

SEQ ID NO: 12269 - RNA, 24 nt, Human
cuuccuccacgucucaccccagcc

SEQ ID NO: 12270 - RNA, 24 nt, Human
cuuccugcuccagcugacagccgc

SEQ ID NO: 12271 - RNA, 22 nt, Human
cuuccuggguucauauccuggu

SEQ ID NO: 12272 - RNA, 24 nt, Human
cuuccuguauguggcugggcuugg

SEQ ID NO: 12273 - RNA, 24 nt, Human
cuuccugucuuuauggauucaagg

SEQ ID NO: 12274 - RNA, 22 nt, Human
cuucuacuucugguguuuuugg

SEQ ID NO: 12275 - RNA, 22 nt, Human
cuucuaugugaaaagagaaggu

SEQ ID NO: 12276 - RNA, 22 nt, Human
cuucucacaccaucagaaaauu

SEQ ID NO: 12277 - RNA, 22 nt, Human
cuucucucguuguugaacagag

SEQ ID NO: 12278 - RNA, 22 nt, Human
cuugaaauacaaauauugggaa

SEQ ID NO: 12279 - RNA, 24 nt, Human
cuugaaccugggaguuugagguug

SEQ ID NO: 12280 - RNA, 23 nt, Human
cuugaagauuucuaugcaggacc

SEQ ID NO: 12281 - RNA, 22 nt, Human
cuugaauccacaaucuuuucuc

SEQ ID NO: 12282 - RNA, 24 nt, Human
cuugacagcugugggcuggcugcc

SEQ ID NO: 12283 - RNA, 24 nt, Human
cuugaccccagaccuggggguguu

SEQ ID NO: 12284 - RNA, 22 nt, Human
cuugagauuagggaguggugau

SEQ ID NO: 12285 - RNA, 22 nt, Human
cuugcaaaagaaaagugacgug

SEQ ID NO: 12286 - RNA, 24 nt, Human
cuugcaacaauuguuaugcuuuug

SEQ ID NO: 12287 - RNA, 21 nt, Human
cuugcacccgggucuggcccg

SEQ ID NO: 12288 - RNA, 22 nt, Human
cuugcagaaccuuucuuagacu

SEQ ID NO: 12289 - RNA, 19 nt, Human
cuugcaggaagcaggacag

SEQ ID NO: 12290 - RNA, 24 nt, Human
cuugcggaccuuccucgagcgcca

SEQ ID NO: 12291 - RNA, 20 nt, Human
cuugcucuuaacuuuucugu

SEQ ID NO: 12292 - RNA, 22 nt, Human
cuugcugguuccuugcuucuag

SEQ ID NO: 12293 - RNA, 22 nt, Human
cuugcuuacaaggagggguuac

SEQ ID NO: 12294 - RNA, 22 nt, Human
cuuggaaugguaucccaugguu

SEQ ID NO: 12295 - RNA, 22 nt, Human
cuuggagucacugcuacucagc

SEQ ID NO: 12296 - RNA, 24 nt, Human
cuuggauuuucuggaaagauuuca

SEQ ID NO: 12297 - RNA, 22 nt, Human
cuuggcaaggaugagaauaccu

SEQ ID NO: 12298 - RNA, 21 nt, Human
cuuggcaugggagacauugcc

SEQ ID NO: 12299 - RNA, 20 nt, Human
cuuggcccaguaccuaugca

SEQ ID NO: 12300 - RNA, 24 nt, Human
cuuggcccaguaccuaugcaacga

SEQ ID NO: 12301 - RNA, 22 nt, Human
cuuggcccugugaggcuucacc

SEQ ID NO: 12302 - RNA, 24 nt, Human
cuuggcccuuggggccuccacagu

SEQ ID NO: 12303 - RNA, 22 nt, Human
cuuggcgagugcuggggcuagu

SEQ ID NO: 12304 - RNA, 24 nt, Human
cuuggcuuccaaggauggaaaguc

SEQ ID NO: 12305 - RNA, 22 nt, Human
cuugggaagaccaagaggaagu

SEQ ID NO: 12306 - RNA, 24 nt, Human
cuuguaaaaaucaaugaauggcaa

SEQ ID NO: 12307 - RNA, 24 nt, Human
cuuguccggacacgaugaucuggg

SEQ ID NO: 12308 - RNA, 22 nt, Human
cuuuaugaggagaggaagagca

SEQ ID NO: 12309 - RNA, 24 nt, Human
cuuuaugguggugcuggaguuggc

SEQ ID NO: 12310 - RNA, 24 nt, Human
cuuucagccuuucacggaucagcu

SEQ ID NO: 12311 - RNA, 22 nt, Human
cuuuccuucccuggaagagauu

SEQ ID NO: 12312 - RNA, 24 nt, Human
cuuucgggguccgcugcugcugcu

SEQ ID NO: 12313 - RNA, 24 nt, Human
cuuucuguucauccguacuuucaa

SEQ ID NO: 12314 - RNA, 24 nt, Human
cuuucuugauggcggggcaggugg

SEQ ID NO: 12315 - RNA, 21 nt, Human
cuuugaggaguucucagcgcc

SEQ ID NO: 12316 - RNA, 24 nt, Human
cuuugagggggcugaugcggagga

SEQ ID NO: 12317 - RNA, 24 nt, Human
cuuugcuucuguuuucuggaugca

SEQ ID NO: 12318 - RNA, 21 nt, Human
cuuuggcaagggagaagucac

SEQ ID NO: 12319 - RNA, 22 nt, Human
cuuuggccaaauugggguacca

SEQ ID NO: 12320 - RNA, 24 nt, Human
cuuugggaagaaaagagguuguug

SEQ ID NO: 12321 - RNA, 24 nt, Human
cuuugguaguuccuggaaaucauc

SEQ ID NO: 12322 - RNA, 22 nt, Human
cuuugguuggguggguauuugg

SEQ ID NO: 12323 - RNA, 22 nt, Human
cuuugugauguaucugcagcca

SEQ ID NO: 12324 - RNA, 24 nt, Human
cuuuucaacaguuucacauccagc

SEQ ID NO: 12325 - RNA, 22 nt, Human
cuuuucagauguggcuggucau

SEQ ID NO: 12326 - RNA, 24 nt, Human
cuuuucccuuccugugagccccuu

SEQ ID NO: 12327 - RNA, 22 nt, Human
cuuuuccugggucugggcugug

SEQ ID NO: 12328 - RNA, 22 nt, Human
cuuuucuucuuucuuaacuuua

SEQ ID NO: 12329 - RNA, 24 nt, Human
cuuuugggcaucauauaccccaug

SEQ ID NO: 12330 - RNA, 22 nt, Human
cuuuuugggguuuggggcuugg

SEQ ID NO: 12331 - RNA, 22 nt, Human
gaaaaauggagugucauuugca

SEQ ID NO: 12332 - RNA, 22 nt, Human
gaaacuaguguugggacaaagg

SEQ ID NO: 12333 - RNA, 24 nt, Human
gaaacuuucacaauguccggagcc

SEQ ID NO: 12334 - RNA, 24 nt, Human
gaaagcuaucagauaauucgcagu

SEQ ID NO: 12335 - RNA, 24 nt, Human
gaaagcucugccugcaauauuuuu

SEQ ID NO: 12336 - RNA, 24 nt, Human
gaaaggacgggguuucuaguugcu

SEQ ID NO: 12337 - RNA, 22 nt, Human
gaaaugagagaccuguacugua

SEQ ID NO: 12338 - RNA, 22 nt, Human
gaaccuucaacugcuuagccug

SEQ ID NO: 12339 - RNA, 24 nt, Human
gaacugccuucgugccgccucaau

SEQ ID NO: 12340 - RNA, 22 nt, Human
gaagacuguuaaaguguggucu

SEQ ID NO: 12341 - RNA, 22 nt, Human
gaagagcugugugcugugaugu

SEQ ID NO: 12342 - RNA, 24 nt, Human
gaagauagcgaaauacauugggga

SEQ ID NO: 12343 - RNA, 24 nt, Human
gaagcagccucauggucucaugcu

SEQ ID NO: 12344 - RNA, 24 nt, Human
gaaggcacaacaguuaauggcugu

SEQ ID NO: 12345 - RNA, 22 nt, Human
gaaggcaguagguuguauaguu

SEQ ID NO: 12346 - RNA, 24 nt, Human
gaagggaaaugucugagguagagc

SEQ ID NO: 12347 - RNA, 24 nt, Human
gaaggugcugacuuccuugggaga

SEQ ID NO: 12348 - RNA, 24 nt, Human
gaagucacacucagaauuuaauuu

SEQ ID NO: 12349 - RNA, 24 nt, Human
gaagugaaguuuaucaagaacgau

SEQ ID NO: 12350 - RNA, 24 nt, Human
gaaguugucuguacuucuucccua

SEQ ID NO: 12351 - RNA, 22 nt, Human
gaaguuugaagccuguuguuca

SEQ ID NO: 12352 - RNA, 24 nt, Human
gaauguuccccccauuggaaacug

SEQ ID NO: 12353 - RNA, 22 nt, Human
gacaagaggcacagacagcagg

SEQ ID NO: 12354 - RNA, 21 nt, Human
gacacaggcccagagaggcag

SEQ ID NO: 12355 - RNA, 24 nt, Human
gacaccacuccucucugcagcacu

SEQ ID NO: 12356 - RNA, 24 nt, Human
gacacgauggagaagguaugugca

SEQ ID NO: 12357 - RNA, 23 nt, Human
gacacugugcuuacagggaacgg

SEQ ID NO: 12358 - RNA, 24 nt, Human
gacagcagcaggaugaagcuggau

SEQ ID NO: 12359 - RNA, 22 nt, Human
gacauugguuuaccuugccagg

SEQ ID NO: 12360 - RNA, 19 nt, Human
gaccaagaugucuauuacu

SEQ ID NO: 12361 - RNA, 24 nt, Human
gaccagcaccauggcgguuggcaa

SEQ ID NO: 12362 - RNA, 24 nt, Human
gaccaggagaccuaccgcugugaa

SEQ ID NO: 12363 - RNA, 24 nt, Human
gaccagugaagcuggagccagggu

SEQ ID NO: 12364 - RNA, 24 nt, Human
gacccagcccuacucauugcgaug

SEQ ID NO: 12365 - RNA, 21 nt, Human
gaccccauacauuugugguca

SEQ ID NO: 12366 - RNA, 24 nt, Human
gacccggcaacccgcggcccuugg

SEQ ID NO: 12367 - RNA, 22 nt, Human
gacccuggugagcuggguggcc

SEQ ID NO: 12368 - RNA, 24 nt, Human
gaccgcuggaucgugccgggcggg

SEQ ID NO: 12369 - RNA, 23 nt, Human
gaccgggacccggcggcccugcu

SEQ ID NO: 12370 - RNA, 24 nt, Human
gaccucacugacccagacguuccg

SEQ ID NO: 12371 - RNA, 18 nt, Human
gaccucagguuaucugcc

SEQ ID NO: 12372 - RNA, 24 nt, Human
gaccuggauccugcacaguugggg

SEQ ID NO: 12373 - RNA, 24 nt, Human
gaccuugugauccaccugccucag

SEQ ID NO: 12374 - RNA, 24 nt, Human
gaccuuuuaaauggcucaucugug

SEQ ID NO: 12375 - RNA, 22 nt, Human
gacuaacagacacaggcuuaca

SEQ ID NO: 12376 - RNA, 24 nt, Human
gacuccuuaggaggagugagacag

SEQ ID NO: 12377 - RNA, 24 nt, Human
gacucuguuuccccauuucuugcu

SEQ ID NO: 12378 - RNA, 22 nt, Human
gacugaaccuaagauucagaug

SEQ ID NO: 12379 - RNA, 22 nt, Human
gacuggagagaaaggcagucca

SEQ ID NO: 12380 - RNA, 22 nt, Human
gacuucaagaugaaucuuuggg

SEQ ID NO: 12381 - RNA, 24 nt, Human
gacuuuuuccauucccucacgguu

SEQ ID NO: 12382 - RNA, 22 nt, Human
gagaaacagaaucuccuuuguu

SEQ ID NO: 12383 - RNA, 24 nt, Human
gagaaguaggugagggcaugcaaa

SEQ ID NO: 12384 - RNA, 24 nt, Human
gagaggccguguagcgucgccguu

SEQ ID NO: 12385 - RNA, 24 nt, Human
gagaucuugggcaaaucacuuagu

SEQ ID NO: 12386 - RNA, 24 nt, Human
gagcacaugugccgccuggacauu

SEQ ID NO: 12387 - RNA, 24 nt, Human
gagcacccccuccaggcaugaugg

SEQ ID NO: 12388 - RNA, 24 nt, Human
gagcaccgaggagcugcgggugcg

SEQ ID NO: 12389 - RNA, 24 nt, Human
gagcaccugucuucauugccucuc

SEQ ID NO: 12390 - RNA, 24 nt, Human
gagcagaagacagagcuggugugc

SEQ ID NO: 12391 - RNA, 24 nt, Human
gagcagcaagacugaaacuguuga

SEQ ID NO: 12392 - RNA, 23 nt, Human
gagcagcagaacaagguccugga

SEQ ID NO: 12393 - RNA, 24 nt, Human
gagcaggaagaugugccacuuccu

SEQ ID NO: 12394 - RNA, 24 nt, Human
gagcagguccaccggccccuacau

SEQ ID NO: 12395 - RNA, 24 nt, Human
gagcagucggguccggcguccucc

SEQ ID NO: 12396 - RNA, 24 nt, Human
gagcagugcgucaugguugugcga

SEQ ID NO: 12397 - RNA, 24 nt, Human
gagcaguggugcgcucucggcacu

SEQ ID NO: 12398 - RNA, 24 nt, Human
gagcaucaaaguccacguucaugu

SEQ ID NO: 12399 - RNA, 24 nt, Human
gagcaugguuauggugauucgugc

SEQ ID NO: 12400 - RNA, 24 nt, Human
gagcauuagacccaagaccauugu

SEQ ID NO: 12401 - RNA, 23 nt, Human
gagcauuggcagugaauugcaga

SEQ ID NO: 12402 - RNA, 24 nt, Human
gagcauuuguauguuauggugaau

SEQ ID NO: 12403 - RNA, 24 nt, Human
gagccagcccugcccuuggaacca

SEQ ID NO: 12404 - RNA, 22 nt, Human
gagccagucuacuagaaggggg

SEQ ID NO: 12405 - RNA, 24 nt, Human
gagccugucuguccucccucagag

SEQ ID NO: 12406 - RNA, 24 nt, Human
gagccuuaaugggggcagaaaggg

SEQ ID NO: 12407 - RNA, 21 nt, Human
gagccuuugagccagugcugc

SEQ ID NO: 12408 - RNA, 24 nt, Human
gagcgggcccugcuggcugcggcu

SEQ ID NO: 12409 - RNA, 24 nt, Human
gagcgggcuuauaaacccucugug

SEQ ID NO: 12410 - RNA, 24 nt, Human
gagcgguccuuggggagacgcggg

SEQ ID NO: 12411 - RNA, 24 nt, Human
gagcgguucauuuauuuggaaacu

SEQ ID NO: 12412 - RNA, 24 nt, Human
gagcgucaaggcccugugcugcug

SEQ ID NO: 12413 - RNA, 24 nt, Human
gagcucgcuugggucccuuugaca

SEQ ID NO: 12414 - RNA, 24 nt, Human
gagcugagcgaagcgaugccuaaa

SEQ ID NO: 12415 - RNA, 24 nt, Human
gagcugccaaagccauccugccac

SEQ ID NO: 12416 - RNA, 24 nt, Human
gagcugcuggaggcuggcuacuug

SEQ ID NO: 12417 - RNA, 24 nt, Human
gagcuuuaugcugaaaagguggcc

SEQ ID NO: 12418 - RNA, 24 nt, Human
gagcuuuucuuuaacgauaucaac

SEQ ID NO: 12419 - RNA, 22 nt, Human
gaggacccuuaggucagacaga

SEQ ID NO: 12420 - RNA, 24 nt, Human
gaggacguccuggaugauuggacg

SEQ ID NO: 12421 - RNA, 24 nt, Human
gaggagaggcggcccaacucuucu

SEQ ID NO: 12422 - RNA, 24 nt, Human
gaggauccauuuuaugguugaugc

SEQ ID NO: 12423 - RNA, 24 nt, Human
gaggaugccgcacagagauugacu

SEQ ID NO: 12424 - RNA, 22 nt, Human
gaggcagagguugcagugauca

SEQ ID NO: 12425 - RNA, 23 nt, Human
gaggcccaguucuguccgggccc

SEQ ID NO: 12426 - RNA, 24 nt, Human
gaggcugguguugugaagauccug

SEQ ID NO: 12427 - RNA, 21 nt, Human
gagggcccuauggacacccca

SEQ ID NO: 12428 - RNA, 24 nt, Human
gaggggccgauacccagucgcacu

SEQ ID NO: 12429 - RNA, 24 nt, Human
gaggggccuuuguccaauucagca

SEQ ID NO: 12430 - RNA, 22 nt, Human
gaggguaaauucagaguaggag

SEQ ID NO: 12431 - RNA, 22 nt, Human
gagguagagguugcagugaguc

SEQ ID NO: 12432 - RNA, 22 nt, Human
gaggucaccugacucugcuugu

SEQ ID NO: 12433 - RNA, 22 nt, Human
gaggugaaagcauaacaugggu

SEQ ID NO: 12434 - RNA, 22 nt, Human
gagguuucauuauguugcccag

SEQ ID NO: 12435 - RNA, 24 nt, Human
gaguaugcggcucgggcccgucug

SEQ ID NO: 12436 - RNA, 22 nt, Human
gaguccuccuucuuccggucuu

SEQ ID NO: 12437 - RNA, 22 nt, Human
gaguugggagcaauggauucaa

SEQ ID NO: 12438 - RNA, 22 nt, Human
gauaaaggugcugauguuaaug

SEQ ID NO: 12439 - RNA, 21 nt, Human
gauaauaguaauuguggcagc

SEQ ID NO: 12440 - RNA, 24 nt, Human
gauacagcccugguaugaggccuu

SEQ ID NO: 12441 - RNA, 24 nt, Human
gauaccacagaaaugguucagucu

SEQ ID NO: 12442 - RNA, 24 nt, Human
gaucacucugcucugauuauggaa

SEQ ID NO: 12443 - RNA, 24 nt, Human
gaucauacuccacugugguccuga

SEQ ID NO: 12444 - RNA, 22 nt, Human
gaucuguccuggcaguuaacac

SEQ ID NO: 12445 - RNA, 21 nt, Human
gaugacagcaggcaaaaucac

SEQ ID NO: 12446 - RNA, 24 nt, Human
gaugaccaagcgggaggauggggg

SEQ ID NO: 12447 - RNA, 24 nt, Human
gaugcaaaauguuugcaguuugac

SEQ ID NO: 12448 - RNA, 23 nt, Human
gaugcaggugugacugguucuga

SEQ ID NO: 12449 - RNA, 22 nt, Human
gaugcggccaaggcaucaguau

SEQ ID NO: 12450 - RNA, 19 nt, Human
gaugcuguugugccagaag

SEQ ID NO: 12451 - RNA, 24 nt, Human
gauggagcgagucagaaccagcau

SEQ ID NO: 12452 - RNA, 22 nt, Human
gauggcaccuugaacgcugcgu

SEQ ID NO: 12453 - RNA, 24 nt, Human
gauggcccaccgaugggcgggugg

SEQ ID NO: 12454 - RNA, 24 nt, Human
gauggguuucaccauguuggucag

SEQ ID NO: 12455 - RNA, 24 nt, Human
gaugugcgcuugugugggucauga

SEQ ID NO: 12456 - RNA, 22 nt, Human
gauuacacaggcuauuguagcc

SEQ ID NO: 12457 - RNA, 24 nt, Human
gauuacacuguuaccgagaucccu

SEQ ID NO: 12458 - RNA, 22 nt, Human
gauuccuccucuuuaaaauggu

SEQ ID NO: 12459 - RNA, 22 nt, Human
gauucugagaaacacaccagga

SEQ ID NO: 12460 - RNA, 24 nt, Human
gauugggcuccagcuaucgagccu

SEQ ID NO: 12461 - RNA, 24 nt, Human
gauuguuucucuucacccccaaca

SEQ ID NO: 12462 - RNA, 24 nt, Human
gauuucaccuuaaugguagaagua

SEQ ID NO: 12463 - RNA, 22 nt, Human
gauuugagcaacaagaugccgu

SEQ ID NO: 12464 - RNA, 22 nt, Human
gauuuucauaggagcagaaacc

SEQ ID NO: 12465 - RNA, 24 nt, Human
gcaaucccgcgcgguuugucaugg

SEQ ID NO: 12466 - RNA, 20 nt, Human
gcacaaacuggagaaagggg

SEQ ID NO: 12467 - RNA, 22 nt, Human
gcacagagacaguccugagauc

SEQ ID NO: 12468 - RNA, 24 nt, Human
gcacuaguagucaguagggagugg

SEQ ID NO: 12469 - RNA, 22 nt, Human
gcacucaagccuggguuacaga

SEQ ID NO: 12470 - RNA, 24 nt, Human
gcagaagugccgccaaagcugugg

SEQ ID NO: 12471 - RNA, 24 nt, Human
gcagcaaaucauaggcaagcggcc

SEQ ID NO: 12472 - RNA, 22 nt, Human
gcagcaggcagggccaggcagg

SEQ ID NO: 12473 - RNA, 22 nt, Human
gcagcuguuuauuuagaaccug

SEQ ID NO: 12474 - RNA, 22 nt, Human
gcaggcaauuuuggaaggucag

SEQ ID NO: 12475 - RNA, 24 nt, Human
gcaggccagcagggaacaagagga

SEQ ID NO: 12476 - RNA, 22 nt, Human
gcaggccgauuuguuagaaguc

SEQ ID NO: 12477 - RNA, 22 nt, Human
gcaggcugguuggugaggcaaa

SEQ ID NO: 12478 - RNA, 24 nt, Human
gcaggucgaugauguugagcagcu

SEQ ID NO: 12479 - RNA, 24 nt, Human
gcaguagguggcuacuugaugugg

SEQ ID NO: 12480 - RNA, 22 nt, Human
gcauccaugggguccugggagu

SEQ ID NO: 12481 - RNA, 22 nt, Human
gcaucucugcuggagcuguuca

SEQ ID NO: 12482 - RNA, 22 nt, Human
gccaaaagucugagaagugauu

SEQ ID NO: 12483 - RNA, 24 nt, Human
gccaauggugccaccagauguuuu

SEQ ID NO: 12484 - RNA, 21 nt, Human
gccacagcguagggcuggggu

SEQ ID NO: 12485 - RNA, 24 nt, Human
gccaccgucggugcuuuggugcuc

SEQ ID NO: 12486 - RNA, 24 nt, Human
gccacuguacucuagccugggcaa

SEQ ID NO: 12487 - RNA, 24 nt, Human
gccacuguuucaugggcccgaguu

SEQ ID NO: 12488 - RNA, 22 nt, Human
gccaggaugaagaggaggagaa

SEQ ID NO: 12489 - RNA, 24 nt, Human
gccagggugguggcuaacgccugu

SEQ ID NO: 12490 - RNA, 22 nt, Human
gccaugaagaaaccuccuuuuu

SEQ ID NO: 12491 - RNA, 22 nt, Human
gccaugaaucacccaggccauc

SEQ ID NO: 12492 - RNA, 24 nt, Human
gcccagcaucuucaaagacaugcu

SEQ ID NO: 12493 - RNA, 24 nt, Human
gcccagcuggcuaaaguucaagaa

SEQ ID NO: 12494 - RNA, 24 nt, Human
gcccaggacguguggaugcugcug

SEQ ID NO: 12495 - RNA, 22 nt, Human
gcccaggagucugaggcuggag

SEQ ID NO: 12496 - RNA, 24 nt, Human
gcccagugcugaguugucuucgag

SEQ ID NO: 12497 - RNA, 24 nt, Human
gccccagccaccuucacaugagga

SEQ ID NO: 12498 - RNA, 24 nt, Human
gccccagcuccagugccuacugca

SEQ ID NO: 12499 - RNA, 22 nt, Human
gcccccugaggugugagugaaa

SEQ ID NO: 12500 - RNA, 24 nt, Human
gccccgauaugaguagggggagcg

SEQ ID NO: 12501 - RNA, 24 nt, Human
gccccuaggcaccugcggccuggc

SEQ ID NO: 12502 - RNA, 22 nt, Human
gccccuuugcaggggagcgccc

SEQ ID NO: 12503 - RNA, 24 nt, Human
gcccgagugcacgugucugaggag

SEQ ID NO: 12504 - RNA, 24 nt, Human
gcccggggguacccagaggcggga

SEQ ID NO: 12505 - RNA, 24 nt, Human
gcccugacccuacaagaugccaag

SEQ ID NO: 12506 - RNA, 22 nt, Human
gcccugaugcuucugcauuucu

SEQ ID NO: 12507 - RNA, 24 nt, Human
gcccugggauucgagcaggagaug

SEQ ID NO: 12508 - RNA, 24 nt, Human
gcccuuaggggagucacggcugga

SEQ ID NO: 12509 - RNA, 24 nt, Human
gcccuuaggggaguccagggccag

SEQ ID NO: 12510 - RNA, 24 nt, Human
gcccuuuucccagugauaugagca

SEQ ID NO: 12511 - RNA, 22 nt, Human
gccgcgcuguugccgcggcuug

SEQ ID NO: 12512 - RNA, 24 nt, Human
gccgcugugcugaaggaggugugc

SEQ ID NO: 12513 - RNA, 22 nt, Human
gccuaggggcagcuuugacucg

SEQ ID NO: 12514 - RNA, 22 nt, Human
gccuggaugugaccacccucac

SEQ ID NO: 12515 - RNA, 24 nt, Human
gccugugucuggccaggcugaggu

SEQ ID NO: 12516 - RNA, 22 nt, Human
gccuuuccuccagaacugcucc

SEQ ID NO: 12517 - RNA, 24 nt, Human
gcgaaccacagacuaggcuauuua

SEQ ID NO: 12518 - RNA, 24 nt, Human
gcgcaaagacacucucugcucuag

SEQ ID NO: 12519 - RNA, 22 nt, Human
gcgcaacaguugucauuuuucu

SEQ ID NO: 12520 - RNA, 24 nt, Human
gcgcacugauuccgggccccagag

SEQ ID NO: 12521 - RNA, 24 nt, Human
gcgcagguacgucgucuguagcag

SEQ ID NO: 12522 - RNA, 24 nt, Human
gcgcaucguggggaugacugagca

SEQ ID NO: 12523 - RNA, 24 nt, Human
gcgccgggggcaugcucaccuacg

SEQ ID NO: 12524 - RNA, 24 nt, Human
gcgccuggagcucgacgcgcugcg

SEQ ID NO: 12525 - RNA, 24 nt, Human
gcgcugcggcucccgcuggcucgg

SEQ ID NO: 12526 - RNA, 24 nt, Human
gcgcuuuuugcggggggcgaaaag

SEQ ID NO: 12527 - RNA, 24 nt, Human
gcggagcuugcagugagccgagau

SEQ ID NO: 12528 - RNA, 22 nt, Human
gcggggcccagcaaucuguguu

SEQ ID NO: 12529 - RNA, 22 nt, Human
gcguagguguagauuggaccuc

SEQ ID NO: 12530 - RNA, 22 nt, Human
gcguccaaucaggagggagcuc

SEQ ID NO: 12531 - RNA, 24 nt, Human
gcuacagcuucaccaccacggccg

SEQ ID NO: 12532 - RNA, 24 nt, Human
gcucaaggugcagcgccucugcuc

SEQ ID NO: 12533 - RNA, 24 nt, Human
gcuccaccagaugcagauuugugu

SEQ ID NO: 12534 - RNA, 24 nt, Human
gcuccggggaaacgcgagccgcga

SEQ ID NO: 12535 - RNA, 24 nt, Human
gcucgugggacuguacguggaccc

SEQ ID NO: 12536 - RNA, 24 nt, Human
gcucucuuuuucuaauguaaaugu

SEQ ID NO: 12537 - RNA, 24 nt, Human
gcucugcucucuccucccucucau

SEQ ID NO: 12538 - RNA, 22 nt, Human
gcucugcucugauaauucugug

SEQ ID NO: 12539 - RNA, 22 nt, Human
gcugaauuuugacuccaucucc

SEQ ID NO: 12540 - RNA, 22 nt, Human
gcugagaccacccuugccugcc

SEQ ID NO: 12541 - RNA, 24 nt, Human
gcugcagagccugggcugggaagc

SEQ ID NO: 12542 - RNA, 24 nt, Human
gcugccaucuaguuggacgcggau

SEQ ID NO: 12543 - RNA, 22 nt, Human
gcugcgcagaucugcuguucuc

SEQ ID NO: 12544 - RNA, 22 nt, Human
gcugcuccugcucucccucucc

SEQ ID NO: 12545 - RNA, 22 nt, Human
gcugcugccucaacauuuuagg

SEQ ID NO: 12546 - RNA, 24 nt, Human
gcuggcugcccgugcugcggcacu

SEQ ID NO: 12547 - RNA, 22 nt, Human
gcuggggagaggaguuccuccc

SEQ ID NO: 12548 - RNA, 24 nt, Human
gcuguggggggcuuuaauauucug

SEQ ID NO: 12549 - RNA, 24 nt, Human
gcuguggugucuggguguggccug

SEQ ID NO: 12550 - RNA, 22 nt, Human
gcugugguucugcaugaagaca

SEQ ID NO: 12551 - RNA, 22 nt, Human
gcuguguuaacuguucaaacuc

SEQ ID NO: 12552 - RNA, 22 nt, Human
gcuuauagaagacgucaucacc

SEQ ID NO: 12553 - RNA, 24 nt, Human
gcuucagauugacauaccugaugc

SEQ ID NO: 12554 - RNA, 24 nt, Human
gcuucagugacauugagaaccuug

SEQ ID NO: 12555 - RNA, 22 nt, Human
gcuuccugaccgauagagguug

SEQ ID NO: 12556 - RNA, 22 nt, Human
gcuuccuguauuggcugcaagu

SEQ ID NO: 12557 - RNA, 24 nt, Human
gcuuccuuaucccaccccagagac

SEQ ID NO: 12558 - RNA, 24 nt, Human
gcuugaguggaggaaggcagaaua

SEQ ID NO: 12559 - RNA, 22 nt, Human
gcuugauggaaaaaggaugcag

SEQ ID NO: 12560 - RNA, 21 nt, Human
gcuuugguauucuagcuguga

SEQ ID NO: 12561 - RNA, 24 nt, Human
gcuuuugucagauggagugccggu

SEQ ID NO: 12562 - RNA, 22 nt, Human
ggaaaacaaguaccccuggaac

SEQ ID NO: 12563 - RNA, 22 nt, Human
ggaaaguuaaagauguauguau

SEQ ID NO: 12564 - RNA, 22 nt, Human
ggaacccuagacuugcgcagaa

SEQ ID NO: 12565 - RNA, 24 nt, Human
ggaaggacgggcguggucugcagg

SEQ ID NO: 12566 - RNA, 22 nt, Human
ggaauucuggucuaggacaaga

SEQ ID NO: 12567 - RNA, 22 nt, Human
ggacagaacuggcucaaugacc

SEQ ID NO: 12568 - RNA, 22 nt, Human
ggacaucaggauuccucuggga

SEQ ID NO: 12569 - RNA, 22 nt, Human
ggacauggccugucaggugcag

SEQ ID NO: 12570 - RNA, 24 nt, Human
ggacaugggccugguggucgucuu

SEQ ID NO: 12571 - RNA, 24 nt, Human
ggaccgggggcugggcuggccgca

SEQ ID NO: 12572 - RNA, 22 nt, Human
ggacugcagucacacucuaaga

SEQ ID NO: 12573 - RNA, 24 nt, Human
ggacuuggaaggcuggugugacgu

SEQ ID NO: 12574 - RNA, 22 nt, Human
ggagaaguagaucggugagcag

SEQ ID NO: 12575 - RNA, 24 nt, Human
ggagacaguaaaggugaugggggc

SEQ ID NO: 12576 - RNA, 24 nt, Human
ggagacugauuaaguaacuucggc

SEQ ID NO: 12577 - RNA, 22 nt, Human
ggagacugcugguaaagauggg

SEQ ID NO: 12578 - RNA, 24 nt, Human
ggagagcggguggggagcuucugu

SEQ ID NO: 12579 - RNA, 24 nt, Human
ggagauaccugacagaugagagcc

SEQ ID NO: 12580 - RNA, 22 nt, Human
ggagauagacugauugggaacu

SEQ ID NO: 12581 - RNA, 21 nt, Human
ggagauggccauggcgaccgu

SEQ ID NO: 12582 - RNA, 24 nt, Human
ggagauguguauucuuuggccuuc

SEQ ID NO: 12583 - RNA, 24 nt, Human
ggagcagauggccaucaguggcgg

SEQ ID NO: 12584 - RNA, 24 nt, Human
ggaggaaacauuaaaggugauggg

SEQ ID NO: 12585 - RNA, 24 nt, Human
ggaggagagacuccuaggauggcu

SEQ ID NO: 12586 - RNA, 24 nt, Human
ggaggagauaaaauaauucauucu

SEQ ID NO: 12587 - RNA, 22 nt, Human
ggagguagagcccacuaagccu

SEQ ID NO: 12588 - RNA, 24 nt, Human
ggagguuugcagugagccgagagc

SEQ ID NO: 12589 - RNA, 24 nt, Human
ggaguaaauuccccccucucauuu

SEQ ID NO: 12590 - RNA, 24 nt, Human
ggagucuuaugaacuacagucaaa

SEQ ID NO: 12591 - RNA, 24 nt, Human
ggagugguaaaaccagccaaugga

SEQ ID NO: 12592 - RNA, 22 nt, Human
ggaguguaaagaaggauguuac

SEQ ID NO: 12593 - RNA, 22 nt, Human
ggaucugggcugcagucuaggc

SEQ ID NO: 12594 - RNA, 22 nt, Human
ggaugcugcuccacaucccaca

SEQ ID NO: 12595 - RNA, 22 nt, Human
ggauuuuucggaagcuauggau

SEQ ID NO: 12596 - RNA, 22 nt, Human
ggcaaggaagaaagcagaaguu

SEQ ID NO: 12597 - RNA, 23 nt, Human
ggcacgguuaugaaauauuuugu

SEQ ID NO: 12598 - RNA, 22 nt, Human
ggcacuguagguucaaugguaa

SEQ ID NO: 12599 - RNA, 22 nt, Human
ggcagaggacacgucucagggc

SEQ ID NO: 12600 - RNA, 22 nt, Human
ggcagcacauaauguaucauga

SEQ ID NO: 12601 - RNA, 21 nt, Human
ggcagcagaaggaugagggcc

SEQ ID NO: 12602 - RNA, 22 nt, Human
ggcagcuuuguaaauggacucu

SEQ ID NO: 12603 - RNA, 22 nt, Human
ggcaucgaugaggcucauggca

SEQ ID NO: 12604 - RNA, 22 nt, Human
ggcaugauucagcagaggagag

SEQ ID NO: 12605 - RNA, 22 nt, Human
ggcauuagauuagcauuggagc

SEQ ID NO: 12606 - RNA, 22 nt, Human
ggcauuugucucaggugcaaaa

SEQ ID NO: 12607 - RNA, 22 nt, Human
ggccacauuccagagggcugaa

SEQ ID NO: 12608 - RNA, 22 nt, Human
ggccacuuccaccuuccagggc

SEQ ID NO: 12609 - RNA, 22 nt, Human
ggccaggacucuugcagaacug

SEQ ID NO: 12610 - RNA, 20 nt, Human
ggccauggaagcuggcugcc

SEQ ID NO: 12611 - RNA, 24 nt, Human
ggcccaguguuggagagcugaagg

SEQ ID NO: 12612 - RNA, 22 nt, Human
ggccccuuugugaggcacgcuu

SEQ ID NO: 12613 - RNA, 24 nt, Human
ggcccugggugcugcuggcuuuau

SEQ ID NO: 12614 - RNA, 24 nt, Human
ggccgcuacgcgcugcuucccccg

SEQ ID NO: 12615 - RNA, 24 nt, Human
ggccgcuaggacugaagcaccucg

SEQ ID NO: 12616 - RNA, 24 nt, Human
ggccggggcgggagagacucagca

SEQ ID NO: 12617 - RNA, 22 nt, Human
ggccucagaagcugaggggaga

SEQ ID NO: 12618 - RNA, 24 nt, Human
ggccucgagcaagccuggccuauc

SEQ ID NO: 12619 - RNA, 24 nt, Human
ggccuggaggagggggucgcgcga

SEQ ID NO: 12620 - RNA, 22 nt, Human
ggccuuuucucauggcaugacc

SEQ ID NO: 12621 - RNA, 24 nt, Human
ggcgaagcugggccaugcuguuug

SEQ ID NO: 12622 - RNA, 24 nt, Human
ggcgguuagggcuguguagggcga

SEQ ID NO: 12623 - RNA, 22 nt, Human
ggcgugaucuuggcucaccaca

SEQ ID NO: 12624 - RNA, 22 nt, Human
ggcugggcaugguggcucacgc

SEQ ID NO: 12625 - RNA, 22 nt, Human
ggcuggggauuguggcuguaga

SEQ ID NO: 12626 - RNA, 22 nt, Human
ggcuugauuugcuuggugaccg

SEQ ID NO: 12627 - RNA, 22 nt, Human
ggcuuggcacguauaggaucca

SEQ ID NO: 12628 - RNA, 22 nt, Human
ggcuuuuguuauaaucaggccu

SEQ ID NO: 12629 - RNA, 22 nt, Human
gggaaaggaggaucgaugcaca

SEQ ID NO: 12630 - RNA, 24 nt, Human
gggaaaguguucggcagggcagaa

SEQ ID NO: 12631 - RNA, 22 nt, Human
gggaaaucgugcgcgacaucaa

SEQ ID NO: 12632 - RNA, 22 nt, Human
gggaaaucugcuuccuagggcu

SEQ ID NO: 12633 - RNA, 24 nt, Human
gggaacccuaggucagaccuuggu

SEQ ID NO: 12634 - RNA, 24 nt, Human
gggaagaugccaaggcugggcuau

SEQ ID NO: 12635 - RNA, 24 nt, Human
gggaagcccgucucuucgaccucc

SEQ ID NO: 12636 - RNA, 24 nt, Human
gggaagcuuuguuaaauuuuuguu

SEQ ID NO: 12637 - RNA, 24 nt, Human
gggaagucaugcugagggugguag

SEQ ID NO: 12638 - RNA, 24 nt, Human
gggaauaaauauauuaagugccuc

SEQ ID NO: 12639 - RNA, 24 nt, Human
gggaaucagucuaaagcugugcuc

SEQ ID NO: 12640 - RNA, 24 nt, Human
gggaauguucuggagcugccaagg

SEQ ID NO: 12641 - RNA, 22 nt, Human
gggacugagaugcaggauuucu

SEQ ID NO: 12642 - RNA, 24 nt, Human
gggagugugggcgcggcugggguc

SEQ ID NO: 12643 - RNA, 24 nt, Human
gggcaaguuggugagguucugcaa

SEQ ID NO: 12644 - RNA, 24 nt, Human
gggcaaucuuccuggccaucaucc

SEQ ID NO: 12645 - RNA, 24 nt, Human
gggcacugaggcccgggauguaug

SEQ ID NO: 12646 - RNA, 23 nt, Human
gggcaggaggagcuccggagcug

SEQ ID NO: 12647 - RNA, 24 nt, Human
gggcagggggaaugggaguauaag

SEQ ID NO: 12648 - RNA, 21 nt, Human
gggcaggggugaggcagguuu

SEQ ID NO: 12649 - RNA, 24 nt, Human
gggcaguaaucaaguggaugaagc

SEQ ID NO: 12650 - RNA, 24 nt, Human
gggcagugggguccgcaucguggu

SEQ ID NO: 12651 - RNA, 24 nt, Human
gggcaucguggcugaggugcuggu

SEQ ID NO: 12652 - RNA, 24 nt, Human
gggcaugaagaucacaaugggccu

SEQ ID NO: 12653 - RNA, 22 nt, Human
gggcaugaugauggcacuagcg

SEQ ID NO: 12654 - RNA, 24 nt, Human
gggcauggggcugcucacuggcac

SEQ ID NO: 12655 - RNA, 24 nt, Human
gggcaugggucaagggcguccggg

SEQ ID NO: 12656 - RNA, 24 nt, Human
gggcauggugucuuaugccuguaa

SEQ ID NO: 12657 - RNA, 24 nt, Human
gggcauggugugccucgggcucua

SEQ ID NO: 12658 - RNA, 24 nt, Human
gggcauuccaugcagccuugcgga

SEQ ID NO: 12659 - RNA, 24 nt, Human
gggccaccaagcggggggacaaaa

SEQ ID NO: 12660 - RNA, 22 nt, Human
gggccaugacagggagauaggc

SEQ ID NO: 12661 - RNA, 24 nt, Human
gggcccagccaagcaagggugugg

SEQ ID NO: 12662 - RNA, 24 nt, Human
gggccugugaccuugagaaccuca

SEQ ID NO: 12663 - RNA, 24 nt, Human
gggcucaggugagagcagguguuc

SEQ ID NO: 12664 - RNA, 24 nt, Human
gggcucuaugauauuaagaagggg

SEQ ID NO: 12665 - RNA, 24 nt, Human
gggcugggccaguccaggagccgc

SEQ ID NO: 12666 - RNA, 24 nt, Human
ggggaagagauauuuuuaaaacaa

SEQ ID NO: 12667 - RNA, 24 nt, Human
ggggaaggucaggaagguccaagc

SEQ ID NO: 12668 - RNA, 22 nt, Human
ggggaauuaaaugagaagccuu

SEQ ID NO: 12669 - RNA, 24 nt, Human
ggggacagguguacagacauguuc

SEQ ID NO: 12670 - RNA, 24 nt, Human
ggggacagguguacagacauguuu

SEQ ID NO: 12671 - RNA, 22 nt, Human
ggggagagacuguucccaggca

SEQ ID NO: 12672 - RNA, 24 nt, Human
ggggagcagacacaucagcacucg

SEQ ID NO: 12673 - RNA, 24 nt, Human
ggggagccggagcggcagggauuu

SEQ ID NO: 12674 - RNA, 24 nt, Human
ggggagccgucuuggccugcgcgg

SEQ ID NO: 12675 - RNA, 22 nt, Human
ggggagcuguaccaugagcagu

SEQ ID NO: 12676 - RNA, 22 nt, Human
ggggcggccacagacucgacau

SEQ ID NO: 12677 - RNA, 22 nt, Human
ggggcuguuucuuaacacggag

SEQ ID NO: 12678 - RNA, 22 nt, Human
gggggaauccaaggcagaccau

SEQ ID NO: 12679 - RNA, 22 nt, Human
gggggaguucuuucagauucag

SEQ ID NO: 12680 - RNA, 22 nt, Human
gggggaucauuauaaaaauacu

SEQ ID NO: 12681 - RNA, 22 nt, Human
gggggaugauagcagccagugg

SEQ ID NO: 12682 - RNA, 24 nt, Human
gggggcccaggccgagcuccuugu

SEQ ID NO: 12683 - RNA, 24 nt, Human
ggggucacaaauugaaauggcucc

SEQ ID NO: 12684 - RNA, 24 nt, Human
ggguaugggauugaugagggcaug

SEQ ID NO: 12685 - RNA, 22 nt, Human
gggucaccacacuuugcuaacu

SEQ ID NO: 12686 - RNA, 22 nt, Human
gggucucaaaugagggacauuu

SEQ ID NO: 12687 - RNA, 22 nt, Human
gggucucauuauguuguccagg

SEQ ID NO: 12688 - RNA, 24 nt, Human
gggugcccuugauuaucuucacca

SEQ ID NO: 12689 - RNA, 24 nt, Human
gguaagaaaugaaugaguauggcu

SEQ ID NO: 12690 - RNA, 24 nt, Human
ggucaacaggagucgggccucucu

SEQ ID NO: 12691 - RNA, 22 nt, Human
ggucacuugccaacggcgccgg

SEQ ID NO: 12692 - RNA, 22 nt, Human
ggucagugguaugggugugagg

SEQ ID NO: 12693 - RNA, 22 nt, Human
ggucauggacacagucccugaa

SEQ ID NO: 12694 - RNA, 22 nt, Human
gguccagacuggaguauagugc

SEQ ID NO: 12695 - RNA, 22 nt, Human
gguccagauggggagaagaugu

SEQ ID NO: 12696 - RNA, 24 nt, Human
gguccaggaagccagccagcuugg

SEQ ID NO: 12697 - RNA, 24 nt, Human
gguccugggccacccuggccgggg

SEQ ID NO: 12698 - RNA, 22 nt, Human
ggucugugaugcccuuaguugu

SEQ ID NO: 12699 - RNA, 22 nt, Human
ggugaacugaagccuguuccug

SEQ ID NO: 12700 - RNA, 22 nt, Human
ggugaugcauuuaaaagggcag

SEQ ID NO: 12701 - RNA, 22 nt, Human
ggugauggcuguugugugagcc

SEQ ID NO: 12702 - RNA, 24 nt, Human
ggugcaauugacgcagcuugguau

SEQ ID NO: 12703 - RNA, 23 nt, Human
ggugcagaccugcuuggaggccc

SEQ ID NO: 12704 - RNA, 24 nt, Human
ggugcagauccuuagcauaggcag

SEQ ID NO: 12705 - RNA, 24 nt, Human
ggugcagcccucccucccaugccc

SEQ ID NO: 12706 - RNA, 24 nt, Human
gguggcaacuuuaggggguuccag

SEQ ID NO: 12707 - RNA, 22 nt, Human
gguggguuuccuuaauggcauc

SEQ ID NO: 12708 - RNA, 24 nt, Human
ggugguaucauguacucaagaccu

SEQ ID NO: 12709 - RNA, 20 nt, Human
ggugguggauaugcccaggu

SEQ ID NO: 12710 - RNA, 22 nt, Human
gguuaaaaaggaggaagaggaa

SEQ ID NO: 12711 - RNA, 22 nt, Human
gguuaaggagcuaguagauuuc

SEQ ID NO: 12712 - RNA, 22 nt, Human
gguuaggaugcaggucaucuuu

SEQ ID NO: 12713 - RNA, 24 nt, Human
gguuauaaauucuguuaguugcua

SEQ ID NO: 12714 - RNA, 22 nt, Human
gguugcuguguugugcuuccuu

SEQ ID NO: 12715 - RNA, 24 nt, Human
gguugggggcuaaauuaauuggag

SEQ ID NO: 12716 - RNA, 24 nt, Human
guaaaauucuucugauacccacuc

SEQ ID NO: 12717 - RNA, 24 nt, Human
guacagcaagcacugacagugagu

SEQ ID NO: 12718 - RNA, 22 nt, Human
guacaggaauguccuggccauc

SEQ ID NO: 12719 - RNA, 24 nt, Human
guacaggguucucugaauugcugc

SEQ ID NO: 12720 - RNA, 24 nt, Human
guaccagaagggcuccaccaggca

SEQ ID NO: 12721 - RNA, 24 nt, Human
guacguaggauaauucacgucgcu

SEQ ID NO: 12722 - RNA, 22 nt, Human
guacuacuuucuuuuucuuuaa

SEQ ID NO: 12723 - RNA, 22 nt, Human
guacuauguugguggagaggug

SEQ ID NO: 12724 - RNA, 22 nt, Human
guacuuccauccacauauaugu

SEQ ID NO: 12725 - RNA, 24 nt, Human
guagaguuuucuucaggcuuaaag

SEQ ID NO: 12726 - RNA, 24 nt, Human
guagaguuuucuuuaggcuuaaag

SEQ ID NO: 12727 - RNA, 22 nt, Human
guagcaaagauucaggaugugc

SEQ ID NO: 12728 - RNA, 24 nt, Human
guagugcaggaaaguggugauaag

SEQ ID NO: 12729 - RNA, 24 nt, Human
guaguugcagaacucuggguagcu

SEQ ID NO: 12730 - RNA, 24 nt, Human
guaguuguguugggauaagcagga

SEQ ID NO: 12731 - RNA, 24 nt, Human
guaguuguuggggcccaggaccca

SEQ ID NO: 12732 - RNA, 24 nt, Human
gucaagaagugaagacagaugguc

SEQ ID NO: 12733 - RNA, 24 nt, Human
gucaagucaccaaugauguacaua

SEQ ID NO: 12734 - RNA, 22 nt, Human
gucaaucacaaaggcuugucca

SEQ ID NO: 12735 - RNA, 20 nt, Human
gucaaucguuugacagguaa

SEQ ID NO: 12736 - RNA, 24 nt, Human
gucaauggggcaacacgguuagcg

SEQ ID NO: 12737 - RNA, 24 nt, Human
gucaccuugggcaaggacuucgca

SEQ ID NO: 12738 - RNA, 24 nt, Human
gucacuuaaacaagccaucuaucc

SEQ ID NO: 12739 - RNA, 24 nt, Human
gucacuugugguauugauguggac

SEQ ID NO: 12740 - RNA, 22 nt, Human
gucagcaaggagggguggacaa

SEQ ID NO: 12741 - RNA, 22 nt, Human
gucaucuguggagggacagccc

SEQ ID NO: 12742 - RNA, 24 nt, Human
gucaugaauauggacaaaaccuuu

SEQ ID NO: 12743 - RNA, 23 nt, Human
gucauuuuccuuugugagaggaa

SEQ ID NO: 12744 - RNA, 22 nt, Human
guccaauagaugccaguaacaa

SEQ ID NO: 12745 - RNA, 18 nt, Human
guccagguguagaaugcc

SEQ ID NO: 12746 - RNA, 24 nt, Human
guccaguucacagacauuguggaa

SEQ ID NO: 12747 - RNA, 24 nt, Human
gucccggucaagugguucuucugc

SEQ ID NO: 12748 - RNA, 24 nt, Human
gucccuugcaagcguauuuccuua

SEQ ID NO: 12749 - RNA, 24 nt, Human
guccgguggucucucgcggcgcgc

SEQ ID NO: 12750 - RNA, 22 nt, Human
guccucucuccauuugcagauc

SEQ ID NO: 12751 - RNA, 24 nt, Human
guccucuuaaggcaaaugccgaga

SEQ ID NO: 12752 - RNA, 24 nt, Human
guccucuuaucuccugccuccuuc

SEQ ID NO: 12753 - RNA, 24 nt, Human
guccuggucaugugccacacgagg

SEQ ID NO: 12754 - RNA, 24 nt, Human
guccuguacaagugcgugguuucc

SEQ ID NO: 12755 - RNA, 22 nt, Human
guccuucugucuuuuaaauugu

SEQ ID NO: 12756 - RNA, 22 nt, Human
guccuugucauccucugccugu

SEQ ID NO: 12757 - RNA, 24 nt, Human
gucgacccacgcguccgcauuacc

SEQ ID NO: 12758 - RNA, 24 nt, Human
gucgauuggaaacugugaaggugu

SEQ ID NO: 12759 - RNA, 24 nt, Human
gucgccuccccuccuguagcccac

SEQ ID NO: 12760 - RNA, 22 nt, Human
gucgccuguugaguagacaugg

SEQ ID NO: 12761 - RNA, 22 nt, Human
gucggcuugguugucggugaua

SEQ ID NO: 12762 - RNA, 22 nt, Human
gucgugguuuugugcaaagcag

SEQ ID NO: 12763 - RNA, 22 nt, Human
gucuaggggagggaugauggca

SEQ ID NO: 12764 - RNA, 24 nt, Human
gucuauaucaccuugaagaaguau

SEQ ID NO: 12765 - RNA, 24 nt, Human
gucucuuuuuuggggaugagagca

SEQ ID NO: 12766 - RNA, 24 nt, Human
gucuucuuccauccagucaagcca

SEQ ID NO: 12767 - RNA, 24 nt, Human
gugaaacuccuuccucagcugguu

SEQ ID NO: 12768 - RNA, 24 nt, Human
gugaacaggggacaaucucagccu

SEQ ID NO: 12769 - RNA, 24 nt, Human
gugaacuugaagugcuucccauuc

SEQ ID NO: 12770 - RNA, 24 nt, Human
gugaagcaggauguauguggccuu

SEQ ID NO: 12771 - RNA, 22 nt, Human
gugaaggaggugaaguauuuaa

SEQ ID NO: 12772 - RNA, 22 nt, Human
gugaagguagguuucagguuug

SEQ ID NO: 12773 - RNA, 24 nt, Human
gugaaguucauaaaguuuugaggu

SEQ ID NO: 12774 - RNA, 24 nt, Human
gugacacucuggaaaucuuggaug

SEQ ID NO: 12775 - RNA, 24 nt, Human
gugaccgugaucuuguucgucuuu

SEQ ID NO: 12776 - RNA, 22 nt, Human
gugaggagacaccgggcuguuu

SEQ ID NO: 12777 - RNA, 24 nt, Human
gugaggcgccggggcccacugagu

SEQ ID NO: 12778 - RNA, 22 nt, Human
gugagugugaaugggugugcgc

SEQ ID NO: 12779 - RNA, 22 nt, Human
gugaguucccaguucuuggcug

SEQ ID NO: 12780 - RNA, 24 nt, Human
gugauccaccugccuuggccuuuc

SEQ ID NO: 12781 - RNA, 22 nt, Human
gugauuaaauuaaggcucuuga

SEQ ID NO: 12782 - RNA, 24 nt, Human
gugcacuugauaauaacccugcag

SEQ ID NO: 12783 - RNA, 24 nt, Human
gugcagcaccaccagcguguccag

SEQ ID NO: 12784 - RNA, 24 nt, Human
gugcagcagaccuguaaaugucuu

SEQ ID NO: 12785 - RNA, 22 nt, Human
gugcagggaugcagguaugaag

SEQ ID NO: 12786 - RNA, 24 nt, Human
gugcagugaguggccucaaaguug

SEQ ID NO: 12787 - RNA, 24 nt, Human
gugcaguguaacgaugcacuuugg

SEQ ID NO: 12788 - RNA, 22 nt, Human
gugcauaugugugugcauaugu

SEQ ID NO: 12789 - RNA, 24 nt, Human
gugcauggccggaugucucuggga

SEQ ID NO: 12790 - RNA, 22 nt, Human
gugcauguaugugugcaugugu

SEQ ID NO: 12791 - RNA, 24 nt, Human
gugcaugucuaagcccugugccuu

SEQ ID NO: 12792 - RNA, 18 nt, Human
gugcauguggauugauac

SEQ ID NO: 12793 - RNA, 24 nt, Human
gugcauguggauugauacuagcag

SEQ ID NO: 12794 - RNA, 24 nt, Human
gugccuguguccucgauggucugg

SEQ ID NO: 12795 - RNA, 24 nt, Human
gugccuuuagugauggccugggcu

SEQ ID NO: 12796 - RNA, 22 nt, Human
gugcucaucuucuguaacuguu

SEQ ID NO: 12797 - RNA, 22 nt, Human
gugcucuuuggaauuuuccugu

SEQ ID NO: 12798 - RNA, 24 nt, Human
gugcuggaggcggcuauggcuuug

SEQ ID NO: 12799 - RNA, 24 nt, Human
gugcuguaggguguggucugguac

SEQ ID NO: 12800 - RNA, 24 nt, Human
gugcuuugauuaaugguuaaaacu

SEQ ID NO: 12801 - RNA, 24 nt, Human
guggaagugggcagcaagaucuac

SEQ ID NO: 12802 - RNA, 24 nt, Human
guggagcgauguuuccaucucuaa

SEQ ID NO: 12803 - RNA, 24 nt, Human
guggagcgcugguggaagguaccg

SEQ ID NO: 12804 - RNA, 24 nt, Human
guggagcuagaagcagggugucca

SEQ ID NO: 12805 - RNA, 24 nt, Human
guggagcugguagaugagcccacg

SEQ ID NO: 12806 - RNA, 24 nt, Human
guggagcugucuuaaacgaagaga

SEQ ID NO: 12807 - RNA, 22 nt, Human
guggagggcagcuuugucuaca

SEQ ID NO: 12808 - RNA, 24 nt, Human
guggaucccguggagccacauggc

SEQ ID NO: 12809 - RNA, 24 nt, Human
guggauuacaagaucaggaguuug

SEQ ID NO: 12810 - RNA, 22 nt, Human
guggcauuggugguggcauugg

SEQ ID NO: 12811 - RNA, 24 nt, Human
guggcccaacuggaucaggcaguu

SEQ ID NO: 12812 - RNA, 24 nt, Human
guggccuuauucugcggcuguggg

SEQ ID NO: 12813 - RNA, 22 nt, Human
guggcucagacuuauaauccca

SEQ ID NO: 12814 - RNA, 24 nt, Human
guggcuccaaggaaucuucccacg

SEQ ID NO: 12815 - RNA, 22 nt, Human
guggcugcagagcuccacagag

SEQ ID NO: 12816 - RNA, 22 nt, Human
gugggcaagggaaaauagaugg

SEQ ID NO: 12817 - RNA, 22 nt, Human
gugggcaaguugcucaagggua

SEQ ID NO: 12818 - RNA, 24 nt, Human
guggggcagaccgcaaugccuaug

SEQ ID NO: 12819 - RNA, 22 nt, Human
gugggguguacucccccuugca

SEQ ID NO: 12820 - RNA, 22 nt, Human
guggguggaacgugccucugcu

SEQ ID NO: 12821 - RNA, 22 nt, Human
gugggugugguguucagguggc

SEQ ID NO: 12822 - RNA, 22 nt, Human
guggucucguggaugccgcaag

SEQ ID NO: 12823 - RNA, 24 nt, Human
guggugcgggccuguggucucagc

SEQ ID NO: 12824 - RNA, 23 nt, Human
gugguuccggccuucugauaauc

SEQ ID NO: 12825 - RNA, 22 nt, Human
gugugggcagggccgugcuccc

SEQ ID NO: 12826 - RNA, 22 nt, Human
gugugggguuuuuuggagggga

SEQ ID NO: 12827 - RNA, 22 nt, Human
guguuccaggaagucgucuuga

SEQ ID NO: 12828 - RNA, 22 nt, Human
guguugaugcauuuucacuucu

SEQ ID NO: 12829 - RNA, 22 nt, Human
guguugcuuccauuacgccagu

SEQ ID NO: 12830 - RNA, 24 nt, Human
guuaacuucuugagcuauuucgug

SEQ ID NO: 12831 - RNA, 23 nt, Human
guuacagaggcucaccugguggu

SEQ ID NO: 12832 - RNA, 22 nt, Human
guucaaauccaaccccuugucu

SEQ ID NO: 12833 - RNA, 24 nt, Human
guucaagcgauucuccugccucac

SEQ ID NO: 12834 - RNA, 23 nt, Human
guucaagggcauggaaagucacc

SEQ ID NO: 12835 - RNA, 24 nt, Human
guucacgcccuucuccugccucag

SEQ ID NO: 12836 - RNA, 24 nt, Human
guucagagaaggcugcagucagcu

SEQ ID NO: 12837 - RNA, 22 nt, Human
guucaguaauaugccagggguu

SEQ ID NO: 12838 - RNA, 24 nt, Human
guuccauucggcccuccuggguuu

SEQ ID NO: 12839 - RNA, 24 nt, Human
guuccugucaccauugcucucgau

SEQ ID NO: 12840 - RNA, 22 nt, Human
guuccuguccaguuucccccuc

SEQ ID NO: 12841 - RNA, 22 nt, Human
guucuccuggcucccacccugc

SEQ ID NO: 12842 - RNA, 24 nt, Human
guugaucacucacaucgugcucgc

SEQ ID NO: 12843 - RNA, 22 nt, Human
guugccuaggcuggagugcagu

SEQ ID NO: 12844 - RNA, 22 nt, Human
guuggccuuuuggagugggugu

SEQ ID NO: 12845 - RNA, 22 nt, Human
guuguguggaagaugcuuugcc

SEQ ID NO: 12846 - RNA, 22 nt, Human
guuucuucuguuugauacuggc

SEQ ID NO: 12847 - RNA, 22 nt, Human
guuuuaggcaacauaggaagac

SEQ ID NO: 12848 - RNA, 22 nt, Human
guuuugugugugugcccacacg

SEQ ID NO: 12849 - RNA, 24 nt, Human
uaaaacaagauuuggaugacaugg

SEQ ID NO: 12850 - RNA, 24 nt, Human
uaaaacacucuacacaauuucaca

SEQ ID NO: 12851 - RNA, 24 nt, Human
uaaaaccauuaccuuaaaaugggu

SEQ ID NO: 12852 - RNA, 24 nt, Human
uaaaagaaggcaggugucucuuua

SEQ ID NO: 12853 - RNA, 24 nt, Human
uaaaagcagcaauaucaugucuug

SEQ ID NO: 12854 - RNA, 24 nt, Human
uaaaagccaaggagcagcccuagu

SEQ ID NO: 12855 - RNA, 24 nt, Human
uaaaaggacuaacugcagucagca

SEQ ID NO: 12856 - RNA, 24 nt, Human
uaaaaguuugucuuuauuagccau

SEQ ID NO: 12857 - RNA, 24 nt, Human
uaaaauaccuguaucacagaugac

SEQ ID NO: 12858 - RNA, 24 nt, Human
uaaaaucauuucagauaucaccau

SEQ ID NO: 12859 - RNA, 24 nt, Human
uaaaauccacaucaauagcacacg

SEQ ID NO: 12860 - RNA, 21 nt, Human
uaaaaugcauuauaucuggag

SEQ ID NO: 12861 - RNA, 24 nt, Human
uaaacagagugacaacagggagug

SEQ ID NO: 12862 - RNA, 24 nt, Human
uaaacaguccacaacuuugcaucu

SEQ ID NO: 12863 - RNA, 22 nt, Human
uaaacuauuagcuguaauuuua

SEQ ID NO: 12864 - RNA, 24 nt, Human
uaaacuguauccuuuaguuuuauc

SEQ ID NO: 12865 - RNA, 22 nt, Human
uaaagaauggguggcugggcug

SEQ ID NO: 12866 - RNA, 24 nt, Human
uaaagcaucugcaacagccaggaa

SEQ ID NO: 12867 - RNA, 24 nt, Human
uaaagcucaaauugcucuuaaacu

SEQ ID NO: 12868 - RNA, 24 nt, Human
uaaagcucuaagacuccugagcca

SEQ ID NO: 12869 - RNA, 24 nt, Human
uaaaggaauagguugggcuaguua

SEQ ID NO: 12870 - RNA, 24 nt, Human
uaaaguacaaaaacgccaccuuuu

SEQ ID NO: 12871 - RNA, 24 nt, Human
uaaaguagauuggauuugcugaaa

SEQ ID NO: 12872 - RNA, 24 nt, Human
uaaaguauaagguaagguaaauuu

SEQ ID NO: 12873 - RNA, 24 nt, Human
uaaagugaaaaaacacugaaaaga

SEQ ID NO: 12874 - RNA, 22 nt, Human
uaaauccugaaaagugcagacu

SEQ ID NO: 12875 - RNA, 24 nt, Human
uaaaugauacagaaauacguuuau

SEQ ID NO: 12876 - RNA, 24 nt, Human
uaaaugcacuugauggguguugaa

SEQ ID NO: 12877 - RNA, 24 nt, Human
uaaauguaaggaguauauauuuug

SEQ ID NO: 12878 - RNA, 24 nt, Human
uaaauguaguuucaucugucguca

SEQ ID NO: 12879 - RNA, 24 nt, Human
uaaauguccuaucugugagaaaag

SEQ ID NO: 12880 - RNA, 24 nt, Human
uaaauguugagccuuuuuggccug

SEQ ID NO: 12881 - RNA, 24 nt, Human
uaacaaaggucccuuggacauugc

SEQ ID NO: 12882 - RNA, 20 nt, Human
uaacacaagaaaucauguca

SEQ ID NO: 12883 - RNA, 24 nt, Human
uaacagcagaaaauuauccgguag

SEQ ID NO: 12884 - RNA, 24 nt, Human
uaacaggccaaaauucuauuuccu

SEQ ID NO: 12885 - RNA, 24 nt, Human
uaacaguugccucgagaugcucug

SEQ ID NO: 12886 - RNA, 22 nt, Human
uaacaguuuucauugacggcua

SEQ ID NO: 12887 - RNA, 22 nt, Human
uaacauggugaaacccugucuc

SEQ ID NO: 12888 - RNA, 24 nt, Human
uaaccagaggcaagaugcccgagg

SEQ ID NO: 12889 - RNA, 24 nt, Human
uaaccauauugauuauguuuuauu

SEQ ID NO: 12890 - RNA, 24 nt, Human
uaaccuguuuuaccgcaucuucuc

SEQ ID NO: 12891 - RNA, 24 nt, Human
uaaccuuuccuuaaaaggcagaac

SEQ ID NO: 12892 - RNA, 24 nt, Human
uaacgcuguucacguagcucuuuu

SEQ ID NO: 12893 - RNA, 23 nt, Human
uaacggguccugcgguggugggu

SEQ ID NO: 12894 - RNA, 21 nt, Human
uaacuaaaggcagaucuucua

SEQ ID NO: 12895 - RNA, 24 nt, Human
uaacuagacauuauuuaugcugcc

SEQ ID NO: 12896 - RNA, 24 nt, Human
uaacugacaacuguuuucaacucc

SEQ ID NO: 12897 - RNA, 24 nt, Human
uaacugcugaacuaguuccucagg

SEQ ID NO: 12898 - RNA, 22 nt, Human
uaacuuaacaggaggacggauc

SEQ ID NO: 12899 - RNA, 22 nt, Human
uaacuuggaguugauucccauu

SEQ ID NO: 12900 - RNA, 24 nt, Human
uaagaaaaaacuccuuucaucucu

SEQ ID NO: 12901 - RNA, 24 nt, Human
uaagaacaauuucaaauauuucuu

SEQ ID NO: 12902 - RNA, 22 nt, Human
uaagaaguuucacuguuguugu

SEQ ID NO: 12903 - RNA, 22 nt, Human
uaagacagcagacgguggcaug

SEQ ID NO: 12904 - RNA, 24 nt, Human
uaagacgugcucaaucuguguucc

SEQ ID NO: 12905 - RNA, 24 nt, Human
uaagacuaggggcuugguauauau

SEQ ID NO: 12906 - RNA, 24 nt, Human
uaagagaaagguggcagugggauc

SEQ ID NO: 12907 - RNA, 24 nt, Human
uaagagcaacaguggaucaagcug

SEQ ID NO: 12908 - RNA, 24 nt, Human
uaagagguuacagaacuauuagcu

SEQ ID NO: 12909 - RNA, 24 nt, Human
uaagauagauauauaugaguagaa

SEQ ID NO: 12910 - RNA, 24 nt, Human
uaagauaggcuaggcuaagcuggg

SEQ ID NO: 12911 - RNA, 22 nt, Human
uaagaucuccugggcaggagau

SEQ ID NO: 12912 - RNA, 22 nt, Human
uaagaugacugaaugaaacucu

SEQ ID NO: 12913 - RNA, 24 nt, Human
uaagaugcuagaaauucaauggga

SEQ ID NO: 12914 - RNA, 24 nt, Human
uaagauggaaaagaacaugagugg

SEQ ID NO: 12915 - RNA, 24 nt, Human
uaagcagagcucgcagcguggcuu

SEQ ID NO: 12916 - RNA, 23 nt, Human
uaagccucuaaagugaucagugc

SEQ ID NO: 12917 - RNA, 24 nt, Human
uaagcuaauuacuguugcagaaug

SEQ ID NO: 12918 - RNA, 21 nt, Human
uaagcuagucguucuuggcuc

SEQ ID NO: 12919 - RNA, 24 nt, Human
uaagcuccucugagcagggucgac

SEQ ID NO: 12920 - RNA, 22 nt, Human
uaaggaagggcuggauugaaag

SEQ ID NO: 12921 - RNA, 22 nt, Human
uaaggacaucaauaccuucucu

SEQ ID NO: 12922 - RNA, 21 nt, Human
uaaggagggggcauggguccc

SEQ ID NO: 12923 - RNA, 24 nt, Human
uaaggcaauuucaaaaaugcucca

SEQ ID NO: 12924 - RNA, 24 nt, Human
uaagguaaaugacacaaaguugaa

SEQ ID NO: 12925 - RNA, 24 nt, Human
uaagguacaccucagcaguuccag

SEQ ID NO: 12926 - RNA, 24 nt, Human
uaaggucaucgauacggagcagga

SEQ ID NO: 12927 - RNA, 24 nt, Human
uaagguccagguugauucacucca

SEQ ID NO: 12928 - RNA, 24 nt, Human
uaaggucuugugcaagaggaggcc

SEQ ID NO: 12929 - RNA, 24 nt, Human
uaaguaaaaacgcugggucaaaac

SEQ ID NO: 12930 - RNA, 22 nt, Human
uaaguaaagagagaagccagaa

SEQ ID NO: 12931 - RNA, 24 nt, Human
uaaguacauguaaaaaguaggaag

SEQ ID NO: 12932 - RNA, 24 nt, Human
uaaguauaucuauguugcugacau

SEQ ID NO: 12933 - RNA, 24 nt, Human
uaaguauuagauuuucuggugugc

SEQ ID NO: 12934 - RNA, 24 nt, Human
uaaguccccaaucugguugccggc

SEQ ID NO: 12935 - RNA, 22 nt, Human
uaaguccugguguuguguggau

SEQ ID NO: 12936 - RNA, 24 nt, Human
uaagucugugaaucuacccugguc

SEQ ID NO: 12937 - RNA, 22 nt, Human
uaagucuuuuuauucuaccuag

SEQ ID NO: 12938 - RNA, 24 nt, Human
uaagugaaguuacauuggcccuaa

SEQ ID NO: 12939 - RNA, 24 nt, Human
uaagugacuugcucaaugccacac

SEQ ID NO: 12940 - RNA, 21 nt, Human
uaagugaguaggcauuguucu

SEQ ID NO: 12941 - RNA, 24 nt, Human
uaagugccugcacucuguauucua

SEQ ID NO: 12942 - RNA, 24 nt, Human
uaagugcuuuuaaugucaaguuuu

SEQ ID NO: 12943 - RNA, 21 nt, Human
uaaguggacucaacagugugc

SEQ ID NO: 12944 - RNA, 24 nt, Human
uaaguggaguuagaaguggguuau

SEQ ID NO: 12945 - RNA, 24 nt, Human
uaagugggcggggacccaaggcug

SEQ ID NO: 12946 - RNA, 24 nt, Human
uaaguggugaaugaaugugaaggc

SEQ ID NO: 12947 - RNA, 24 nt, Human
uaaguucuuuucaaaucuuggaag

SEQ ID NO: 12948 - RNA, 24 nt, Human
uaaguugaaaacucaguaucuaug

SEQ ID NO: 12949 - RNA, 22 nt, Human
uaauacggaauauaaaguagag

SEQ ID NO: 12950 - RNA, 24 nt, Human
uaauauuuacugaccauuuacuau

SEQ ID NO: 12951 - RNA, 24 nt, Human
uaaucuaguaaaggcauagauuau

SEQ ID NO: 12952 - RNA, 21 nt, Human
uaaucuggaagaucuggcauu

SEQ ID NO: 12953 - RNA, 24 nt, Human
uaaucugugaacauuauugacagg

SEQ ID NO: 12954 - RNA, 22 nt, Human
uaaucuucugcuggaacuguca

SEQ ID NO: 12955 - RNA, 24 nt, Human
uaauggggagagggauggcaagag

SEQ ID NO: 12956 - RNA, 24 nt, Human
uaaugggucugaaaauucugugac

SEQ ID NO: 12957 - RNA, 24 nt, Human
uaaugugcugcuucccuuuucccc

SEQ ID NO: 12958 - RNA, 24 nt, Human
uaauguucugucacgugaaauauu

SEQ ID NO: 12959 - RNA, 21 nt, Human
uaauucuugagacaaaaggug

SEQ ID NO: 12960 - RNA, 24 nt, Human
uaauuuuuuacccuauguuuacau

SEQ ID NO: 12961 - RNA, 24 nt, Human
uacaaaguuauauguguagagcau

SEQ ID NO: 12962 - RNA, 24 nt, Human
uacaaaucugggcaccagugguuc

SEQ ID NO: 12963 - RNA, 22 nt, Human
uacaaauuccugggucuccugg

SEQ ID NO: 12964 - RNA, 24 nt, Human
uacaaauugccugacggcagguaa

SEQ ID NO: 12965 - RNA, 20 nt, Human
uacaacuugcuguuacuuga

SEQ ID NO: 12966 - RNA, 24 nt, Human
uacaagaagauaauaaggguucuu

SEQ ID NO: 12967 - RNA, 24 nt, Human
uacaagcaauaguuauggggaucu

SEQ ID NO: 12968 - RNA, 24 nt, Human
uacaagcauuuugaaauauucugu

SEQ ID NO: 12969 - RNA, 24 nt, Human
uacaagccagcuacuuugcaggaa

SEQ ID NO: 12970 - RNA, 24 nt, Human
uacaagguuuguugaauacuaguu

SEQ ID NO: 12971 - RNA, 21 nt, Human
uacaagugcuccaguacggcc

SEQ ID NO: 12972 - RNA, 22 nt, Human
uacaauccugagaaccuggcca

SEQ ID NO: 12973 - RNA, 24 nt, Human
uacaaugagugaaccugaggccca

SEQ ID NO: 12974 - RNA, 24 nt, Human
uacacacugugagacucugcuaca

SEQ ID NO: 12975 - RNA, 24 nt, Human
uacacaucaauuuggaguuguuuc

SEQ ID NO: 12976 - RNA, 22 nt, Human
uacaccacagaaaucuuuggcc

SEQ ID NO: 12977 - RNA, 24 nt, Human
uacaccacugugagccgacugaaa

SEQ ID NO: 12978 - RNA, 24 nt, Human
uacacggucguggacgagauguuc

SEQ ID NO: 12979 - RNA, 24 nt, Human
uacacuggcagagcucacagauga

SEQ ID NO: 12980 - RNA, 24 nt, Human
uacacuguggacuggagaaaguca

SEQ ID NO: 12981 - RNA, 24 nt, Human
uacacuuuuggauagaauuuauac

SEQ ID NO: 12982 - RNA, 24 nt, Human
uacagccuuuucuuuaucuuauag

SEQ ID NO: 12983 - RNA, 24 nt, Human
uacagcuacagauuguccacacag

SEQ ID NO: 12984 - RNA, 24 nt, Human
uacaggacacuguuggcuuuagag

SEQ ID NO: 12985 - RNA, 24 nt, Human
uacaggcaggaucuugccaccuug

SEQ ID NO: 12986 - RNA, 22 nt, Human
uacaggcaggcacagaggcagu

SEQ ID NO: 12987 - RNA, 24 nt, Human
uacaggcccgggauguaugggauc

SEQ ID NO: 12988 - RNA, 24 nt, Human
uacaggggcaagcuaccaugucug

SEQ ID NO: 12989 - RNA, 24 nt, Human
uacagguaugagccaccacaccca

SEQ ID NO: 12990 - RNA, 24 nt, Human
uacaguacacagcgagagucuuac

SEQ ID NO: 12991 - RNA, 24 nt, Human
uacagucuaccccuacaugcaugc

SEQ ID NO: 12992 - RNA, 24 nt, Human
uacagugcuuguaaaacgguuuga

SEQ ID NO: 12993 - RNA, 24 nt, Human
uacaguucaccaccacggccgagc

SEQ ID NO: 12994 - RNA, 24 nt, Human
uacauacaaugagucuccacgccu

SEQ ID NO: 12995 - RNA, 24 nt, Human
uacauaguuuuaaaacaugcaaaa

SEQ ID NO: 12996 - RNA, 24 nt, Human
uacaucacugcuagaauauuuagc

SEQ ID NO: 12997 - RNA, 24 nt, Human
uacaucgcccuugaacgaggaccu

SEQ ID NO: 12998 - RNA, 24 nt, Human
uacaugcaugcauguguguaugug

SEQ ID NO: 12999 - RNA, 24 nt, Human
uacauuaagaaaauugguacaacc

SEQ ID NO: 13000 - RNA, 22 nt, Human
uacauucuguaccauucuguac

SEQ ID NO: 13001 - RNA, 24 nt, Human
uacauuguguuaaaacagaagaua

SEQ ID NO: 13002 - RNA, 24 nt, Human
uaccaagcccagcuaauuuuugug

SEQ ID NO: 13003 - RNA, 23 nt, Human
uaccaagggccugguugggccac

SEQ ID NO: 13004 - RNA, 22 nt, Human
uaccaaguacugcgcagaaaug

SEQ ID NO: 13005 - RNA, 21 nt, Human
uaccacacaaaggcauuggcu

SEQ ID NO: 13006 - RNA, 24 nt, Human
uaccacaccaaugccuucaugguc

SEQ ID NO: 13007 - RNA, 22 nt, Human
uaccagaaagccauguucauau

SEQ ID NO: 13008 - RNA, 24 nt, Human
uaccaggaagauccaugaucuggg

SEQ ID NO: 13009 - RNA, 24 nt, Human
uaccaggaagcauuugaaauuagu

SEQ ID NO: 13010 - RNA, 24 nt, Human
uaccaggaugguuaccaggaugac

SEQ ID NO: 13011 - RNA, 24 nt, Human
uaccaggugaauauuggcuuggaa

SEQ ID NO: 13012 - RNA, 24 nt, Human
uaccagguuuaaauguagucuucu

SEQ ID NO: 13013 - RNA, 21 nt, Human
uaccagugccacucugacagg

SEQ ID NO: 13014 - RNA, 24 nt, Human
uaccauaccaucaaauggucauaa

SEQ ID NO: 13015 - RNA, 24 nt, Human
uaccauuggcuggucuuaccgugg

SEQ ID NO: 13016 - RNA, 24 nt, Human
uaccauuugccucucgggcucaag

SEQ ID NO: 13017 - RNA, 24 nt, Human
uacccaaagcccgaaucggaaaau

SEQ ID NO: 13018 - RNA, 24 nt, Human
uacccacuuauaaauagcacugau

SEQ ID NO: 13019 - RNA, 24 nt, Human
uacccagugguacaguucauauag

SEQ ID NO: 13020 - RNA, 24 nt, Human
uacccaguuuuuacucaguuugaa

SEQ ID NO: 13021 - RNA, 22 nt, Human
uacccauucuugauuuagauga

SEQ ID NO: 13022 - RNA, 24 nt, Human
uacccauugcucucccacuccacg

SEQ ID NO: 13023 - RNA, 24 nt, Human
uaccccagagccuagcaggccgac

SEQ ID NO: 13024 - RNA, 24 nt, Human
uacccggauugaccaggugcccag

SEQ ID NO: 13025 - RNA, 24 nt, Human
uacccguucucccuuuggucaggg

SEQ ID NO: 13026 - RNA, 19 nt, Human
uacccguuguuaggggcgc

SEQ ID NO: 13027 - RNA, 24 nt, Human
uacccuacgcugccagguggaggg

SEQ ID NO: 13028 - RNA, 22 nt, Human
uacccuaucucuauaaaaauaa

SEQ ID NO: 13029 - RNA, 22 nt, Human
uacccucuuucuuuggagcuaa

SEQ ID NO: 13030 - RNA, 24 nt, Human
uacccugagaacucagagcaguug

SEQ ID NO: 13031 - RNA, 24 nt, Human
uacccuggucaccccaggaucagg

SEQ ID NO: 13032 - RNA, 23 nt, Human
uaccggcccaaguacugcgguuc

SEQ ID NO: 13033 - RNA, 24 nt, Human
uaccguagucuagaugucuugagg

SEQ ID NO: 13034 - RNA, 24 nt, Human
uaccgugcggcuugcugacaggag

SEQ ID NO: 13035 - RNA, 24 nt, Human
uaccuaguaagaguagacuucuuu

SEQ ID NO: 13036 - RNA, 21 nt, Human
uaccuaugggaagccugucac

SEQ ID NO: 13037 - RNA, 24 nt, Human
uaccucaggcuaauuacuguuauu

SEQ ID NO: 13038 - RNA, 22 nt, Human
uaccucugucaguaccgcugcg

SEQ ID NO: 13039 - RNA, 24 nt, Human
uaccucuguugaucuugaagaaac

SEQ ID NO: 13040 - RNA, 24 nt, Human
uaccugagucucugagcuuuucag

SEQ ID NO: 13041 - RNA, 24 nt, Human
uaccugccccguuuucccugugag

SEQ ID NO: 13042 - RNA, 20 nt, Human
uaccuggacagggcaggggc

SEQ ID NO: 13043 - RNA, 24 nt, Human
uaccuggagguuggagacaggggc

SEQ ID NO: 13044 - RNA, 24 nt, Human
uaccugucuguaucgguucagagu

SEQ ID NO: 13045 - RNA, 24 nt, Human
uaccugugcuauaaggugggccug

SEQ ID NO: 13046 - RNA, 24 nt, Human
uaccuuacuuuuccucauucuuaa

SEQ ID NO: 13047 - RNA, 24 nt, Human
uaccuuagaagcuaaaugugucac

SEQ ID NO: 13048 - RNA, 24 nt, Human
uaccuugcaccuuaugccaaguau

SEQ ID NO: 13049 - RNA, 24 nt, Human
uacgaguuuggggcagucuccuca

SEQ ID NO: 13050 - RNA, 22 nt, Human
uacgcugugcugugacauggua

SEQ ID NO: 13051 - RNA, 24 nt, Human
uacgcuguuuuaaaaccuaggugg

SEQ ID NO: 13052 - RNA, 24 nt, Human
uacgggcaguucacgggccaggcc

SEQ ID NO: 13053 - RNA, 24 nt, Human
uacgugguccaugcgguguucucu

SEQ ID NO: 13054 - RNA, 24 nt, Human
uacguggugauauggucagugacu

SEQ ID NO: 13055 - RNA, 17 nt, Human
uacgugguugagaaggu

SEQ ID NO: 13056 - RNA, 24 nt, Human
uacguuaagcuaugcaucacuuuc

SEQ ID NO: 13057 - RNA, 24 nt, Human
uacguuucucacaggcugccaagg

SEQ ID NO: 13058 - RNA, 24 nt, Human
uacuacuggauaucugacuggagc

SEQ ID NO: 13059 - RNA, 24 nt, Human
uacuaugugauaaaauacauauag

SEQ ID NO: 13060 - RNA, 24 nt, Human
uacuaugugccacucauuucucuc

SEQ ID NO: 13061 - RNA, 22 nt, Human
uacucauuuaugcauuguuuug

SEQ ID NO: 13062 - RNA, 24 nt, Human
uacucugggcauggagcagggaag

SEQ ID NO: 13063 - RNA, 22 nt, Human
uacugcacuccagccugggcaa

SEQ ID NO: 13064 - RNA, 24 nt, Human
uacugcagugauggagaugcaagc

SEQ ID NO: 13065 - RNA, 21 nt, Human
uacuguguaacaaaucacugc

SEQ ID NO: 13066 - RNA, 24 nt, Human
uacuguguuauccgggauaucagg

SEQ ID NO: 13067 - RNA, 20 nt, Human
uacuguucuggaguggcccg

SEQ ID NO: 13068 - RNA, 22 nt, Human
uacuguuucuucccuaagaugu

SEQ ID NO: 13069 - RNA, 20 nt, Human
uacuucacgcuaucuaagug

SEQ ID NO: 13070 - RNA, 24 nt, Human
uacuucaggaacucuuuuucaaac

SEQ ID NO: 13071 - RNA, 24 nt, Human
uacuucauauuacacauacuuuuc

SEQ ID NO: 13072 - RNA, 19 nt, Human
uacuucgcacuaaguucuc

SEQ ID NO: 13073 - RNA, 24 nt, Human
uacuugaugggacaggcauugccc

SEQ ID NO: 13074 - RNA, 24 nt, Human
uacuuggagaagaccugugacugg

SEQ ID NO: 13075 - RNA, 22 nt, Human
uacuuucccuuucauucuuugu

SEQ ID NO: 13076 - RNA, 24 nt, Human
uacuuugguggggacuuuggaaca

SEQ ID NO: 13077 - RNA, 24 nt, Human
uacuuuugaacaucuaaauuuaaa

SEQ ID NO: 13078 - RNA, 24 nt, Human
uagaaaagcugauucugguuaucu

SEQ ID NO: 13079 - RNA, 22 nt, Human
uagaaaauagcgugaggugugu

SEQ ID NO: 13080 - RNA, 20 nt, Human
uagaacaggaaggacucaug

SEQ ID NO: 13081 - RNA, 23 nt, Human
uagaacauuaccaucauugcaga

SEQ ID NO: 13082 - RNA, 24 nt, Human
uagaagcauuucuuuacugaaccu

SEQ ID NO: 13083 - RNA, 24 nt, Human
uagaagccuuugaccaagcagguc

SEQ ID NO: 13084 - RNA, 24 nt, Human
uagaagccuuugaccaggcagguc

SEQ ID NO: 13085 - RNA, 24 nt, Human
uagaaugcauugugaaacgacugg

SEQ ID NO: 13086 - RNA, 24 nt, Human
uagaauggggagaguaacaauagc

SEQ ID NO: 13087 - RNA, 23 nt, Human
uagaauucggcugugaauccauc

SEQ ID NO: 13088 - RNA, 22 nt, Human
uagacugaggcuuccugcaggg

SEQ ID NO: 13089 - RNA, 22 nt, Human
uagacugugagcuccuugaagg

SEQ ID NO: 13090 - RNA, 24 nt, Human
uagagaccacugguagccuaagaa

SEQ ID NO: 13091 - RNA, 24 nt, Human
uagagaccagaagggccuggagaa

SEQ ID NO: 13092 - RNA, 22 nt, Human
uagagaugggguuucaccaugu

SEQ ID NO: 13093 - RNA, 22 nt, Human
uagagcaccuguugugugugca

SEQ ID NO: 13094 - RNA, 24 nt, Human
uagaggauccaagcuuacguacgc

SEQ ID NO: 13095 - RNA, 24 nt, Human
uagaggcccugcugagcugcuagc

SEQ ID NO: 13096 - RNA, 24 nt, Human
uagagggagggcgccgugcaaaau

SEQ ID NO: 13097 - RNA, 24 nt, Human
uagagucagugacagggaggcagc

SEQ ID NO: 13098 - RNA, 22 nt, Human
uagaguccuuggaucuguauca

SEQ ID NO: 13099 - RNA, 22 nt, Human
uagaguucuccgagugcuuuuc

SEQ ID NO: 13100 - RNA, 22 nt, Human
uagauagaacgaggcucggagg

SEQ ID NO: 13101 - RNA, 24 nt, Human
uagaucauuuauugaagacauacu

SEQ ID NO: 13102 - RNA, 22 nt, Human
uagauggguuacucagaugacu

SEQ ID NO: 13103 - RNA, 24 nt, Human
uagauguucugacagcacugcacc

SEQ ID NO: 13104 - RNA, 24 nt, Human
uagcaagcaggccaaagaugucuc

SEQ ID NO: 13105 - RNA, 22 nt, Human
uagcacaaugcauuugguauac

SEQ ID NO: 13106 - RNA, 22 nt, Human
uagcaccauuugaaaucgguua

SEQ ID NO: 13107 - RNA, 22 nt, Human
uagcaccuucugaaauaacgug

SEQ ID NO: 13108 - RNA, 24 nt, Human
uagcacgccccgccagaacuacca

SEQ ID NO: 13109 - RNA, 24 nt, Human
uagcagcacaucgcugacuuggcu

SEQ ID NO: 13110 - RNA, 24 nt, Human
uagcagcucguuguauuuccuggu

SEQ ID NO: 13111 - RNA, 22 nt, Human
uagcagcuuccucagcaccaug

SEQ ID NO: 13112 - RNA, 24 nt, Human
uagcaggaacacuacacuacgugc

SEQ ID NO: 13113 - RNA, 24 nt, Human
uagcaguacaaaaucuuugacuau

SEQ ID NO: 13114 - RNA, 24 nt, Human
uagcagugcaaagaguuccuuuau

SEQ ID NO: 13115 - RNA, 24 nt, Human
uagcauaugggcaggugcaaucca

SEQ ID NO: 13116 - RNA, 24 nt, Human
uagcaucaugaauuugcuuuucuc

SEQ ID NO: 13117 - RNA, 22 nt, Human
uagcaucuacuuguagguuugu

SEQ ID NO: 13118 - RNA, 24 nt, Human
uagcaucugagauccaggucaguu

SEQ ID NO: 13119 - RNA, 24 nt, Human
uagcaugaaucaaauguauuuauu

SEQ ID NO: 13120 - RNA, 22 nt, Human
uagcauucugguccuggcugca

SEQ ID NO: 13121 - RNA, 24 nt, Human
uagcauugcugucugcaagggagc

SEQ ID NO: 13122 - RNA, 24 nt, Human
uagccacuauccuugucuagcgcc

SEQ ID NO: 13123 - RNA, 24 nt, Human
uagccagcaggauggaguccacgg

SEQ ID NO: 13124 - RNA, 22 nt, Human
uagccggggcaagaggcagggg

SEQ ID NO: 13125 - RNA, 24 nt, Human
uagcgcagucucggccucgccguu

SEQ ID NO: 13126 - RNA, 24 nt, Human
uagcgcgugucacucccgcggcgc

SEQ ID NO: 13127 - RNA, 24 nt, Human
uagcggcagaggaucuugacugca

SEQ ID NO: 13128 - RNA, 24 nt, Human
uagcggcgacggggagggugggcu

SEQ ID NO: 13129 - RNA, 24 nt, Human
uagcgggucucaugccucggccuc

SEQ ID NO: 13130 - RNA, 24 nt, Human
uagcguccagcgauccagacaaau

SEQ ID NO: 13131 - RNA, 24 nt, Human
uagcguggccacugcguugauguu

SEQ ID NO: 13132 - RNA, 22 nt, Human
uagcuaugaucaugccacugca

SEQ ID NO: 13133 - RNA, 24 nt, Human
uagcucaaccuggugcuggacgag

SEQ ID NO: 13134 - RNA, 24 nt, Human
uagcugguucuguaaagguuggug

SEQ ID NO: 13135 - RNA, 24 nt, Human
uagcuguaacacgaagggcuccga

SEQ ID NO: 13136 - RNA, 24 nt, Human
uagcuguaguacauguuuucauug

SEQ ID NO: 13137 - RNA, 24 nt, Human
uagcuugagacucuauccugagau

SEQ ID NO: 13138 - RNA, 24 nt, Human
uaggaaaaugccaaaauggaauua

SEQ ID NO: 13139 - RNA, 22 nt, Human
uaggaaguauuuuuuaaaaaca

SEQ ID NO: 13140 - RNA, 24 nt, Human
uaggacauaaugguagcuuagacu

SEQ ID NO: 13141 - RNA, 24 nt, Human
uaggaccgucgugagacaugguca

SEQ ID NO: 13142 - RNA, 24 nt, Human
uaggacgcagcuguugccaugacg

SEQ ID NO: 13143 - RNA, 24 nt, Human
uaggagaagagagagaucgcuguc

SEQ ID NO: 13144 - RNA, 22 nt, Human
uaggagaugcuguagugaccau

SEQ ID NO: 13145 - RNA, 24 nt, Human
uaggagcccugggaacgggugacc

SEQ ID NO: 13146 - RNA, 24 nt, Human
uaggagccucuucucggcgcugcg

SEQ ID NO: 13147 - RNA, 24 nt, Human
uaggaggauguggcuguuggggua

SEQ ID NO: 13148 - RNA, 24 nt, Human
uaggaggauguggcuguugggguu

SEQ ID NO: 13149 - RNA, 24 nt, Human
uaggaggugauagucaucgcuguc

SEQ ID NO: 13150 - RNA, 22 nt, Human
uaggaguuucauuugguuuggu

SEQ ID NO: 13151 - RNA, 21 nt, Human
uaggaucaacacuguauguug

SEQ ID NO: 13152 - RNA, 22 nt, Human
uaggaucaguuuuaaacaggca

SEQ ID NO: 13153 - RNA, 24 nt, Human
uaggaucaugaugguaaggcaaau

SEQ ID NO: 13154 - RNA, 20 nt, Human
uaggaucuguaccguccagu

SEQ ID NO: 13155 - RNA, 23 nt, Human
uaggcucuuaauucaaucucacu

SEQ ID NO: 13156 - RNA, 22 nt, Human
uaggcuuuagucccuggaauua

SEQ ID NO: 13157 - RNA, 24 nt, Human
uagggagauaagcacuauuuagaa

SEQ ID NO: 13158 - RNA, 22 nt, Human
uagggcuugcauuccuuugaga

SEQ ID NO: 13159 - RNA, 24 nt, Human
uaggguauuucuccuugauaaaug

SEQ ID NO: 13160 - RNA, 24 nt, Human
uagggucucuagaaggcagguagu

SEQ ID NO: 13161 - RNA, 24 nt, Human
uaggucccuguugaaggcuaggca

SEQ ID NO: 13162 - RNA, 24 nt, Human
uagguccgcgcugucuuccgcgcc

SEQ ID NO: 13163 - RNA, 24 nt, Human
uaggugccauuagcucuuagggag

SEQ ID NO: 13164 - RNA, 24 nt, Human
uaggugugugccacgaugcuggcu

SEQ ID NO: 13165 - RNA, 24 nt, Human
uagguuccaguaaugggcaguuug

SEQ ID NO: 13166 - RNA, 24 nt, Human
uagguucuaggggugcaagccucu

SEQ ID NO: 13167 - RNA, 22 nt, Human
uagguugugcgcuccuuaugag

SEQ ID NO: 13168 - RNA, 22 nt, Human
uagguuuguucucacuggaacu

SEQ ID NO: 13169 - RNA, 24 nt, Human
uaguacuuuuacacguuguaugac

SEQ ID NO: 13170 - RNA, 24 nt, Human
uaguagagaugggguuucaccuug

SEQ ID NO: 13171 - RNA, 24 nt, Human
uaguaguaucucauuuugguuuua

SEQ ID NO: 13172 - RNA, 24 nt, Human
uaguaguggugccuucgcccaaag

SEQ ID NO: 13173 - RNA, 24 nt, Human
uaguauuuauaaucauuuacuugu

SEQ ID NO: 13174 - RNA, 24 nt, Human
uaguauuucauaccgccugaaaug

SEQ ID NO: 13175 - RNA, 22 nt, Human
uaguggaaccuucuaaaugacg

SEQ ID NO: 13176 - RNA, 24 nt, Human
uaguggagauaggguuucaccaug

SEQ ID NO: 13177 - RNA, 24 nt, Human
uaguuuucugcccaguggaggcug

SEQ ID NO: 13178 - RNA, 24 nt, Human
uauaaaaaauacuugcugucacaa

SEQ ID NO: 13179 - RNA, 24 nt, Human
uauaacaaggcacaagauuuggaa

SEQ ID NO: 13180 - RNA, 24 nt, Human
uauaagaacauucuagaagguugu

SEQ ID NO: 13181 - RNA, 24 nt, Human
uauacuguauuguuuuuauuugua

SEQ ID NO: 13182 - RNA, 24 nt, Human
uauagagacuucaguagguauaaa

SEQ ID NO: 13183 - RNA, 24 nt, Human
uauagcaaugauuauaaagcuggg

SEQ ID NO: 13184 - RNA, 24 nt, Human
uauaguaaccuuaaaaagaacauu

SEQ ID NO: 13185 - RNA, 24 nt, Human
uauaguaauggccuucagcauccu

SEQ ID NO: 13186 - RNA, 20 nt, Human
uauaguguggaucaggaaaa

SEQ ID NO: 13187 - RNA, 24 nt, Human
uauaguguuaggucagacacggcu

SEQ ID NO: 13188 - RNA, 24 nt, Human
uauaguuucuccugaacaccugcu

SEQ ID NO: 13189 - RNA, 24 nt, Human
uauaucaucuggguugccuuuuug

SEQ ID NO: 13190 - RNA, 24 nt, Human
uauaugcuccaucaucacucuccu

SEQ ID NO: 13191 - RNA, 24 nt, Human
uauauggauccaauggcaagauca

SEQ ID NO: 13192 - RNA, 24 nt, Human
uaucaagcacuucaggguuguaga

SEQ ID NO: 13193 - RNA, 24 nt, Human
uaucaaggaagggcaaggcgugau

SEQ ID NO: 13194 - RNA, 18 nt, Human
uaucaaggaagggcaggc

SEQ ID NO: 13195 - RNA, 24 nt, Human
uaucaagucagcacacaccuuuuc

SEQ ID NO: 13196 - RNA, 24 nt, Human
uaucacacucacaaauuugguguc

SEQ ID NO: 13197 - RNA, 21 nt, Human
uaucacagaaugcagaauugg

SEQ ID NO: 13198 - RNA, 24 nt, Human
uaucacaguuuacuuauuuacuua

SEQ ID NO: 13199 - RNA, 22 nt, Human
uaucacccaggcuggagugcag

SEQ ID NO: 13200 - RNA, 24 nt, Human
uaucagcgucugaugccuucuucc

SEQ ID NO: 13201 - RNA, 24 nt, Human
uaucaggccauuaggacccgagga

SEQ ID NO: 13202 - RNA, 24 nt, Human
uaucaguggauggcauaauuaacu

SEQ ID NO: 13203 - RNA, 24 nt, Human
uaucauaaaauaaaugcugcgcug

SEQ ID NO: 13204 - RNA, 24 nt, Human
uaucaugucgcccacgcgggucac

SEQ ID NO: 13205 - RNA, 24 nt, Human
uauccagccuugauacccauuacc

SEQ ID NO: 13206 - RNA, 24 nt, Human
uauccaguaucuccgugauuaccu

SEQ ID NO: 13207 - RNA, 22 nt, Human
uauccaguguaaauuguugagc

SEQ ID NO: 13208 - RNA, 24 nt, Human
uaucccaaugacuaaaguaagaau

SEQ ID NO: 13209 - RNA, 24 nt, Human
uaucccagaggcauccuuccugga

SEQ ID NO: 13210 - RNA, 24 nt, Human
uaucccuuuuaaagagguuuauuc

SEQ ID NO: 13211 - RNA, 22 nt, Human
uauccugaacuguauccaaccc

SEQ ID NO: 13212 - RNA, 24 nt, Human
uauccuuguuuuuaacuguugugg

SEQ ID NO: 13213 - RNA, 24 nt, Human
uaucucaaaucugcuuucauccag

SEQ ID NO: 13214 - RNA, 20 nt, Human
uaucucaucuagauggcacu

SEQ ID NO: 13215 - RNA, 24 nt, Human
uaucucuaccagugguucucaaac

SEQ ID NO: 13216 - RNA, 22 nt, Human
uaucucugaauccaagggugac

SEQ ID NO: 13217 - RNA, 22 nt, Human
uaucucuugccuugaccuccua

SEQ ID NO: 13218 - RNA, 22 nt, Human
uaucucuuuaccaucuuggcuu

SEQ ID NO: 13219 - RNA, 24 nt, Human
uaucugaaaacuacaccgcugugg

SEQ ID NO: 13220 - RNA, 24 nt, Human
uaucugaggaacaaccaacuaguu

SEQ ID NO: 13221 - RNA, 24 nt, Human
uaucuugcugauuuguagaaguga

SEQ ID NO: 13222 - RNA, 24 nt, Human
uaugaaaugguaaaaaguauaugu

SEQ ID NO: 13223 - RNA, 22 nt, Human
uaugaauguaaggaauguggga

SEQ ID NO: 13224 - RNA, 21 nt, Human
uaugacacugcacagggaaug

SEQ ID NO: 13225 - RNA, 24 nt, Human
uaugacagaaucaugaagacuugc

SEQ ID NO: 13226 - RNA, 24 nt, Human
uaugacaggucaccguguguaaau

SEQ ID NO: 13227 - RNA, 24 nt, Human
uaugaccaacugaaagagugggaa

SEQ ID NO: 13228 - RNA, 24 nt, Human
uaugacccagguccaaaaguucca

SEQ ID NO: 13229 - RNA, 23 nt, Human
uaugacugcagagcaaguagcug

SEQ ID NO: 13230 - RNA, 24 nt, Human
uaugaggcugaugaauuugagaug

SEQ ID NO: 13231 - RNA, 24 nt, Human
uaugauaaaugauuauaacgugug

SEQ ID NO: 13232 - RNA, 24 nt, Human
uaugaucgugcuacuuucauggcu

SEQ ID NO: 13233 - RNA, 24 nt, Human
uaugauguacagugggaauguaag

SEQ ID NO: 13234 - RNA, 24 nt, Human
uaugauguggaagcugguuucagc

SEQ ID NO: 13235 - RNA, 24 nt, Human
uaugcaaggucaagagcggagggg

SEQ ID NO: 13236 - RNA, 24 nt, Human
uaugcaguucugagucugugccac

SEQ ID NO: 13237 - RNA, 24 nt, Human
uaugccaaggccaauagcuucacc

SEQ ID NO: 13238 - RNA, 23 nt, Human
uaugccacauagugugucaggag

SEQ ID NO: 13239 - RNA, 24 nt, Human
uaugccagccucuacuucugcugc

SEQ ID NO: 13240 - RNA, 24 nt, Human
uaugccauugucuuuguaauucuu

SEQ ID NO: 13241 - RNA, 22 nt, Human
uaugccggucucucccuggcgc

SEQ ID NO: 13242 - RNA, 24 nt, Human
uauggaguuaaggaaggucacgug

SEQ ID NO: 13243 - RNA, 24 nt, Human
uauggcaacucuuggcuguccuca

SEQ ID NO: 13244 - RNA, 24 nt, Human
uauggcaagaaguccaagcuggag

SEQ ID NO: 13245 - RNA, 24 nt, Human
uauggcaagucacuuugacagaca

SEQ ID NO: 13246 - RNA, 24 nt, Human
uauggcaagucacuuuugacagac

SEQ ID NO: 13247 - RNA, 24 nt, Human
uauggcacuggcguccccacacca

SEQ ID NO: 13248 - RNA, 24 nt, Human
uauggggaacgggugucucaaagg

SEQ ID NO: 13249 - RNA, 24 nt, Human
uauggggcccacaugggugguaac

SEQ ID NO: 13250 - RNA, 24 nt, Human
uauggugcggaggcccuggagagg

SEQ ID NO: 13251 - RNA, 24 nt, Human
uauguacauaguguuuucaauguu

SEQ ID NO: 13252 - RNA, 24 nt, Human
uauguacugcagagucugaugagc

SEQ ID NO: 13253 - RNA, 24 nt, Human
uauguagaauggaaugugaaacau

SEQ ID NO: 13254 - RNA, 21 nt, Human
uaugucaauucagaaauagag

SEQ ID NO: 13255 - RNA, 21 nt, Human
uaugucauaccuccauggggg

SEQ ID NO: 13256 - RNA, 24 nt, Human
uaugucuugcagcccucuuugugu

SEQ ID NO: 13257 - RNA, 24 nt, Human
uaugugauaucaaugaagaaauau

SEQ ID NO: 13258 - RNA, 24 nt, Human
uauguuauauuaaaaccuuguucc

SEQ ID NO: 13259 - RNA, 24 nt, Human
uauguugauaaaaacuuguacauc

SEQ ID NO: 13260 - RNA, 24 nt, Human
uauguuguuuaguguuauauucca

SEQ ID NO: 13261 - RNA, 24 nt, Human
uauguuuguuuucucaucccaaaa

SEQ ID NO: 13262 - RNA, 24 nt, Human
uauuacagauacaaauaagaguac

SEQ ID NO: 13263 - RNA, 22 nt, Human
uauuagagacaauaauguugga

SEQ ID NO: 13264 - RNA, 24 nt, Human
uauuaucaagccaccuaacuccuc

SEQ ID NO: 13265 - RNA, 24 nt, Human
uauuauguguauauauauacacac

SEQ ID NO: 13266 - RNA, 20 nt, Human
uauucagagaaucuaaagca

SEQ ID NO: 13267 - RNA, 24 nt, Human
uauucaggauaucucuaaaguuau

SEQ ID NO: 13268 - RNA, 22 nt, Human
uauucuucaacuuuucuccucu

SEQ ID NO: 13269 - RNA, 24 nt, Human
uauugaguuuaaggguugugugua

SEQ ID NO: 13270 - RNA, 24 nt, Human
uauugcucuuguugauccuuucuu

SEQ ID NO: 13271 - RNA, 24 nt, Human
uauuggacaaauuugguggggagc

SEQ ID NO: 13272 - RNA, 24 nt, Human
uauuggguguuuacucugccccau

SEQ ID NO: 13273 - RNA, 24 nt, Human
uauuguacaaaaggagggaggaac

SEQ ID NO: 13274 - RNA, 24 nt, Human
uauugugacucacauguccuccug

SEQ ID NO: 13275 - RNA, 21 nt, Human
uauuguguuuacuacuuguga

SEQ ID NO: 13276 - RNA, 24 nt, Human
uauuucaaaaaugacuaaaucuga

SEQ ID NO: 13277 - RNA, 22 nt, Human
uauuuguuuuuaaugcugggug

SEQ ID NO: 13278 - RNA, 20 nt, Human
uauuuuaggggccuuaccau

SEQ ID NO: 13279 - RNA, 24 nt, Human
uauuuuauugcaggaggugggggu

SEQ ID NO: 13280 - RNA, 22 nt, Human
uauuuugcucacuucccuauuc

SEQ ID NO: 13281 - RNA, 24 nt, Human
uauuuugggggguaggaaacgggu

SEQ ID NO: 13282 - RNA, 24 nt, Human
uauuuugguaaaauucggguuaaa

SEQ ID NO: 13283 - RNA, 17 nt, Human
uauuuuuggagaggugu

SEQ ID NO: 13284 - RNA, 24 nt, Human
ucaaaaauguuaggauuggggggc

SEQ ID NO: 13285 - RNA, 24 nt, Human
ucaaaauagccuccuggaagaagg

SEQ ID NO: 13286 - RNA, 22 nt, Human
ucaaaaucauuaguugggcuuu

SEQ ID NO: 13287 - RNA, 24 nt, Human
ucaaagauaaauccaaauacugca

SEQ ID NO: 13288 - RNA, 22 nt, Human
ucaaagcugcagauugccugug

SEQ ID NO: 13289 - RNA, 24 nt, Human
ucaaaucuccccaaauugauguau

SEQ ID NO: 13290 - RNA, 24 nt, Human
ucaaauggaaagaaguuugauucc

SEQ ID NO: 13291 - RNA, 24 nt, Human
ucaaaugucugugugcaugucuag

SEQ ID NO: 13292 - RNA, 24 nt, Human
ucaacagacuaugcgucugaagug

SEQ ID NO: 13293 - RNA, 24 nt, Human
ucaacagucagcucagugcuugug

SEQ ID NO: 13294 - RNA, 24 nt, Human
ucaacauuuugugugauccagcau

SEQ ID NO: 13295 - RNA, 22 nt, Human
ucaacuaugauuaccaaagcag

SEQ ID NO: 13296 - RNA, 22 nt, Human
ucaacugcucucccuccuucau

SEQ ID NO: 13297 - RNA, 22 nt, Human
ucaagaaauuauaccucuagga

SEQ ID NO: 13298 - RNA, 24 nt, Human
ucaagaauaccaaagcccauguca

SEQ ID NO: 13299 - RNA, 22 nt, Human
ucaagcgauucucaugccuuag

SEQ ID NO: 13300 - RNA, 24 nt, Human
ucaaggagaaugcuuccaguuuuu

SEQ ID NO: 13301 - RNA, 18 nt, Human
ucaaggguaugcaugugu

SEQ ID NO: 13302 - RNA, 24 nt, Human
ucaaggguuaacacgguucuaggu

SEQ ID NO: 13303 - RNA, 24 nt, Human
ucaaggguuccacacuguugggag

SEQ ID NO: 13304 - RNA, 24 nt, Human
ucaagguuucuuuuguauauaauu

SEQ ID NO: 13305 - RNA, 22 nt, Human
ucaaguaauccaggauaggcug

SEQ ID NO: 13306 - RNA, 24 nt, Human
ucaauauuuuaaaugugaugcagu

SEQ ID NO: 13307 - RNA, 24 nt, Human
ucaaucauuuguacagugacuuau

SEQ ID NO: 13308 - RNA, 22 nt, Human
ucaaugcuuuaaaaagugagag

SEQ ID NO: 13309 - RNA, 24 nt, Human
ucaauggauggccuuccgguccca

SEQ ID NO: 13310 - RNA, 24 nt, Human
ucacaaggauugaaagaugagguu

SEQ ID NO: 13311 - RNA, 24 nt, Human
ucacaaggucaggagaucgagacc

SEQ ID NO: 13312 - RNA, 24 nt, Human
ucacaagguccggagauugagacc

SEQ ID NO: 13313 - RNA, 22 nt, Human
ucacacacucuccuugggugau

SEQ ID NO: 13314 - RNA, 24 nt, Human
ucacagaacaggggcaugaacucu

SEQ ID NO: 13315 - RNA, 24 nt, Human
ucacagaagacuucgugucccacc

SEQ ID NO: 13316 - RNA, 22 nt, Human
ucacagcuguagaucaugcugc

SEQ ID NO: 13317 - RNA, 24 nt, Human
ucacaguaugccugggcucuugga

SEQ ID NO: 13318 - RNA, 22 nt, Human
ucacagugaaccggucucuuuc

SEQ ID NO: 13319 - RNA, 17 nt, Human
ucacaguggaauucguc

SEQ ID NO: 13320 - RNA, 22 nt, Human
ucacauaguaaggaaugcugag

SEQ ID NO: 13321 - RNA, 24 nt, Human
ucacauccacucucaacaaacuca

SEQ ID NO: 13322 - RNA, 24 nt, Human
ucacauggauucacuggcuaauaa

SEQ ID NO: 13323 - RNA, 24 nt, Human
ucacauggauuucugggcggagcg

SEQ ID NO: 13324 - RNA, 24 nt, Human
ucacauugaucucaaagcugaaga

SEQ ID NO: 13325 - RNA, 24 nt, Human
ucaccagccucaggacagauacaa

SEQ ID NO: 13326 - RNA, 22 nt, Human
ucaccaggcuggagugcagugg

SEQ ID NO: 13327 - RNA, 24 nt, Human
ucaccagugaccccagucagugcc

SEQ ID NO: 13328 - RNA, 22 nt, Human
ucacccaggcuggaguucagug

SEQ ID NO: 13329 - RNA, 22 nt, Human
ucaccgagagccugggcucagc

SEQ ID NO: 13330 - RNA, 22 nt, Human
ucaccgaggcuggagugcagug

SEQ ID NO: 13331 - RNA, 22 nt, Human
ucaccugaugaaaaaucaguaa

SEQ ID NO: 13332 - RNA, 24 nt, Human
ucaccuggauggcuuucguguccc

SEQ ID NO: 13333 - RNA, 24 nt, Human
ucacuaaauacugaaaguccuuga

SEQ ID NO: 13334 - RNA, 24 nt, Human
ucacucauacuacagacacuuggc

SEQ ID NO: 13335 - RNA, 24 nt, Human
ucacucgggaggaagaugugccug

SEQ ID NO: 13336 - RNA, 22 nt, Human
ucacucuuaugucucucuccuu

SEQ ID NO: 13337 - RNA, 24 nt, Human
ucacugaaguacucgcauguuguu

SEQ ID NO: 13338 - RNA, 24 nt, Human
ucacugagcuagugacuauuggga

SEQ ID NO: 13339 - RNA, 24 nt, Human
ucacugaggcgucuuggcuacugg

SEQ ID NO: 13340 - RNA, 24 nt, Human
ucacugaucccaaugagcagguac

SEQ ID NO: 13341 - RNA, 24 nt, Human
ucacugcaaacuccaccucccggg

SEQ ID NO: 13342 - RNA, 22 nt, Human
ucacugcaaccuacagcucaug

SEQ ID NO: 13343 - RNA, 24 nt, Human
ucacugcaaccuccgccucccggg

SEQ ID NO: 13344 - RNA, 22 nt, Human
ucacugcaaccuccgccugccg

SEQ ID NO: 13345 - RNA, 24 nt, Human
ucacugcaaccucugccucauggg

SEQ ID NO: 13346 - RNA, 24 nt, Human
ucacugcaaccucugccuccuggg

SEQ ID NO: 13347 - RNA, 22 nt, Human
ucacugcaaccucugcugccug

SEQ ID NO: 13348 - RNA, 22 nt, Human
ucacugcaaccucuggguucaa

SEQ ID NO: 13349 - RNA, 24 nt, Human
ucacugcacccucaaacuccuggg

SEQ ID NO: 13350 - RNA, 24 nt, Human
ucacugcacuccagccugggggaa

SEQ ID NO: 13351 - RNA, 24 nt, Human
ucacugcagccuccaacuccuggg

SEQ ID NO: 13352 - RNA, 24 nt, Human
ucacugcaguccacgaggccacac

SEQ ID NO: 13353 - RNA, 24 nt, Human
ucacugcauccucugccucccggg

SEQ ID NO: 13354 - RNA, 24 nt, Human
ucacugcguucaauuuugaguuuc

SEQ ID NO: 13355 - RNA, 24 nt, Human
ucacuggcgggcucgggaccgggc

SEQ ID NO: 13356 - RNA, 24 nt, Human
ucacugggcagguuuaagaagaag

SEQ ID NO: 13357 - RNA, 24 nt, Human
ucacugguuuuguggcugccuccc

SEQ ID NO: 13358 - RNA, 24 nt, Human
ucacuguaaccuugaacuccuggg

SEQ ID NO: 13359 - RNA, 24 nt, Human
ucacuguguucaauuuugaguuuc

SEQ ID NO: 13360 - RNA, 22 nt, Human
ucacuugccuagggucacacag

SEQ ID NO: 13361 - RNA, 24 nt, Human
ucacuugguuggucguauuguagc

SEQ ID NO: 13362 - RNA, 24 nt, Human
ucagaaacuccuggaaacaucuga

SEQ ID NO: 13363 - RNA, 24 nt, Human
ucagaacacuuaauuuacaaucaa

SEQ ID NO: 13364 - RNA, 24 nt, Human
ucagaaccacagagggcucauugg

SEQ ID NO: 13365 - RNA, 24 nt, Human
ucagaacucauuuggugguggcaa

SEQ ID NO: 13366 - RNA, 22 nt, Human
ucagaagagcguggucaucacc

SEQ ID NO: 13367 - RNA, 18 nt, Human
ucagaagcaaucucuucc

SEQ ID NO: 13368 - RNA, 24 nt, Human
ucagaagcuacuacaugugaaauu

SEQ ID NO: 13369 - RNA, 22 nt, Human
ucagaauagagguucuugguga

SEQ ID NO: 13370 - RNA, 24 nt, Human
ucagacaagcaacccacuggcuug

SEQ ID NO: 13371 - RNA, 24 nt, Human
ucagacucuucacaacuauuccua

SEQ ID NO: 13372 - RNA, 24 nt, Human
ucagaggcagccagaggggacagg

SEQ ID NO: 13373 - RNA, 24 nt, Human
ucagagggguugguguacauuccc

SEQ ID NO: 13374 - RNA, 22 nt, Human
ucagaguaggcuugauguaauc

SEQ ID NO: 13375 - RNA, 22 nt, Human
ucagagugauuucuuuuagguu

SEQ ID NO: 13376 - RNA, 24 nt, Human
ucagcaguuucauaugguuccacc

SEQ ID NO: 13377 - RNA, 22 nt, Human
ucagcccaguggaguugcccuu

SEQ ID NO: 13378 - RNA, 22 nt, Human
ucagccuaauacaggaaaagcu

SEQ ID NO: 13379 - RNA, 23 nt, Human
ucagccuuccgaguagcuggagc

SEQ ID NO: 13380 - RNA, 22 nt, Human
ucagcggcaucacuaccaaaac

SEQ ID NO: 13381 - RNA, 24 nt, Human
ucagcgggggacacaggaagggcu

SEQ ID NO: 13382 - RNA, 24 nt, Human
ucagcuauaggaagaggccauacc

SEQ ID NO: 13383 - RNA, 21 nt, Human
ucaggaacugaugagguucuc

SEQ ID NO: 13384 - RNA, 24 nt, Human
ucaggaagagcucaagaugggagg

SEQ ID NO: 13385 - RNA, 24 nt, Human
ucaggaauaugcggucauuuuauu

SEQ ID NO: 13386 - RNA, 24 nt, Human
ucaggagaccauugcaucauuggc

SEQ ID NO: 13387 - RNA, 24 nt, Human
ucaggagccuccacuuuccccagu

SEQ ID NO: 13388 - RNA, 24 nt, Human
ucaggagugcaacgagguaaaagc

SEQ ID NO: 13389 - RNA, 24 nt, Human
ucaggaguucaucuugauuuuuac

SEQ ID NO: 13390 - RNA, 24 nt, Human
ucaggaguugguguccugccugcg

SEQ ID NO: 13391 - RNA, 22 nt, Human
ucaggauaggucaacugcugua

SEQ ID NO: 13392 - RNA, 24 nt, Human
ucaggauccacaugcagcuuguca

SEQ ID NO: 13393 - RNA, 24 nt, Human
ucaggcgcaguacaaguuggggca

SEQ ID NO: 13394 - RNA, 24 nt, Human
ucaggcuccugcugaggggcccga

SEQ ID NO: 13395 - RNA, 24 nt, Human
ucaggcuccugcuucccagagagu

SEQ ID NO: 13396 - RNA, 22 nt, Human
ucaggcugaggucaucugcauc

SEQ ID NO: 13397 - RNA, 22 nt, Human
ucaggcuuuugugauuugagac

SEQ ID NO: 13398 - RNA, 24 nt, Human
ucagggaggugucugcaguauuau

SEQ ID NO: 13399 - RNA, 24 nt, Human
ucagggcggggagcacugcaggcc

SEQ ID NO: 13400 - RNA, 24 nt, Human
ucagggguuucucacucucuuccu

SEQ ID NO: 13401 - RNA, 24 nt, Human
ucagguggaccaucuucuagggcc

SEQ ID NO: 13402 - RNA, 24 nt, Human
ucagguggagcaggaaagccuggu

SEQ ID NO: 13403 - RNA, 24 nt, Human
ucagguggaugcgagaaauaucca

SEQ ID NO: 13404 - RNA, 24 nt, Human
ucaggugguggauccaaaacuuaa

SEQ ID NO: 13405 - RNA, 22 nt, Human
ucagguuccugauuggaguucu

SEQ ID NO: 13406 - RNA, 22 nt, Human
ucagguuugcaaccucgggcaa

SEQ ID NO: 13407 - RNA, 24 nt, Human
ucagucacuugcacaauuaauccu

SEQ ID NO: 13408 - RNA, 24 nt, Human
ucagucauccaaacuagugccauu

SEQ ID NO: 13409 - RNA, 24 nt, Human
ucagucccugguuucucuacuuuu

SEQ ID NO: 13410 - RNA, 24 nt, Human
ucaguccuuuucucgucgaugguc

SEQ ID NO: 13411 - RNA, 22 nt, Human
ucagucguguggaaaucgaugu

SEQ ID NO: 13412 - RNA, 24 nt, Human
ucagucuauagugggaaagcaggu

SEQ ID NO: 13413 - RNA, 24 nt, Human
ucagucuucuccuaagagugacaa

SEQ ID NO: 13414 - RNA, 24 nt, Human
ucagugaacucaugagcgggacag

SEQ ID NO: 13415 - RNA, 24 nt, Human
ucagugagguaaaucggaaugcac

SEQ ID NO: 13416 - RNA, 22 nt, Human
ucagugcaaacuaagcagggca

SEQ ID NO: 13417 - RNA, 24 nt, Human
ucagugcaacgaaggcugcagcug

SEQ ID NO: 13418 - RNA, 23 nt, Human
ucagugcgguucagcucaaggga

SEQ ID NO: 13419 - RNA, 24 nt, Human
ucaguggagaaggaguuggaccag

SEQ ID NO: 13420 - RNA, 24 nt, Human
ucagugggcuggacauggaggaag

SEQ ID NO: 13421 - RNA, 24 nt, Human
ucagugguaggcugauucugauuu

SEQ ID NO: 13422 - RNA, 22 nt, Human
ucagugguccaguggcacauuc

SEQ ID NO: 13423 - RNA, 24 nt, Human
ucaguuggaagacacccugaaauc

SEQ ID NO: 13424 - RNA, 24 nt, Human
ucaguuggagagagcguugaggag

SEQ ID NO: 13425 - RNA, 24 nt, Human
ucauaaggaauuaacucaugagau

SEQ ID NO: 13426 - RNA, 23 nt, Human
ucauaggucacauuccacaagga

SEQ ID NO: 13427 - RNA, 22 nt, Human
ucauauugagccuccuacugaa

SEQ ID NO: 13428 - RNA, 24 nt, Human
ucaucaggaaaauguaaaaaagau

SEQ ID NO: 13429 - RNA, 22 nt, Human
ucaucuaagcuggccaacuugg

SEQ ID NO: 13430 - RNA, 24 nt, Human
ucaucuggugacuccugauucugc

SEQ ID NO: 13431 - RNA, 24 nt, Human
ucaugcagccaucaggacacaggc

SEQ ID NO: 13432 - RNA, 20 nt, Human
ucaugcugcaauuuguuaga

SEQ ID NO: 13433 - RNA, 24 nt, Human
ucaugcugcaauuuguuagaauaa

SEQ ID NO: 13434 - RNA, 24 nt, Human
ucaugcugucagcacuugcaacgg

SEQ ID NO: 13435 - RNA, 24 nt, Human
ucauggaggggauacaagacggaa

SEQ ID NO: 13436 - RNA, 24 nt, Human
ucauggccgaguuaucccugaacc

SEQ ID NO: 13437 - RNA, 24 nt, Human
ucauggguggaaaagaccaggcuu

SEQ ID NO: 13438 - RNA, 22 nt, Human
ucaugggugggggugugugucg

SEQ ID NO: 13439 - RNA, 24 nt, Human
ucauugaggccaggagcucugccc

SEQ ID NO: 13440 - RNA, 22 nt, Human
ucauugcaaccuccaccuccug

SEQ ID NO: 13441 - RNA, 24 nt, Human
ucauuggagauugugccacccaag

SEQ ID NO: 13442 - RNA, 22 nt, Human
ucauuggaggguugagcuuuga

SEQ ID NO: 13443 - RNA, 22 nt, Human
ucauugggcuuugcuuaucuuu

SEQ ID NO: 13444 - RNA, 22 nt, Human
ucauugguugcauaauuugauc

SEQ ID NO: 13445 - RNA, 24 nt, Human
ucauuuauuuuguacuguguuagg

SEQ ID NO: 13446 - RNA, 22 nt, Human
uccaaaauuaaagguuguagaa

SEQ ID NO: 13447 - RNA, 24 nt, Human
uccaaagacaagguuucccuggaa

SEQ ID NO: 13448 - RNA, 24 nt, Human
uccaaagagagucagagcuaagca

SEQ ID NO: 13449 - RNA, 22 nt, Human
uccaaauaaauuccccgcgcgg

SEQ ID NO: 13450 - RNA, 24 nt, Human
uccaagagaucaaggucgagcucu

SEQ ID NO: 13451 - RNA, 24 nt, Human
uccaagauggauggcucccagucg

SEQ ID NO: 13452 - RNA, 24 nt, Human
uccaaguacgagaaguaacaggag

SEQ ID NO: 13453 - RNA, 24 nt, Human
uccaaguaguugggacuacaggca

SEQ ID NO: 13454 - RNA, 24 nt, Human
uccaaugugugaggauggcuggac

SEQ ID NO: 13455 - RNA, 24 nt, Human
uccacaacgguugaacuaauuucc

SEQ ID NO: 13456 - RNA, 24 nt, Human
uccacaggauaaagccacgcuggu

SEQ ID NO: 13457 - RNA, 24 nt, Human
uccacagguucacuaacgggggca

SEQ ID NO: 13458 - RNA, 20 nt, Human
uccacauguggaaguggggu

SEQ ID NO: 13459 - RNA, 24 nt, Human
uccaccauccaggugugcuuggau

SEQ ID NO: 13460 - RNA, 24 nt, Human
uccacuugacaacugacuucugug

SEQ ID NO: 13461 - RNA, 24 nt, Human
uccaggaagggccugguguugcag

SEQ ID NO: 13462 - RNA, 22 nt, Human
uccaggaggcagagguugcagu

SEQ ID NO: 13463 - RNA, 24 nt, Human
uccaggauguuaccguuccugcug

SEQ ID NO: 13464 - RNA, 19 nt, Human
uccaggcacacacagacac

SEQ ID NO: 13465 - RNA, 24 nt, Human
uccaggggagguuugcagaacuuc

SEQ ID NO: 13466 - RNA, 24 nt, Human
uccagguaggaggccaggcggucg

SEQ ID NO: 13467 - RNA, 22 nt, Human
uccaggucaacauuacuguccu

SEQ ID NO: 13468 - RNA, 24 nt, Human
uccagguguaucuuagcuaaaacu

SEQ ID NO: 13469 - RNA, 24 nt, Human
uccagguuacagguagauuuaaaa

SEQ ID NO: 13470 - RNA, 24 nt, Human
uccagguucgaacccaggaucaca

SEQ ID NO: 13471 - RNA, 22 nt, Human
uccaguacaggucucucauuuc

SEQ ID NO: 13472 - RNA, 24 nt, Human
uccaguaucccaaacuuucuaguc

SEQ ID NO: 13473 - RNA, 22 nt, Human
uccagucuggugagaguguuaa

SEQ ID NO: 13474 - RNA, 22 nt, Human
uccagugaaacaggucucuuug

SEQ ID NO: 13475 - RNA, 24 nt, Human
uccauaaauaccauaguuaaaugu

SEQ ID NO: 13476 - RNA, 24 nt, Human
uccauccugagguuuggggggaga

SEQ ID NO: 13477 - RNA, 24 nt, Human
uccaugaccaaaaaucucugaaaa

SEQ ID NO: 13478 - RNA, 24 nt, Human
uccauggcaggcggguacaagggg

SEQ ID NO: 13479 - RNA, 24 nt, Human
uccauggcuaguuguuucuuuuuc

SEQ ID NO: 13480 - RNA, 24 nt, Human
uccauggggcgcccagucgcaggc

SEQ ID NO: 13481 - RNA, 22 nt, Human
uccauguucugggugauggaaa

SEQ ID NO: 13482 - RNA, 24 nt, Human
ucccaaaguuaaccuuggcuaucu

SEQ ID NO: 13483 - RNA, 21 nt, Human
ucccaagcagucacuaggugg

SEQ ID NO: 13484 - RNA, 24 nt, Human
ucccaauacuuuagaaaaauuacu

SEQ ID NO: 13485 - RNA, 24 nt, Human
ucccacagaagcuacagcugccag

SEQ ID NO: 13486 - RNA, 24 nt, Human
ucccacauccaggaugacaccuua

SEQ ID NO: 13487 - RNA, 24 nt, Human
ucccacuuaauugaauacuuagaa

SEQ ID NO: 13488 - RNA, 24 nt, Human
ucccagaagguguccagccgagac

SEQ ID NO: 13489 - RNA, 24 nt, Human
ucccagagauuuugguacguugug

SEQ ID NO: 13490 - RNA, 24 nt, Human
ucccagcuaguucacuccuuucgc

SEQ ID NO: 13491 - RNA, 24 nt, Human
ucccagggcuccagggcccuccuc

SEQ ID NO: 13492 - RNA, 24 nt, Human
ucccagggcugggggacuuccuuc

SEQ ID NO: 13493 - RNA, 24 nt, Human
ucccaguaucgaggggcaaacuua

SEQ ID NO: 13494 - RNA, 24 nt, Human
ucccagugcaacacuaccuuugug

SEQ ID NO: 13495 - RNA, 22 nt, Human
uccccaagccuuguaccagcgu

SEQ ID NO: 13496 - RNA, 24 nt, Human
uccccaauaaaaugcuguucauua

SEQ ID NO: 13497 - RNA, 24 nt, Human
uccccagaaauugacugagagaca

SEQ ID NO: 13498 - RNA, 24 nt, Human
uccccagcaaccaggccuggccuc

SEQ ID NO: 13499 - RNA, 24 nt, Human
uccccagugucuuugggggucugu

SEQ ID NO: 13500 - RNA, 22 nt, Human
uccccaucucuuuuuccccaca

SEQ ID NO: 13501 - RNA, 24 nt, Human
ucccccagucagccuggcccugcu

SEQ ID NO: 13502 - RNA, 21 nt, Human
ucccccugacccaccaggcca

SEQ ID NO: 13503 - RNA, 24 nt, Human
uccccgaaagcacuggagaagggg

SEQ ID NO: 13504 - RNA, 24 nt, Human
uccccgaggccgcgccgggagcuc

SEQ ID NO: 13505 - RNA, 22 nt, Human
uccccgauggcccacugcguga

SEQ ID NO: 13506 - RNA, 24 nt, Human
uccccggaugucccucagacccgc

SEQ ID NO: 13507 - RNA, 21 nt, Human
uccccgggaaaacguucguca

SEQ ID NO: 13508 - RNA, 24 nt, Human
uccccggggauccugcagcucuag

SEQ ID NO: 13509 - RNA, 24 nt, Human
uccccgguacucgccggccggagc

SEQ ID NO: 13510 - RNA, 20 nt, Human
uccccguguguguuggcaua

SEQ ID NO: 13511 - RNA, 24 nt, Human
uccccuaagcuccagggcccaggg

SEQ ID NO: 13512 - RNA, 24 nt, Human
uccccugauaaugcaucaccuucc

SEQ ID NO: 13513 - RNA, 24 nt, Human
uccccuggguccucuguguaguua

SEQ ID NO: 13514 - RNA, 24 nt, Human
uccccuuguccacugauggggggu

SEQ ID NO: 13515 - RNA, 24 nt, Human
ucccgaaagucccaggcuguugga

SEQ ID NO: 13516 - RNA, 24 nt, Human
ucccgauuccuguaguagcggcug

SEQ ID NO: 13517 - RNA, 24 nt, Human
ucccgcacagccugacaggguaca

SEQ ID NO: 13518 - RNA, 24 nt, Human
ucccgcagugggucccggagagga

SEQ ID NO: 13519 - RNA, 24 nt, Human
ucccgcugaugauuaugagucuga

SEQ ID NO: 13520 - RNA, 24 nt, Human
ucccggcucucccgcccucccucc

SEQ ID NO: 13521 - RNA, 24 nt, Human
ucccggggggcaggcgggggccag

SEQ ID NO: 13522 - RNA, 24 nt, Human
ucccgggguaaucacuccccaaua

SEQ ID NO: 13523 - RNA, 24 nt, Human
ucccgggguugccugaggcagagc

SEQ ID NO: 13524 - RNA, 22 nt, Human
ucccggguuauccucgcuggca

SEQ ID NO: 13525 - RNA, 24 nt, Human
ucccgguuccuaacggacugcaag

SEQ ID NO: 13526 - RNA, 24 nt, Human
ucccguggaugacugucuuugaac

SEQ ID NO: 13527 - RNA, 20 nt, Human
ucccuaaaugcaguagauua

SEQ ID NO: 13528 - RNA, 24 nt, Human
ggggaucgagggcuggcggggaga

SEQ ID NO: 13529 - RNA, 22 nt, Human
ggggcacaugccaaacaccaca

SEQ ID NO: 13530 - RNA, 22 nt, Human
gggggagaauaugugaaggggg

SEQ ID NO: 13531 - RNA, 19 nt, Human
gggggaugauagcagccag

SEQ ID NO: 13532 - RNA, 24 nt, Human
ggggggcccaggccgagcuccuug

SEQ ID NO: 13533 - RNA, 22 nt, Human
ggggggucucuccuuucuccug

SEQ ID NO: 13534 - RNA, 22 nt, Human
ggggucagaagacuggauugug

SEQ ID NO: 13535 - RNA, 22 nt, Human
gggguuucuguaggcacuuuau

SEQ ID NO: 13536 - RNA, 22 nt, Human
ggguccaccucugucaaaggaa

SEQ ID NO: 13537 - RNA, 24 nt, Human
gggugaguggcagacccuugggcc

SEQ ID NO: 13538 - RNA, 22 nt, Human
ggguggaguuuucagcccucug

SEQ ID NO: 13539 - RNA, 22 nt, Human
ggguggcucacguuauugcggc

SEQ ID NO: 13540 - RNA, 22 nt, Human
gguacagaugggucuggcacau

SEQ ID NO: 13541 - RNA, 22 nt, Human
gguagcuagaggggagauagca

SEQ ID NO: 13542 - RNA, 22 nt, Human
gguagcuuauuaaagaaacucc

SEQ ID NO: 13543 - RNA, 22 nt, Human
gguauggaccccaugauggaac

SEQ ID NO: 13544 - RNA, 22 nt, Human
gguauguuauaucccuggggca

SEQ ID NO: 13545 - RNA, 22 nt, Human
gguauuaauccuuagcaucagg

SEQ ID NO: 13546 - RNA, 22 nt, Human
ggucauucaaggaacgucaagu

SEQ ID NO: 13547 - RNA, 22 nt, Human
ggucauucaagggaagucaagu

SEQ ID NO: 13548 - RNA, 22 nt, Human
ggucauucacggcaagucaagu

SEQ ID NO: 13549 - RNA, 22 nt, Human
gguccacaaggggagagcaggg

SEQ ID NO: 13550 - RNA, 23 nt, Human
gguccagcaggcagguacaagcc

SEQ ID NO: 13551 - RNA, 24 nt, Human
ggugaauucauguguaguacaagc

SEQ ID NO: 13552 - RNA, 22 nt, Human
ggugacuaucauuugaacaacu

SEQ ID NO: 13553 - RNA, 21 nt, Human
ggugaucgaggagccuggccu

SEQ ID NO: 13554 - RNA, 24 nt, Human
ggugauggcguugguaaaggcuuc

SEQ ID NO: 13555 - RNA, 24 nt, Human
ggugaugguugucauguguggguc

SEQ ID NO: 13556 - RNA, 22 nt, Human
ggugcagaucauggauagagcu

SEQ ID NO: 13557 - RNA, 24 nt, Human
ggugcagucgucacucgcgucugg

SEQ ID NO: 13558 - RNA, 24 nt, Human
ggugcaguggaaauccuugccuug

SEQ ID NO: 13559 - RNA, 22 nt, Human
gguguuguguucagggcccuuc

SEQ ID NO: 13560 - RNA, 24 nt, Human
gguguuuuggugucuguuuuugcc

SEQ ID NO: 13561 - RNA, 22 nt, Human
gguuaugcacuacuuaugagaa

SEQ ID NO: 13562 - RNA, 22 nt, Human
gguuccuuguguggcaacagua

SEQ ID NO: 13563 - RNA, 22 nt, Human
gguucucaaaugagggacauuu

SEQ ID NO: 13564 - RNA, 22 nt, Human
gguucuucagaggaagcuuuuu

SEQ ID NO: 13565 - RNA, 22 nt, Human
gguuggaguugagucucacguu

SEQ ID NO: 13566 - RNA, 22 nt, Human
gguuuggggagaugguggagga

SEQ ID NO: 13567 - RNA, 22 nt, Human
gguuuguuacauagguaaacgu

SEQ ID NO: 13568 - RNA, 22 nt, Human
gguuuugacucugaggaugaca

SEQ ID NO: 13569 - RNA, 24 nt, Human
guaaucccaaccuuugagauagca

SEQ ID NO: 13570 - RNA, 22 nt, Human
guagacagcaagaaaaugaaga

SEQ ID NO: 13571 - RNA, 24 nt, Human
guagaguauucuucaggcuuaaag

SEQ ID NO: 13572 - RNA, 22 nt, Human
guagccauugcacugcagauga

SEQ ID NO: 13573 - RNA, 22 nt, Human
guaggggagugaguuuccaucu

SEQ ID NO: 13574 - RNA, 24 nt, Human
guagucccggauccuuaguuggcu

SEQ ID NO: 13575 - RNA, 22 nt, Human
guaguguggaaaucuuuuugcc

SEQ ID NO: 13576 - RNA, 22 nt, Human
guauggagaucucugcccuugu

SEQ ID NO: 13577 - RNA, 23 nt, Human
gucaagggauggaaagucaccgu

SEQ ID NO: 13578 - RNA, 22 nt, Human
gucacacagcugaacaguggug

SEQ ID NO: 13579 - RNA, 24 nt, Human
gucacuuccagaacugaguccggu

SEQ ID NO: 13580 - RNA, 24 nt, Human
gucaucuuaagccucauccuacau

SEQ ID NO: 13581 - RNA, 22 nt, Human
guccaggcucucuuucacacuc

SEQ ID NO: 13582 - RNA, 24 nt, Human
guccagggcgcggcaugggcgucc

SEQ ID NO: 13583 - RNA, 22 nt, Human
guccagugcucacugccgacau

SEQ ID NO: 13584 - RNA, 24 nt, Human
guccauccucaagccacgauaaga

SEQ ID NO: 13585 - RNA, 22 nt, Human
guccauuccuuuaauguccuua

SEQ ID NO: 13586 - RNA, 24 nt, Human
gucccaaaggcagaaggcaguauu

SEQ ID NO: 13587 - RNA, 24 nt, Human
gucccaauggccaacgugcagcgg

SEQ ID NO: 13588 - RNA, 24 nt, Human
guccccuucagcaaggagggcggc

SEQ ID NO: 13589 - RNA, 24 nt, Human
guccgugggcucagguucucaucc

SEQ ID NO: 13590 - RNA, 24 nt, Human
guccuauaauguaggaaugugaga

SEQ ID NO: 13591 - RNA, 20 nt, Human
guccuaucuggggucuccuc

SEQ ID NO: 13592 - RNA, 22 nt, Human
guccucauuaauuuuccucaug

SEQ ID NO: 13593 - RNA, 22 nt, Human
guccuccuagcuggccugccca

SEQ ID NO: 13594 - RNA, 24 nt, Human
guccucgggugccuuuccaaaaca

SEQ ID NO: 13595 - RNA, 24 nt, Human
guccucuucuuuucccagagcucc

SEQ ID NO: 13596 - RNA, 24 nt, Human
guccuguuccucaugauguuggga

SEQ ID NO: 13597 - RNA, 21 nt, Human
guccuuggauuucucuuucuc

SEQ ID NO: 13598 - RNA, 24 nt, Human
guccuuguggccuuccuugaggag

SEQ ID NO: 13599 - RNA, 22 nt, Human
gucgggaggaaaagaaagaaga

SEQ ID NO: 13600 - RNA, 22 nt, Human
gucucccuuccuagccauggaa

SEQ ID NO: 13601 - RNA, 22 nt, Human
gucugcugucuacacuacacac

SEQ ID NO: 13602 - RNA, 22 nt, Human
gucuggcuuucauggcucugca

SEQ ID NO: 13603 - RNA, 20 nt, Human
gucuuucugauugcaagcug

SEQ ID NO: 13604 - RNA, 24 nt, Human
gugaagcucuacuacccgccccgu

SEQ ID NO: 13605 - RNA, 24 nt, Human
gugaaguauuuuguuaccucaguc

SEQ ID NO: 13606 - RNA, 24 nt, Human
gugaaguggugaaaggaguuucuc

SEQ ID NO: 13607 - RNA, 24 nt, Human
gugacucuccuguggggucccaug

SEQ ID NO: 13608 - RNA, 22 nt, Human
gugagcaaaguuucaggaguag

SEQ ID NO: 13609 - RNA, 24 nt, Human
gugagcccugccgcugucccaugg

SEQ ID NO: 13610 - RNA, 24 nt, Human
gugaugaccuugaagcuguagcca

SEQ ID NO: 13611 - RNA, 23 nt, Human
gugaugcuccuccagcuccucgu

SEQ ID NO: 13612 - RNA, 22 nt, Human
gugcacaacgagcagguuuguu

SEQ ID NO: 13613 - RNA, 24 nt, Human
gugcacucuauucaagugcaagga

SEQ ID NO: 13614 - RNA, 24 nt, Human
gugcagagaaccauugcaagacuu

SEQ ID NO: 13615 - RNA, 24 nt, Human
gugcagcaucucuuuggcaggugg

SEQ ID NO: 13616 - RNA, 24 nt, Human
gugcaggacuuugaugcuuggggu

SEQ ID NO: 13617 - RNA, 24 nt, Human
gugcaucuuuuaaccagccgaaug

SEQ ID NO: 13618 - RNA, 22 nt, Human
gugcauguuuauucagugugca

SEQ ID NO: 13619 - RNA, 24 nt, Human
gugcauugaaaggucuccaggccu

SEQ ID NO: 13620 - RNA, 24 nt, Human
gugcauuguccuguuuucacuuuu

SEQ ID NO: 13621 - RNA, 24 nt, Human
gugccugggggccuaggugaggcu

SEQ ID NO: 13622 - RNA, 24 nt, Human
gugcucaguccuacagcugcaugg

SEQ ID NO: 13623 - RNA, 24 nt, Human
gugcugugaugcgugaggcagccg

SEQ ID NO: 13624 - RNA, 22 nt, Human
gugcuuccauuuccccaucugu

SEQ ID NO: 13625 - RNA, 22 nt, Human
gugcuuccuuaaucccuuuacu

SEQ ID NO: 13626 - RNA, 22 nt, Human
gugcuuguaguugcagcuuagu

SEQ ID NO: 13627 - RNA, 22 nt, Human
gugcuuguuggcuuuaacaucc

SEQ ID NO: 13628 - RNA, 24 nt, Human
gugcuuucacaaaauggagagugg

SEQ ID NO: 13629 - RNA, 22 nt, Human
gugcuuucccaaccuucuuggu

SEQ ID NO: 13630 - RNA, 24 nt, Human
gugcuuuuccaagguuagagguuu

SEQ ID NO: 13631 - RNA, 24 nt, Human
guggacagcgaggccaggauggag

SEQ ID NO: 13632 - RNA, 24 nt, Human
guggacuaccugccugagagggau

SEQ ID NO: 13633 - RNA, 24 nt, Human
guggagcuagaaguuccuuggcug

SEQ ID NO: 13634 - RNA, 24 nt, Human
guggaggaggcgauugccuauggc

SEQ ID NO: 13635 - RNA, 22 nt, Human
guggaguagcugaagcagccaa

SEQ ID NO: 13636 - RNA, 22 nt, Human
guggaguucucugcuaguccua

SEQ ID NO: 13637 - RNA, 24 nt, Human
guggaucgaccagaacucggcccu

SEQ ID NO: 13638 - RNA, 24 nt, Human
guggaucuaccauucugguguuug

SEQ ID NO: 13639 - RNA, 24 nt, Human
guggccccacacaccagucccagc

SEQ ID NO: 13640 - RNA, 24 nt, Human
guggcggcggcggcggcggcagca

SEQ ID NO: 13641 - RNA, 22 nt, Human
guggcuaucaaauuaggacuca

SEQ ID NO: 13642 - RNA, 24 nt, Human
gugggagcuggcgugcuuggcucu

SEQ ID NO: 13643 - RNA, 24 nt, Human
guggucccuccauguugucacagc

SEQ ID NO: 13644 - RNA, 24 nt, Human
guggucugcucauaguuugugugc

SEQ ID NO: 13645 - RNA, 24 nt, Human
guggugcaggggacaagaggcugu

SEQ ID NO: 13646 - RNA, 24 nt, Human
guggugcugccgcugcucccuggc

SEQ ID NO: 13647 - RNA, 21 nt, Human
guggugcugguguuugggaug

SEQ ID NO: 13648 - RNA, 24 nt, Human
gugguggcagacuuugggcuguca

SEQ ID NO: 13649 - RNA, 24 nt, Human
gugguucagucagggaggucagaa

SEQ ID NO: 13650 - RNA, 24 nt, Human
gugguuccgcaauugccuccagcu

SEQ ID NO: 13651 - RNA, 23 nt, Human
gugguugggaaauguuaccauau

SEQ ID NO: 13652 - RNA, 24 nt, Human
gugguuucgcauagugccaagcac

SEQ ID NO: 13653 - RNA, 23 nt, Human
guguauuggccaggagaggacac

SEQ ID NO: 13654 - RNA, 24 nt, Human
gugugcuguuagaaggguucuggg

SEQ ID NO: 13655 - RNA, 24 nt, Human
gugugcuucucgauuuggcuucga

SEQ ID NO: 13656 - RNA, 22 nt, Human
guguggccagguccauugugcu

SEQ ID NO: 13657 - RNA, 22 nt, Human
gugugugauaaggacacagaua

SEQ ID NO: 13658 - RNA, 22 nt, Human
guguguggaaaugcagaugacc

SEQ ID NO: 13659 - RNA, 22 nt, Human
guguguguauauguuucugucc

SEQ ID NO: 13660 - RNA, 22 nt, Human
gugugugugcauguaccgggga

SEQ ID NO: 13661 - RNA, 22 nt, Human
guguguuugagcuggaagugcc

SEQ ID NO: 13662 - RNA, 22 nt, Human
guguuagcauggaacagaacgc

SEQ ID NO: 13663 - RNA, 21 nt, Human
guguuggcugagauuguccau

SEQ ID NO: 13664 - RNA, 24 nt, Human
guuaaauuaacauugcauaaacac

SEQ ID NO: 13665 - RNA, 24 nt, Human
guucacaccagcuuguuucaguuu

SEQ ID NO: 13666 - RNA, 24 nt, Human
guucaugggucgcuugaugugccc

SEQ ID NO: 13667 - RNA, 24 nt, Human
guucauuagcgugaagauguugga

SEQ ID NO: 13668 - RNA, 24 nt, Human
guuccaguuaggggcaguagaguu

SEQ ID NO: 13669 - RNA, 23 nt, Human
guucccguugccuuugcugaggg

SEQ ID NO: 13670 - RNA, 22 nt, Human
guucugcugagauacgugcucu

SEQ ID NO: 13671 - RNA, 22 nt, Human
guucuucugggagaaaaauggc

SEQ ID NO: 13672 - RNA, 24 nt, Human
guugcaauggugagaucucaaaaa

SEQ ID NO: 13673 - RNA, 24 nt, Human
guugcaguccggaacuguugcugg

SEQ ID NO: 13674 - RNA, 22 nt, Human
guugccaacucaguccuuguac

SEQ ID NO: 13675 - RNA, 22 nt, Human
guugggccaaaggugauuacuu

SEQ ID NO: 13676 - RNA, 22 nt, Human
guugggugugagggggguccca

SEQ ID NO: 13677 - RNA, 22 nt, Human
guuggugacauugacuaggcau

SEQ ID NO: 13678 - RNA, 22 nt, Human
guuguuaucuguaccuaaguua

SEQ ID NO: 13679 - RNA, 22 nt, Human
guuuaagguuuucuccauggcc

SEQ ID NO: 13680 - RNA, 22 nt, Human
guuuagcucaaguaugcagcuu

SEQ ID NO: 13681 - RNA, 22 nt, Human
guuucccaggugccagauguga

SEQ ID NO: 13682 - RNA, 22 nt, Human
guuuggcacugaaucauauaca

SEQ ID NO: 13683 - RNA, 24 nt, Human
guuuuggucaaggaugguagccca

SEQ ID NO: 13684 - RNA, 24 nt, Human
uaaaaaggcuuuauaauuacagau

SEQ ID NO: 13685 - RNA, 24 nt, Human
uaaaacaaaacaaaagucauuuca

SEQ ID NO: 13686 - RNA, 24 nt, Human
uaaaacaaguuuuuguugguuacu

SEQ ID NO: 13687 - RNA, 23 nt, Human
uaaaacccgcggggugaaccggg

SEQ ID NO: 13688 - RNA, 22 nt, Human
uaaaagaaccgaaaggcuguac

SEQ ID NO: 13689 - RNA, 24 nt, Human
uaaaagaaguuacugaggaagauu

SEQ ID NO: 13690 - RNA, 23 nt, Human
uaaaauacauuuuauguuaaugu

SEQ ID NO: 13691 - RNA, 24 nt, Human
uaaaauaccucuaauaaacauugu

SEQ ID NO: 13692 - RNA, 22 nt, Human
uaaaaugcaucaaacuccuuuc

SEQ ID NO: 13693 - RNA, 23 nt, Human
uaaaauguacuuuuauuuuaugg

SEQ ID NO: 13694 - RNA, 24 nt, Human
uaaaauguauuugguuuuguugga

SEQ ID NO: 13695 - RNA, 22 nt, Human
uaaaccguugaaacccauucgu

SEQ ID NO: 13696 - RNA, 24 nt, Human
uaaagcacuaagguugauuuuugu

SEQ ID NO: 13697 - RNA, 24 nt, Human
uaaagcuaacaaaucaaaggcaca

SEQ ID NO: 13698 - RNA, 24 nt, Human
uaaagcucuaagacucaugagcca

SEQ ID NO: 13699 - RNA, 24 nt, Human
uaaagggagacaauggugucuugg

SEQ ID NO: 13700 - RNA, 24 nt, Human
uaaagguuccaaggcaugccccaa

SEQ ID NO: 13701 - RNA, 22 nt, Human
uaaagguuucacagucagugca

SEQ ID NO: 13702 - RNA, 24 nt, Human
uaaagucaaccucaauuccuuaca

SEQ ID NO: 13703 - RNA, 24 nt, Human
uaaagugaugauacacugggcuuu

SEQ ID NO: 13704 - RNA, 24 nt, Human
uaaaguuuaguuuaaaaguuguag

SEQ ID NO: 13705 - RNA, 24 nt, Human
uaaaguuugcucucucuuuuugaa

SEQ ID NO: 13706 - RNA, 22 nt, Human
uaaauacagugauucuaagauc

SEQ ID NO: 13707 - RNA, 22 nt, Human
uaaauacugcucacauguuccu

SEQ ID NO: 13708 - RNA, 24 nt, Human
uaaauagcaucccucuccccacga

SEQ ID NO: 13709 - RNA, 22 nt, Human
uaaauaucagcuucuaauuaag

SEQ ID NO: 13710 - RNA, 24 nt, Human
uaaaucaaaacaaaacacaaggua

SEQ ID NO: 13711 - RNA, 22 nt, Human
uaaaugcagauucccaggcccu

SEQ ID NO: 13712 - RNA, 24 nt, Human
uaaauggauuaaucccauuauugc

SEQ ID NO: 13713 - RNA, 24 nt, Human
uaaauuaugaucuaccuaccaauc

SEQ ID NO: 13714 - RNA, 24 nt, Human
uaacaaaaggaaaaugugacuuaa

SEQ ID NO: 13715 - RNA, 22 nt, Human
uaacaacgaggccaggagggau

SEQ ID NO: 13716 - RNA, 24 nt, Human
uaacagaagggguuuuguaagcug

SEQ ID NO: 13717 - RNA, 24 nt, Human
uaacaguauuuccagugacaaugc

SEQ ID NO: 13718 - RNA, 24 nt, Human
uaacauacacauagugaagaaugc

SEQ ID NO: 13719 - RNA, 21 nt, Human
uaacauaguggucauuugucc

SEQ ID NO: 13720 - RNA, 24 nt, Human
uaaccacuuaaauagaacaguguc

SEQ ID NO: 13721 - RNA, 24 nt, Human
uaacccgugugggggaagaggacu

SEQ ID NO: 13722 - RNA, 23 nt, Human
uaaccgcaaaacucuagaggggg

SEQ ID NO: 13723 - RNA, 24 nt, Human
uaaccuguggggcuguguugauaa

SEQ ID NO: 13724 - RNA, 24 nt, Human
uaacgccggugaagcuucaggggg

SEQ ID NO: 13725 - RNA, 24 nt, Human
uaacgugguguugugccugcuggc

SEQ ID NO: 13726 - RNA, 24 nt, Human
uaacucagcacgcuuccacuucac

SEQ ID NO: 13727 - RNA, 24 nt, Human
uaacucuccaagccuucugggaug

SEQ ID NO: 13728 - RNA, 24 nt, Human
uaacugaaagcugaaaccucugga

SEQ ID NO: 13729 - RNA, 24 nt, Human
uaacugaccuaaagaggugugugu

SEQ ID NO: 13730 - RNA, 24 nt, Human
uaacugcauuugcgccaccugcug

SEQ ID NO: 13731 - RNA, 24 nt, Human
uaacuuagcuaagcccuuugcaca

SEQ ID NO: 13732 - RNA, 24 nt, Human
uaacuugagaaucuugaggggcuu

SEQ ID NO: 13733 - RNA, 24 nt, Human
uaacuuuauugcaagucacauaau

SEQ ID NO: 13734 - RNA, 24 nt, Human
uaagaaaacaggcuugaauuucac

SEQ ID NO: 13735 - RNA, 20 nt, Human
uaagaaaauugggucagagg

SEQ ID NO: 13736 - RNA, 24 nt, Human
uaagaaacauguuccaguacuuua

SEQ ID NO: 13737 - RNA, 24 nt, Human
uaagaagccagucagccugcccau

SEQ ID NO: 13738 - RNA, 24 nt, Human
uaagaagugcuuacucacccuuuu

SEQ ID NO: 13739 - RNA, 24 nt, Human
uaagaaguugucaucauucugaau

SEQ ID NO: 13740 - RNA, 24 nt, Human
uaagaccaucaucacugcgugaaa

SEQ ID NO: 13741 - RNA, 24 nt, Human
uaagagaacaguacaauuugcagu

SEQ ID NO: 13742 - RNA, 24 nt, Human
uaagagacauugaaccuggagaag

SEQ ID NO: 13743 - RNA, 22 nt, Human
uaagagcagacacaaccugaga

SEQ ID NO: 13744 - RNA, 24 nt, Human
uaagauacgaaaauuagcugggug

SEQ ID NO: 13745 - RNA, 22 nt, Human
uaagaugagugcuagagacuug

SEQ ID NO: 13746 - RNA, 24 nt, Human
uaagcagcaugauggauucagaag

SEQ ID NO: 13747 - RNA, 24 nt, Human
uaagcauucggcuggguuggcccu

SEQ ID NO: 13748 - RNA, 24 nt, Human
uaagccaccaugaggcugucagug

SEQ ID NO: 13749 - RNA, 22 nt, Human
uaagccuugggacagcugggaa

SEQ ID NO: 13750 - RNA, 24 nt, Human
uaagcuuggccuaagagcuagagu

SEQ ID NO: 13751 - RNA, 24 nt, Human
uaaggaaauauuuuaauuucaugg

SEQ ID NO: 13752 - RNA, 24 nt, Human
uaaggaaauguggaggaggcagaa

SEQ ID NO: 13753 - RNA, 24 nt, Human
uaaggaccugcucuaggaaacauu

SEQ ID NO: 13754 - RNA, 24 nt, Human
uaaggaccuguuuggggcagcagg

SEQ ID NO: 13755 - RNA, 22 nt, Human
uaaggagaggaagggagggaug

SEQ ID NO: 13756 - RNA, 24 nt, Human
uaaggauaggccccaaauguggac

SEQ ID NO: 13757 - RNA, 24 nt, Human
uaaggcaggcggccgaauuugggg

SEQ ID NO: 13758 - RNA, 23 nt, Human
uaagggccugguuaagcaagcgg

SEQ ID NO: 13759 - RNA, 24 nt, Human
uaagguauccgcuucaaggccucc

SEQ ID NO: 13760 - RNA, 22 nt, Human
uaaggugcaucuagugcaguua

SEQ ID NO: 13761 - RNA, 24 nt, Human
uaaguaacauuaacacaauguuga

SEQ ID NO: 13762 - RNA, 24 nt, Human
uaaguagcaucugggaagaggaga

SEQ ID NO: 13763 - RNA, 24 nt, Human
uaagucaugacuguuaucacaggg

SEQ ID NO: 13764 - RNA, 24 nt, Human
uaaguccugauggaggcuuucuga

SEQ ID NO: 13765 - RNA, 24 nt, Human
uaagucgucuucugaccggucaag

SEQ ID NO: 13766 - RNA, 24 nt, Human
uaagucuggguucuacucccaaag

SEQ ID NO: 13767 - RNA, 24 nt, Human
uaagucuuuagccuucccaaguuu

SEQ ID NO: 13768 - RNA, 24 nt, Human
uaagugaaguauuuuucaaagaau

SEQ ID NO: 13769 - RNA, 24 nt, Human
uaagugacaaugcuuauggaaagc

SEQ ID NO: 13770 - RNA, 24 nt, Human
uaagugcuccaaggagguggccac

SEQ ID NO: 13771 - RNA, 22 nt, Human
uaagugcugcugauuuuggaaa

SEQ ID NO: 13772 - RNA, 22 nt, Human
uaaguguacuugccaucuguag

SEQ ID NO: 13773 - RNA, 24 nt, Human
uaaguguccacuuucuuuauccca

SEQ ID NO: 13774 - RNA, 24 nt, Human
uaaguuagacuaugauacuuaguu

SEQ ID NO: 13775 - RNA, 24 nt, Human
uaaguugacuauaucccaacagca

SEQ ID NO: 13776 - RNA, 24 nt, Human
uaaguuuaauguuaauuccaugcu

SEQ ID NO: 13777 - RNA, 24 nt, Human
uaaguuuguuuuggaaaguugagc

SEQ ID NO: 13778 - RNA, 24 nt, Human
uaauaaggauauuuugcuccagca

SEQ ID NO: 13779 - RNA, 24 nt, Human
uaauacacccguuuugccucgugc

SEQ ID NO: 13780 - RNA, 24 nt, Human
uaauacgagagguaaucagauggu

SEQ ID NO: 13781 - RNA, 22 nt, Human
uaauacugccggguaaugaugg

SEQ ID NO: 13782 - RNA, 23 nt, Human
uaauagcguguauagugcaucuc

SEQ ID NO: 13783 - RNA, 24 nt, Human
uaauaugcucaaaaauggaggaaa

SEQ ID NO: 13784 - RNA, 24 nt, Human
uaauaugucucauccucggccuug

SEQ ID NO: 13785 - RNA, 24 nt, Human
uaaugcaacaaaaauacagcauca

SEQ ID NO: 13786 - RNA, 24 nt, Human
uaaugccaacugaagaaaauauug

SEQ ID NO: 13787 - RNA, 24 nt, Human
uaaugcuagcagguuaaaaucaau

SEQ ID NO: 13788 - RNA, 24 nt, Human
uaauggaagaacagaguauuuuaa

SEQ ID NO: 13789 - RNA, 24 nt, Human
uaauggaguuaguguccagucagc

SEQ ID NO: 13790 - RNA, 24 nt, Human
uaauggccagcucuccacgcugcu

SEQ ID NO: 13791 - RNA, 24 nt, Human
uaaugggcguuuucacaugcacau

SEQ ID NO: 13792 - RNA, 24 nt, Human
uaaugguuuaauuuuauguggacg

SEQ ID NO: 13793 - RNA, 24 nt, Human
uaauguacagaacuaaauuuuuua

SEQ ID NO: 13794 - RNA, 24 nt, Human
uaauguacagcagaaauugggcag

SEQ ID NO: 13795 - RNA, 24 nt, Human
uaauguauugauggaaagggucca

SEQ ID NO: 13796 - RNA, 24 nt, Human
uaauuaaaugugauuuccaucauu

SEQ ID NO: 13797 - RNA, 22 nt, Human
uaauucuuuaugagaggauccu

SEQ ID NO: 13798 - RNA, 24 nt, Human
uaauuuuuaaaauauuuguagaga

SEQ ID NO: 13799 - RNA, 24 nt, Human
uacaaaaagcuccuucuguauugg

SEQ ID NO: 13800 - RNA, 24 nt, Human
uacaaagcuuaaaauucugcauau

SEQ ID NO: 13801 - RNA, 22 nt, Human
uacaaaggaaggcacuguucug

SEQ ID NO: 13802 - RNA, 24 nt, Human
uacaacauuauguucccgaauucc

SEQ ID NO: 13803 - RNA, 24 nt, Human
uacaacccugaagugcuuggauau

SEQ ID NO: 13804 - RNA, 24 nt, Human
uacaacuuauagaaaagguaaagg

SEQ ID NO: 13805 - RNA, 24 nt, Human
uacaagacaggcaagaacaagugg

SEQ ID NO: 13806 - RNA, 24 nt, Human
uacaaggaggccuuucggaaggac

SEQ ID NO: 13807 - RNA, 24 nt, Human
uacaagguuccuuccacugaagca

SEQ ID NO: 13808 - RNA, 20 nt, Human
uacacaggcacauggcuuua

SEQ ID NO: 13809 - RNA, 24 nt, Human
uacacaggugccuaugcaaguaca

SEQ ID NO: 13810 - RNA, 24 nt, Human
uacaccacucccaagaagaacaag

SEQ ID NO: 13811 - RNA, 24 nt, Human
uacaccacucccaagaagaauaag

SEQ ID NO: 13812 - RNA, 24 nt, Human
uacaccauucccaagaagaauaag

SEQ ID NO: 13813 - RNA, 23 nt, Human
uacaccuucuuggcacagcagca

SEQ ID NO: 13814 - RNA, 24 nt, Human
uacacugagcaccacgggguuccu

SEQ ID NO: 13815 - RNA, 24 nt, Human
uacacugccuucauacuugcccug

SEQ ID NO: 13816 - RNA, 24 nt, Human
uacagaacaaagggcgagcucuaa

SEQ ID NO: 13817 - RNA, 24 nt, Human
uacagaagaaaucaauacaauaga

SEQ ID NO: 13818 - RNA, 23 nt, Human
uacagcaaguaagucuugccuuu

SEQ ID NO: 13819 - RNA, 24 nt, Human
uacagcauguuguccagagccaac

SEQ ID NO: 13820 - RNA, 23 nt, Human
uacagcuagguaucucuggagac

SEQ ID NO: 13821 - RNA, 22 nt, Human
uacagcucugcuucuggcucac

SEQ ID NO: 13822 - RNA, 24 nt, Human
uacagcuugaaaagcacuuuuuac

SEQ ID NO: 13823 - RNA, 24 nt, Human
uacagcuuugcacacugacaggag

SEQ ID NO: 13824 - RNA, 24 nt, Human
uacaggagacaaucauuuauguuu

SEQ ID NO: 13825 - RNA, 24 nt, Human
uacaggauguucaguuugcaagga

SEQ ID NO: 13826 - RNA, 24 nt, Human
uacaggccaggcuacacuguucuc

SEQ ID NO: 13827 - RNA, 24 nt, Human
uacagguuagaaaauuugaggcac

SEQ ID NO: 13828 - RNA, 24 nt, Human
uacagguuagggcaauuuggacuu

SEQ ID NO: 13829 - RNA, 24 nt, Human
uacagguugccugauggacagcag

SEQ ID NO: 13830 - RNA, 22 nt, Human
uacaguacaugucccagagcaa

SEQ ID NO: 13831 - RNA, 24 nt, Human
uacaguauaguauaaauacaacuu

SEQ ID NO: 13832 - RNA, 22 nt, Human
uacagucaugacagaaguggaa

SEQ ID NO: 13833 - RNA, 24 nt, Human
uacaugaccaagcgacuaucuuca

SEQ ID NO: 13834 - RNA, 24 nt, Human
uacauggaagaguauauaugggaa

SEQ ID NO: 13835 - RNA, 24 nt, Human
uacauuaagaugaagucaaguguu

SEQ ID NO: 13836 - RNA, 24 nt, Human
uaccaagaaguggaagaagaccaa

SEQ ID NO: 13837 - RNA, 23 nt, Human
uaccacacaaaggcauuggcugc

SEQ ID NO: 13838 - RNA, 24 nt, Human
uaccaccagcaccagcacagcugc

SEQ ID NO: 13839 - RNA, 24 nt, Human
uaccagagcauugugggaaagcag

SEQ ID NO: 13840 - RNA, 24 nt, Human
uaccagcuccagaccuuuguccug

SEQ ID NO: 13841 - RNA, 23 nt, Human
uaccaggggaggaguggagcugc

SEQ ID NO: 13842 - RNA, 24 nt, Human
uaccauacacaugaugaaguugcu

SEQ ID NO: 13843 - RNA, 24 nt, Human
uaccaugccagcaagcucagcauc

SEQ ID NO: 13844 - RNA, 24 nt, Human
uaccauggucuagaagugcacugg

SEQ ID NO: 13845 - RNA, 24 nt, Human
uaccauuucuucaaauucuacugc

SEQ ID NO: 13846 - RNA, 24 nt, Human
uacccaaggcccuuucaauuucua

SEQ ID NO: 13847 - RNA, 24 nt, Human
uaccccaaauacacuugcuaacac

SEQ ID NO: 13848 - RNA, 24 nt, Human
uaccccaaugcuauucucgugaua

SEQ ID NO: 13849 - RNA, 22 nt, Human
uaccccgauagggagggugggg

SEQ ID NO: 13850 - RNA, 24 nt, Human
uacccgaggugaugaucuuggucu

SEQ ID NO: 13851 - RNA, 24 nt, Human
uacccgcaagagccagcuugcucg

SEQ ID NO: 13852 - RNA, 22 nt, Human
uacccguuguuaggggcgcagc

SEQ ID NO: 13853 - RNA, 24 nt, Human
uacccugcacccagaacuuaguag

SEQ ID NO: 13854 - RNA, 24 nt, Human
uacccuguaagguagacuuuaucu

SEQ ID NO: 13855 - RNA, 22 nt, Human
uacccugugacagucauucauc

SEQ ID NO: 13856 - RNA, 21 nt, Human
uacccuguguacaacagcaag

SEQ ID NO: 13857 - RNA, 24 nt, Human
uaccgcauuguuucucagaagcaa

SEQ ID NO: 13858 - RNA, 24 nt, Human
uaccggacgggcugggucuauggu

SEQ ID NO: 13859 - RNA, 24 nt, Human
uaccgggagaagauugagaaggag

SEQ ID NO: 13860 - RNA, 24 nt, Human
uaccgggguagagguccacccggc

SEQ ID NO: 13861 - RNA, 24 nt, Human
uaccguagucuauuuaaagugugc

SEQ ID NO: 13862 - RNA, 21 nt, Human
uaccguguuggccaggcuggu

SEQ ID NO: 13863 - RNA, 24 nt, Human
uaccguuuguaaggcgcuugcgca

SEQ ID NO: 13864 - RNA, 24 nt, Human
uaccuauaauagaauuagaugcuu

SEQ ID NO: 13865 - RNA, 24 nt, Human
uaccucagcguucacaggccugug

SEQ ID NO: 13866 - RNA, 24 nt, Human
uaccuccaccugaguuggaugaua

SEQ ID NO: 13867 - RNA, 24 nt, Human
uaccucgcccacacuggccagcag

SEQ ID NO: 13868 - RNA, 24 nt, Human
uaccuggaagagaggcuggaagcu

SEQ ID NO: 13869 - RNA, 24 nt, Human
uaccuggaccagcccugccuugag

SEQ ID NO: 13870 - RNA, 21 nt, Human
uaccuggccacaguucaagcc

SEQ ID NO: 13871 - RNA, 24 nt, Human
uaccugggcugacguugccuuguc

SEQ ID NO: 13872 - RNA, 24 nt, Human
uaccuggguucaaaccacaugcug

SEQ ID NO: 13873 - RNA, 24 nt, Human
uaccugucacucuagaauguaggc

SEQ ID NO: 13874 - RNA, 24 nt, Human
uaccuuguacaggaccuggcacuu

SEQ ID NO: 13875 - RNA, 19 nt, Human
uaccuugugagcaguuggu

SEQ ID NO: 13876 - RNA, 24 nt, Human
uaccuuguguuuucgagccuauag

SEQ ID NO: 13877 - RNA, 24 nt, Human
uaccuuguuucccaacggguuucc

SEQ ID NO: 13878 - RNA, 24 nt, Human
uacgauguucccaccuggaugccc

SEQ ID NO: 13879 - RNA, 24 nt, Human
uacgcuguacggccuggccugcgc

SEQ ID NO: 13880 - RNA, 22 nt, Human
uacggccuccccauccuggguc

SEQ ID NO: 13881 - RNA, 24 nt, Human
uacuacacauuuaaaggaacuguu

SEQ ID NO: 13882 - RNA, 24 nt, Human
uacuacagaaaauaugcagcuauc

SEQ ID NO: 13883 - RNA, 24 nt, Human
uacuagagcgcaaggcuccuccgg

SEQ ID NO: 13884 - RNA, 24 nt, Human
uacuauggcuguccugugucacau

SEQ ID NO: 13885 - RNA, 24 nt, Human
uacuauguaauccggauccaggau

SEQ ID NO: 13886 - RNA, 24 nt, Human
uacucaagacaauugacgagggag

SEQ ID NO: 13887 - RNA, 24 nt, Human
uacuccagccugggggacaaaagg

SEQ ID NO: 13888 - RNA, 24 nt, Human
uacucuaguucaacaaagaguuau

SEQ ID NO: 13889 - RNA, 24 nt, Human
uacugauugagcuaaagaagaaaa

SEQ ID NO: 13890 - RNA, 22 nt, Human
uacugcaacuuccagcuccugg

SEQ ID NO: 13891 - RNA, 24 nt, Human
uacugcacugcagccugguacaaa

SEQ ID NO: 13892 - RNA, 18 nt, Human
uacugcauguuuacauaa

SEQ ID NO: 13893 - RNA, 24 nt, Human
uacugcgagcaguucuuccaauuc

SEQ ID NO: 13894 - RNA, 24 nt, Human
uacugcuccugaaaaaugcucaag

SEQ ID NO: 13895 - RNA, 24 nt, Human
uacugggaguggccugcagugcca

SEQ ID NO: 13896 - RNA, 24 nt, Human
uacugggauuuuuguauuauucug

SEQ ID NO: 13897 - RNA, 24 nt, Human
uacugggcugauuuuggacagugg

SEQ ID NO: 13898 - RNA, 24 nt, Human
uacugguguucuccuggccucaau

SEQ ID NO: 13899 - RNA, 24 nt, Human
uacuguaacuuugaucaugucugu

SEQ ID NO: 13900 - RNA, 24 nt, Human
uacuguagacaaauguaaauaaag

SEQ ID NO: 13901 - RNA, 20 nt, Human
uacuguggaccucacucagg

SEQ ID NO: 13902 - RNA, 22 nt, Human
uacuuacagaaggaagcaauug

SEQ ID NO: 13903 - RNA, 24 nt, Human
uacuucaguuauggacagaaagaa

SEQ ID NO: 13904 - RNA, 24 nt, Human
uacuucucgaaauucuuaagaggu

SEQ ID NO: 13905 - RNA, 24 nt, Human
uacuuuagcuuacuaacuuccaca

SEQ ID NO: 13906 - RNA, 24 nt, Human
uacuuugaaaggcucuacaaaguu

SEQ ID NO: 13907 - RNA, 24 nt, Human
uacuuugacuuugguuugcugcug

SEQ ID NO: 13908 - RNA, 24 nt, Human
uacuuuugcuuuuuauagugauua

SEQ ID NO: 13909 - RNA, 24 nt, Human
uacuuuuuucggaguuagggaggg

SEQ ID NO: 13910 - RNA, 24 nt, Human
uagaaaguguucguccauucggaa

SEQ ID NO: 13911 - RNA, 24 nt, Human
uagaacacaguuaugggucgcaag

SEQ ID NO: 13912 - RNA, 22 nt, Human
uagaacuguggcagugacuggc

SEQ ID NO: 13913 - RNA, 24 nt, Human
uagaagauaaaaggcauucuguau

SEQ ID NO: 13914 - RNA, 24 nt, Human
uagaagcauuugcgguggacaaug

SEQ ID NO: 13915 - RNA, 24 nt, Human
uagaagcugcagcaaguucuccac

SEQ ID NO: 13916 - RNA, 24 nt, Human
uagaaggcuggagucuaaauuggg

SEQ ID NO: 13917 - RNA, 24 nt, Human
uagaaguaguauguuauuccuggu

SEQ ID NO: 13918 - RNA, 24 nt, Human
uagaaguauacgugugugucucca

SEQ ID NO: 13919 - RNA, 22 nt, Human
uagaagugaaccaggcugggag

SEQ ID NO: 13920 - RNA, 21 nt, Human
uagaauaacacugcuguagac

SEQ ID NO: 13921 - RNA, 24 nt, Human
uagaauacugucucgaaauguacu

SEQ ID NO: 13922 - RNA, 24 nt, Human
uagaaugcuguaaaaacuguuagg

SEQ ID NO: 13923 - RNA, 24 nt, Human
uagaauguguaaggcucuugccag

SEQ ID NO: 13924 - RNA, 22 nt, Human
uagaauuagucaccaggcaaag

SEQ ID NO: 13925 - RNA, 24 nt, Human
uagaauuuauaaagaagacucagu

SEQ ID NO: 13926 - RNA, 24 nt, Human
uagaauuuccauugagacaauuga

SEQ ID NO: 13927 - RNA, 20 nt, Human
uagacuccaguuauaacuga

SEQ ID NO: 13928 - RNA, 22 nt, Human
uagacuugaucacaucauuaac

SEQ ID NO: 13929 - RNA, 24 nt, Human
uagagcacauagguucuuuggaga

SEQ ID NO: 13930 - RNA, 24 nt, Human
uagaggauuauacagaugaugauu

SEQ ID NO: 13931 - RNA, 24 nt, Human
uagagugagacucaggcucaaaaa

SEQ ID NO: 13932 - RNA, 22 nt, Human
uagaguuauaugaugugcuagu

SEQ ID NO: 13933 - RNA, 24 nt, Human
uagaucauguuaaauuagcgaaug

SEQ ID NO: 13934 - RNA, 24 nt, Human
uagaugaucuuacuuucuugaaag

SEQ ID NO: 13935 - RNA, 24 nt, Human
uagaugcagacagugaggauggag

SEQ ID NO: 13936 - RNA, 24 nt, Human
uagauucgggcaaguccaccacua

SEQ ID NO: 13937 - RNA, 24 nt, Human
uagcaaaggugcaucugucauccg

SEQ ID NO: 13938 - RNA, 21 nt, Human
uagcaccuggaauucccuggu

SEQ ID NO: 13939 - RNA, 22 nt, Human
uagcagaaggacagguuccucg

SEQ ID NO: 13940 - RNA, 24 nt, Human
uagcagagugugagggcacugagg

SEQ ID NO: 13941 - RNA, 24 nt, Human
uagcagcaagguugaaaagguuaa

SEQ ID NO: 13942 - RNA, 22 nt, Human
uagcagcacauaaugguuugaa

SEQ ID NO: 13943 - RNA, 24 nt, Human
uagcagcagacuaaucugaagaaa

SEQ ID NO: 13944 - RNA, 24 nt, Human
uagcagcagaucuguaguuuguau

SEQ ID NO: 13945 - RNA, 24 nt, Human
uagcagcauuaggucuauaggugg

SEQ ID NO: 13946 - RNA, 24 nt, Human
uagcaggcuuccugcagacuguau

SEQ ID NO: 13947 - RNA, 24 nt, Human
uagcagguccaccggccccuacau

SEQ ID NO: 13948 - RNA, 24 nt, Human
uagcaguaauuuaucagaggucac

SEQ ID NO: 13949 - RNA, 21 nt, Human
uagcaguagauuacuaagcuc

SEQ ID NO: 13950 - RNA, 24 nt, Human
uagcaguaugagaaugaacuaaca

SEQ ID NO: 13951 - RNA, 24 nt, Human
uagcauaauagaaaaguggagaau

SEQ ID NO: 13952 - RNA, 23 nt, Human
uagcauaucaggucucauuaugc

SEQ ID NO: 13953 - RNA, 24 nt, Human
uagcaugaugcuuccagcuuuauu

SEQ ID NO: 13954 - RNA, 24 nt, Human
uagcaugccacuaaaagaggcaga

SEQ ID NO: 13955 - RNA, 24 nt, Human
uagcauggauguaugcaucucuug

SEQ ID NO: 13956 - RNA, 21 nt, Human
uagcauguggaucucgagcuc

SEQ ID NO: 13957 - RNA, 24 nt, Human
uagcauucaguguaccauaccuau

SEQ ID NO: 13958 - RNA, 24 nt, Human
uagcauuccaccacaugaauacac

SEQ ID NO: 13959 - RNA, 22 nt, Human
uagcauuucacugaucuucacu

SEQ ID NO: 13960 - RNA, 22 nt, Human
uagcgcauugugaaauugguuu

SEQ ID NO: 13961 - RNA, 24 nt, Human
uagcgugggauacacgggugcacg

SEQ ID NO: 13962 - RNA, 22 nt, Human
uagcucauuuuugaaaucaguu

SEQ ID NO: 13963 - RNA, 24 nt, Human
uagcuccauuuaacaccagccaug

SEQ ID NO: 13964 - RNA, 24 nt, Human
uagcugaaaagaacgcuagaccaa

SEQ ID NO: 13965 - RNA, 24 nt, Human
uagcugcugauuguacuagagcag

SEQ ID NO: 13966 - RNA, 24 nt, Human
uagcuguaaacugaaaacaauauu

SEQ ID NO: 13967 - RNA, 24 nt, Human
uagcugucggcugucugagagcac

SEQ ID NO: 13968 - RNA, 22 nt, Human
uagcuuaucagacugauguuga

SEQ ID NO: 13969 - RNA, 24 nt, Human
uagcuucauuauuagauuguuuca

SEQ ID NO: 13970 - RNA, 24 nt, Human
uagcuuccugucucaggcuuucua

SEQ ID NO: 13971 - RNA, 24 nt, Human
uagcuucuggccugagcuuggccu

SEQ ID NO: 13972 - RNA, 24 nt, Human
uagcuuuaacugugacgggugucg

SEQ ID NO: 13973 - RNA, 22 nt, Human
uagcuuuaagguggagaggggu

SEQ ID NO: 13974 - RNA, 22 nt, Human
uaggaaauccacugcagaauga

SEQ ID NO: 13975 - RNA, 24 nt, Human
uaggaccccuccaaauagguuuug

SEQ ID NO: 13976 - RNA, 24 nt, Human
uaggagaacguaggguagucaagc

SEQ ID NO: 13977 - RNA, 24 nt, Human
uaggagccgauggaucuguggucc

SEQ ID NO: 13978 - RNA, 24 nt, Human
uaggagggcaggcucuucacuccc

SEQ ID NO: 13979 - RNA, 24 nt, Human
uaggauaauaguggagagaagguc

SEQ ID NO: 13980 - RNA, 24 nt, Human
uaggaucccaaacaucgcugccgc

SEQ ID NO: 13981 - RNA, 24 nt, Human
uaggaugaugauuaauaagaggga

SEQ ID NO: 13982 - RNA, 24 nt, Human
uaggaugguuccugggcugauuga

SEQ ID NO: 13983 - RNA, 24 nt, Human
uaggauguccucauaugggcuuag

SEQ ID NO: 13984 - RNA, 24 nt, Human
uaggauguuugggagcauaauccg

SEQ ID NO: 13985 - RNA, 24 nt, Human
uaggauugguaucaauucuccuuu

SEQ ID NO: 13986 - RNA, 22 nt, Human
uaggcaaucagauguucacaca

SEQ ID NO: 13987 - RNA, 22 nt, Human
uaggcaguugcucaagccagug

SEQ ID NO: 13988 - RNA, 24 nt, Human
uaggggcagucgaaagggcuuggg

SEQ ID NO: 13989 - RNA, 22 nt, Human
uagggggucaccuaugugggag

SEQ ID NO: 13990 - RNA, 24 nt, Human
uaggggguuccuggugagggcuca

SEQ ID NO: 13991 - RNA, 24 nt, Human
uaggguggugggaacaggcccuac

SEQ ID NO: 13992 - RNA, 22 nt, Human
uagguaguuuccuguuguuggg

SEQ ID NO: 13993 - RNA, 23 nt, Human
uaggucccgagguggagucgggg

SEQ ID NO: 13994 - RNA, 24 nt, Human
uaggucccgagguggagucggggg

SEQ ID NO: 13995 - RNA, 24 nt, Human
uaggugacugcaggacugcagcau

SEQ ID NO: 13996 - RNA, 20 nt, Human
uaggugguuauguuccaccc

SEQ ID NO: 13997 - RNA, 22 nt, Human
uagguuaguuucaaguauuggc

SEQ ID NO: 13998 - RNA, 21 nt, Human
uagguucaaacagaguauggc

SEQ ID NO: 13999 - RNA, 24 nt, Human
uagguuccaugauucugaugcagu

SEQ ID NO: 14000 - RNA, 24 nt, Human
uaguacaccacuacagacacauaa

SEQ ID NO: 14001 - RNA, 22 nt, Human
uaguagugucuuacugguuuuu

SEQ ID NO: 14002 - RNA, 23 nt, Human
uaguauacagacauucugcucuu

SEQ ID NO: 14003 - RNA, 23 nt, Human
uaguauguacaggauguacuggu

SEQ ID NO: 14004 - RNA, 24 nt, Human
uaguauucucaaauaagguccuga

SEQ ID NO: 14005 - RNA, 22 nt, Human
uagucguacuucuucucggucu

SEQ ID NO: 14006 - RNA, 24 nt, Human
uagucugcacaauucaauaugaac

SEQ ID NO: 14007 - RNA, 24 nt, Human
uagucugcugggccugcuccucca

SEQ ID NO: 14008 - RNA, 24 nt, Human
uagugcacuuugagcgagggcggc

SEQ ID NO: 14009 - RNA, 24 nt, Human
uagugcuauaaauuucccucuaca

SEQ ID NO: 14010 - RNA, 23 nt, Human
uaguggccccaaaugucuggcug

SEQ ID NO: 14011 - RNA, 24 nt, Human
uagugugcaucaggcaagaugagc

SEQ ID NO: 14012 - RNA, 24 nt, Human
uagugugucuaaaacaaggagguu

SEQ ID NO: 14013 - RNA, 24 nt, Human
uaguucacuuguuuuuccucuuug

SEQ ID NO: 14014 - RNA, 24 nt, Human
uauaaaaguauuacacaauucugu

SEQ ID NO: 14015 - RNA, 22 nt, Human
uauaacagccagcuuggauuca

SEQ ID NO: 14016 - RNA, 24 nt, Human
uauaacauguaugcuuuucagaau

SEQ ID NO: 14017 - RNA, 24 nt, Human
uauaaggcuaaauguguuuauucu

SEQ ID NO: 14018 - RNA, 24 nt, Human
uauaauauauucuaaacacaauga

SEQ ID NO: 14019 - RNA, 22 nt, Human
uauacugcucuuagccagaguc

SEQ ID NO: 14020 - RNA, 24 nt, Human
uauacuguugcuauguuuggauac

SEQ ID NO: 14021 - RNA, 24 nt, Human
uauagaauuuccagauuucuugcc

SEQ ID NO: 14022 - RNA, 22 nt, Human
uauagacaaggggucugaaaac

SEQ ID NO: 14023 - RNA, 22 nt, Human
uauagcagugcuagcucugucu

SEQ ID NO: 14024 - RNA, 24 nt, Human
uauagggcuccugcaucccucugg

SEQ ID NO: 14025 - RNA, 24 nt, Human
uauaguacuaccaauguuggugac

SEQ ID NO: 14026 - RNA, 24 nt, Human
uauagucuccuaacauuugucucu

SEQ ID NO: 14027 - RNA, 24 nt, Human
uauauaauauaauuacauauauau

SEQ ID NO: 14028 - RNA, 24 nt, Human
uauauagauguauauauauacaca

SEQ ID NO: 14029 - RNA, 24 nt, Human
uauauauuuacggggucuaugaga

SEQ ID NO: 14030 - RNA, 24 nt, Human
uauaugaugaaaagaauugagaag

SEQ ID NO: 14031 - RNA, 24 nt, Human
uauauguauacacauacuuacaua

SEQ ID NO: 14032 - RNA, 22 nt, Human
uauaugucugguauucuugggg

SEQ ID NO: 14033 - RNA, 24 nt, Human
uaucaacuauguuuuuucagucua

SEQ ID NO: 14034 - RNA, 24 nt, Human
uaucaagaaagggcuucaccagga

SEQ ID NO: 14035 - RNA, 24 nt, Human
uaucaagcacuugcgacagcugaa

SEQ ID NO: 14036 - RNA, 24 nt, Human
uaucaaggaagggcaggcgugaug

SEQ ID NO: 14037 - RNA, 24 nt, Human
uaucaagugccucauuaaauuugu

SEQ ID NO: 14038 - RNA, 23 nt, Human
uaucacagaagcauggggugacc

SEQ ID NO: 14039 - RNA, 22 nt, Human
uaucacagacuggauuuaguua

SEQ ID NO: 14040 - RNA, 24 nt, Human
uaucacagaugaacaaauccagga

SEQ ID NO: 14041 - RNA, 24 nt, Human
uaucacaguguuauucuucuucau

SEQ ID NO: 14042 - RNA, 24 nt, Human
uaucagagacuguuauccauuugu

SEQ ID NO: 14043 - RNA, 24 nt, Human
uaucaggucuguugguuucuacua

SEQ ID NO: 14044 - RNA, 24 nt, Human
uaucaguagauccuuccacugggu

SEQ ID NO: 14045 - RNA, 24 nt, Human
uaucauuuauggaggcucugugac

SEQ ID NO: 14046 - RNA, 22 nt, Human
uauccaaaugaaugccguccca

SEQ ID NO: 14047 - RNA, 24 nt, Human
uauccagggguuguguguccccau

SEQ ID NO: 14048 - RNA, 24 nt, Human
uauccaguguagcaaauaacagua

SEQ ID NO: 14049 - RNA, 24 nt, Human
uauccauuagacauugagugagaa

SEQ ID NO: 14050 - RNA, 22 nt, Human
uaucccagauguuuugauaggu

SEQ ID NO: 14051 - RNA, 24 nt, Human
uauccuaagaucagcugggcaugg

SEQ ID NO: 14052 - RNA, 24 nt, Human
uauccuagaaggacucacauucua

SEQ ID NO: 14053 - RNA, 24 nt, Human
uauccucauugauccauuccauaa

SEQ ID NO: 14054 - RNA, 24 nt, Human
uauccucucuuaugaacaacugua

SEQ ID NO: 14055 - RNA, 24 nt, Human
uauccuggcuagugauuuucucau

SEQ ID NO: 14056 - RNA, 24 nt, Human
uaucuaaggauuauucugcugaag

SEQ ID NO: 14057 - RNA, 24 nt, Human
uaucugcugcgccugagaugagua

SEQ ID NO: 14058 - RNA, 24 nt, Human
uaucuuaugauuucuuaaggagau

SEQ ID NO: 14059 - RNA, 24 nt, Human
uaucuuauugucacaaaguuguuc

SEQ ID NO: 14060 - RNA, 20 nt, Human
uaugaacuggguccucucua

SEQ ID NO: 14061 - RNA, 21 nt, Human
uaugacaucucaugcugaccc

SEQ ID NO: 14062 - RNA, 24 nt, Human
uaugacauuuuauuuucacuuaug

SEQ ID NO: 14063 - RNA, 24 nt, Human
uaugagaacauuucuaccucugga

SEQ ID NO: 14064 - RNA, 24 nt, Human
uaugaggcccuagagcuccgggac

SEQ ID NO: 14065 - RNA, 22 nt, Human
uaugauacucuggggaggaacc

SEQ ID NO: 14066 - RNA, 24 nt, Human
uaugauagauguggccgucuugua

SEQ ID NO: 14067 - RNA, 24 nt, Human
uaugaucagauuuaccauuuuuag

SEQ ID NO: 14068 - RNA, 24 nt, Human
uaugaucucaacuguuuuugugac

SEQ ID NO: 14069 - RNA, 24 nt, Human
uaugaugccaacauuacucaaagc

SEQ ID NO: 14070 - RNA, 24 nt, Human
uaugauguaacagugggaauguaa

SEQ ID NO: 14071 - RNA, 24 nt, Human
uaugcaacuauauuucauguugua

SEQ ID NO: 14072 - RNA, 24 nt, Human
uaugcaggccaucaaguguguggu

SEQ ID NO: 14073 - RNA, 24 nt, Human
uaugcaggcgcugggggccuggcc

SEQ ID NO: 14074 - RNA, 24 nt, Human
uaugcauuuguuauuuauauugaa

SEQ ID NO: 14075 - RNA, 24 nt, Human
uaugccaaguacaggcacugcuca

SEQ ID NO: 14076 - RNA, 24 nt, Human
uaugccagcuggagcgacugugcu

SEQ ID NO: 14077 - RNA, 22 nt, Human
uaugcuagaauuggacugccau

SEQ ID NO: 14078 - RNA, 22 nt, Human
uaugcuggggccgugucgaugu

SEQ ID NO: 14079 - RNA, 24 nt, Human
uaugcugucugucaguguacagua

SEQ ID NO: 14080 - RNA, 22 nt, Human
uauggaagcuguagcauuucug

SEQ ID NO: 14081 - RNA, 24 nt, Human
uauggagcaaagaaacuggugucc

SEQ ID NO: 14082 - RNA, 24 nt, Human
uauggaguuuucaacauggggucu

SEQ ID NO: 14083 - RNA, 24 nt, Human
uauggcaacaggccauucugggcc

SEQ ID NO: 14084 - RNA, 24 nt, Human
uauggcaagucacuugacagacau

SEQ ID NO: 14085 - RNA, 22 nt, Human
uauggcaucguuggauuucaga

SEQ ID NO: 14086 - RNA, 24 nt, Human
uaugggcauaccuuuaagaauuag

SEQ ID NO: 14087 - RNA, 24 nt, Human
uauggggaagggugucucaaaggc

SEQ ID NO: 14088 - RNA, 24 nt, Human
uauggugggaaggggcacacgggu

SEQ ID NO: 14089 - RNA, 24 nt, Human
uauggugguggcagggguggcugu

SEQ ID NO: 14090 - RNA, 24 nt, Human
uauguagagaaaauugcaugacuu

SEQ ID NO: 14091 - RNA, 22 nt, Human
uaugugagacacuguccuaggc

SEQ ID NO: 14092 - RNA, 24 nt, Human
uaugugaugaaaaaguauagcuuu

SEQ ID NO: 14093 - RNA, 24 nt, Human
uauguugcccaggcugguccugaa

SEQ ID NO: 14094 - RNA, 24 nt, Human
uauuaaggagcucauuaauuuugg

SEQ ID NO: 14095 - RNA, 24 nt, Human
uauuacacuggaggaucacaaacu

SEQ ID NO: 14096 - RNA, 22 nt, Human
uauuacauucauuuugaugguu

SEQ ID NO: 14097 - RNA, 24 nt, Human
uauuacccuucagcaccugagucc

SEQ ID NO: 14098 - RNA, 24 nt, Human
uauuacuggcaucuucaaucuggu

SEQ ID NO: 14099 - RNA, 24 nt, Human
uauuagggagugagggagcacaaa

SEQ ID NO: 14100 - RNA, 22 nt, Human
uauuaguugauuccaagggacc

SEQ ID NO: 14101 - RNA, 24 nt, Human
uauucauguaaagugauuaucaca

SEQ ID NO: 14102 - RNA, 22 nt, Human
uauuccucuuuaaugccuuuuu

SEQ ID NO: 14103 - RNA, 24 nt, Human
uauugaagguacuggucugugcug

SEQ ID NO: 14104 - RNA, 22 nt, Human
uauugaucugucccagccugug

SEQ ID NO: 14105 - RNA, 22 nt, Human
uauugcacuccagccugggcaa

SEQ ID NO: 14106 - RNA, 24 nt, Human
uauugcauuaaaaaugauaccuaa

SEQ ID NO: 14107 - RNA, 22 nt, Human
uauugcuaagaauucagguagu

SEQ ID NO: 14108 - RNA, 24 nt, Human
uauugcucucuaaacuuuguuccu

SEQ ID NO: 14109 - RNA, 24 nt, Human
uauuggacuuuccaucugucagaa

SEQ ID NO: 14110 - RNA, 24 nt, Human
uauuggcacuaguauaaaacagag

SEQ ID NO: 14111 - RNA, 24 nt, Human
uauuguagagcuuauuccuuccuc

SEQ ID NO: 14112 - RNA, 24 nt, Human
uauuguauugaugaugguuauucu

SEQ ID NO: 14113 - RNA, 24 nt, Human
uauugugcaccauauggaaguacu

SEQ ID NO: 14114 - RNA, 24 nt, Human
uauuguguaaaguuuauagaagua

SEQ ID NO: 14115 - RNA, 24 nt, Human
uauuguuuguguuucuguguuuca

SEQ ID NO: 14116 - RNA, 22 nt, Human
uauuucuuguuggcuuaguuug

SEQ ID NO: 14117 - RNA, 22 nt, Human
uauuugguccaaccccugcuuu

SEQ ID NO: 14118 - RNA, 24 nt, Human
uauuugguuuuggcuuuagcugau

SEQ ID NO: 14119 - RNA, 24 nt, Human
uauuuuaacaucugaaaucagaaa

SEQ ID NO: 14120 - RNA, 24 nt, Human
uauuuuacuaugauaguugagaaa

SEQ ID NO: 14121 - RNA, 24 nt, Human
uauuuuauacacucuaugcugagu

SEQ ID NO: 14122 - RNA, 24 nt, Human
uauuuuaucacaggcuuacacuac

SEQ ID NO: 14123 - RNA, 24 nt, Human
uauuuuauugcccgaggugggggu

SEQ ID NO: 14124 - RNA, 24 nt, Human
uauuuuccuuucuggacuuccaag

SEQ ID NO: 14125 - RNA, 24 nt, Human
uauuuuguauuuuuaguagagaca

SEQ ID NO: 14126 - RNA, 24 nt, Human
uauuuugucuucauggaauauauc

SEQ ID NO: 14127 - RNA, 24 nt, Human
ucaaacagacggacucugcaaggc

SEQ ID NO: 14128 - RNA, 24 nt, Human
ucaaacgaaaacccacaggagacc

SEQ ID NO: 14129 - RNA, 24 nt, Human
ucaaagcaggaagaguccaaagcu

SEQ ID NO: 14130 - RNA, 24 nt, Human
ucaacacaaaccauccugugcauc

SEQ ID NO: 14131 - RNA, 24 nt, Human
ucaacauacauggucucaucaucc

SEQ ID NO: 14132 - RNA, 24 nt, Human
ucaagaccaugaccaucucuucua

SEQ ID NO: 14133 - RNA, 22 nt, Human
ucaagcaacuacugucaagugg

SEQ ID NO: 14134 - RNA, 22 nt, Human
ucaagcaauccuccugcuucug

SEQ ID NO: 14135 - RNA, 24 nt, Human
ucaagcacuuuucuguagaagguc

SEQ ID NO: 14136 - RNA, 22 nt, Human
ucaagcucauuccucuaaccuc

SEQ ID NO: 14137 - RNA, 24 nt, Human
ucaagcuuugggaggcugaggcug

SEQ ID NO: 14138 - RNA, 24 nt, Human
ucaaguacauucccagucguggcc

SEQ ID NO: 14139 - RNA, 24 nt, Human
ucaaugcugccauugccaccauca

SEQ ID NO: 14140 - RNA, 22 nt, Human
ucacaacccucauauguuaaau

SEQ ID NO: 14141 - RNA, 22 nt, Human
ucacaaccugcugauaugcugu

SEQ ID NO: 14142 - RNA, 22 nt, Human
ucacaaggagaaucuggaauuu

SEQ ID NO: 14143 - RNA, 24 nt, Human
ucacaaggcugccaagugccuguu

SEQ ID NO: 14144 - RNA, 24 nt, Human
ucacaagggccggcacuucugcag

SEQ ID NO: 14145 - RNA, 24 nt, Human
ucacacuggcaggcgguggcucag

SEQ ID NO: 14146 - RNA, 24 nt, Human
ucacacugguuucucgugcccacc

SEQ ID NO: 14147 - RNA, 24 nt, Human
ucacagcaacugggggaauaucgg

SEQ ID NO: 14148 - RNA, 24 nt, Human
ucacaggcaggcccggcugcacaa

SEQ ID NO: 14149 - RNA, 24 nt, Human
ucacaggcuagccuuucugcacug

SEQ ID NO: 14150 - RNA, 23 nt, Human
ucacaggggaagcugugguacgu

SEQ ID NO: 14151 - RNA, 18 nt, Human
ucacaguggaauucgucc

SEQ ID NO: 14152 - RNA, 22 nt, Human
ucacaguggccucaagugugau

SEQ ID NO: 14153 - RNA, 24 nt, Human
ucacaucguuguuggggaugacgg

SEQ ID NO: 14154 - RNA, 24 nt, Human
ucacauuguaguagggagguuggg

SEQ ID NO: 14155 - RNA, 22 nt, Human
ucaccaccuacuugaguguuga

SEQ ID NO: 14156 - RNA, 24 nt, Human
ucaccaguaauaguggcauuggau

SEQ ID NO: 14157 - RNA, 24 nt, Human
ucaccaguaucuuuuuucugaagg

SEQ ID NO: 14158 - RNA, 22 nt, Human
ucacccaggcuggagugcagug

SEQ ID NO: 14159 - RNA, 22 nt, Human
ucacccaguguaaacagcauga

SEQ ID NO: 14160 - RNA, 24 nt, Human
ucacccgcgccaagccugacagca

SEQ ID NO: 14161 - RNA, 24 nt, Human
ucaccggaggaauaauuuaugaug

SEQ ID NO: 14162 - RNA, 22 nt, Human
ucaccguguuagccgggauggu

SEQ ID NO: 14163 - RNA, 22 nt, Human
ucaccuaggcuggagugcagug

SEQ ID NO: 14164 - RNA, 24 nt, Human
ucaccugaaugcuguggaguccga

SEQ ID NO: 14165 - RNA, 24 nt, Human
ucacgguguaagaagggagaggau

SEQ ID NO: 14166 - RNA, 24 nt, Human
ucacgugauguuucccaggcacug

SEQ ID NO: 14167 - RNA, 24 nt, Human
ucacuagaugcccaugguccaggc

SEQ ID NO: 14168 - RNA, 24 nt, Human
ucacucaauuuaucaguaauggag

SEQ ID NO: 14169 - RNA, 22 nt, Human
ucacucaccuccuuagugaaga

SEQ ID NO: 14170 - RNA, 24 nt, Human
ucacucaggagcauguuauucaau

SEQ ID NO: 14171 - RNA, 24 nt, Human
ucacucuccacccuucccuucugc

SEQ ID NO: 14172 - RNA, 20 nt, Human
ucacucuggcuguccaagcc

SEQ ID NO: 14173 - RNA, 24 nt, Human
ucacugauguuggagcugggcucu

SEQ ID NO: 14174 - RNA, 22 nt, Human
ucacugcaaccuccaccucccg

SEQ ID NO: 14175 - RNA, 24 nt, Human
ucacugcaaccuccaccucccggg

SEQ ID NO: 14176 - RNA, 24 nt, Human
ucacugcaaccuccaccuccuggg

SEQ ID NO: 14177 - RNA, 22 nt, Human
ucacugcaaccuccgccuccca

SEQ ID NO: 14178 - RNA, 22 nt, Human
ucacugcaaccucugccuccca

SEQ ID NO: 14179 - RNA, 22 nt, Human
ucacugcaaccucugccucccg

SEQ ID NO: 14180 - RNA, 22 nt, Human
ucacugcaaccucugccuuccg

SEQ ID NO: 14181 - RNA, 22 nt, Human
ucacugcaaccucugcuucugg

SEQ ID NO: 14182 - RNA, 22 nt, Human
ucacugcaaucucugccugccg

SEQ ID NO: 14183 - RNA, 24 nt, Human
ucacugcacuccagccugggauac

SEQ ID NO: 14184 - RNA, 24 nt, Human
ucacugcagccuugaacuccuggg

SEQ ID NO: 14185 - RNA, 24 nt, Human
ucacugccaccagaagacugugga

SEQ ID NO: 14186 - RNA, 24 nt, Human
ucacugcccucaggcuuggccugu

SEQ ID NO: 14187 - RNA, 24 nt, Human
ucacugccuccugccuuccuuaug

SEQ ID NO: 14188 - RNA, 24 nt, Human
ucacugcggccacaaccuuccagc

SEQ ID NO: 14189 - RNA, 24 nt, Human
ucacuggauaucuugguaugugaa

SEQ ID NO: 14190 - RNA, 24 nt, Human
ucacugggaacgcuuaauggggcc

SEQ ID NO: 14191 - RNA, 24 nt, Human
ucacugggaauugcgaaggggaua

SEQ ID NO: 14192 - RNA, 24 nt, Human
ucacugguaaaaugcuucugaauu

SEQ ID NO: 14193 - RNA, 24 nt, Human
ucacugguugucauucuggguauu

SEQ ID NO: 14194 - RNA, 22 nt, Human
ucacuguuccuuuuuguugaga

SEQ ID NO: 14195 - RNA, 23 nt, Human
ucacuuagucccugcgggugccu

SEQ ID NO: 14196 - RNA, 22 nt, Human
ucacuuuucaaaguuccaaaua

SEQ ID NO: 14197 - RNA, 24 nt, Human
ucagaaaugugaauuccaggaugc

SEQ ID NO: 14198 - RNA, 24 nt, Human
ucagaagaagucaacaggcccaag

SEQ ID NO: 14199 - RNA, 24 nt, Human
ucagaagagucagaugggcuuccc

SEQ ID NO: 14200 - RNA, 24 nt, Human
ucagaaggcacaaagagcuguauu

SEQ ID NO: 14201 - RNA, 24 nt, Human
ucagaaggucuaggugagcuuuuc

SEQ ID NO: 14202 - RNA, 22 nt, Human
ucagaagucuaaggaacagacu

SEQ ID NO: 14203 - RNA, 20 nt, Human
ucagaauguguccuccucau

SEQ ID NO: 14204 - RNA, 18 nt, Human
ucagacccagagguuguc

SEQ ID NO: 14205 - RNA, 24 nt, Human
ucagaccccuugaggcauagaugg

SEQ ID NO: 14206 - RNA, 23 nt, Human
ucagacugcuguuggauuuuaac

SEQ ID NO: 14207 - RNA, 24 nt, Human
ucagagagggggaaguguggacaa

SEQ ID NO: 14208 - RNA, 22 nt, Human
ucagagcaacaggcuauaccag

SEQ ID NO: 14209 - RNA, 24 nt, Human
ucagagcaacggcccaagucuggg

SEQ ID NO: 14210 - RNA, 24 nt, Human
ucagagcagcgacagugaggccgg

SEQ ID NO: 14211 - RNA, 22 nt, Human
ucagagcaggaaggccagcagu

SEQ ID NO: 14212 - RNA, 24 nt, Human
ucagauccagcuuguggaugcucu

SEQ ID NO: 14213 - RNA, 22 nt, Human
ucagauccccagaacaagauuu

SEQ ID NO: 14214 - RNA, 24 nt, Human
ucagcaaugagaauauagcaguga

SEQ ID NO: 14215 - RNA, 24 nt, Human
ucagcacgcgagcgugguggaugg

SEQ ID NO: 14216 - RNA, 24 nt, Human
ucagcagauccuggccuaaugggg

SEQ ID NO: 14217 - RNA, 24 nt, Human
ucagcagcuacauuuucuguuuuu

SEQ ID NO: 14218 - RNA, 22 nt, Human
ucagcagguauuuauugagccc

SEQ ID NO: 14219 - RNA, 24 nt, Human
ucagcauaggcagggucacccaga

SEQ ID NO: 14220 - RNA, 24 nt, Human
ucagccaggguacaagcauucucu

SEQ ID NO: 14221 - RNA, 24 nt, Human
ucagcccauucagcaggaguagga

SEQ ID NO: 14222 - RNA, 23 nt, Human
ucagcccgccagcccgccagcuc

SEQ ID NO: 14223 - RNA, 24 nt, Human
ucagcucaccgcaacaagagcgaa

SEQ ID NO: 14224 - RNA, 24 nt, Human
ucagcucagugaaaccucggccuc

SEQ ID NO: 14225 - RNA, 24 nt, Human
ucagcucgaugacugccugcuuca

SEQ ID NO: 14226 - RNA, 24 nt, Human
ucagcugagcugaguaagggcucc

SEQ ID NO: 14227 - RNA, 24 nt, Human
ucaggaguguggccauguuuucug

SEQ ID NO: 14228 - RNA, 24 nt, Human
ucaggcagauugguauucagcgcu

SEQ ID NO: 14229 - RNA, 22 nt, Human
ucaggcaugacaugugcucccu

SEQ ID NO: 14230 - RNA, 24 nt, Human
ucaggcccaggauguaauccagcu

SEQ ID NO: 14231 - RNA, 24 nt, Human
ucaggcccugcucaagauuccagu

SEQ ID NO: 14232 - RNA, 24 nt, Human
ucagggagggacucagcaaaugau

SEQ ID NO: 14233 - RNA, 24 nt, Human
ucagggcaguguucugcugauggc

SEQ ID NO: 14234 - RNA, 24 nt, Human
ucagggucuucacgaagaucugca

SEQ ID NO: 14235 - RNA, 24 nt, Human
ucagggugaggcaguuaagggucc

SEQ ID NO: 14236 - RNA, 24 nt, Human
ucaggucaggucucucacccagga

SEQ ID NO: 14237 - RNA, 22 nt, Human
ucaguaauucaacaaccuugcu

SEQ ID NO: 14238 - RNA, 24 nt, Human
ucaguacgagugugcgugagugug

SEQ ID NO: 14239 - RNA, 20 nt, Human
ucaguaggccaguccaggug

SEQ ID NO: 14240 - RNA, 24 nt, Human
ucaguaggccuggaaucucuucuc

SEQ ID NO: 14241 - RNA, 24 nt, Human
ucaguaguuaggauucugauuuug

SEQ ID NO: 14242 - RNA, 24 nt, Human
ucagucacacagaaucugcuuugu

SEQ ID NO: 14243 - RNA, 22 nt, Human
ucagucaggaggacagggcccu

SEQ ID NO: 14244 - RNA, 24 nt, Human
ucaguccaguuauauccgcaguau

SEQ ID NO: 14245 - RNA, 24 nt, Human
ucagucccacuccaggcuucaccc

SEQ ID NO: 14246 - RNA, 24 nt, Human
ucagucucaacuccucccacucua

SEQ ID NO: 14247 - RNA, 22 nt, Human
ucagucucuucucucaccuacc

SEQ ID NO: 14248 - RNA, 22 nt, Human
ucagucuuuuugucuauuccug

SEQ ID NO: 14249 - RNA, 18 nt, Human
ucagugaaacacaguagu

SEQ ID NO: 14250 - RNA, 24 nt, Human
ucagugaauauuugcuaagaacag

SEQ ID NO: 14251 - RNA, 24 nt, Human
ucagugagacucuugguggggcgg

SEQ ID NO: 14252 - RNA, 24 nt, Human
ucagugagcgugugggaacugaga

SEQ ID NO: 14253 - RNA, 24 nt, Human
ucagugcacacacugauuuuucac

SEQ ID NO: 14254 - RNA, 24 nt, Human
ucagugcaccauguguuugcuuug

SEQ ID NO: 14255 - RNA, 23 nt, Human
ucagugccccuuuaauuucuggc

SEQ ID NO: 14256 - RNA, 24 nt, Human
ucagugccugauggaguggccggg

SEQ ID NO: 14257 - RNA, 24 nt, Human
ucaguggaaaaccgauggggaacc

SEQ ID NO: 14258 - RNA, 24 nt, Human
ucaguggagaacaggaugcucugu

SEQ ID NO: 14259 - RNA, 22 nt, Human
ucaguugauagcagaugcuguu

SEQ ID NO: 14260 - RNA, 24 nt, Human
ucaguuuuagauuggagcugguau

SEQ ID NO: 14261 - RNA, 22 nt, Human
ucauaaacuggcaagcacuacc

SEQ ID NO: 14262 - RNA, 24 nt, Human
ucauaaggguaguuggggauuucc

SEQ ID NO: 14263 - RNA, 24 nt, Human
ucauacauuuguuauauugucaca

SEQ ID NO: 14264 - RNA, 24 nt, Human
ucauacuuuccuuugauuucccag

SEQ ID NO: 14265 - RNA, 24 nt, Human
ucauagggacaaaccgaggggguu

SEQ ID NO: 14266 - RNA, 24 nt, Human
ucauaguggcaggguggggguggg

SEQ ID NO: 14267 - RNA, 22 nt, Human
ucauaucauuuugaaagcugag

SEQ ID NO: 14268 - RNA, 22 nt, Human
ucauauuuagcucuacauguuu

SEQ ID NO: 14269 - RNA, 24 nt, Human
ucaucaggaaucauuugguuuggg

SEQ ID NO: 14270 - RNA, 22 nt, Human
ucauccugcaugguggaggguc

SEQ ID NO: 14271 - RNA, 22 nt, Human
ucaucuauuaaagugggagaac

SEQ ID NO: 14272 - RNA, 22 nt, Human
ucauguaucacauccagcaagu

SEQ ID NO: 14273 - RNA, 24 nt, Human
ucauugagaggugauuaggggacu

SEQ ID NO: 14274 - RNA, 24 nt, Human
ucauugaggccauccgaagagcca

SEQ ID NO: 14275 - RNA, 24 nt, Human
ucauugauuguguggugagaaucc

SEQ ID NO: 14276 - RNA, 24 nt, Human
ucauugcagucauuauaggauuga

SEQ ID NO: 14277 - RNA, 24 nt, Human
ucauugcucccuuguguuguacua

SEQ ID NO: 14278 - RNA, 24 nt, Human
ucauuggaaguggcaaggggcuuc

SEQ ID NO: 14279 - RNA, 24 nt, Human
ucauuggucgaagaguugaaguua

SEQ ID NO: 14280 - RNA, 24 nt, Human
ucauuuggugggcugauucaucuc

SEQ ID NO: 14281 - RNA, 22 nt, Human
ucauuuucuuucacgcugcugc

SEQ ID NO: 14282 - RNA, 22 nt, Human
uccaaaaguggagaggaauaug

SEQ ID NO: 14283 - RNA, 22 nt, Human
uccaaagacucaacaguuagac

SEQ ID NO: 14284 - RNA, 24 nt, Human
uccaaaggugagaguuggagugag

SEQ ID NO: 14285 - RNA, 24 nt, Human
uccaaauaccagagacugaaauuu

SEQ ID NO: 14286 - RNA, 24 nt, Human
uccaaggcuuccugaaaagcaguc

SEQ ID NO: 14287 - RNA, 24 nt, Human
uccaauaaaagaacucuaugagga

SEQ ID NO: 14288 - RNA, 22 nt, Human
uccaaugcaccaugggugaauu

SEQ ID NO: 14289 - RNA, 24 nt, Human
uccacaauucuagacauuuuccau

SEQ ID NO: 14290 - RNA, 24 nt, Human
uccacagaguuuaguuuccucauu

SEQ ID NO: 14291 - RNA, 24 nt, Human
uccacaggggcuggccguucuggg

SEQ ID NO: 14292 - RNA, 24 nt, Human
uccacagucaugagccuggcuugc

SEQ ID NO: 14293 - RNA, 24 nt, Human
uccacagugucagcuauggccaug

SEQ ID NO: 14294 - RNA, 24 nt, Human
uccacaucagccaucugcuggccc

SEQ ID NO: 14295 - RNA, 22 nt, Human
uccacaugaugaaacccagaug

SEQ ID NO: 14296 - RNA, 19 nt, Human
uccaccagaaaacuugauc

SEQ ID NO: 14297 - RNA, 23 nt, Human
uccaccuggauugcaggcuccag

SEQ ID NO: 14298 - RNA, 24 nt, Human
uccaccuguugacaggacagcagg

SEQ ID NO: 14299 - RNA, 24 nt, Human
uccacgaauugugaauggcuccag

SEQ ID NO: 14300 - RNA, 24 nt, Human
uccacuggcgaaagaugccuuucu

SEQ ID NO: 14301 - RNA, 22 nt, Human
uccacuggguuggaaaccccaa

SEQ ID NO: 14302 - RNA, 24 nt, Human
uccagagguaaagcccauugugug

SEQ ID NO: 14303 - RNA, 24 nt, Human
uccagaguucaguuccuucuggca

SEQ ID NO: 14304 - RNA, 24 nt, Human
uccagcaguucugucagcaaaggg

SEQ ID NO: 14305 - RNA, 22 nt, Human
uccagcuggucaccuuucuccu

SEQ ID NO: 14306 - RNA, 24 nt, Human
uccaggaccucuucucugucaccu

SEQ ID NO: 14307 - RNA, 24 nt, Human
uccaggaugucuacgaaauuggug

SEQ ID NO: 14308 - RNA, 22 nt, Human
uccagggauggcaagucaccgu

SEQ ID NO: 14309 - RNA, 22 nt, Human
uccagggugggccucagacccu

SEQ ID NO: 14310 - RNA, 24 nt, Human
uccagguugaugguuuccaugucc

SEQ ID NO: 14311 - RNA, 21 nt, Human
uccagugaaacaggucucuuu

SEQ ID NO: 14312 - RNA, 24 nt, Human
uccagugucaaucccaaaccccga

SEQ ID NO: 14313 - RNA, 24 nt, Human
uccaucuaaaggcgcugcuugauu

SEQ ID NO: 14314 - RNA, 22 nt, Human
uccaucuacgagauuuuccaga

SEQ ID NO: 14315 - RNA, 24 nt, Human
uccauggcuaaaucaaagcugccc

SEQ ID NO: 14316 - RNA, 22 nt, Human
uccaugggcgagauccaucgac

SEQ ID NO: 14317 - RNA, 24 nt, Human
uccauucuggcucugguggaugga

SEQ ID NO: 14318 - RNA, 24 nt, Human
ucccaaaccacuccucugcucucc

SEQ ID NO: 14319 - RNA, 24 nt, Human
ucccaaguccacacaggggaggug

SEQ ID NO: 14320 - RNA, 24 nt, Human
ucccaauuggaguucugcugguga

SEQ ID NO: 14321 - RNA, 22 nt, Human
ucccacagcuuccuagccacag

SEQ ID NO: 14322 - RNA, 22 nt, Human
ucccacaugcccaccaggagca

SEQ ID NO: 14323 - RNA, 20 nt, Human
ucccacuuaaacacaggccc

SEQ ID NO: 14324 - RNA, 24 nt, Human
ucccagaaucccuugucccucccc

SEQ ID NO: 14325 - RNA, 22 nt, Human
ucccagagaaaguuggucagcu

SEQ ID NO: 14326 - RNA, 19 nt, Human
ucccagagacuguuucucc

SEQ ID NO: 14327 - RNA, 23 nt, Human
ucccagccagcccgggcccuggg

SEQ ID NO: 14328 - RNA, 24 nt, Human
ucccaggccugaugcccacuccuc

SEQ ID NO: 14329 - RNA, 24 nt, Human
ucccaggggaagcccccagcccug

SEQ ID NO: 14330 - RNA, 24 nt, Human
uccccagcagaaaauuugccuuuu

SEQ ID NO: 14331 - RNA, 24 nt, Human
ucccccacauuccaugcaccuccc

SEQ ID NO: 14332 - RNA, 24 nt, Human
ucccccagcugcucugccccuuuc

SEQ ID NO: 14333 - RNA, 24 nt, Human
ucccccgucgcugccccgccccug

SEQ ID NO: 14334 - RNA, 23 nt, Human
ucccccgugccuuggugacgaug

SEQ ID NO: 14335 - RNA, 24 nt, Human
ucccccuaagcccccacugccuuc

SEQ ID NO: 14336 - RNA, 24 nt, Human
ucccccucaagguaacauuggaug

SEQ ID NO: 14337 - RNA, 24 nt, Human
ucccccucuuccucuuggccucug

SEQ ID NO: 14338 - RNA, 24 nt, Human
ucccccugcucuaggccaaggugg

SEQ ID NO: 14339 - RNA, 24 nt, Human
uccccgagcccugaaguggaguaa

SEQ ID NO: 14340 - RNA, 24 nt, Human
uccccgauggcccacugcgugacc

SEQ ID NO: 14341 - RNA, 19 nt, Human
uccccggcugaaguuuucu

SEQ ID NO: 14342 - RNA, 24 nt, Human
uccccgugacaggugggccugagg

SEQ ID NO: 14343 - RNA, 24 nt, Human
uccccugccagcucccccagcugc

SEQ ID NO: 14344 - RNA, 24 nt, Human
uccccuuuuuaacuuccugugccc

SEQ ID NO: 14345 - RNA, 24 nt, Human
ucccgaccaagauggcggccgugg

SEQ ID NO: 14346 - RNA, 24 nt, Human
ucccggaaagggcggggcggccaa

SEQ ID NO: 14347 - RNA, 24 nt, Human
ucccggagaguaaauccucuuucc

SEQ ID NO: 14348 - RNA, 24 nt, Human
ucccggagucagaaaaggcagguc

SEQ ID NO: 14349 - RNA, 24 nt, Human
ucccggauccaggcguccgggauc

SEQ ID NO: 14350 - RNA, 24 nt, Human
ucccggggccgggggaccuuagcg

SEQ ID NO: 14351 - RNA, 24 nt, Human
ucccggggcgucuucgugcagugg

SEQ ID NO: 14352 - RNA, 24 nt, Human
ucccgggugugcagggcauucuag

SEQ ID NO: 14353 - RNA, 24 nt, Human
ucccggugcucugcgagaucuccc

SEQ ID NO: 14354 - RNA, 24 nt, Human
ucccguguccugaacuuggguccc

SEQ ID NO: 14355 - RNA, 24 nt, Human
ucccuagaaaaacauuuuugucac

SEQ ID NO: 14356 - RNA, 24 nt, Human
ucccuagaucaauuuucuucugga

SEQ ID NO: 14357 - RNA, 24 nt, Human
ucccucagcagcguggugaccgug

SEQ ID NO: 14358 - RNA, 24 nt, Human
ucccuccagccucuccuccauucc

SEQ ID NO: 14359 - RNA, 21 nt, Human
ucccuccuaguuguguuguug

SEQ ID NO: 14360 - RNA, 22 nt, Human
ucccucuccugucugcuucuuu

SEQ ID NO: 14361 - RNA, 22 nt, Human
ucccugagacucuuuaacuucu

SEQ ID NO: 14362 - RNA, 24 nt, Human
ucccugagccaugacugcuugacu

SEQ ID NO: 14363 - RNA, 24 nt, Human
ucccugagccucagucucucaucc

SEQ ID NO: 14364 - RNA, 24 nt, Human
ucccugagcucccuagagucggcc

SEQ ID NO: 14365 - RNA, 24 nt, Human
ucccugaggccaacucuuccugau

SEQ ID NO: 14366 - RNA, 24 nt, Human
ucccuggaccagcccgguggcacc

SEQ ID NO: 14367 - RNA, 24 nt, Human
ucccuggagggacuaggaugcugg

SEQ ID NO: 14368 - RNA, 24 nt, Human
ucccuggcuuaugagcaggcugag

SEQ ID NO: 14369 - RNA, 24 nt, Human
ucccugggaguaauuuuggugaag

SEQ ID NO: 14370 - RNA, 24 nt, Human
ucccugggcacagugagcagggcu

SEQ ID NO: 14371 - RNA, 24 nt, Human
ucccuggugcucucaguccaggca

SEQ ID NO: 14372 - RNA, 24 nt, Human
ucccuguacaguguuaccaucccc

SEQ ID NO: 14373 - RNA, 24 nt, Human
ucccugugacuccacaggccagac

SEQ ID NO: 14374 - RNA, 24 nt, Human
ucccugugggcucccuuugggggu

SEQ ID NO: 14375 - RNA, 24 nt, Human
ucccugugucuccccagguaguaa

SEQ ID NO: 14376 - RNA, 21 nt, Human
ucccuguuguccauuguguau

SEQ ID NO: 14377 - RNA, 24 nt, Human
ucccuuaccuacauuguuccaaca

SEQ ID NO: 14378 - RNA, 22 nt, Human
ucccuucagagcccauggguuu

SEQ ID NO: 14379 - RNA, 24 nt, Human
ucccuugcaauuguucgccccucu

SEQ ID NO: 14380 - RNA, 24 nt, Human
uccgagaucugcuuauguucccaa

SEQ ID NO: 14381 - RNA, 24 nt, Human
uccgaguuccugcuccaguuagac

SEQ ID NO: 14382 - RNA, 24 nt, Human
uccgcaccucuuccaaccacccuc

SEQ ID NO: 14383 - RNA, 24 nt, Human
uccgcagagaacagacuuggcccu

SEQ ID NO: 14384 - RNA, 24 nt, Human
uccguacacacgaagccuuuaauc

SEQ ID NO: 14385 - RNA, 24 nt, Human
uccgucuccugaaacaugcccuua

SEQ ID NO: 14386 - RNA, 22 nt, Human
uccgugcgcgugcugcggccgu

SEQ ID NO: 14387 - RNA, 24 nt, Human
uccgugcgcguugcugcggccgug

SEQ ID NO: 14388 - RNA, 22 nt, Human
uccguucuaagccauugcugac

SEQ ID NO: 14389 - RNA, 23 nt, Human
uccuaagaugacuauaguagagg

SEQ ID NO: 14390 - RNA, 24 nt, Human
uccuaggagucugaaggccucgcu

SEQ ID NO: 14391 - RNA, 22 nt, Human
uccuauuaucucauaccuaagg

SEQ ID NO: 14392 - RNA, 22 nt, Human
uccucuucagcuggugaauccu

SEQ ID NO: 14393 - RNA, 24 nt, Human
uccugcuccugacucaccgcuguu

SEQ ID NO: 14394 - RNA, 24 nt, Human
uccuggggccacuguugggggugg

SEQ ID NO: 14395 - RNA, 24 nt, Human
uccuggugcaaaauggcaacucuu

SEQ ID NO: 14396 - RNA, 24 nt, Human
uccuucgucuaccacucugugcca

SEQ ID NO: 14397 - RNA, 24 nt, Human
uccuugggaaaagggguagcaaag

SEQ ID NO: 14398 - RNA, 24 nt, Human
uccuugguaguuuaacucuggaag

SEQ ID NO: 14399 - RNA, 24 nt, Human
ucgaagcugcacaaagguggcccc

SEQ ID NO: 14400 - RNA, 24 nt, Human
ucgaaggcaccagguccaaugcag

SEQ ID NO: 14401 - RNA, 22 nt, Human
ucgaaguuuaucaggauguuca

SEQ ID NO: 14402 - RNA, 24 nt, Human
ucgagcguggucaagcugcugcug

SEQ ID NO: 14403 - RNA, 18 nt, Human
ucgaguggauaauugaac

SEQ ID NO: 14404 - RNA, 22 nt, Human
ucgaguugaugcuagaaugggu

SEQ ID NO: 14405 - RNA, 24 nt, Human
ucgcagacuacggaccugucuggg

SEQ ID NO: 14406 - RNA, 24 nt, Human
ucgcagagucaucuguuugguggg

SEQ ID NO: 14407 - RNA, 24 nt, Human
ucgcaggcugcucugucucuuagc

SEQ ID NO: 14408 - RNA, 24 nt, Human
ucgcagugucagcuggggcuguuu

SEQ ID NO: 14409 - RNA, 24 nt, Human
ucgccacgaaggaucggcugcggg

SEQ ID NO: 14410 - RNA, 24 nt, Human
ucgccauaguugagugagccugac

SEQ ID NO: 14411 - RNA, 22 nt, Human
ucgcccagguuggagugcagug

SEQ ID NO: 14412 - RNA, 24 nt, Human
ucgccggccguucccguucccggc

SEQ ID NO: 14413 - RNA, 24 nt, Human
ucgccgguccaggucguagggccg

SEQ ID NO: 14414 - RNA, 24 nt, Human
ucgccuggaauucgagcagagaug

SEQ ID NO: 14415 - RNA, 24 nt, Human
ucgcgggugacuccgggcuccgug

SEQ ID NO: 14416 - RNA, 24 nt, Human
ucgcucccgucccgcccgcggucc

SEQ ID NO: 14417 - RNA, 24 nt, Human
ucgcucugaaaucaucugacugug

SEQ ID NO: 14418 - RNA, 24 nt, Human
ucgcuggagcugacugcugcccgc

SEQ ID NO: 14419 - RNA, 24 nt, Human
ucggaagcggagcaaggucgaggc

SEQ ID NO: 14420 - RNA, 24 nt, Human
ucggacggaaagcggggcugcggg

SEQ ID NO: 14421 - RNA, 24 nt, Human
ucggacuaggccuggaggccgccg

SEQ ID NO: 14422 - RNA, 22 nt, Human
ucggaggaaauccugucucgug

SEQ ID NO: 14423 - RNA, 22 nt, Human
ucggcagggaacaggaaguagg

SEQ ID NO: 14424 - RNA, 22 nt, Human
ucggccaaagauuucacccuug

SEQ ID NO: 14425 - RNA, 24 nt, Human
ucggccaucaacguggccaucccg

SEQ ID NO: 14426 - RNA, 24 nt, Human
ucgggccucgguggugccuggguc

SEQ ID NO: 14427 - RNA, 24 nt, Human
ucggguggugacuccagcgcagga

SEQ ID NO: 14428 - RNA, 24 nt, Human
ucggucggccuaggcuuucugcug

SEQ ID NO: 14429 - RNA, 24 nt, Human
ucggugcuugguaccuggucucuc

SEQ ID NO: 14430 - RNA, 24 nt, Human
ucggugugauugaugccccucaaa

SEQ ID NO: 14431 - RNA, 22 nt, Human
ucgguguuccugaccaugcugu

SEQ ID NO: 14432 - RNA, 24 nt, Human
ucgguucgcuggagagaggcgagc

SEQ ID NO: 14433 - RNA, 22 nt, Human
ucguauggaaugcaccugcaag

SEQ ID NO: 14434 - RNA, 24 nt, Human
ucgucaggcucagguagcugcugg

SEQ ID NO: 14435 - RNA, 22 nt, Human
ucgugagucugacauuaacaga

SEQ ID NO: 14436 - RNA, 24 nt, Human
ucguugggauaaaagccuuugacc

SEQ ID NO: 14437 - RNA, 24 nt, Human
ucuaaaccaaacaggaaaggugca

SEQ ID NO: 14438 - RNA, 24 nt, Human
ucuaaagugacuauuuggaacucu

SEQ ID NO: 14439 - RNA, 24 nt, Human
ucuaaagugcauucuugcagcuaa

SEQ ID NO: 14440 - RNA, 24 nt, Human
ucuaacagccugcccgugcuuucc

SEQ ID NO: 14441 - RNA, 24 nt, Human
ucuaagaacacuacuagaagcauu

SEQ ID NO: 14442 - RNA, 24 nt, Human
ucuaagggcaaacuccagcagcca

SEQ ID NO: 14443 - RNA, 24 nt, Human
ucuaauggcuuaccgagacagcuc

SEQ ID NO: 14444 - RNA, 24 nt, Human
ucuacaacaacaguguaagugaac

SEQ ID NO: 14445 - RNA, 24 nt, Human
ucuacaaguguuugcuauuuacaa

SEQ ID NO: 14446 - RNA, 22 nt, Human
ucuacaccuaggcuguccgaca

SEQ ID NO: 14447 - RNA, 24 nt, Human
ucuacagucugugaauauaccaau

SEQ ID NO: 14448 - RNA, 24 nt, Human
ucuacagucuucacaugccccacu

SEQ ID NO: 14449 - RNA, 24 nt, Human
ucuacauuagcagugcugugcaag

SEQ ID NO: 14450 - RNA, 24 nt, Human
ucuagagucagaacuggccgaagc

SEQ ID NO: 14451 - RNA, 22 nt, Human
ucuagcagcuacggguccucug

SEQ ID NO: 14452 - RNA, 22 nt, Human
ucuagcucugauuuuaagggau

SEQ ID NO: 14453 - RNA, 24 nt, Human
ucuaguuacagauucaugaaacuu

SEQ ID NO: 14454 - RNA, 24 nt, Human
ucuauccccugaccuucagcugaa

SEQ ID NO: 14455 - RNA, 22 nt, Human
ucuaucuuuauccggaauccuc

SEQ ID NO: 14456 - RNA, 24 nt, Human
ucuaugaguccucucuaggaggag

SEQ ID NO: 14457 - RNA, 24 nt, Human
ucuaugcucagaauccaaugcgga

SEQ ID NO: 14458 - RNA, 22 nt, Human
ucucaaccucaguguguguggg

SEQ ID NO: 14459 - RNA, 22 nt, Human
ucucaagacaagaacguuggca

SEQ ID NO: 14460 - RNA, 24 nt, Human
ucucaagcaaauuaaguucugacu

SEQ ID NO: 14461 - RNA, 24 nt, Human
ucucaagugauccacccaccuugg

SEQ ID NO: 14462 - RNA, 24 nt, Human
ucucaccgaagugaucuggaaugu

SEQ ID NO: 14463 - RNA, 22 nt, Human
ucucaccucaaacucaccuucu

SEQ ID NO: 14464 - RNA, 24 nt, Human
ucucacgccgcggccucacccggc

SEQ ID NO: 14465 - RNA, 24 nt, Human
ucucacucugucaccuaggcugaa

SEQ ID NO: 14466 - RNA, 22 nt, Human
ucucacuucuguguuauggaca

SEQ ID NO: 14467 - RNA, 24 nt, Human
ucucagcccuguacugguucaacu

SEQ ID NO: 14468 - RNA, 24 nt, Human
ucucagggaugccacaaccauggg

SEQ ID NO: 14469 - RNA, 24 nt, Human
ucucagguuuuaaauguugcaaau

SEQ ID NO: 14470 - RNA, 24 nt, Human
ucucaucgcugcucaguacagcgg

SEQ ID NO: 14471 - RNA, 24 nt, Human
ucucaugauaauaguuuccuucac

SEQ ID NO: 14472 - RNA, 24 nt, Human
ucucaugcugaacaguucuccauc

SEQ ID NO: 14473 - RNA, 24 nt, Human
ucucauuguugcugaaugccccuc

SEQ ID NO: 14474 - RNA, 21 nt, Human
ucuccaacccccaagcucuug

SEQ ID NO: 14475 - RNA, 21 nt, Human
ucuccaaccuccuugagugac

SEQ ID NO: 14476 - RNA, 24 nt, Human
ucuccacucugcacggcggcugag

SEQ ID NO: 14477 - RNA, 21 nt, Human
ucuccaggcacacacagacac

SEQ ID NO: 14478 - RNA, 24 nt, Human
ucuccaggugaagcagaaaggugc

SEQ ID NO: 14479 - RNA, 24 nt, Human
ucuccagguucuucaauaucagug

SEQ ID NO: 14480 - RNA, 24 nt, Human
ucuccagucuugucugcuguuucu

SEQ ID NO: 14481 - RNA, 24 nt, Human
ucuccaugcccccuccaguuuggg

SEQ ID NO: 14482 - RNA, 24 nt, Human
ucuccauguccacagcugauuucc

SEQ ID NO: 14483 - RNA, 24 nt, Human
ucuccauuaggaguggggugcucc

SEQ ID NO: 14484 - RNA, 24 nt, Human
ucuccccgccuacguuccagacuc

SEQ ID NO: 14485 - RNA, 24 nt, Human
ucucccugcugaaucgaaaggaag

SEQ ID NO: 14486 - RNA, 24 nt, Human
ucuccgaguuugcgacucgcggac

SEQ ID NO: 14487 - RNA, 24 nt, Human
ucuccugggguccugcagguguac

SEQ ID NO: 14488 - RNA, 24 nt, Human
ucuccuggugcagaggggcagcuu

SEQ ID NO: 14489 - RNA, 24 nt, Human
ucucgaguggggauccagcaaggc

SEQ ID NO: 14490 - RNA, 22 nt, Human
ucucgcucugucacccaggcug

SEQ ID NO: 14491 - RNA, 24 nt, Human
ucucgggcucuacucagacuagcg

SEQ ID NO: 14492 - RNA, 24 nt, Human
ucucgggggcaccuuccgggguuc

SEQ ID NO: 14493 - RNA, 24 nt, Human
ucucguaaucuuggcuuuugaagu

SEQ ID NO: 14494 - RNA, 24 nt, Human
ucucuaacucaggcaucucuggau

SEQ ID NO: 14495 - RNA, 22 nt, Human
ucucuaggccaggugcaguggc

SEQ ID NO: 14496 - RNA, 24 nt, Human
ucucucagaacucuuggcuuucaa

SEQ ID NO: 14497 - RNA, 24 nt, Human
ucucuccacuaucuugaaagcuau

SEQ ID NO: 14498 - RNA, 24 nt, Human
ucucugacgauuagugaugcugag

SEQ ID NO: 14499 - RNA, 22 nt, Human
ucucugaggcccagcugcuccc

SEQ ID NO: 14500 - RNA, 24 nt, Human
ucucugaugaugcaauccaggugg

SEQ ID NO: 14501 - RNA, 24 nt, Human
ucucuggguggccaugcuugguuu

SEQ ID NO: 14502 - RNA, 24 nt, Human
ucucuggugauuuagauaaggcag

SEQ ID NO: 14503 - RNA, 24 nt, Human
ucucugguuccucucugcagucuc

SEQ ID NO: 14504 - RNA, 24 nt, Human
ucucugugugaugaccuuggaugc

SEQ ID NO: 14505 - RNA, 22 nt, Human
ucucuuccauacuucuuugguc

SEQ ID NO: 14506 - RNA, 24 nt, Human
ucucuuccuuuugaagauccgucu

SEQ ID NO: 14507 - RNA, 24 nt, Human
ucucuuguccucagugucucuucu

SEQ ID NO: 14508 - RNA, 24 nt, Human
ucugaaagaccacagggccggggu

SEQ ID NO: 14509 - RNA, 24 nt, Human
ucugaaauucaugcaagcuuccga

SEQ ID NO: 14510 - RNA, 24 nt, Human
ucugaagauggaacagucauugcu

SEQ ID NO: 14511 - RNA, 24 nt, Human
ucugaagugaggguggagguggag

SEQ ID NO: 14512 - RNA, 22 nt, Human
ucugaaucugacgucugccccu

SEQ ID NO: 14513 - RNA, 24 nt, Human
ucugacagugaaaagcagcaacaa

SEQ ID NO: 14514 - RNA, 24 nt, Human
ucugacccacucugcguccuuuua

SEQ ID NO: 14515 - RNA, 24 nt, Human
ucugacccggacuccguuaccccu

SEQ ID NO: 14516 - RNA, 24 nt, Human
ucugaccuucaaauguguagagag

SEQ ID NO: 14517 - RNA, 24 nt, Human
ucugacuuuauucccaguccucuu

SEQ ID NO: 14518 - RNA, 22 nt, Human
ucugagaaauauguucgcaauu

SEQ ID NO: 14519 - RNA, 24 nt, Human
ucugagaaaucgaguucaggcugc

SEQ ID NO: 14520 - RNA, 24 nt, Human
ucugagguugccaucagccagggc

SEQ ID NO: 14521 - RNA, 24 nt, Human
ucugaucaauccuucuuuuucucu

SEQ ID NO: 14522 - RNA, 24 nt, Human
ucugaucugugacacgaggagagg

SEQ ID NO: 14523 - RNA, 22 nt, Human
ucugauuaggcagaaaacacca

SEQ ID NO: 14524 - RNA, 24 nt, Human
ucugcaaaaccaauaaauacaaga

SEQ ID NO: 14525 - RNA, 24 nt, Human
ucugcaacaacaagugguucacag

SEQ ID NO: 14526 - RNA, 20 nt, Human
ucugcaauauuuuucuccuc

SEQ ID NO: 14527 - RNA, 24 nt, Human
ucugcaaugaaaucauguugacug

SEQ ID NO: 14528 - RNA, 23 nt, Human
ucugcaaugagguucuucugugc

SEQ ID NO: 14529 - RNA, 24 nt, Human
ucugcaauuuccccuaagccaggc

SEQ ID NO: 14530 - RNA, 24 nt, Human
ucugcagcacucugcucacauucc

SEQ ID NO: 14531 - RNA, 24 nt, Human
ucugcagcugauuggcucuggagu

SEQ ID NO: 14532 - RNA, 20 nt, Human
ucugcaguccaggcgugugg

SEQ ID NO: 14533 - RNA, 24 nt, Human
ucugcaguccauagaagagcguga

SEQ ID NO: 14534 - RNA, 21 nt, Human
ucugcaugucagaaaagugca

SEQ ID NO: 14535 - RNA, 24 nt, Human
ucugcauucggcugugagugccag

SEQ ID NO: 14536 - RNA, 24 nt, Human
ucugcauuggcugcugggcauaug

SEQ ID NO: 14537 - RNA, 24 nt, Human
ucugcauuguucuagcugcucccc

SEQ ID NO: 14538 - RNA, 22 nt, Human
ucugcauuuuuaacaagcucca

SEQ ID NO: 14539 - RNA, 24 nt, Human
ucugccagcucaagcgagaccagc

SEQ ID NO: 14540 - RNA, 23 nt, Human
ucugccgaauugaagaggccuga

SEQ ID NO: 14541 - RNA, 22 nt, Human
ucugccucccugucucacucuc

SEQ ID NO: 14542 - RNA, 24 nt, Human
ucugcgcaucaguggucauggcuc

SEQ ID NO: 14543 - RNA, 24 nt, Human
ucugcucgugcuucgccguggccc

SEQ ID NO: 14544 - RNA, 22 nt, Human
ucugcucuaagcacauucuuuc

SEQ ID NO: 14545 - RNA, 22 nt, Human
ucugcucugugucuuggcucca

SEQ ID NO: 14546 - RNA, 24 nt, Human
ucugcuggacaucagggugagugg

SEQ ID NO: 14547 - RNA, 21 nt, Human
ucugcugugauggacacuugu

SEQ ID NO: 14548 - RNA, 22 nt, Human
ucugcuuggacugaucauugaa

SEQ ID NO: 14549 - RNA, 23 nt, Human
ucuggacauauugcgugccuaac

SEQ ID NO: 14550 - RNA, 24 nt, Human
ucuggagaaggagaggaugaugcg

SEQ ID NO: 14551 - RNA, 24 nt, Human
ucuggagagcuuuggauccugggu

SEQ ID NO: 14552 - RNA, 22 nt, Human
ucuggauuugagaggcuuuacu

SEQ ID NO: 14553 - RNA, 24 nt, Human
ucuggcacaggaaauggucuccaa

SEQ ID NO: 14554 - RNA, 24 nt, Human
ucuggcaggaagcauccagggccc

SEQ ID NO: 14555 - RNA, 24 nt, Human
ucuggcauauauuagcugugugac

SEQ ID NO: 14556 - RNA, 24 nt, Human
ucuggcccccugcaugccacccag

SEQ ID NO: 14557 - RNA, 24 nt, Human
ucuggcuccggcuuugcuguagcc

SEQ ID NO: 14558 - RNA, 22 nt, Human
ucuggggugugcacaggcacug

SEQ ID NO: 14559 - RNA, 22 nt, Human
ucuggguaacugaggcuaauau

SEQ ID NO: 14560 - RNA, 24 nt, Human
ucuggugauuguuccuucccuccc

SEQ ID NO: 14561 - RNA, 24 nt, Human
ucuggugggucugauacagguagc

SEQ ID NO: 14562 - RNA, 22 nt, Human
ucugguuucaauggguacgauu

SEQ ID NO: 14563 - RNA, 22 nt, Human
ucugguuugagagacaaugaca

SEQ ID NO: 14564 - RNA, 24 nt, Human
ucugguuuuauuauucaaauuaag

SEQ ID NO: 14565 - RNA, 24 nt, Human
ucuguaaauacccguuaccauauu

SEQ ID NO: 14566 - RNA, 24 nt, Human
ucuguccugcguccucuguccccg

SEQ ID NO: 14567 - RNA, 20 nt, Human
ucugucgggcagguggccgu

SEQ ID NO: 14568 - RNA, 24 nt, Human
ucugucuacuguggugaucuguag

SEQ ID NO: 14569 - RNA, 22 nt, Human
ucugucuucgaccaacugaagc

SEQ ID NO: 14570 - RNA, 24 nt, Human
ucugugacuuccuggagacucacu

SEQ ID NO: 14571 - RNA, 22 nt, Human
ucugugcucaugugccugucug

SEQ ID NO: 14572 - RNA, 24 nt, Human
ucugugucugguucagagcucuuc

SEQ ID NO: 14573 - RNA, 22 nt, Human
ucuguuggaggagcgccaaaag

SEQ ID NO: 14574 - RNA, 24 nt, Human
ucuuacagccucugucucuuuauu

SEQ ID NO: 14575 - RNA, 22 nt, Human
ucuuagauugagaagauguggc

SEQ ID NO: 14576 - RNA, 24 nt, Human
ucuuauguuucuauggcuuugaag

SEQ ID NO: 14577 - RNA, 24 nt, Human
ucuucagagaaacagacuguucau

SEQ ID NO: 14578 - RNA, 24 nt, Human
ucuucaggaaaugcuaaaauuggg

SEQ ID NO: 14579 - RNA, 24 nt, Human
ucuucaguaaucgacauuccacua

SEQ ID NO: 14580 - RNA, 22 nt, Human
ucuuccccaccuucggcuugca

SEQ ID NO: 14581 - RNA, 24 nt, Human
ucuugaacucuauaguguuugauc

SEQ ID NO: 14582 - RNA, 24 nt, Human
ucuugcgcuguaugacaucguccu

SEQ ID NO: 14583 - RNA, 24 nt, Human
ucuugcgucuaaugcugcuccaca

SEQ ID NO: 14584 - RNA, 24 nt, Human
ucuugcucugucacccaggcugga

SEQ ID NO: 14585 - RNA, 24 nt, Human
ucuugcugaucagagcuugguugg

SEQ ID NO: 14586 - RNA, 24 nt, Human
ucuuggccacuuuaauucagaaga

SEQ ID NO: 14587 - RNA, 24 nt, Human
ucuuggguccacauacggccauca

SEQ ID NO: 14588 - RNA, 24 nt, Human
ucuugggugaguuagagauggaag

SEQ ID NO: 14589 - RNA, 24 nt, Human
ucuugugucuagaggcuccagagc

SEQ ID NO: 14590 - RNA, 24 nt, Human
ucuuguuuuccacaugugguaucu

SEQ ID NO: 14591 - RNA, 22 nt, Human
ucuuuagaguauauggccuuua

SEQ ID NO: 14592 - RNA, 22 nt, Human
ucuuuaggacugauauucaauu

SEQ ID NO: 14593 - RNA, 24 nt, Human
ucuuucacuggaauugcaaaggga

SEQ ID NO: 14594 - RNA, 22 nt, Human
ucuuucuacaccucugccagug

SEQ ID NO: 14595 - RNA, 22 nt, Human
ucuuucugaugggaagggucaa

SEQ ID NO: 14596 - RNA, 24 nt, Human
ucuuugcccaaaccaauguccugu

SEQ ID NO: 14597 - RNA, 22 nt, Human
ucuuugcuggaaggugccuccc

SEQ ID NO: 14598 - RNA, 22 nt, Human
ucuuuuccagaguucugaacuu

SEQ ID NO: 14599 - RNA, 23 nt, Human
ucuuuugggcgccgggccccaga

SEQ ID NO: 14600 - RNA, 24 nt, Human
ucuuuuguucauuuugagucccca

SEQ ID NO: 14601 - RNA, 22 nt, Human
ucuuuuuguuguagcuguaugg

SEQ ID NO: 14602 - RNA, 24 nt, Human
ugaaaaaacugaggauuagagaag

SEQ ID NO: 14603 - RNA, 24 nt, Human
ugaaaaaauacaaaauucaaaagg

SEQ ID NO: 14604 - RNA, 24 nt, Human
ugaaaaacugaauucugcaacaga

SEQ ID NO: 14605 - RNA, 22 nt, Human
ugaaaacauccugacgugggac

SEQ ID NO: 14606 - RNA, 24 nt, Human
ugaaaagaaacuagucauuuauuu

SEQ ID NO: 14607 - RNA, 22 nt, Human
ugaaaagccuuuggguagugau

SEQ ID NO: 14608 - RNA, 22 nt, Human
ugaaaauccacaaugucuuuga

SEQ ID NO: 14609 - RNA, 24 nt, Human
ugaaaauuugaaaaauaacagaau

SEQ ID NO: 14610 - RNA, 24 nt, Human
ugaaacauaugaaauugcugcauu

SEQ ID NO: 14611 - RNA, 24 nt, Human
ugaaacuaagagauaucgauugac

SEQ ID NO: 14612 - RNA, 24 nt, Human
ugaaagaagagaaauaugggucug

SEQ ID NO: 14613 - RNA, 24 nt, Human
ugaaagaccgaccauucuucccug

SEQ ID NO: 14614 - RNA, 24 nt, Human
ugaaagagacagucgacggaugug

SEQ ID NO: 14615 - RNA, 22 nt, Human
ugaaagagauguggugugugaa

SEQ ID NO: 14616 - RNA, 24 nt, Human
ugaaagcagauaugagucaccaga

SEQ ID NO: 14617 - RNA, 24 nt, Human
ugaaagccagccagauucauuuuc

SEQ ID NO: 14618 - RNA, 24 nt, Human
ugaaaggugaguuucauuguuuag

SEQ ID NO: 14619 - RNA, 24 nt, Human
ugaaaggugugaacuugcaauguc

SEQ ID NO: 14620 - RNA, 24 nt, Human
ugaaagguugagaaaggaaugguu

SEQ ID NO: 14621 - RNA, 24 nt, Human
ugaaaguauucaaaagucuucccg

SEQ ID NO: 14622 - RNA, 24 nt, Human
ugaaagucauccucgccagucccg

SEQ ID NO: 14623 - RNA, 24 nt, Human
ugaaaucaacaaaaggucuuggac

SEQ ID NO: 14624 - RNA, 24 nt, Human
ugaaaucaggaccgcagcucgggc

SEQ ID NO: 14625 - RNA, 21 nt, Human
ugaaaucauacagcugugcaa

SEQ ID NO: 14626 - RNA, 24 nt, Human
ugaaaugaagcagaagcugggagu

SEQ ID NO: 14627 - RNA, 22 nt, Human
ugaaaugacauugguauuugag

SEQ ID NO: 14628 - RNA, 24 nt, Human
ugaaaugcuacacaccucuugucu

SEQ ID NO: 14629 - RNA, 22 nt, Human
ugaaaugcuuuuaggacacugc

SEQ ID NO: 14630 - RNA, 24 nt, Human
ugaaaugggaggaucacuugagcc

SEQ ID NO: 14631 - RNA, 24 nt, Human
ugaacacagagguggaucaggcug

SEQ ID NO: 14632 - RNA, 24 nt, Human
ugaacacaugcaccuuauuuuuug

SEQ ID NO: 14633 - RNA, 21 nt, Human
ugaacagaacguagugguagg

SEQ ID NO: 14634 - RNA, 24 nt, Human
ugaacaguaguuaaauagggaaau

SEQ ID NO: 14635 - RNA, 22 nt, Human
ugaacguuuuguuccuuagaug

SEQ ID NO: 14636 - RNA, 24 nt, Human
ugaagacaccauugacgccccaac

SEQ ID NO: 14637 - RNA, 24 nt, Human
ugaagagaauguauuugcugcagu

SEQ ID NO: 14638 - RNA, 24 nt, Human
ugaagagacgagcugcguggaucu

SEQ ID NO: 14639 - RNA, 23 nt, Human
ugaagaggaaucaggaccuggcu

SEQ ID NO: 14640 - RNA, 24 nt, Human
ugaagaggaaucaggaccuggcuc

SEQ ID NO: 14641 - RNA, 24 nt, Human
ugaagauaacagcuguggacaaga

SEQ ID NO: 14642 - RNA, 22 nt, Human
ugaagaugaugagauaucacuc

SEQ ID NO: 14643 - RNA, 24 nt, Human
ugaagcagagauuauagauguuaa

SEQ ID NO: 14644 - RNA, 22 nt, Human
ugaaggaagaaaggcaguucuc

SEQ ID NO: 14645 - RNA, 24 nt, Human
ugaaggaggcucuguggccaggug

SEQ ID NO: 14646 - RNA, 22 nt, Human
ugaaggggacaguggugcaagu

SEQ ID NO: 14647 - RNA, 24 nt, Human
ugaagguuuuaucagagcccaggg

SEQ ID NO: 14648 - RNA, 24 nt, Human
ugaaguacaagaaaggaggugugg

SEQ ID NO: 14649 - RNA, 22 nt, Human
ugaagucuuugauauauuggug

SEQ ID NO: 14650 - RNA, 24 nt, Human
ugaauacugcuuuuaccacuuuga

SEQ ID NO: 14651 - RNA, 22 nt, Human
ugaauauauuaugucagucccu

SEQ ID NO: 14652 - RNA, 24 nt, Human
ugaaucacgacuguggacgacaau

SEQ ID NO: 14653 - RNA, 24 nt, Human
ugaaugaagcauuguaaagacuua

SEQ ID NO: 14654 - RNA, 24 nt, Human
ugaaugacgagcauugagccauca

SEQ ID NO: 14655 - RNA, 24 nt, Human
ugaaugcccuuguuuagaaugggu

SEQ ID NO: 14656 - RNA, 22 nt, Human
ugaaugcuacccugcuggcucu

SEQ ID NO: 14657 - RNA, 24 nt, Human
ugaauuaaacaaucguguggagaa

SEQ ID NO: 14658 - RNA, 22 nt, Human
ugaauuguguuuccuggaguug

SEQ ID NO: 14659 - RNA, 24 nt, Human
ugaauuuuugaaacuggacagaga

SEQ ID NO: 14660 - RNA, 22 nt, Human
ugacaaccuccuuagugugaug

SEQ ID NO: 14661 - RNA, 22 nt, Human
ugacaagauacaggguagugaa

SEQ ID NO: 14662 - RNA, 24 nt, Human
ugacaagcagaggcaugagcuggg

SEQ ID NO: 14663 - RNA, 24 nt, Human
ugacaagugaaucuccaugugggu

SEQ ID NO: 14664 - RNA, 24 nt, Human
ugacaauaggucuuaaugcaaguu

SEQ ID NO: 14665 - RNA, 23 nt, Human
ugacaauccccuugacguucuau

SEQ ID NO: 14666 - RNA, 24 nt, Human
ugacaauucucaacuccauuuccu

SEQ ID NO: 14667 - RNA, 24 nt, Human
ugacaauuucacagugcucccacu

SEQ ID NO: 14668 - RNA, 24 nt, Human
ugacaccaccccacuccucuuccu

SEQ ID NO: 14669 - RNA, 21 nt, Human
ugacaccauggggagcugcug

SEQ ID NO: 14670 - RNA, 22 nt, Human
ugacacucaacuucaacaugcc

SEQ ID NO: 14671 - RNA, 24 nt, Human
ugacagagaggaccagggugagaa

SEQ ID NO: 14672 - RNA, 22 nt, Human
ugacagagcaagaucuagauaa

SEQ ID NO: 14673 - RNA, 24 nt, Human
ugacagauggagauugggcagcag

SEQ ID NO: 14674 - RNA, 24 nt, Human
ugacagcaaaggcacagacauucu

SEQ ID NO: 14675 - RNA, 24 nt, Human
ugacagcaguuaucucugauagau

SEQ ID NO: 14676 - RNA, 24 nt, Human
ugacagcgcaggacccaaagcucu

SEQ ID NO: 14677 - RNA, 24 nt, Human
ugacagcugguagaggcagacauc

SEQ ID NO: 14678 - RNA, 24 nt, Human
ugacaggacauuugaaauuaagau

SEQ ID NO: 14679 - RNA, 24 nt, Human
ugacaggucgauguagcugaggac

SEQ ID NO: 14680 - RNA, 24 nt, Human
ugacaguccaaaggguuccucggg

SEQ ID NO: 14681 - RNA, 24 nt, Human
ugacagugugcaacucucauugga

SEQ ID NO: 14682 - RNA, 24 nt, Human
ugacaguuuaacaagccuuaggaa

SEQ ID NO: 14683 - RNA, 24 nt, Human
ugacaugaaguugcaaggucaccu

SEQ ID NO: 14684 - RNA, 24 nt, Human
ugacaugcucacgugacaugguua

SEQ ID NO: 14685 - RNA, 21 nt, Human
ugacaugguuucaaaggccug

SEQ ID NO: 14686 - RNA, 22 nt, Human
ugacaugugguuacuggguugc

SEQ ID NO: 14687 - RNA, 24 nt, Human
ugaccaacauggugaaacccaucu

SEQ ID NO: 14688 - RNA, 24 nt, Human
ugaccacgaccuucgggcgcugcc

SEQ ID NO: 14689 - RNA, 24 nt, Human
ugaccagaggugcugcccagaccc

SEQ ID NO: 14690 - RNA, 24 nt, Human
ugaccaggacaucuacgggcgcga

SEQ ID NO: 14691 - RNA, 24 nt, Human
ugaccaggacauggaagucaacga

SEQ ID NO: 14692 - RNA, 24 nt, Human
ugaccaggcuagaccacacgugcc

SEQ ID NO: 14693 - RNA, 24 nt, Human
ugaccagggcugugcuugagguac

SEQ ID NO: 14694 - RNA, 24 nt, Human
ugaccauauuccaaaaugcucaac

SEQ ID NO: 14695 - RNA, 24 nt, Human
ugaccaugcccguggugccacaag

SEQ ID NO: 14696 - RNA, 24 nt, Human
ugacccgacaagaguaccaagaaa

SEQ ID NO: 14697 - RNA, 24 nt, Human
ugaccgaaggaggagcugcgcaga

SEQ ID NO: 14698 - RNA, 20 nt, Human
ugaccuggagcugcaccccc

SEQ ID NO: 14699 - RNA, 24 nt, Human
ugaccuucugauuagcaaagccca

SEQ ID NO: 14700 - RNA, 24 nt, Human
ugaccuuggaugcuguaaagugau

SEQ ID NO: 14701 - RNA, 24 nt, Human
ugacgagcuaugcauacugaacaa

SEQ ID NO: 14702 - RNA, 24 nt, Human
ugacgaggcauuuggcuaccuuaa

SEQ ID NO: 14703 - RNA, 24 nt, Human
ugacgaggggaagagaugagaaga

SEQ ID NO: 14704 - RNA, 24 nt, Human
ugacgcugaagcuggugagccugg

SEQ ID NO: 14705 - RNA, 24 nt, Human
ugacggggcccugggcuggggcug

SEQ ID NO: 14706 - RNA, 18 nt, Human
ugacguggacauccgcaa

SEQ ID NO: 14707 - RNA, 22 nt, Human
ugacuagagacauuuuaagguu

SEQ ID NO: 14708 - RNA, 24 nt, Human
ugacuagaguggccggggauccuc

SEQ ID NO: 14709 - RNA, 24 nt, Human
ugacugcacuuauauaugcagugg

SEQ ID NO: 14710 - RNA, 24 nt, Human
ugacuguguccucacccaaaucuc

SEQ ID NO: 14711 - RNA, 24 nt, Human
ugacuucuaaugcugucacagaga

SEQ ID NO: 14712 - RNA, 24 nt, Human
ugacuuguaguaagcagguuucug

SEQ ID NO: 14713 - RNA, 24 nt, Human
ugacuuugagcaaguuauuuaucc

SEQ ID NO: 14714 - RNA, 24 nt, Human
ugagaaaaugaauucgagucuuug

SEQ ID NO: 14715 - RNA, 24 nt, Human
ugagaaacuuuugauuguuuucaa

SEQ ID NO: 14716 - RNA, 24 nt, Human
ugagaaagaaauucagauauggga

SEQ ID NO: 14717 - RNA, 24 nt, Human
ugagaaagcaagauguuggcuacc

SEQ ID NO: 14718 - RNA, 24 nt, Human
ugagaaaggcggagaggcuccaaa

SEQ ID NO: 14719 - RNA, 24 nt, Human
ugagaaagucuuaaccaguuguug

SEQ ID NO: 14720 - RNA, 24 nt, Human
ugagaacaacaagccccaaagaca

SEQ ID NO: 14721 - RNA, 24 nt, Human
ugagaacgagccagacuuggccag

SEQ ID NO: 14722 - RNA, 24 nt, Human
ugagaacuccaggauuguccugca

SEQ ID NO: 14723 - RNA, 24 nt, Human
ugagaagagguggugguuaaaggc

SEQ ID NO: 14724 - RNA, 24 nt, Human
ugagaagaguguuccuggccuugc

SEQ ID NO: 14725 - RNA, 24 nt, Human
ugagaaggaaauggccgcaauuua

SEQ ID NO: 14726 - RNA, 24 nt, Human
ugagaaggcagguuccauugaaga

SEQ ID NO: 14727 - RNA, 24 nt, Human
ugagaagggagggacuuggcuccc

SEQ ID NO: 14728 - RNA, 24 nt, Human
ugagaagugggugagggcaugcaa

SEQ ID NO: 14729 - RNA, 24 nt, Human
ugagaaugaccuuuacuuuccuau

SEQ ID NO: 14730 - RNA, 24 nt, Human
ugagaauggcaaaauuagucgccu

SEQ ID NO: 14731 - RNA, 24 nt, Human
ugagaauggcucaagcacuuccua

SEQ ID NO: 14732 - RNA, 24 nt, Human
ugagaaugucauguugauccaucc

SEQ ID NO: 14733 - RNA, 24 nt, Human
ugagaauguccgagaauucuucuu

SEQ ID NO: 14734 - RNA, 22 nt, Human
ugagacagaauuugaaauuguu

SEQ ID NO: 14735 - RNA, 24 nt, Human
ugagacauggucucacucugacac

SEQ ID NO: 14736 - RNA, 24 nt, Human
ugagaccagucugggcaacauggc

SEQ ID NO: 14737 - RNA, 24 nt, Human
ugagaccguacucagagugaggau

SEQ ID NO: 14738 - RNA, 24 nt, Human
ugagagaauaaaguauuuuggaaa

SEQ ID NO: 14739 - RNA, 22 nt, Human
ugagagagcaagugaauuuccc

SEQ ID NO: 14740 - RNA, 24 nt, Human
ugagagagcuuucucgugggcacc

SEQ ID NO: 14741 - RNA, 24 nt, Human
ugagagcaagggaacagggcggau

SEQ ID NO: 14742 - RNA, 24 nt, Human
ugagagcacgaguuaguuguaguc

SEQ ID NO: 14743 - RNA, 24 nt, Human
ugagagcacuuuaucuguaggucc

SEQ ID NO: 14744 - RNA, 24 nt, Human
ugagaggaagccuucuguacuuga

SEQ ID NO: 14745 - RNA, 24 nt, Human
ugagagguggaggaguucugaucc

SEQ ID NO: 14746 - RNA, 22 nt, Human
ugagagguggagguugcaguga

SEQ ID NO: 14747 - RNA, 24 nt, Human
ugagauacgauaugauaaacaggc

SEQ ID NO: 14748 - RNA, 24 nt, Human
ugagauagccaggcugaagaagca

SEQ ID NO: 14749 - RNA, 23 nt, Human
ugagauaugggagagcuuuuagg

SEQ ID NO: 14750 - RNA, 24 nt, Human
ugagauccucaucacgggacaccu

SEQ ID NO: 14751 - RNA, 24 nt, Human
ugagaucugacagucucaggucug

SEQ ID NO: 14752 - RNA, 24 nt, Human
ugagaucugcucaccgucuggggc

SEQ ID NO: 14753 - RNA, 22 nt, Human
ugagaugaaccagguaucucag

SEQ ID NO: 14754 - RNA, 22 nt, Human
ugagaugaacccgguaccucag

SEQ ID NO: 14755 - RNA, 22 nt, Human
ugagaugauugugaaacuaggu

SEQ ID NO: 14756 - RNA, 24 nt, Human
ugagauuacagggcaugaggccac

SEQ ID NO: 14757 - RNA, 24 nt, Human
ugagauuggggccgacgugcaagc

SEQ ID NO: 14758 - RNA, 24 nt, Human
ugagauuuuucaaguucuuuauga

SEQ ID NO: 14759 - RNA, 24 nt, Human
ugagcaaagaggccaagcagagac

SEQ ID NO: 14760 - RNA, 24 nt, Human
ugagcaaauggcagaauuaggggc

SEQ ID NO: 14761 - RNA, 24 nt, Human
ugagcaggagagauggggcuauug

SEQ ID NO: 14762 - RNA, 24 nt, Human
ugagcaggcucgugggacggcccu

SEQ ID NO: 14763 - RNA, 23 nt, Human
ugagcagguagccuggggggaca

SEQ ID NO: 14764 - RNA, 24 nt, Human
ugagcaguguaugucaggacuugu

SEQ ID NO: 14765 - RNA, 24 nt, Human
ugagcaucaggauuuuauggauga

SEQ ID NO: 14766 - RNA, 24 nt, Human
ugagcaucaugcauaaggccucca

SEQ ID NO: 14767 - RNA, 24 nt, Human
ugagccagagcagggcgcccccga

SEQ ID NO: 14768 - RNA, 24 nt, Human
ugagcccaggagguggaggcugca

SEQ ID NO: 14769 - RNA, 24 nt, Human
ugagccuauuuuguggccccugug

SEQ ID NO: 14770 - RNA, 24 nt, Human
ugagccucuguucuaaauccuccg

SEQ ID NO: 14771 - RNA, 22 nt, Human
ugagccucuuugaucucuuccg

SEQ ID NO: 14772 - RNA, 24 nt, Human
ugagccuggacggacgggggcugg

SEQ ID NO: 14773 - RNA, 24 nt, Human
ugagcgccccacccaugccugccu

SEQ ID NO: 14774 - RNA, 24 nt, Human
ugagcgggcccugcuccgagauca

SEQ ID NO: 14775 - RNA, 22 nt, Human
ugagcuccaaggaagugaauaa

SEQ ID NO: 14776 - RNA, 22 nt, Human
ugagcuccagggcuggggcuca

SEQ ID NO: 14777 - RNA, 24 nt, Human
ugagcugacacgaggcggaggggu

SEQ ID NO: 14778 - RNA, 24 nt, Human
ugagcuguggccauccaugcuggg

SEQ ID NO: 14779 - RNA, 24 nt, Human
ugagcuuagugcuaggacugagag

SEQ ID NO: 14780 - RNA, 24 nt, Human
ugaggaaagaaaaacugcaggauc

SEQ ID NO: 14781 - RNA, 22 nt, Human
ugaggaaggugugagaaaugag

SEQ ID NO: 14782 - RNA, 24 nt, Human
ugaggaauguaucaucuuuuuguc

SEQ ID NO: 14783 - RNA, 24 nt, Human
ugaggacaggcaucgccgagacuc

SEQ ID NO: 14784 - RNA, 24 nt, Human
ugaggaccuccugccugccauguu

SEQ ID NO: 14785 - RNA, 24 nt, Human
ugaggagagagugugcucagaacu

SEQ ID NO: 14786 - RNA, 24 nt, Human
ugaggagauguugcugaagcaucu

SEQ ID NO: 14787 - RNA, 24 nt, Human
ugaggagucaggcuuaaaacuugu

SEQ ID NO: 14788 - RNA, 24 nt, Human
ugaggaguuccggaaccccaaggc

SEQ ID NO: 14789 - RNA, 22 nt, Human
ugaggaguuuuaagagugagaa

SEQ ID NO: 14790 - RNA, 24 nt, Human
ugaggauacaugugugaugccacu

SEQ ID NO: 14791 - RNA, 24 nt, Human
ugaggcaaagaaugguggcgucug

SEQ ID NO: 14792 - RNA, 22 nt, Human
ugaggcacaggauaguugcuga

SEQ ID NO: 14793 - RNA, 24 nt, Human
ugaggcaggagaaucacuugaacc

SEQ ID NO: 14794 - RNA, 24 nt, Human
ugaggcaggagacuggcaugaacc

SEQ ID NO: 14795 - RNA, 19 nt, Human
ugaggcaguguauuuguau

SEQ ID NO: 14796 - RNA, 21 nt, Human
ugaggccagaggugcugucag

SEQ ID NO: 14797 - RNA, 24 nt, Human
ugaggcgcgacuuccugcgccugc

SEQ ID NO: 14798 - RNA, 24 nt, Human
ugaggcuguggccuccaaaggguc

SEQ ID NO: 14799 - RNA, 24 nt, Human
ugaggcuucauccuugcucugcag

SEQ ID NO: 14800 - RNA, 24 nt, Human
ugagggaaaauucaguuguugugc

SEQ ID NO: 14801 - RNA, 22 nt, Human
ugagggaaugucuguguccuug

SEQ ID NO: 14802 - RNA, 22 nt, Human
ugagggcaggugugaaaaugcu

SEQ ID NO: 14803 - RNA, 24 nt, Human
ugagggccaccaccccacuguggg

SEQ ID NO: 14804 - RNA, 24 nt, Human
ugaggguauuaagcgcauacugug

SEQ ID NO: 14805 - RNA, 22 nt, Human
ugagggugggagggugugucug

SEQ ID NO: 14806 - RNA, 22 nt, Human
ugagguaaguauguuauuggaa

SEQ ID NO: 14807 - RNA, 22 nt, Human
ugagguaggaugauugcuagcu

SEQ ID NO: 14808 - RNA, 22 nt, Human
ugagguaggggucaaaaugagc

SEQ ID NO: 14809 - RNA, 24 nt, Human
ugagguagguaaccuuguuuacug

SEQ ID NO: 14810 - RNA, 21 nt, Human
ugagguaggugcugaaacugc

SEQ ID NO: 14811 - RNA, 22 nt, Human
ugagguaggugcugaaacugcu

SEQ ID NO: 14812 - RNA, 22 nt, Human
ugagguauaguauuguagcuua

SEQ ID NO: 14813 - RNA, 24 nt, Human
ugagguaucuaaagaggcccggaa

SEQ ID NO: 14814 - RNA, 22 nt, Human
ugagguauguauguucuauaug

SEQ ID NO: 14815 - RNA, 24 nt, Human
ugaggucauguguuaagguaugua

SEQ ID NO: 14816 - RNA, 22 nt, Human
ugaggucauguucugucagguu

SEQ ID NO: 14817 - RNA, 24 nt, Human
ugagguccaagauucuggagcaau

SEQ ID NO: 14818 - RNA, 20 nt, Human
ugaggugacagucacggagg

SEQ ID NO: 14819 - RNA, 24 nt, Human
ugaggugcgggugcgcgggccugg

SEQ ID NO: 14820 - RNA, 24 nt, Human
ugagguggaacaacuuguugcgga

SEQ ID NO: 14821 - RNA, 24 nt, Human
ugagguggaguuggacgcgggugu

SEQ ID NO: 14822 - RNA, 22 nt, Human
ugaggugggagaauugcuugaa

SEQ ID NO: 14823 - RNA, 24 nt, Human
ugaggugggaggacugcuuaaggc

SEQ ID NO: 14824 - RNA, 24 nt, Human
ugaggugggaggauggcuugaaca

SEQ ID NO: 14825 - RNA, 24 nt, Human
ugaggugggcgcaccgggcauagu

SEQ ID NO: 14826 - RNA, 24 nt, Human
ugaguaaagcuaaagcuguuauca

SEQ ID NO: 14827 - RNA, 24 nt, Human
ugaguacacgaugcccacccuccu

SEQ ID NO: 14828 - RNA, 24 nt, Human
ugaguacagagaggaccuagaagc

SEQ ID NO: 14829 - RNA, 23 nt, Human
ugaguaggcaaacuccaggccug

SEQ ID NO: 14830 - RNA, 24 nt, Human
ugaguaguaagaggcgcauuugcu

SEQ ID NO: 14831 - RNA, 24 nt, Human
ugagucuagagauauuugugaaau

SEQ ID NO: 14832 - RNA, 24 nt, Human
ugagugaagcugaggagaaggcug

SEQ ID NO: 14833 - RNA, 24 nt, Human
ugagugaaugauuauauguuuaaa

SEQ ID NO: 14834 - RNA, 22 nt, Human
ugagugacagagcaacacucug

SEQ ID NO: 14835 - RNA, 21 nt, Human
ugagugaggacuccaagaaug

SEQ ID NO: 14836 - RNA, 24 nt, Human
ugagugcaacggaaagggcuauca

SEQ ID NO: 14837 - RNA, 24 nt, Human
ugagugcacuugggagaccuggug

SEQ ID NO: 14838 - RNA, 24 nt, Human
ugagugcaggaagcacauuuggcu

SEQ ID NO: 14839 - RNA, 24 nt, Human
ugagugccaaggacaccacuggaa

SEQ ID NO: 14840 - RNA, 24 nt, Human
ugagugccgucugcuuucgguccc

SEQ ID NO: 14841 - RNA, 24 nt, Human
ugaguggagcugccgccuggucac

SEQ ID NO: 14842 - RNA, 24 nt, Human
ugaguggaucaucugaggucagga

SEQ ID NO: 14843 - RNA, 24 nt, Human
ugagugggucguagcggaaucggg

SEQ ID NO: 14844 - RNA, 24 nt, Human
ugaguguagccuuuguaucaugug

SEQ ID NO: 14845 - RNA, 22 nt, Human
ugaguguaugugugagagagaa

SEQ ID NO: 14846 - RNA, 24 nt, Human
ugaguguccccaaaaaaguugucc

SEQ ID NO: 14847 - RNA, 24 nt, Human
ugagugugaagaauguggaaaaug

SEQ ID NO: 14848 - RNA, 24 nt, Human
ugaguuacaggcugugggaagaga

SEQ ID NO: 14849 - RNA, 24 nt, Human
ugaguuaggcugcagaggacuggu

SEQ ID NO: 14850 - RNA, 24 nt, Human
ugaguugaaacucuuggaggaagc

SEQ ID NO: 14851 - RNA, 22 nt, Human
ugaguugaaagcugcaguugau

SEQ ID NO: 14852 - RNA, 24 nt, Human
ugaguuggggccuuauaguggggc

SEQ ID NO: 14853 - RNA, 24 nt, Human
ugaguugguuggauuggcaagcau

SEQ ID NO: 14854 - RNA, 22 nt, Human
ugauaacaaaccaaacuacuug

SEQ ID NO: 14855 - RNA, 24 nt, Human
ugauaagacucaggaauucugaaa

SEQ ID NO: 14856 - RNA, 24 nt, Human
ugauaaggauggcuauaccuuggg

SEQ ID NO: 14857 - RNA, 24 nt, Human
ugauacuggcuuuuguaauccugg

SEQ ID NO: 14858 - RNA, 22 nt, Human
ugauagaauuucuagggcuggg

SEQ ID NO: 14859 - RNA, 24 nt, Human
ugauaggugucagucuuguaauca

SEQ ID NO: 14860 - RNA, 24 nt, Human
ugauagucuccagcagggccugga

SEQ ID NO: 14861 - RNA, 24 nt, Human
ugauagugucgagcaggaugucaa

SEQ ID NO: 14862 - RNA, 24 nt, Human
ugauauaauuuugauuuucuuaaa

SEQ ID NO: 14863 - RNA, 24 nt, Human
ugauaugcaugauguugaagauga

SEQ ID NO: 14864 - RNA, 20 nt, Human
ugaucaaauucugagcggac

SEQ ID NO: 14865 - RNA, 22 nt, Human
ugaucagauuuuaaaaucaguu

SEQ ID NO: 14866 - RNA, 22 nt, Human
ugauccucuggcuucagccucc

SEQ ID NO: 14867 - RNA, 22 nt, Human
ugaucuagagacucauucaaua

SEQ ID NO: 14868 - RNA, 24 nt, Human
ugaucucguuggacugcguggcua

SEQ ID NO: 14869 - RNA, 24 nt, Human
ugaucugucucaggacucugacac

SEQ ID NO: 14870 - RNA, 24 nt, Human
ugaugaagguuucccauaugguuu

SEQ ID NO: 14871 - RNA, 24 nt, Human
ugaugagcucaucacugucuacag

SEQ ID NO: 14872 - RNA, 24 nt, Human
ugaugaggcggcuguuggcagcau

SEQ ID NO: 14873 - RNA, 24 nt, Human
ugaugaugacgaugaugaugauga

SEQ ID NO: 14874 - RNA, 22 nt, Human
ugaugcaucaguggcagcagau

SEQ ID NO: 14875 - RNA, 21 nt, Human
ugaugcugaggagccaggcag

SEQ ID NO: 14876 - RNA, 24 nt, Human
ugauggacuugaacuuccugccau

SEQ ID NO: 14877 - RNA, 22 nt, Human
ugauggaggagauuguauguua

SEQ ID NO: 14878 - RNA, 22 nt, Human
ugauggcagagauuggugagga

SEQ ID NO: 14879 - RNA, 24 nt, Human
ugaugggcccaacccaauauaucc

SEQ ID NO: 14880 - RNA, 24 nt, Human
ugauggggggagaugugggguugc

SEQ ID NO: 14881 - RNA, 18 nt, Human
ugaugguagagacagacu

SEQ ID NO: 14882 - RNA, 24 nt, Human
ugauggugguggaggaaccgaugu

SEQ ID NO: 14883 - RNA, 24 nt, Human
ugaugguguagguggucuggcuuu

SEQ ID NO: 14884 - RNA, 24 nt, Human
ugauguagaauuugagcugagugc

SEQ ID NO: 14885 - RNA, 24 nt, Human
ugauguauuugcaaacauuaaugu

SEQ ID NO: 14886 - RNA, 24 nt, Human
ugauguuuucuucucucuucauuu

SEQ ID NO: 14887 - RNA, 24 nt, Human
ugauuacagaaaauguucuauuua

SEQ ID NO: 14888 - RNA, 24 nt, Human
ugauuaggacuuuuauugugaauu

SEQ ID NO: 14889 - RNA, 24 nt, Human
ugauuagucucuuggcuccuagca

SEQ ID NO: 14890 - RNA, 22 nt, Human
ugauucauuucuaaacccagcu

SEQ ID NO: 14891 - RNA, 24 nt, Human
ugauuggauacuuaaguuuuagaa

SEQ ID NO: 14892 - RNA, 22 nt, Human
ugauugggggugagguuaucua

SEQ ID NO: 14893 - RNA, 22 nt, Human
ugauuguaugauauaugaguuu

SEQ ID NO: 14894 - RNA, 24 nt, Human
ugcaaaccuucccaccccuguauu

SEQ ID NO: 14895 - RNA, 24 nt, Human
ugcaaagagaugcauaaguaaacu

SEQ ID NO: 14896 - RNA, 22 nt, Human
ugcaaaucgagguccaaggagg

SEQ ID NO: 14897 - RNA, 24 nt, Human
ugcaacuacugcaaagacgcgggc

SEQ ID NO: 14898 - RNA, 22 nt, Human
ugcaagagaccccauugauugc

SEQ ID NO: 14899 - RNA, 22 nt, Human
ugcaaggauauauaauaacuga

SEQ ID NO: 14900 - RNA, 24 nt, Human
ugcaaggcggaaaggcuggggcag

SEQ ID NO: 14901 - RNA, 24 nt, Human
ugcaaggugacagcagucgguugg

SEQ ID NO: 14902 - RNA, 22 nt, Human
ugcaagucugugauuuuguguu

SEQ ID NO: 14903 - RNA, 24 nt, Human
ugcaaugacaugaauaauagcugc

SEQ ID NO: 14904 - RNA, 24 nt, Human
ugcaauguauuuuccugcuuuuca

SEQ ID NO: 14905 - RNA, 24 nt, Human
ugcacagaggggcacggaacucca

SEQ ID NO: 14906 - RNA, 24 nt, Human
ugcacaguuccaaaaauguggagg

SEQ ID NO: 14907 - RNA, 24 nt, Human
ugcacggggcuuucugcauguaac

SEQ ID NO: 14908 - RNA, 24 nt, Human
ugcacguagacgcgcaaugcgggu

SEQ ID NO: 14909 - RNA, 24 nt, Human
ugcacuaacugugcccgaugcgug

SEQ ID NO: 14910 - RNA, 22 nt, Human
ugcacuugucuuuacccuagag

SEQ ID NO: 14911 - RNA, 24 nt, Human
ugcagaaucuguaugggaguucca

SEQ ID NO: 14912 - RNA, 24 nt, Human
ugcagcagaaguugguggagcugu

SEQ ID NO: 14913 - RNA, 24 nt, Human
ugcaggaaugagagugauuuuaug

SEQ ID NO: 14914 - RNA, 24 nt, Human
ugcaggaucaucagguucggauga

SEQ ID NO: 14915 - RNA, 22 nt, Human
ugcaggcagagaaggguggaug

SEQ ID NO: 14916 - RNA, 23 nt, Human
ugcaggcgugccccggcggcggc

SEQ ID NO: 14917 - RNA, 22 nt, Human
ugcagugacuggaaguucuggg

SEQ ID NO: 14918 - RNA, 24 nt, Human
ugcagugcacaugauccggaaggu

SEQ ID NO: 14919 - RNA, 24 nt, Human
ugcaguguagaagguauucuguuc

SEQ ID NO: 14920 - RNA, 24 nt, Human
ugcagugucaccauauuggccagg

SEQ ID NO: 14921 - RNA, 24 nt, Human
ugcaugaaggugaaguaaggaggc

SEQ ID NO: 14922 - RNA, 24 nt, Human
ugcauggacaucauccaauucauu

SEQ ID NO: 14923 - RNA, 24 nt, Human
ugcauggugagggauaguucuugg

SEQ ID NO: 14924 - RNA, 24 nt, Human
ugcaugguuuuuacaaaacucauu

SEQ ID NO: 14925 - RNA, 24 nt, Human
ugcauguagugauccggggcuccc

SEQ ID NO: 14926 - RNA, 24 nt, Human
ugcauucuuaucaccuaguauaua

SEQ ID NO: 14927 - RNA, 24 nt, Human
ugcauugccaucuugaagauuugu

SEQ ID NO: 14928 - RNA, 22 nt, Human
ugcauugugugugcauguggcc

SEQ ID NO: 14929 - RNA, 24 nt, Human
ugcauuguuaucauuaaccagucu

SEQ ID NO: 14930 - RNA, 24 nt, Human
ugcauuguuaucauuaacccaguc

SEQ ID NO: 14931 - RNA, 23 nt, Human
ugccaaggaccaggaugauggag

SEQ ID NO: 14932 - RNA, 24 nt, Human
ugccaaggauguagaauaaauaag

SEQ ID NO: 14933 - RNA, 24 nt, Human
ugccaaugaaagacugagccccuc

SEQ ID NO: 14934 - RNA, 24 nt, Human
ugccaccacccuugucuuccucug

SEQ ID NO: 14935 - RNA, 24 nt, Human
ugccacgggcccggcgggauuuuu

SEQ ID NO: 14936 - RNA, 24 nt, Human
ugccagaacgcugguguggggcgc

SEQ ID NO: 14937 - RNA, 24 nt, Human
ugccagagggagggccaugggccg

SEQ ID NO: 14938 - RNA, 24 nt, Human
ugccagauauuggagauaaaaagg

SEQ ID NO: 14939 - RNA, 24 nt, Human
ugccaggacgugcugagcagcuuc

SEQ ID NO: 14940 - RNA, 24 nt, Human
ugccagggcugcacugaguucaaa

SEQ ID NO: 14941 - RNA, 24 nt, Human
ugccagggggaagagcgauggguc

SEQ ID NO: 14942 - RNA, 24 nt, Human
ugccagguugagaauaucccaggu

SEQ ID NO: 14943 - RNA, 24 nt, Human
ugccaguaucacauaaugauaauc

SEQ ID NO: 14944 - RNA, 22 nt, Human
ugccagugcaugugagacugcc

SEQ ID NO: 14945 - RNA, 24 nt, Human
ugccagugguggaaaccuggagug

SEQ ID NO: 14946 - RNA, 24 nt, Human
ugccaucaugagcagggcauugag

SEQ ID NO: 14947 - RNA, 24 nt, Human
ugccaugggaggccugaaggugcu

SEQ ID NO: 14948 - RNA, 24 nt, Human
ugccaugguuuugcacuaugauua

SEQ ID NO: 14949 - RNA, 24 nt, Human
ugccaugucacuuaguguucugug

SEQ ID NO: 14950 - RNA, 22 nt, Human
ugccauguccuccuuuagaagg

SEQ ID NO: 14951 - RNA, 24 nt, Human
ugccauugugggaaugauaguagc

SEQ ID NO: 14952 - RNA, 24 nt, Human
ugcccagaagaaaguuaauggcaa

SEQ ID NO: 14953 - RNA, 23 nt, Human
ugcccaggccucgcugcugcccu

SEQ ID NO: 14954 - RNA, 24 nt, Human
ugcccagugcacaggcccagcuac

SEQ ID NO: 14955 - RNA, 23 nt, Human
ugcccggugagcuucuuauagac

SEQ ID NO: 14956 - RNA, 24 nt, Human
ugcccuggcgccugugccgcuccu

SEQ ID NO: 14957 - RNA, 24 nt, Human
ugcccugguggcagcccccagcac

SEQ ID NO: 14958 - RNA, 22 nt, Human
ugccgaggcuggagugcagugg

SEQ ID NO: 14959 - RNA, 24 nt, Human
ugccggaggaguggucgcaugugg

SEQ ID NO: 14960 - RNA, 22 nt, Human
ugccggccaggcuggagugcag

SEQ ID NO: 14961 - RNA, 24 nt, Human
ugccgggccagggacuggugcgcu

SEQ ID NO: 14962 - RNA, 24 nt, Human
ugccgggggugguggcacugagag

SEQ ID NO: 14963 - RNA, 24 nt, Human
ugccguggaggccucuucaagugc

SEQ ID NO: 14964 - RNA, 22 nt, Human
ugccuaauugaaucgaaacuuc

SEQ ID NO: 14965 - RNA, 22 nt, Human
ugccuaggcuggagugcagugg

SEQ ID NO: 14966 - RNA, 24 nt, Human
ugccuaggcuggagugcaguggug

SEQ ID NO: 14967 - RNA, 24 nt, Human
ugccuaggcugguaggcuggucuc

SEQ ID NO: 14968 - RNA, 22 nt, Human
ugccucacucucuuccuacuga

SEQ ID NO: 14969 - RNA, 24 nt, Human
ugccucagagaacuucugcagccg

SEQ ID NO: 14970 - RNA, 24 nt, Human
ugccucucugcaaaguugaggcgg

SEQ ID NO: 14971 - RNA, 24 nt, Human
ugccucugcuuuuaaaggugcugu

SEQ ID NO: 14972 - RNA, 22 nt, Human
ugccucuuuuucucucuccuau

SEQ ID NO: 14973 - RNA, 24 nt, Human
ugccugaaaaaauauccuuugugc

SEQ ID NO: 14974 - RNA, 24 nt, Human
ugccugaaccaacuguuuugagcc

SEQ ID NO: 14975 - RNA, 24 nt, Human
ugccugcauggauggacaagaguu

SEQ ID NO: 14976 - RNA, 24 nt, Human
ugccugcgccugcuccuguuauca

SEQ ID NO: 14977 - RNA, 24 nt, Human
ugccuggagugacagagccuuccu

SEQ ID NO: 14978 - RNA, 24 nt, Human
ugccugggaggcuugcccauggga

SEQ ID NO: 14979 - RNA, 24 nt, Human
ugccugggguguuguccucuucuu

SEQ ID NO: 14980 - RNA, 24 nt, Human
ugccuguaauccuagcacuuuggg

SEQ ID NO: 14981 - RNA, 24 nt, Human
ugccugugaaauccaaauuccagu

SEQ ID NO: 14982 - RNA, 22 nt, Human
ugccuugggucccuucaguagc

SEQ ID NO: 14983 - RNA, 21 nt, Human
ugccuugugacuagacugugc

SEQ ID NO: 14984 - RNA, 24 nt, Human
ugcgagaaauuccaggcggcgcuc

SEQ ID NO: 14985 - RNA, 24 nt, Human
ugcgagugcccgagggcguuggag

SEQ ID NO: 14986 - RNA, 24 nt, Human
ugcgauguuuuaccuggcugcggc

SEQ ID NO: 14987 - RNA, 24 nt, Human
ugcgauuguccaccuugugucuuc

SEQ ID NO: 14988 - RNA, 24 nt, Human
ugcgcacugaagaugccagagcua

SEQ ID NO: 14989 - RNA, 24 nt, Human
ugcgcgcgcacaugagcgcgugcu

SEQ ID NO: 14990 - RNA, 24 nt, Human
ugcggacuccaaggaggugcacua

SEQ ID NO: 14991 - RNA, 22 nt, Human
ugcggcucaaagggaaggccuu

SEQ ID NO: 14992 - RNA, 24 nt, Human
ugcgggccaagcacggugcgcaaa

SEQ ID NO: 14993 - RNA, 24 nt, Human
ugcgggugaaccaguuaaggguuu

SEQ ID NO: 14994 - RNA, 21 nt, Human
ugcuaagcaaaggaccuguga

SEQ ID NO: 14995 - RNA, 24 nt, Human
ugcuaaguaaccagagcgaggcgg

SEQ ID NO: 14996 - RNA, 24 nt, Human
ugcuagaaaacauucuauuguaua

SEQ ID NO: 14997 - RNA, 24 nt, Human
ugcuagagaggaaauggcugcuuc

SEQ ID NO: 14998 - RNA, 22 nt, Human
ugcuaggcuuauucucuuccuc

SEQ ID NO: 14999 - RNA, 24 nt, Human
ugcuauguguucacuacaacagga

SEQ ID NO: 15000 - RNA, 24 nt, Human
ugcuauguuggcuaaacugguguc

SEQ ID NO: 15001 - RNA, 22 nt, Human
ugcuauucucagagcacucuau

SEQ ID NO: 15002 - RNA, 24 nt, Human
ugcuauugacagauccuggacaua

SEQ ID NO: 15003 - RNA, 24 nt, Human
ugcucagugaccuccaggagucug

SEQ ID NO: 15004 - RNA, 24 nt, Human
ugcuccugucccuuccacuuccuc

SEQ ID NO: 15005 - RNA, 24 nt, Human
ugcugauagucguacuuucuugcu

SEQ ID NO: 15006 - RNA, 22 nt, Human
ugcugcaguagaaauuagagca

SEQ ID NO: 15007 - RNA, 24 nt, Human
ugcugcggccuuucaugcgcucca

SEQ ID NO: 15008 - RNA, 24 nt, Human
ugcugcggugagcgugagacccgc

SEQ ID NO: 15009 - RNA, 19 nt, Human
ugcugcucguggccugcuc

SEQ ID NO: 15010 - RNA, 24 nt, Human
ugcugcugucguccugccuggcgc

SEQ ID NO: 15011 - RNA, 20 nt, Human
ugcugggagaccuuggccac

SEQ ID NO: 15012 - RNA, 24 nt, Human
ugcuggguggggccaggcauaacc

SEQ ID NO: 15013 - RNA, 24 nt, Human
ugcuggugagggcugugcagcugc

SEQ ID NO: 15014 - RNA, 22 nt, Human
ugcuguacagguacaggcugga

SEQ ID NO: 15015 - RNA, 22 nt, Human
ugcuguaguauguauauaguau

SEQ ID NO: 15016 - RNA, 22 nt, Human
ugcugugucaucuuugaaguca

SEQ ID NO: 15017 - RNA, 21 nt, Human
ugcuguugcccccggccucgc

SEQ ID NO: 15018 - RNA, 22 nt, Human
ugcuguuuucuagcccugucca

SEQ ID NO: 15019 - RNA, 22 nt, Human
ugcuuuaguucuucugaagugu

SEQ ID NO: 15020 - RNA, 24 nt, Human
uggaaaaaucagcucagaaaggcc

SEQ ID NO: 15021 - RNA, 24 nt, Human
uggaaaacggcgauggggaacaac

SEQ ID NO: 15022 - RNA, 22 nt, Human
uggaaaagugcucugauaccug

SEQ ID NO: 15023 - RNA, 24 nt, Human
uggaaaaucuacaacauggagugu

SEQ ID NO: 15024 - RNA, 24 nt, Human
uggaaacacuguaugaacugaagc

SEQ ID NO: 15025 - RNA, 22 nt, Human
uggaaacaugggcugggggaug

SEQ ID NO: 15026 - RNA, 22 nt, Human
uggaaaccuccuuggcuggguu

SEQ ID NO: 15027 - RNA, 23 nt, Human
uggaaagacacugacaaaucgcc

SEQ ID NO: 15028 - RNA, 24 nt, Human
uggaaagauuuaugacauaauuuu

SEQ ID NO: 15029 - RNA, 24 nt, Human
uggaaagcuucauguaauaugauc

SEQ ID NO: 15030 - RNA, 24 nt, Human
uggaaagguccaggaguugggucc

SEQ ID NO: 15031 - RNA, 24 nt, Human
uggaacagaaaguaauauggccaa

SEQ ID NO: 15032 - RNA, 24 nt, Human
uggaacaugggccuuauguuguca

SEQ ID NO: 15033 - RNA, 24 nt, Human
uggaaccucaguuaaauucacuua

SEQ ID NO: 15034 - RNA, 24 nt, Human
uggaaccugacaauguugguguug

SEQ ID NO: 15035 - RNA, 24 nt, Human
uggaacuagaaucaccaaggcuuu

SEQ ID NO: 15036 - RNA, 24 nt, Human
uggaacuucuggaccagcucaguc

SEQ ID NO: 15037 - RNA, 24 nt, Human
uggaacuucuuuuagccccagacc

SEQ ID NO: 15038 - RNA, 24 nt, Human
uggaagaaaagagcaucgacuuga

SEQ ID NO: 15039 - RNA, 24 nt, Human
uggaagaaauauucuguucuaaaa

SEQ ID NO: 15040 - RNA, 24 nt, Human
uggaagaagaaugaaguugcugau

SEQ ID NO: 15041 - RNA, 24 nt, Human
uggaagaagauugucuuugggcau

SEQ ID NO: 15042 - RNA, 24 nt, Human
uggaagaauaaggacauucagagg

SEQ ID NO: 15043 - RNA, 24 nt, Human
uggaagaaugacacgggcucagga

SEQ ID NO: 15044 - RNA, 24 nt, Human
uggaagacauggcucguccggaca

SEQ ID NO: 15045 - RNA, 22 nt, Human
uggaagacuagugauuuaaggc

SEQ ID NO: 15046 - RNA, 24 nt, Human
uggaagacuuguugcaggugggua

SEQ ID NO: 15047 - RNA, 24 nt, Human
uggaagagaaauggaagucggcuc

SEQ ID NO: 15048 - RNA, 24 nt, Human
uggaagaggggcuccugcagguaa

SEQ ID NO: 15049 - RNA, 24 nt, Human
uggaagcagcggaggaaggagaca

SEQ ID NO: 15050 - RNA, 24 nt, Human
uggaagccagagguuuuugcucag

SEQ ID NO: 15051 - RNA, 22 nt, Human
uggaagccuccauugccccucc

SEQ ID NO: 15052 - RNA, 24 nt, Human
uggaagcugguagcaguauuaucu

SEQ ID NO: 15053 - RNA, 24 nt, Human
uggaaggagccugcugaaggaggu

SEQ ID NO: 15054 - RNA, 24 nt, Human
uggaaggccuuucaaaagccucac

SEQ ID NO: 15055 - RNA, 21 nt, Human
uggaagggguagauggagggu

SEQ ID NO: 15056 - RNA, 24 nt, Human
uggaaguauuagauacauguuuaa

SEQ ID NO: 15057 - RNA, 24 nt, Human
uggaagugagugcugggucacccc

SEQ ID NO: 15058 - RNA, 22 nt, Human
uggaauacuagugguucuguga

SEQ ID NO: 15059 - RNA, 24 nt, Human
uggaauagcgucuuccauguggga

SEQ ID NO: 15060 - RNA, 24 nt, Human
uggaaugagugcguggauccacaa

SEQ ID NO: 15061 - RNA, 24 nt, Human
uggaaugccugagaggccaguggg

SEQ ID NO: 15062 - RNA, 23 nt, Human
uggaaugcugggggugguggcgc

SEQ ID NO: 15063 - RNA, 24 nt, Human
uggaauggccuugggaagauucag

SEQ ID NO: 15064 - RNA, 24 nt, Human
uggaaugggaacgucuguugagag

SEQ ID NO: 15065 - RNA, 24 nt, Human
uggaauuucugggguauagcacau

SEQ ID NO: 15066 - RNA, 24 nt, Human
uggacaagcagcaaagcuauaauc

SEQ ID NO: 15067 - RNA, 24 nt, Human
uggacaggcaugauuauugggcca

SEQ ID NO: 15068 - RNA, 22 nt, Human
uggacagugcagccuuggaaca

SEQ ID NO: 15069 - RNA, 24 nt, Human
uggacauuccaaaucccaccaucg

SEQ ID NO: 15070 - RNA, 23 nt, Human
uggacugcgcauucauggguucc

SEQ ID NO: 15071 - RNA, 24 nt, Human
uggacugugggcaguuuggacugg

SEQ ID NO: 15072 - RNA, 22 nt, Human
uggagaacaggugcaucucgua

SEQ ID NO: 15073 - RNA, 24 nt, Human
uggagaagugucaaacaaggaugg

SEQ ID NO: 15074 - RNA, 22 nt, Human
uggagagagcagguugcuaaga

SEQ ID NO: 15075 - RNA, 22 nt, Human
uggagcacaacaucagcucacu

SEQ ID NO: 15076 - RNA, 22 nt, Human
uggagcaggcucagucacucca

SEQ ID NO: 15077 - RNA, 22 nt, Human
uggagccagaggauguguggga

SEQ ID NO: 15078 - RNA, 22 nt, Human
uggagccuuguuguuuguucac

SEQ ID NO: 15079 - RNA, 22 nt, Human
uggagcucagcccagguuccag

SEQ ID NO: 15080 - RNA, 22 nt, Human
uggagcugugagcagcagcaca

SEQ ID NO: 15081 - RNA, 22 nt, Human
uggagcuguucuggucuagagu

SEQ ID NO: 15082 - RNA, 24 nt, Human
uggaggcaaaaacaucugugguuc

SEQ ID NO: 15083 - RNA, 24 nt, Human
uggaggcagaaauugggcauaaga

SEQ ID NO: 15084 - RNA, 24 nt, Human
uggaggccuuggugaccaaugcca

SEQ ID NO: 15085 - RNA, 24 nt, Human
uggagggcuguggaguugggggcc

SEQ ID NO: 15086 - RNA, 22 nt, Human
uggaggguggagggguggcauu

SEQ ID NO: 15087 - RNA, 24 nt, Human
uggagggugucguggacgccgccu

SEQ ID NO: 15088 - RNA, 24 nt, Human
uggaggguuugguggucuccacuc

SEQ ID NO: 15089 - RNA, 24 nt, Human
uggaguaaaggucacucuugcuac

SEQ ID NO: 15090 - RNA, 24 nt, Human
uggaguacggaccggugccggaga

SEQ ID NO: 15091 - RNA, 22 nt, Human
uggaguauguucuugaguucug

SEQ ID NO: 15092 - RNA, 24 nt, Human
uggaguccuauguaccagacugag

SEQ ID NO: 15093 - RNA, 24 nt, Human
uggaguccucgggggccgugcacu

SEQ ID NO: 15094 - RNA, 20 nt, Human
uggagugcguaacgcuccag

SEQ ID NO: 15095 - RNA, 22 nt, Human
uggagugucuggaggugucucu

SEQ ID NO: 15096 - RNA, 24 nt, Human
uggagugugaucuagcucacugua

SEQ ID NO: 15097 - RNA, 24 nt, Human
uggaguugcaggauaugagcuugc

SEQ ID NO: 15098 - RNA, 24 nt, Human
uggaguugguuaacacacacuuaa

SEQ ID NO: 15099 - RNA, 24 nt, Human
uggaucaccugaggucaggaguuc

SEQ ID NO: 15100 - RNA, 24 nt, Human
uggaugauccagcaggaaacaguu

SEQ ID NO: 15101 - RNA, 24 nt, Human
uggauggcccuccgggaaacugug

SEQ ID NO: 15102 - RNA, 24 nt, Human
uggaugguggccucacccagauug

SEQ ID NO: 15103 - RNA, 24 nt, Human
uggauguauaauaguuuagcaaga

SEQ ID NO: 15104 - RNA, 24 nt, Human
uggauguauuuugucuguauguaa

SEQ ID NO: 15105 - RNA, 22 nt, Human
uggauuaguaaagaagaaugaa

SEQ ID NO: 15106 - RNA, 24 nt, Human
uggcaaaaccugcaauuacuuuug

SEQ ID NO: 15107 - RNA, 24 nt, Human
uggcaaaaguuuaaucagaggaaa

SEQ ID NO: 15108 - RNA, 24 nt, Human
uggcaaaauucuacugaagacaca

SEQ ID NO: 15109 - RNA, 24 nt, Human
uggcaaacauuuaucaagacaauu

SEQ ID NO: 15110 - RNA, 24 nt, Human
uggcaaacuuucuucauguccugg

SEQ ID NO: 15111 - RNA, 22 nt, Human
uggcaaagaaggcaguacaguu

SEQ ID NO: 15112 - RNA, 24 nt, Human
uggcaaaguuuguuggcucagacu

SEQ ID NO: 15113 - RNA, 24 nt, Human
uggcaaccucgcagugucauggug

SEQ ID NO: 15114 - RNA, 22 nt, Human
uggcaagaucucggcuuacuac

SEQ ID NO: 15115 - RNA, 22 nt, Human
uggcaagcaagaagcgggagcu

SEQ ID NO: 15116 - RNA, 24 nt, Human
uggcaagcaguuccaguccgagca

SEQ ID NO: 15117 - RNA, 21 nt, Human
uggcaagcaugugguguuugg

SEQ ID NO: 15118 - RNA, 24 nt, Human
uggcaaguaaaugcaguacuguuc

SEQ ID NO: 15119 - RNA, 24 nt, Human
uggcaagucacuuugacagacauu

SEQ ID NO: 15120 - RNA, 24 nt, Human
uggcaagugggugguauagaggcu

SEQ ID NO: 15121 - RNA, 24 nt, Human
uggcaauuagugugacaguuucca

SEQ ID NO: 15122 - RNA, 24 nt, Human
uggcacaggccucaccugcagccu

SEQ ID NO: 15123 - RNA, 24 nt, Human
uggcacagguguggccucagccgg

SEQ ID NO: 15124 - RNA, 24 nt, Human
uggcaccauggaugccuucgugaa

SEQ ID NO: 15125 - RNA, 24 nt, Human
uggcaccauguuggccucuucagg

SEQ ID NO: 15126 - RNA, 24 nt, Human
uggcaccggcccugccugcgcugc

SEQ ID NO: 15127 - RNA, 24 nt, Human
uggcacguuuguugaaacccagca

SEQ ID NO: 15128 - RNA, 24 nt, Human
uggcacugaagaacaccugugagu

SEQ ID NO: 15129 - RNA, 24 nt, Human
uggcacugcaggaguagacuggug

SEQ ID NO: 15130 - RNA, 24 nt, Human
uggcacugccggccccuggcccua

SEQ ID NO: 15131 - RNA, 22 nt, Human
uggcacuguuuggucugagggg

SEQ ID NO: 15132 - RNA, 22 nt, Human
uggcacuuuauucucucgaauc

SEQ ID NO: 15133 - RNA, 24 nt, Human
uggcagaaaacuggagaccaggca

SEQ ID NO: 15134 - RNA, 22 nt, Human
uggcagaaaaggcccaaucgcc

SEQ ID NO: 15135 - RNA, 24 nt, Human
uggcagaagauggugacuggagug

SEQ ID NO: 15136 - RNA, 24 nt, Human
uggcagaagccugggagacugacu

SEQ ID NO: 15137 - RNA, 24 nt, Human
uggcagaauacaagucauuucaau

SEQ ID NO: 15138 - RNA, 24 nt, Human
uggcagagagcaccuuagcaggcc

SEQ ID NO: 15139 - RNA, 24 nt, Human
uggcagaguacggcugcuguugga

SEQ ID NO: 15140 - RNA, 24 nt, Human
uggcagaguuaaauugugcuuuug

SEQ ID NO: 15141 - RNA, 24 nt, Human
uggcagauugauaccugccugguc

SEQ ID NO: 15142 - RNA, 22 nt, Human
uggcagauuugguugcuguugg

SEQ ID NO: 15143 - RNA, 24 nt, Human
uggcagcacccacgaugcgggacc

SEQ ID NO: 15144 - RNA, 24 nt, Human
uggcagcaucauggaagggggcgg

SEQ ID NO: 15145 - RNA, 24 nt, Human
uggcagccgcauggacaggcagac

SEQ ID NO: 15146 - RNA, 24 nt, Human
uggcagccgggagaggagcaagcg

SEQ ID NO: 15147 - RNA, 19 nt, Human
uggcagcgagcuggccaug

SEQ ID NO: 15148 - RNA, 24 nt, Human
uggcaggaagggggcagccugcaa

SEQ ID NO: 15149 - RNA, 24 nt, Human
uggcaggcacgccgggcagaguag

SEQ ID NO: 15150 - RNA, 24 nt, Human
uggcaggccauucacgggcuaugg

SEQ ID NO: 15151 - RNA, 24 nt, Human
uggcagggaacaaaugccaaguga

SEQ ID NO: 15152 - RNA, 24 nt, Human
uggcagggcccagugcugggccgg

SEQ ID NO: 15153 - RNA, 24 nt, Human
uggcaggggaacgcuccuggauga

SEQ ID NO: 15154 - RNA, 24 nt, Human
uggcaguagacucugaagcuaagg

SEQ ID NO: 15155 - RNA, 24 nt, Human
uggcagugagagaauccuggcaga

SEQ ID NO: 15156 - RNA, 24 nt, Human
uggcagugccugacggcgcgucug

SEQ ID NO: 15157 - RNA, 24 nt, Human
uggcagugcuccuggcgucgugga

SEQ ID NO: 15158 - RNA, 24 nt, Human
uggcagugguggaggugggcauug

SEQ ID NO: 15159 - RNA, 24 nt, Human
uggcauaggcguugaugugaccgu

SEQ ID NO: 15160 - RNA, 24 nt, Human
uggcauaucacgaacagcaaagcg

SEQ ID NO: 15161 - RNA, 24 nt, Human
uggcaucagugguggcgccugggc

SEQ ID NO: 15162 - RNA, 17 nt, Human
uggcaucccacagccuc

SEQ ID NO: 15163 - RNA, 24 nt, Human
uggcauccgagagagacuggagca

SEQ ID NO: 15164 - RNA, 22 nt, Human
uggcaugaaaagaaaggguauc

SEQ ID NO: 15165 - RNA, 24 nt, Human
uggcauggauggugguccuguagu

SEQ ID NO: 15166 - RNA, 24 nt, Human
uggcauggggugaacuguuuucca

SEQ ID NO: 15167 - RNA, 24 nt, Human
uggcauggguugaguguggccaac

SEQ ID NO: 15168 - RNA, 24 nt, Human
uggcauuguguaagggcagccagc

SEQ ID NO: 15169 - RNA, 24 nt, Human
uggcauuucagaagugagcagugg

SEQ ID NO: 15170 - RNA, 24 nt, Human
uggcauuugcagauguucagcccc

SEQ ID NO: 15171 - RNA, 22 nt, Human
uggccacuuuucagaugaaacc

SEQ ID NO: 15172 - RNA, 24 nt, Human
uggccagagaaucuguccugaggu

SEQ ID NO: 15173 - RNA, 24 nt, Human
uggccaguggggacagucagggac

SEQ ID NO: 15174 - RNA, 24 nt, Human
uggcccagacaccuccacgcugcu

SEQ ID NO: 15175 - RNA, 24 nt, Human
uggccccacgcuuaccaaccuuga

SEQ ID NO: 15176 - RNA, 22 nt, Human
uggcccucacuuucuucuauuu

SEQ ID NO: 15177 - RNA, 24 nt, Human
uggccgaaggggaacucgguguau

SEQ ID NO: 15178 - RNA, 22 nt, Human
uggccgugugguuagugauugg

SEQ ID NO: 15179 - RNA, 24 nt, Human
uggccucgguggacucgcuccucu

SEQ ID NO: 15180 - RNA, 24 nt, Human
uggccugaugauccacagcuggag

SEQ ID NO: 15181 - RNA, 24 nt, Human
uggccugcuuccaggcugcagaau

SEQ ID NO: 15182 - RNA, 24 nt, Human
uggccuggcaucccgagcccagag

SEQ ID NO: 15183 - RNA, 24 nt, Human
uggcgcagaugagugaggcacccu

SEQ ID NO: 15184 - RNA, 22 nt, Human
uggcgccauucuucagggcagc

SEQ ID NO: 15185 - RNA, 24 nt, Human
uggcgccggccgucgcuguacggu

SEQ ID NO: 15186 - RNA, 24 nt, Human
uggcgcucuacauccugcuccuca

SEQ ID NO: 15187 - RNA, 24 nt, Human
uggcggccaugaguuguugcggcg

SEQ ID NO: 15188 - RNA, 24 nt, Human
uggcggccaugaguuuguugcggc

SEQ ID NO: 15189 - RNA, 24 nt, Human
uggcgggcaccuuugguucucagu

SEQ ID NO: 15190 - RNA, 24 nt, Human
uggcguaauaccgaagaggccuga

SEQ ID NO: 15191 - RNA, 24 nt, Human
uggcgugcucugggugggugugcg

SEQ ID NO: 15192 - RNA, 24 nt, Human
uggcguggugaccaagaugaagau

SEQ ID NO: 15193 - RNA, 24 nt, Human
uggcuaaauggggaugaggagaca

SEQ ID NO: 15194 - RNA, 24 nt, Human
uggcuaaugagcaggcguuucuuc

SEQ ID NO: 15195 - RNA, 24 nt, Human
uggcuagaaacuugucagcaugaa

SEQ ID NO: 15196 - RNA, 24 nt, Human
uggcucagauccagacaaugucuc

SEQ ID NO: 15197 - RNA, 24 nt, Human
uggcucaggaaggauucagccugg

SEQ ID NO: 15198 - RNA, 24 nt, Human
uggcuccacaggcaaacccaaggg

SEQ ID NO: 15199 - RNA, 22 nt, Human
uggcucgcaacuguaaucucag

SEQ ID NO: 15200 - RNA, 24 nt, Human
uggcugaagcuccuaauauggcag

SEQ ID NO: 15201 - RNA, 22 nt, Human
uggcugagaacuuacaaggguu

SEQ ID NO: 15202 - RNA, 24 nt, Human
uggcugagggaagcagugaugggg

SEQ ID NO: 15203 - RNA, 24 nt, Human
uggcugccugcucagggccuggcu

SEQ ID NO: 15204 - RNA, 24 nt, Human
uggcuggacuaugucagggcucgu

SEQ ID NO: 15205 - RNA, 24 nt, Human
uggcuggcguugcugcgcuccgug

SEQ ID NO: 15206 - RNA, 24 nt, Human
uggcuggggauguucauauuguga

SEQ ID NO: 15207 - RNA, 24 nt, Human
uggcuggggucggggagggguaca

SEQ ID NO: 15208 - RNA, 24 nt, Human
uggcugggguuaccguggccugga

SEQ ID NO: 15209 - RNA, 24 nt, Human
uggcugggugaaagggaauggaau

SEQ ID NO: 15210 - RNA, 24 nt, Human
uggcuuaggcagaauucuccucug

SEQ ID NO: 15211 - RNA, 24 nt, Human
uggcuuauaccccaagaggauggg

SEQ ID NO: 15212 - RNA, 24 nt, Human
uggcuucacucucacaaacuccuu

SEQ ID NO: 15213 - RNA, 24 nt, Human
uggcuuccuuuuauuucuugagga

SEQ ID NO: 15214 - RNA, 24 nt, Human
uggcuugggucgagcucugucaca

SEQ ID NO: 15215 - RNA, 22 nt, Human
uggcuuuucauuccuaugugau

SEQ ID NO: 15216 - RNA, 24 nt, Human
ugggaaaaagcuaucugggugcaa

SEQ ID NO: 15217 - RNA, 24 nt, Human
ugggaacuuuguaguuuaucaugu

SEQ ID NO: 15218 - RNA, 22 nt, Human
ugggaagaugcuggcaaggugc

SEQ ID NO: 15219 - RNA, 24 nt, Human
ugggaaggaacacaggccuccagc

SEQ ID NO: 15220 - RNA, 24 nt, Human
ugggaagggaaguuaucaagacga

SEQ ID NO: 15221 - RNA, 24 nt, Human
ugggaauccaggaucaagccugcg

SEQ ID NO: 15222 - RNA, 24 nt, Human
ugggacauaagcaaagauuuggug

SEQ ID NO: 15223 - RNA, 24 nt, Human
ugggaccaagcaauccucccaccu

SEQ ID NO: 15224 - RNA, 19 nt, Human
ugggaccacauugaagggu

SEQ ID NO: 15225 - RNA, 21 nt, Human
ugggaccgguucccggggguc

SEQ ID NO: 15226 - RNA, 24 nt, Human
ugggacguccucucauacugaugu

SEQ ID NO: 15227 - RNA, 20 nt, Human
ugggacucaucuuccuuuca

SEQ ID NO: 15228 - RNA, 24 nt, Human
ugggacucauuauggaagaauggg

SEQ ID NO: 15229 - RNA, 22 nt, Human
ugggacugguuagacagugggu

SEQ ID NO: 15230 - RNA, 24 nt, Human
ugggagaaagaacgcggggcccga

SEQ ID NO: 15231 - RNA, 24 nt, Human
ugggagaaauuaccugauuguuaa

SEQ ID NO: 15232 - RNA, 24 nt, Human
ugggagacagauucagcuagaagc

SEQ ID NO: 15233 - RNA, 24 nt, Human
ugggagacagcuggcaucaucuga

SEQ ID NO: 15234 - RNA, 22 nt, Human
ugggagcuucucuaccacagcu

SEQ ID NO: 15235 - RNA, 24 nt, Human
ugggaggaagaucuccagcuucag

SEQ ID NO: 15236 - RNA, 24 nt, Human
ugggaggcagcggaaucugagacg

SEQ ID NO: 15237 - RNA, 22 nt, Human
ugggaggcuacacguuucucca

SEQ ID NO: 15238 - RNA, 22 nt, Human
ugggagggggcagcugggcuga

SEQ ID NO: 15239 - RNA, 24 nt, Human
ugggagggguccccucggagggag

SEQ ID NO: 15240 - RNA, 24 nt, Human
ugggaucggcaugagcaaaagcuc

SEQ ID NO: 15241 - RNA, 24 nt, Human
ugggaucucacuuuguuguccaau

SEQ ID NO: 15242 - RNA, 24 nt, Human
ugggaugcauaaugccagcaaguu

SEQ ID NO: 15243 - RNA, 24 nt, Human
ugggaugggcgguggcggcccggg

SEQ ID NO: 15244 - RNA, 22 nt, Human
ugggaugguuaaaccucucuuc

SEQ ID NO: 15245 - RNA, 24 nt, Human
ugggaugugaagagcuuggaguca

SEQ ID NO: 15246 - RNA, 21 nt, Human
ugggauuacaggcaugaguca

SEQ ID NO: 15247 - RNA, 21 nt, Human
ugggauuacaggccugagcca

SEQ ID NO: 15248 - RNA, 24 nt, Human
ugggauuauaggcaugaggcuccg

SEQ ID NO: 15249 - RNA, 24 nt, Human
ugggauugguggugauauccccuu

SEQ ID NO: 15250 - RNA, 23 nt, Human
ugggcaaaggccccuguugccgc

SEQ ID NO: 15251 - RNA, 22 nt, Human
ugggcaacauggugaaacccca

SEQ ID NO: 15252 - RNA, 22 nt, Human
ugggcaauauagcaagacccca

SEQ ID NO: 15253 - RNA, 22 nt, Human
ugggcacauacugcaucauuua

SEQ ID NO: 15254 - RNA, 24 nt, Human
ugggcaguauaauugauuugcagg

SEQ ID NO: 15255 - RNA, 22 nt, Human
ugggcucgcucuucagucucgg

SEQ ID NO: 15256 - RNA, 24 nt, Human
ugggcuuguagggccggcggcagc

SEQ ID NO: 15257 - RNA, 22 nt, Human
uggggacccaugaacagcacug

SEQ ID NO: 15258 - RNA, 24 nt, Human
uggggagagacacaggcaggcgag

SEQ ID NO: 15259 - RNA, 22 nt, Human
uggggagagacuguucccaggc

SEQ ID NO: 15260 - RNA, 24 nt, Human
uggggaggcuggggagggucccgg

SEQ ID NO: 15261 - RNA, 24 nt, Human
uggggcacucgcugcccucagcgc

SEQ ID NO: 15262 - RNA, 22 nt, Human
uggggcacuguggaggugucau

SEQ ID NO: 15263 - RNA, 22 nt, Human
uggggccacucuuaaaagggcg

SEQ ID NO: 15264 - RNA, 24 nt, Human
uggggccaggacagggaagcugga

SEQ ID NO: 15265 - RNA, 24 nt, Human
uggggcugaucaagggcagagagc

SEQ ID NO: 15266 - RNA, 24 nt, Human
ugggggaaaaccccgauaggguug

SEQ ID NO: 15267 - RNA, 22 nt, Human
uggggggaaguuaauuaugaag

SEQ ID NO: 15268 - RNA, 22 nt, Human
uggggggaggaauuuucugguc

SEQ ID NO: 15269 - RNA, 24 nt, Human
ugggggugggaagauggaauacug

SEQ ID NO: 15270 - RNA, 24 nt, Human
ugggguagagcaauggucugggcc

SEQ ID NO: 15271 - RNA, 24 nt, Human
uggggucaugccgaacacccauga

SEQ ID NO: 15272 - RNA, 22 nt, Human
ugggguggcagguauuagggau

SEQ ID NO: 15273 - RNA, 24 nt, Human
ugggguggggauuauguguggccc

SEQ ID NO: 15274 - RNA, 24 nt, Human
ugggguuguggugcguauaccauu

SEQ ID NO: 15275 - RNA, 24 nt, Human
ugggugaggcaggcuaagcgggau

SEQ ID NO: 15276 - RNA, 24 nt, Human
ugggugccaauuucguggugugga

SEQ ID NO: 15277 - RNA, 24 nt, Human
ugggugcgugaugccuccucuggg

SEQ ID NO: 15278 - RNA, 24 nt, Human
uggguggagauggggaguccuuug

SEQ ID NO: 15279 - RNA, 24 nt, Human
uggguggaugcugcucucgaauaa

SEQ ID NO: 15280 - RNA, 24 nt, Human
uggguguauaacuacaguauuaau

SEQ ID NO: 15281 - RNA, 21 nt, Human
uggguguggacgucuaugacc

SEQ ID NO: 15282 - RNA, 24 nt, Human
uggguucaggucguaugccaggug

SEQ ID NO: 15283 - RNA, 24 nt, Human
ugguaaagacuauauuuuguacuu

SEQ ID NO: 15284 - RNA, 24 nt, Human
ugguaaggaauaaaaaauguacag

SEQ ID NO: 15285 - RNA, 24 nt, Human
ugguaaguauaaacuucauucaua

SEQ ID NO: 15286 - RNA, 24 nt, Human
ugguacauugguuuuccuuuauga

SEQ ID NO: 15287 - RNA, 24 nt, Human
ugguauacuacugcuuugcggaau

SEQ ID NO: 15288 - RNA, 22 nt, Human
ugguauggacucucugcagcua

SEQ ID NO: 15289 - RNA, 24 nt, Human
ugguauugaugaugaacgucuccg

SEQ ID NO: 15290 - RNA, 24 nt, Human
ugguauuuguagcacaauacauca

SEQ ID NO: 15291 - RNA, 24 nt, Human
ugguauuuucuuuuggcaagaugc

SEQ ID NO: 15292 - RNA, 22 nt, Human
ugguccagaggaggaaugaggg

SEQ ID NO: 15293 - RNA, 22 nt, Human
ugguccuauugaggccaguguc

SEQ ID NO: 15294 - RNA, 24 nt, Human
uggucuguaucaaaguuggccaac

SEQ ID NO: 15295 - RNA, 22 nt, Human
uggucuugucgaagaggaagug

SEQ ID NO: 15296 - RNA, 22 nt, Human
uggugaagagggcgugaggaaa

SEQ ID NO: 15297 - RNA, 23 nt, Human
uggugagcccagagcccgagccc

SEQ ID NO: 15298 - RNA, 23 nt, Human
uggugaguguaaaugagugaggc

SEQ ID NO: 15299 - RNA, 22 nt, Human
uggugcuagugucauagcuccc

SEQ ID NO: 15300 - RNA, 22 nt, Human
uggugcucuugaaggacagaug

SEQ ID NO: 15301 - RNA, 22 nt, Human
ugguggggagaggcuugggaag

SEQ ID NO: 15302 - RNA, 22 nt, Human
uggugguuuagcuucugucuac

SEQ ID NO: 15303 - RNA, 24 nt, Human
uggugugcacccucuguuucuugu

SEQ ID NO: 15304 - RNA, 24 nt, Human
ugguguggaggugcucauggggug

SEQ ID NO: 15305 - RNA, 24 nt, Human
ugguguguaucggcccagggugac

SEQ ID NO: 15306 - RNA, 22 nt, Human
ugguuauuguuuucugccuugu

SEQ ID NO: 15307 - RNA, 24 nt, Human
ugguucuguaaaaaccagugaauu

SEQ ID NO: 15308 - RNA, 24 nt, Human
ugguuugaauguucccuccaacac

SEQ ID NO: 15309 - RNA, 24 nt, Human
ugguuugguaaagaaauccaaaga

SEQ ID NO: 15310 - RNA, 24 nt, Human
uguaaaccaaggucuguaacauca

SEQ ID NO: 15311 - RNA, 22 nt, Human
uguaaacuugucuugaauggaa

SEQ ID NO: 15312 - RNA, 24 nt, Human
uguaaagauguacagcaguuaaaa

SEQ ID NO: 15313 - RNA, 24 nt, Human
uguaacuacuauuggcuauguguu

SEQ ID NO: 15314 - RNA, 24 nt, Human
uguaagcucucagcacugaucaug

SEQ ID NO: 15315 - RNA, 19 nt, Human
uguaaugccaauaaccugu

SEQ ID NO: 15316 - RNA, 24 nt, Human
uguacaaaaccuaauuuguuguca

SEQ ID NO: 15317 - RNA, 22 nt, Human
uguacaaggggcucagccagcc

SEQ ID NO: 15318 - RNA, 22 nt, Human
uguacacaacgugcagguuugu

SEQ ID NO: 15319 - RNA, 24 nt, Human
uguacaggaagaaccuaguguuuc

SEQ ID NO: 15320 - RNA, 24 nt, Human
uguacagucgacugcaaaugaaac

SEQ ID NO: 15321 - RNA, 22 nt, Human
uguaccuaugggaagccuguca

SEQ ID NO: 15322 - RNA, 24 nt, Human
uguacgccgccagcugggugagca

SEQ ID NO: 15323 - RNA, 22 nt, Human
uguagugagcuaaccuugaucu

SEQ ID NO: 15324 - RNA, 24 nt, Human
uguauagacuucauucauauauuu

SEQ ID NO: 15325 - RNA, 24 nt, Human
uguaucaaucagcugacuguucug

SEQ ID NO: 15326 - RNA, 22 nt, Human
uguaugaagaagggaguagggc

SEQ ID NO: 15327 - RNA, 24 nt, Human
ugucaaaccguugugcccccagug

SEQ ID NO: 15328 - RNA, 24 nt, Human
ugucaagccccgcagcagcagcgc

SEQ ID NO: 15329 - RNA, 24 nt, Human
ugucaaggucuaguaggggaucca

SEQ ID NO: 15330 - RNA, 24 nt, Human
ugucaaguccuggacccuucccug

SEQ ID NO: 15331 - RNA, 22 nt, Human
ugucacaguuccgaggcagcag

SEQ ID NO: 15332 - RNA, 24 nt, Human
ugucagaagcucaaagcgacucau

SEQ ID NO: 15333 - RNA, 24 nt, Human
ugucagagcugagucugguguuac

SEQ ID NO: 15334 - RNA, 24 nt, Human
ugucagggccucacuguggaagga

SEQ ID NO: 15335 - RNA, 24 nt, Human
ugucaggguuugccucagaagugc

SEQ ID NO: 15336 - RNA, 22 nt, Human
ugucauaccgugccucgggguu

SEQ ID NO: 15337 - RNA, 22 nt, Human
ugucaucaacaccaguggccaa

SEQ ID NO: 15338 - RNA, 22 nt, Human
ugucauucuggaugucuugcac

SEQ ID NO: 15339 - RNA, 24 nt, Human
ugucauugguggccaugcugggaa

SEQ ID NO: 15340 - RNA, 24 nt, Human
uguccaagauuguccagaccuacc

SEQ ID NO: 15341 - RNA, 24 nt, Human
uguccagaagauccuggagcacau

SEQ ID NO: 15342 - RNA, 24 nt, Human
uguccagacuuugagggcuacagg

SEQ ID NO: 15343 - RNA, 24 nt, Human
uguccagagcuuucaugccuuaaa

SEQ ID NO: 15344 - RNA, 24 nt, Human
uguccagccuggggucugggugua

SEQ ID NO: 15345 - RNA, 22 nt, Human
uguccaugugacuaaguucugg

SEQ ID NO: 15346 - RNA, 24 nt, Human
ugucccaaccgggugguggaccuu

SEQ ID NO: 15347 - RNA, 22 nt, Human
ugucccaggcuguuuuuauguu

SEQ ID NO: 15348 - RNA, 22 nt, Human
uguccccucaacuggaguucua

SEQ ID NO: 15349 - RNA, 24 nt, Human
ugucccggacagugcgugcgagcg

SEQ ID NO: 15350 - RNA, 22 nt, Human
uguccgaguucaucguguacua

SEQ ID NO: 15351 - RNA, 22 nt, Human
uguccggggcugcacgcgcgcu

SEQ ID NO: 15352 - RNA, 24 nt, Human
uguccucgcccucucccgugaggc

SEQ ID NO: 15353 - RNA, 24 nt, Human
uguccugauggagugaaagggauc

SEQ ID NO: 15354 - RNA, 22 nt, Human
uguccuuuguuuugagauggag

SEQ ID NO: 15355 - RNA, 22 nt, Human
ugucgcagagccuggagucugg

SEQ ID NO: 15356 - RNA, 24 nt, Human
ugucgggggagggcugccgucgag

SEQ ID NO: 15357 - RNA, 24 nt, Human
ugucuagcgcaugcaggugccguc

SEQ ID NO: 15358 - RNA, 24 nt, Human
ugucuagugaugaguuugcuaaua

SEQ ID NO: 15359 - RNA, 22 nt, Human
ugucucagaccuugccccacca

SEQ ID NO: 15360 - RNA, 24 nt, Human
ugucuggauuuuccagcuagagau

SEQ ID NO: 15361 - RNA, 24 nt, Human
ugucugugucuaucucccuaucug

SEQ ID NO: 15362 - RNA, 22 nt, Human
ugucuguuuuucaaauaaccca

SEQ ID NO: 15363 - RNA, 24 nt, Human
ugucuuggucuugugcuucuccuu

SEQ ID NO: 15364 - RNA, 23 nt, Human
ugucuugguucuuugcugucugg

SEQ ID NO: 15365 - RNA, 24 nt, Human
ugucuugugaagccuugcugcagg

SEQ ID NO: 15366 - RNA, 24 nt, Human
ugugaacacauguacuccagcagc

SEQ ID NO: 15367 - RNA, 24 nt, Human
ugugaacgggaagaaggugcugca

SEQ ID NO: 15368 - RNA, 24 nt, Human
ugugaagaagacauggagaaugga

SEQ ID NO: 15369 - RNA, 20 nt, Human
ugugaagauaacuuucaugu

SEQ ID NO: 15370 - RNA, 24 nt, Human
ugugaagcccgagaugcaggaagg

SEQ ID NO: 15371 - RNA, 24 nt, Human
ugugaaggcgacauguauaaugac

SEQ ID NO: 15372 - RNA, 24 nt, Human
ugugaaggguuugcugggggccaa

SEQ ID NO: 15373 - RNA, 24 nt, Human
ugugaaggugaugagauuuccauc

SEQ ID NO: 15374 - RNA, 24 nt, Human
ugugaauaaauuaaaugacucuuu

SEQ ID NO: 15375 - RNA, 24 nt, Human
ugugaauagugcaacgccggguaa

SEQ ID NO: 15376 - RNA, 24 nt, Human
ugugacacuuucucagucuuuucu

SEQ ID NO: 15377 - RNA, 24 nt, Human
ugugacccaagcuguguccaaucu

SEQ ID NO: 15378 - RNA, 22 nt, Human
ugugacugaggugcgcauaaag

SEQ ID NO: 15379 - RNA, 22 nt, Human
ugugagagaagggagcaguucg

SEQ ID NO: 15380 - RNA, 24 nt, Human
ugugagagguggcaggaaugggga

SEQ ID NO: 15381 - RNA, 24 nt, Human
ugugagagucuaauggugagcucu

SEQ ID NO: 15382 - RNA, 24 nt, Human
ugugaggaggaccugaugcccgag

SEQ ID NO: 15383 - RNA, 22 nt, Human
ugugagguaauuccaguacauu

SEQ ID NO: 15384 - RNA, 22 nt, Human
ugugaguacauagcucaccuau

SEQ ID NO: 15385 - RNA, 24 nt, Human
ugugaugagaagaagaaugcauug

SEQ ID NO: 15386 - RNA, 24 nt, Human
ugugaugaggucaggaacuaggaa

SEQ ID NO: 15387 - RNA, 24 nt, Human
ugugauuuuaguaggaaauuuauu

SEQ ID NO: 15388 - RNA, 24 nt, Human
ugugcacaucggacaaacaggagc

SEQ ID NO: 15389 - RNA, 24 nt, Human
ugugcacauguauguguguuauuu

SEQ ID NO: 15390 - RNA, 24 nt, Human
ugugcagagaaauagcagagugau

SEQ ID NO: 15391 - RNA, 21 nt, Human
ugugcagcaccaguguguugg

SEQ ID NO: 15392 - RNA, 24 nt, Human
ugugcagcuugaucggcggcgccg

SEQ ID NO: 15393 - RNA, 24 nt, Human
ugugcagguagguaggggauggca

SEQ ID NO: 15394 - RNA, 24 nt, Human
ugugcagucuugcuuacaaggagg

SEQ ID NO: 15395 - RNA, 24 nt, Human
ugugcauggcagcuguuuuccuuu

SEQ ID NO: 15396 - RNA, 24 nt, Human
ugugccagcguugggcaauaaaag

SEQ ID NO: 15397 - RNA, 24 nt, Human
ugugcggagaaggcaugagcuggc

SEQ ID NO: 15398 - RNA, 22 nt, Human
ugugcggguuuguuacauaggu

SEQ ID NO: 15399 - RNA, 24 nt, Human
ugugcuaaucuaaagaacgaauca

SEQ ID NO: 15400 - RNA, 24 nt, Human
ugugcugguccgacaccugggcua

SEQ ID NO: 15401 - RNA, 20 nt, Human
ugugcuuggauguuaguucu

SEQ ID NO: 15402 - RNA, 24 nt, Human
ugugcuuguacgccgccucgucca

SEQ ID NO: 15403 - RNA, 24 nt, Human
uguggaagagcagacccaggagcu

SEQ ID NO: 15404 - RNA, 24 nt, Human
uguggagaagaguucugugucugg

SEQ ID NO: 15405 - RNA, 24 nt, Human
uguggagaguggagugcaccaggu

SEQ ID NO: 15406 - RNA, 24 nt, Human
uguggaguggaucgaacuuccucg

SEQ ID NO: 15407 - RNA, 22 nt, Human
uguggcaaugcccguugcucag

SEQ ID NO: 15408 - RNA, 24 nt, Human
uguggcagauacuguuagugccca

SEQ ID NO: 15409 - RNA, 24 nt, Human
uguggccagcuccagcagggggau

SEQ ID NO: 15410 - RNA, 24 nt, Human
uguggcucucggguccuaaaugug

SEQ ID NO: 15411 - RNA, 23 nt, Human
uguggcugugaagauguaucgaa

SEQ ID NO: 15412 - RNA, 24 nt, Human
uguggcuuucauuaauauaguucu

SEQ ID NO: 15413 - RNA, 24 nt, Human
ugugggaauuguuuuucaucuguu

SEQ ID NO: 15414 - RNA, 24 nt, Human
ugugggaucuuugggcuuggggcu

SEQ ID NO: 15415 - RNA, 22 nt, Human
uguggguagugguuugugcugu

SEQ ID NO: 15416 - RNA, 22 nt, Human
ugugguaguagugugaacauua

SEQ ID NO: 15417 - RNA, 24 nt, Human
uguggucggguguuugcuggugcc

SEQ ID NO: 15418 - RNA, 24 nt, Human
uguggucuguucaagugaucuuuu

SEQ ID NO: 15419 - RNA, 24 nt, Human
ugugguugugagucugagcuugug

SEQ ID NO: 15420 - RNA, 24 nt, Human
ugugguuuauuuuauauucuacuu

SEQ ID NO: 15421 - RNA, 24 nt, Human
uguguaaaucuuaaaauuuuuuaa

SEQ ID NO: 15422 - RNA, 23 nt, Human
uguguacacucccuaggacugau

SEQ ID NO: 15423 - RNA, 24 nt, Human
uguguacauauauguguguauaua

SEQ ID NO: 15424 - RNA, 22 nt, Human
uguguacggugcacacacacag

SEQ ID NO: 15425 - RNA, 24 nt, Human
uguguacggugcacacacacagug

SEQ ID NO: 15426 - RNA, 24 nt, Human
uguguagcaccugggucagcugac

SEQ ID NO: 15427 - RNA, 24 nt, Human
ugugucaaagacaucgguuaucaa

SEQ ID NO: 15428 - RNA, 22 nt, Human
ugugucacugagugaaagcugc

SEQ ID NO: 15429 - RNA, 24 nt, Human
ugugucccuuucaacucagacuuu

SEQ ID NO: 15430 - RNA, 24 nt, Human
ugugucuccaguccucucuggagg

SEQ ID NO: 15431 - RNA, 22 nt, Human
ugugucuguggaacagaagcag

SEQ ID NO: 15432 - RNA, 24 nt, Human
ugugucuuuuagcuacagaggagg

SEQ ID NO: 15433 - RNA, 22 nt, Human
ugugugauuugauuccaagcua

SEQ ID NO: 15434 - RNA, 24 nt, Human
ugugugcacguacauacuguauag

SEQ ID NO: 15435 - RNA, 22 nt, Human
ugugugcucacaaguguucccu

SEQ ID NO: 15436 - RNA, 22 nt, Human
ugugugugugauguguguuuug

SEQ ID NO: 15437 - RNA, 24 nt, Human
uguguugcccaggccggucacaaa

SEQ ID NO: 15438 - RNA, 24 nt, Human
uguguuguggaaccugagauuccu

SEQ ID NO: 15439 - RNA, 22 nt, Human
uguuaacauuuuucagcccaga

SEQ ID NO: 15440 - RNA, 24 nt, Human
uguuaaucggcgaggguugggcaa

SEQ ID NO: 15441 - RNA, 24 nt, Human
uguuauggucuuuaugaaaacaaa

SEQ ID NO: 15442 - RNA, 24 nt, Human
uguuauguggaucuguguggaaag

SEQ ID NO: 15443 - RNA, 24 nt, Human
uguucagauucuuuuguaccacgu

SEQ ID NO: 15444 - RNA, 24 nt, Human
uguucaggauacggcugauuugau

SEQ ID NO: 15445 - RNA, 24 nt, Human
uguucaggugcuccagaagcccca

SEQ ID NO: 15446 - RNA, 24 nt, Human
uguuccaacacggcaagguggaga

SEQ ID NO: 15447 - RNA, 24 nt, Human
uguuccuagcuuaguguuuuguuu

SEQ ID NO: 15448 - RNA, 22 nt, Human
uguucgcguaaccugcugaucc

SEQ ID NO: 15449 - RNA, 22 nt, Human
uguucggcaagaagagagggcu

SEQ ID NO: 15450 - RNA, 24 nt, Human
uguucugugaauguguccauaugu

SEQ ID NO: 15451 - RNA, 24 nt, Human
uguugagggccguuccuugggcag

SEQ ID NO: 15452 - RNA, 24 nt, Human
uguugaguagccgggauccuuggg

SEQ ID NO: 15453 - RNA, 24 nt, Human
uguugauacugcuggaauccagag

SEQ ID NO: 15454 - RNA, 22 nt, Human
uguugcagaugguggauaccaa

SEQ ID NO: 15455 - RNA, 24 nt, Human
uguugcugugggccacgcugaacg

SEQ ID NO: 15456 - RNA, 24 nt, Human
uguugcuugauaguguaucauccu

SEQ ID NO: 15457 - RNA, 24 nt, Human
uguugggauggaagcaugaaggaa

SEQ ID NO: 15458 - RNA, 24 nt, Human
uguuguagggcugcuuccggaggc

SEQ ID NO: 15459 - RNA, 20 nt, Human
uguuguaguggcggucccag

SEQ ID NO: 15460 - RNA, 24 nt, Human
uguugugccagaagcuggcggagc

SEQ ID NO: 15461 - RNA, 24 nt, Human
uguuguuuggucuuuaggccugcg

SEQ ID NO: 15462 - RNA, 24 nt, Human
uguuguuuugguccugauaggaag

SEQ ID NO: 15463 - RNA, 24 nt, Human
uguuucacagccaggcaguuuaug

SEQ ID NO: 15464 - RNA, 24 nt, Human
uguuucuuuagcucuccuccaaga

SEQ ID NO: 15465 - RNA, 22 nt, Human
uguuuggccgccagucuuuugu

SEQ ID NO: 15466 - RNA, 24 nt, Human
uguuuuggagugcagugcaggauu

SEQ ID NO: 15467 - RNA, 24 nt, Human
uguuuugggcaccuuuuucagggc

SEQ ID NO: 15468 - RNA, 24 nt, Human
uguuuuguuuuguuuuguuuucuc

SEQ ID NO: 15469 - RNA, 24 nt, Human
uuaaaagaaggcuagcauuguuug

SEQ ID NO: 15470 - RNA, 23 nt, Human
uuaaaagaucacugaaguuggau

SEQ ID NO: 15471 - RNA, 24 nt, Human
uuaaaaguugcugcaaggcugcag

SEQ ID NO: 15472 - RNA, 23 nt, Human
uuaaaauugucuagucucauguc

SEQ ID NO: 15473 - RNA, 24 nt, Human
uuaaagaacuccaacaggacuggg

SEQ ID NO: 15474 - RNA, 24 nt, Human
uuaaagacacuugaccuguuuggg

SEQ ID NO: 15475 - RNA, 24 nt, Human
uuaaagcacuuucuaaagcccuca

SEQ ID NO: 15476 - RNA, 24 nt, Human
uuaaagcagacagaacuuuuugca

SEQ ID NO: 15477 - RNA, 24 nt, Human
uuaaagcuauucaggauuuaguag

SEQ ID NO: 15478 - RNA, 24 nt, Human
uuaaaguaagugugggucaagguc

SEQ ID NO: 15479 - RNA, 22 nt, Human
uuaaagucaccauuuguggguu

SEQ ID NO: 15480 - RNA, 24 nt, Human
uuaaauauuuaguuuggacuugaa

SEQ ID NO: 15481 - RNA, 24 nt, Human
uuaaauggccaauugaaacaaaca

SEQ ID NO: 15482 - RNA, 24 nt, Human
uuaaaugggaaagcccuuuugagc

SEQ ID NO: 15483 - RNA, 22 nt, Human
uuaaauuuaauuugauaggggu

SEQ ID NO: 15484 - RNA, 24 nt, Human
uuaacaaugguaaccccccuaggg

SEQ ID NO: 15485 - RNA, 24 nt, Human
uuaacauagacuugaauuauuuuu

SEQ ID NO: 15486 - RNA, 24 nt, Human
uuaacauaugucaugcuuacagga

SEQ ID NO: 15487 - RNA, 22 nt, Human
uuaaccauugcaaagcacacug

SEQ ID NO: 15488 - RNA, 22 nt, Human
uuaaccccugugggucggcagc

SEQ ID NO: 15489 - RNA, 22 nt, Human
uuaacugagaggaucugaguag

SEQ ID NO: 15490 - RNA, 24 nt, Human
uuaauaggaaagguuuacaagaag

SEQ ID NO: 15491 - RNA, 24 nt, Human
uuaauauuugcaugcaaugucuaa

SEQ ID NO: 15492 - RNA, 24 nt, Human
uuaaugaaacauauuuagagcacu

SEQ ID NO: 15493 - RNA, 24 nt, Human
uuaaugauaggcucuuggggcauc

SEQ ID NO: 15494 - RNA, 24 nt, Human
uuaaugauuauaaaucaggaucua

SEQ ID NO: 15495 - RNA, 22 nt, Human
uuaaugcuaaucgugauagggg

SEQ ID NO: 15496 - RNA, 22 nt, Human
uuaaugcuuuuugucauacuca

SEQ ID NO: 15497 - RNA, 22 nt, Human
uuaaugugugcaaaccauggug

SEQ ID NO: 15498 - RNA, 24 nt, Human
uuaauuugacuuggaauugucuua

SEQ ID NO: 15499 - RNA, 24 nt, Human
uuacaaagaccacuaggaagaggu

SEQ ID NO: 15500 - RNA, 24 nt, Human
uuacagaggcaaguggucccugga

SEQ ID NO: 15501 - RNA, 24 nt, Human
uuacagggugugaguggggauuac

SEQ ID NO: 15502 - RNA, 24 nt, Human
uuacgcugggaccccgccaaggag

SEQ ID NO: 15503 - RNA, 22 nt, Human
uuacuauaggcucauugagaug

SEQ ID NO: 15504 - RNA, 22 nt, Human
uuacugaauguggcaucagggc

SEQ ID NO: 15505 - RNA, 24 nt, Human
uuacugcaaccucugccucccggg

SEQ ID NO: 15506 - RNA, 21 nt, Human
uuacuuugauccucgugaggc

SEQ ID NO: 15507 - RNA, 24 nt, Human
uuagaaguaaauagcagauucaac

SEQ ID NO: 15508 - RNA, 24 nt, Human
uuagaaguggcuauuaagagacga

SEQ ID NO: 15509 - RNA, 22 nt, Human
uuagaccgugcaauuauuaagc

SEQ ID NO: 15510 - RNA, 24 nt, Human
uuagacugcaacagcagcucagga

SEQ ID NO: 15511 - RNA, 24 nt, Human
uuagacuugacgcaacgggagguu

SEQ ID NO: 15512 - RNA, 24 nt, Human
uuagagcagaggaugaucggguuc

SEQ ID NO: 15513 - RNA, 24 nt, Human
uuagagcuggcagcagcaucucag

SEQ ID NO: 15514 - RNA, 24 nt, Human
uuagaguagccuagcaguuuucaa

SEQ ID NO: 15515 - RNA, 24 nt, Human
uuagagugaaguaauugggaaacu

SEQ ID NO: 15516 - RNA, 20 nt, Human
uuagaguuuuaauuguugac

SEQ ID NO: 15517 - RNA, 24 nt, Human
uuagauguacgaacaaggggacuc

SEQ ID NO: 15518 - RNA, 22 nt, Human
uuagcaaacaucuucgugugag

SEQ ID NO: 15519 - RNA, 24 nt, Human
uuagcaaagguuggaggugucuug

SEQ ID NO: 15520 - RNA, 24 nt, Human
uuagcacagguccaauauccaugg

SEQ ID NO: 15521 - RNA, 24 nt, Human
uuagcacucagggcuuccaggugu

SEQ ID NO: 15522 - RNA, 24 nt, Human
uuagcagcuguuuaauuccaauau

SEQ ID NO: 15523 - RNA, 22 nt, Human
uuagcaguugugagacccuaga

SEQ ID NO: 15524 - RNA, 22 nt, Human
uuaggacagcugacauacuugu

SEQ ID NO: 15525 - RNA, 21 nt, Human
uuaggccaagcaugguggcuc

SEQ ID NO: 15526 - RNA, 24 nt, Human
uuaggcccuuuuuguugugcuucu

SEQ ID NO: 15527 - RNA, 22 nt, Human
uuagggcaggcaugagagaacu

SEQ ID NO: 15528 - RNA, 22 nt, Human
uuaggguggcaaggguggucuu

SEQ ID NO: 15529 - RNA, 22 nt, Human
uuagguauuagcaaucugugcu

SEQ ID NO: 15530 - RNA, 24 nt, Human
uuaguacgggucuagaagccaguu

SEQ ID NO: 15531 - RNA, 24 nt, Human
uuagugaaguaacagacagcagcc

SEQ ID NO: 15532 - RNA, 24 nt, Human
uuagugcuuuuaaaccaacuugcg

SEQ ID NO: 15533 - RNA, 20 nt, Human
uuaguggggaggaggguggg

SEQ ID NO: 15534 - RNA, 24 nt, Human
uuagugguccuaagccccgcagug

SEQ ID NO: 15535 - RNA, 24 nt, Human
uuaguugaugaauucuugaagagc

SEQ ID NO: 15536 - RNA, 24 nt, Human
uuaguugguggagcgauuugucug

SEQ ID NO: 15537 - RNA, 24 nt, Human
uuauaagcccccacuucaccgcag

SEQ ID NO: 15538 - RNA, 24 nt, Human
uuaucaggggcccuuccucggaug

SEQ ID NO: 15539 - RNA, 24 nt, Human
uuaucauguaguaccggaggagac

SEQ ID NO: 15540 - RNA, 22 nt, Human
uuauccuaaauguguuuugaag

SEQ ID NO: 15541 - RNA, 24 nt, Human
uuauucuccaacaacuggaacuug

SEQ ID NO: 15542 - RNA, 24 nt, Human
uuauugcacuccagcccgggcgac

SEQ ID NO: 15543 - RNA, 24 nt, Human
uuauugguucgagaaggaauuggu

SEQ ID NO: 15544 - RNA, 24 nt, Human
uucaaauaaacuuauuugaaaagu

SEQ ID NO: 15545 - RNA, 24 nt, Human
uucaaauucuuccccucggcaaug

SEQ ID NO: 15546 - RNA, 21 nt, Human
uucaacacaaguaauugaguu

SEQ ID NO: 15547 - RNA, 22 nt, Human
uucaagaacccucaggaggcug

SEQ ID NO: 15548 - RNA, 24 nt, Human
uucaagaaucacugguguccgagg

SEQ ID NO: 15549 - RNA, 23 nt, Human
uucaagagcuaagaaccugcugc

SEQ ID NO: 15550 - RNA, 24 nt, Human
uucaagagugcauugcguguggca

SEQ ID NO: 15551 - RNA, 24 nt, Human
uucaagcgauucugccuuagccuc

SEQ ID NO: 15552 - RNA, 24 nt, Human
uucaagcuaugucauaccugccuc

SEQ ID NO: 15553 - RNA, 24 nt, Human
uucaagcugacagagaagcugacg

SEQ ID NO: 15554 - RNA, 22 nt, Human
uucaagcuggcccauggccggu

SEQ ID NO: 15555 - RNA, 24 nt, Human
uucaagggucaggaauggaccaga

SEQ ID NO: 15556 - RNA, 24 nt, Human
uucaaugcuuuaaauaaaacaaca

SEQ ID NO: 15557 - RNA, 24 nt, Human
uucaauggcguugccccucuacuu

SEQ ID NO: 15558 - RNA, 20 nt, Human
uucaauggugaagccaagug

SEQ ID NO: 15559 - RNA, 24 nt, Human
uucaauguuugcucgggagguaca

SEQ ID NO: 15560 - RNA, 24 nt, Human
uucaauuagcagucuagacauuuc

SEQ ID NO: 15561 - RNA, 24 nt, Human
uucaauucuccccuagauucucca

SEQ ID NO: 15562 - RNA, 24 nt, Human
uucaauuuucauugaggaagugug

SEQ ID NO: 15563 - RNA, 24 nt, Human
uucacagaccaaaccagacaucca

SEQ ID NO: 15564 - RNA, 24 nt, Human
uucacagaggccaggagucgcaga

SEQ ID NO: 15565 - RNA, 24 nt, Human
uucacagaugaggacacugaggcc

SEQ ID NO: 15566 - RNA, 23 nt, Human
uucacaggauggcaaguccccgu

SEQ ID NO: 15567 - RNA, 22 nt, Human
uucacagugagauuucuuugaa

SEQ ID NO: 15568 - RNA, 22 nt, Human
uucacaguggcugaagcuguuc

SEQ ID NO: 15569 - RNA, 22 nt, Human
uucacauguugcucaguuuugc

SEQ ID NO: 15570 - RNA, 23 nt, Human
uucacauucauauacucccgcau

SEQ ID NO: 15571 - RNA, 24 nt, Human
uucacauuuuuuaaaaaguguauu

SEQ ID NO: 15572 - RNA, 21 nt, Human
uucaccaccacccaugaucca

SEQ ID NO: 15573 - RNA, 23 nt, Human
uucacccaacauuugcuuuugcu

SEQ ID NO: 15574 - RNA, 21 nt, Human
uucacccaucuuuccacccac

SEQ ID NO: 15575 - RNA, 22 nt, Human
uucacccaucuuuccacccacg

SEQ ID NO: 15576 - RNA, 22 nt, Human
uucacgggauggaagucaccgu

SEQ ID NO: 15577 - RNA, 22 nt, Human
uucacuguaaccuccaccucuu

SEQ ID NO: 15578 - RNA, 22 nt, Human
uucacuugcaaccuaugcuucc

SEQ ID NO: 15579 - RNA, 22 nt, Human
uucagagauaaagagguuucgg

SEQ ID NO: 15580 - RNA, 22 nt, Human
uucagagugguuaagaucaugg

SEQ ID NO: 15581 - RNA, 22 nt, Human
uucagcauugccaguguuucca

SEQ ID NO: 15582 - RNA, 24 nt, Human
uucagcuccaucaccauccuggag

SEQ ID NO: 15583 - RNA, 21 nt, Human
uucaggcaacaguuuguccug

SEQ ID NO: 15584 - RNA, 24 nt, Human
uucagggacaaggagaaugcgugg

SEQ ID NO: 15585 - RNA, 24 nt, Human
uucaggucacaugaguugcaagau

SEQ ID NO: 15586 - RNA, 24 nt, Human
uucagguuucaggcuuuagggugu

SEQ ID NO: 15587 - RNA, 22 nt, Human
uucaguagaucuuccuuggcag

SEQ ID NO: 15588 - RNA, 22 nt, Human
uucaguuaucuguugcagcagg

SEQ ID NO: 15589 - RNA, 24 nt, Human
uucaucaucaauaaucuguacacc

SEQ ID NO: 15590 - RNA, 24 nt, Human
uucaucucuuugcucgggagguuc

SEQ ID NO: 15591 - RNA, 24 nt, Human
uucaucugagacaagcaagucucu

SEQ ID NO: 15592 - RNA, 22 nt, Human
uucaucuuguagcagcucugcc

SEQ ID NO: 15593 - RNA, 24 nt, Human
uucaugcauuacugcguuuauuuc

SEQ ID NO: 15594 - RNA, 22 nt, Human
uucaugggagcaggugguacag

SEQ ID NO: 15595 - RNA, 24 nt, Human
uucauggggcuuacuccucugaga

SEQ ID NO: 15596 - RNA, 22 nt, Human
uucauguaggacaugauuuggc

SEQ ID NO: 15597 - RNA, 24 nt, Human
uucaugucaccuaagauugccaaa

SEQ ID NO: 15598 - RNA, 22 nt, Human
uucauuacuguagauaacugag

SEQ ID NO: 15599 - RNA, 24 nt, Human
uucauuggcaguauuuugugauga

SEQ ID NO: 15600 - RNA, 24 nt, Human
uucauuguggacaaaguuauuauu

SEQ ID NO: 15601 - RNA, 22 nt, Human
uucauuuuggugaagccuuaaa

SEQ ID NO: 15602 - RNA, 22 nt, Human
uuccaaauagcugggacuagag

SEQ ID NO: 15603 - RNA, 24 nt, Human
uuccaaaucuaucuugcgcuccug

SEQ ID NO: 15604 - RNA, 22 nt, Human
uuccaaauuccuuccuuuuuaa

SEQ ID NO: 15605 - RNA, 24 nt, Human
uuccaagaaacuggggcaggcagg

SEQ ID NO: 15606 - RNA, 24 nt, Human
uuccaagacaagaucuccugucac

SEQ ID NO: 15607 - RNA, 24 nt, Human
uuccacagucugcuuaaaaaacug

SEQ ID NO: 15608 - RNA, 24 nt, Human
uuccagaguucagucugcgccuca

SEQ ID NO: 15609 - RNA, 22 nt, Human
uuccagauggguaggaauaccu

SEQ ID NO: 15610 - RNA, 24 nt, Human
uuccagauuuauuuccaauuucag

SEQ ID NO: 15611 - RNA, 24 nt, Human
uuccaggggcuccacagaacuaau

SEQ ID NO: 15612 - RNA, 24 nt, Human
uuccagggucaagucauugccuuc

SEQ ID NO: 15613 - RNA, 24 nt, Human
uuccaggucaaagggcuggcgugu

SEQ ID NO: 15614 - RNA, 24 nt, Human
uuccagguccucgaggucccacuc

SEQ ID NO: 15615 - RNA, 24 nt, Human
uuccagugacaaagaacacaugug

SEQ ID NO: 15616 - RNA, 22 nt, Human
uuccaucuggugccuuuucucu

SEQ ID NO: 15617 - RNA, 24 nt, Human
uuccauucugaucaacuaaagaaa

SEQ ID NO: 15618 - RNA, 24 nt, Human
uuccauugacauaaaaauagucuc

SEQ ID NO: 15619 - RNA, 24 nt, Human
uucccaaaaaguuuuugggaacca

SEQ ID NO: 15620 - RNA, 22 nt, Human
uucccaggagcccucagcuucc

SEQ ID NO: 15621 - RNA, 24 nt, Human
uucccaugccccaggcuccugcag

SEQ ID NO: 15622 - RNA, 22 nt, Human
uuccccauuauaccuccuucac

SEQ ID NO: 15623 - RNA, 22 nt, Human
uuccccucuguauuggaaguua

SEQ ID NO: 15624 - RNA, 24 nt, Human
uucccgcgcugagcuacaggacuc

SEQ ID NO: 15625 - RNA, 24 nt, Human
uucccggacaucgacugaggccca

SEQ ID NO: 15626 - RNA, 24 nt, Human
uucccggagaugcggcgcgcagga

SEQ ID NO: 15627 - RNA, 24 nt, Human
uucccgggcagcagggaugagggc

SEQ ID NO: 15628 - RNA, 24 nt, Human
uucccuagguuugcauuuguuuac

SEQ ID NO: 15629 - RNA, 22 nt, Human
uucccucauucuccacccaguc

SEQ ID NO: 15630 - RNA, 24 nt, Human
uucccuggggauagagugcacccu

SEQ ID NO: 15631 - RNA, 22 nt, Human
uucccuguggcuauguucuggg

SEQ ID NO: 15632 - RNA, 24 nt, Human
uucccuguggcuuagcugguggcc

SEQ ID NO: 15633 - RNA, 22 nt, Human
uucccuuuacuggcaauggcca

SEQ ID NO: 15634 - RNA, 24 nt, Human
uucccuuuccacaugacuccagac

SEQ ID NO: 15635 - RNA, 22 nt, Human
uucccuuuuaauucuucuccuc

SEQ ID NO: 15636 - RNA, 22 nt, Human
uuccgugucugcaucuguggga

SEQ ID NO: 15637 - RNA, 24 nt, Human
uuccguuuucgaaaccccugggaa

SEQ ID NO: 15638 - RNA, 24 nt, Human
uuccuagacucacuuugugcaugg

SEQ ID NO: 15639 - RNA, 24 nt, Human
uuccucacuuaaggcaggcagugu

SEQ ID NO: 15640 - RNA, 24 nt, Human
uuccucccugaucuugggguaguc

SEQ ID NO: 15641 - RNA, 24 nt, Human
uuccuccuuggucacugccuucuc

SEQ ID NO: 15642 - RNA, 22 nt, Human
uuccucugauuuuggcaugugg

SEQ ID NO: 15643 - RNA, 22 nt, Human
uuccucugccacgucuuucccu

SEQ ID NO: 15644 - RNA, 22 nt, Human
uuccugaugccagaucugaucg

SEQ ID NO: 15645 - RNA, 21 nt, Human
uuccuggaaggguagauucug

SEQ ID NO: 15646 - RNA, 24 nt, Human
uuccuggaaggguagauucugcua

SEQ ID NO: 15647 - RNA, 24 nt, Human
uuccuggcucugcaguugguacuu

SEQ ID NO: 15648 - RNA, 24 nt, Human
uuccuggguauggaguccuguccu

SEQ ID NO: 15649 - RNA, 24 nt, Human
uuccuggucgaguccagugugaaa

SEQ ID NO: 15650 - RNA, 24 nt, Human
uuccugucaguccacggguugagc

SEQ ID NO: 15651 - RNA, 24 nt, Human
uuccugugcuuucacauuguuuuu

SEQ ID NO: 15652 - RNA, 24 nt, Human
uuccuguuuccuugaguuaucauc

SEQ ID NO: 15653 - RNA, 22 nt, Human
uuccuucagcccuagcugcuuu

SEQ ID NO: 15654 - RNA, 24 nt, Human
uuccuugcagcaggaacccacuua

SEQ ID NO: 15655 - RNA, 24 nt, Human
uuccuugggauacagggugugggc

SEQ ID NO: 15656 - RNA, 21 nt, Human
uuccuuguagccaagaaugag

SEQ ID NO: 15657 - RNA, 24 nt, Human
uuccuugucaugguccuggccuug

SEQ ID NO: 15658 - RNA, 22 nt, Human
uuccuuugcaagcuccuagagg

SEQ ID NO: 15659 - RNA, 22 nt, Human
uucgaauuucaugcuucuaacc

SEQ ID NO: 15660 - RNA, 24 nt, Human
uucgacaaagcccguguaccccug

SEQ ID NO: 15661 - RNA, 23 nt, Human
uucgacaggcuucuucucuggga

SEQ ID NO: 15662 - RNA, 24 nt, Human
uucgaggggaccugcuauucuucg

SEQ ID NO: 15663 - RNA, 22 nt, Human
uucgucauuaugcagccuguga

SEQ ID NO: 15664 - RNA, 24 nt, Human
uucgucucaguuguuccuguuuuu

SEQ ID NO: 15665 - RNA, 24 nt, Human
uucgugcagucugcaaauuuuccc

SEQ ID NO: 15666 - RNA, 24 nt, Human
uucguggaggccacgccgcagcag

SEQ ID NO: 15667 - RNA, 24 nt, Human
uucguuguugcacaaaaucagcca

SEQ ID NO: 15668 - RNA, 22 nt, Human
uucuaugauucucuaaguagca

SEQ ID NO: 15669 - RNA, 24 nt, Human
uucuauugaagcugcuucuggugg

SEQ ID NO: 15670 - RNA, 24 nt, Human
uucucaagggugucagaaccauac

SEQ ID NO: 15671 - RNA, 24 nt, Human
uucucagacagcaguggccuccug

SEQ ID NO: 15672 - RNA, 22 nt, Human
uucucaugaagcgcgaagucgg

SEQ ID NO: 15673 - RNA, 22 nt, Human
uucuccagucagcauuuccuuu

SEQ ID NO: 15674 - RNA, 24 nt, Human
uucuccaugaucccgcuggccggg

SEQ ID NO: 15675 - RNA, 24 nt, Human
uucuccgcuucuccccauccccau

SEQ ID NO: 15676 - RNA, 22 nt, Human
uucucuccaauuugaaauaccu

SEQ ID NO: 15677 - RNA, 24 nt, Human
uucucugugccaaucucugcaacu

SEQ ID NO: 15678 - RNA, 24 nt, Human
uucucuguucacugucagcuuauc

SEQ ID NO: 15679 - RNA, 22 nt, Human
uucucuucaucuguauaaacug

SEQ ID NO: 15680 - RNA, 22 nt, Human
uucucuuuuagaggcuccauga

SEQ ID NO: 15681 - RNA, 22 nt, Human
uucugauaccguucuuccacca

SEQ ID NO: 15682 - RNA, 22 nt, Human
uucuggugaauucaggauggua

SEQ ID NO: 15683 - RNA, 22 nt, Human
uucugugcagguuaacauuucu

SEQ ID NO: 15684 - RNA, 22 nt, Human
uucuguguaacugucuaguuuu

SEQ ID NO: 15685 - RNA, 24 nt, Human
uucugugucgggugggagcguuug

SEQ ID NO: 15686 - RNA, 22 nt, Human
uucuuaaucuuugucucauucc

SEQ ID NO: 15687 - RNA, 24 nt, Human
uucuucacuuuguucuuuuucuga

SEQ ID NO: 15688 - RNA, 24 nt, Human
uucuucuuuuuguggcuguggaca

SEQ ID NO: 15689 - RNA, 24 nt, Human
uucuugggagaaauucaaguuugc

SEQ ID NO: 15690 - RNA, 24 nt, Human
uucuuguugcccaggcuggagugc

SEQ ID NO: 15691 - RNA, 22 nt, Human
uucuuuuuccgcuuucugagcc

SEQ ID NO: 15692 - RNA, 22 nt, Human
uucuuuuuguggcuguggacac

SEQ ID NO: 15693 - RNA, 24 nt, Human
uugaaaauggaggcuaugcagacc

SEQ ID NO: 15694 - RNA, 24 nt, Human
uugaaacauguaaucaacuaauuc

SEQ ID NO: 15695 - RNA, 21 nt, Human
uugaaacccuuugcuuauucc

SEQ ID NO: 15696 - RNA, 24 nt, Human
uugaaacuggaccagagaaagagc

SEQ ID NO: 15697 - RNA, 24 nt, Human
uugaaagagaauuucuucuucuuc

SEQ ID NO: 15698 - RNA, 24 nt, Human
uugaaagcaucccuguugguauaa

SEQ ID NO: 15699 - RNA, 24 nt, Human
uugaaagccacuguugcuucuaug

SEQ ID NO: 15700 - RNA, 24 nt, Human
uugaaagguauauuaaaauuaagg

SEQ ID NO: 15701 - RNA, 24 nt, Human
uugaaagugccugagauccugcag

SEQ ID NO: 15702 - RNA, 24 nt, Human
uugaacaauaaugagucgcuucuu

SEQ ID NO: 15703 - RNA, 24 nt, Human
uugaacacauucuuaaaaacacug

SEQ ID NO: 15704 - RNA, 22 nt, Human
uugaacaccuuuccucacugac

SEQ ID NO: 15705 - RNA, 21 nt, Human
uugaacauaucucagucucgc

SEQ ID NO: 15706 - RNA, 18 nt, Human
uugaaccggguuuucuuu

SEQ ID NO: 15707 - RNA, 24 nt, Human
uugaagaauucacuggucguuuug

SEQ ID NO: 15708 - RNA, 24 nt, Human
uugaagacucugguccgaaaguuu

SEQ ID NO: 15709 - RNA, 24 nt, Human
uugaagcaggccauugagcugagu

SEQ ID NO: 15710 - RNA, 24 nt, Human
uugaagcagguaucuugcauggcc

SEQ ID NO: 15711 - RNA, 24 nt, Human
uugaagccaauuguuuuccaaaua

SEQ ID NO: 15712 - RNA, 24 nt, Human
uugaagcccuguagaaugacacgc

SEQ ID NO: 15713 - RNA, 24 nt, Human
uugaagcuaucagaccacaucgag

SEQ ID NO: 15714 - RNA, 24 nt, Human
uugaagcuuuuacagcuggagacu

SEQ ID NO: 15715 - RNA, 23 nt, Human
uugaaggaccacacagguagugg

SEQ ID NO: 15716 - RNA, 24 nt, Human
uugaaggcuugcgggcccacagug

SEQ ID NO: 15717 - RNA, 24 nt, Human
uugaagguggcgucucaucugucu

SEQ ID NO: 15718 - RNA, 24 nt, Human
uugaaguagcguauucuuggagcu

SEQ ID NO: 15719 - RNA, 24 nt, Human
uugaauacuauaagaauggggacc

SEQ ID NO: 15720 - RNA, 24 nt, Human
uugaaucccggcucguguucuugc

SEQ ID NO: 15721 - RNA, 24 nt, Human
uugaaucucuuaaauuuaguguau

SEQ ID NO: 15722 - RNA, 22 nt, Human
uugaaugugguggaaccagcug

SEQ ID NO: 15723 - RNA, 24 nt, Human
uugacccaucaucugguuuggcau

SEQ ID NO: 15724 - RNA, 22 nt, Human
uugaccucuuuggggaccccag

SEQ ID NO: 15725 - RNA, 24 nt, Human
uugacggaaaaggcacuuaaaugu

SEQ ID NO: 15726 - RNA, 22 nt, Human
uugagacuaguaggcauagaag

SEQ ID NO: 15727 - RNA, 24 nt, Human
uugagaguggaguuacugcaggga

SEQ ID NO: 15728 - RNA, 22 nt, Human
uugaggcuugauugucccuugc

SEQ ID NO: 15729 - RNA, 24 nt, Human
uugagggccauggaagggugagaa

SEQ ID NO: 15730 - RNA, 24 nt, Human
uugagggggcaucagaauugggug

SEQ ID NO: 15731 - RNA, 24 nt, Human
uugaucuuauccuccgugacuguc

SEQ ID NO: 15732 - RNA, 24 nt, Human
uugaucuuuucuuucuucagcagu

SEQ ID NO: 15733 - RNA, 24 nt, Human
uugaugauaugaaugaucuggauu

SEQ ID NO: 15734 - RNA, 24 nt, Human
uugaugcaugugguuaauguugca

SEQ ID NO: 15735 - RNA, 24 nt, Human
uugaugcauuuucacuucuguggu

SEQ ID NO: 15736 - RNA, 23 nt, Human
uugcacagaagaauauccugggg

SEQ ID NO: 15737 - RNA, 24 nt, Human
uugcaccauuguugaacagggaau

SEQ ID NO: 15738 - RNA, 24 nt, Human
uugcaccucguggcugcuuuguuc

SEQ ID NO: 15739 - RNA, 24 nt, Human
uugcacgcggacaugaccaugcac

SEQ ID NO: 15740 - RNA, 24 nt, Human
uugcagcuggacgacgugguuagc

SEQ ID NO: 15741 - RNA, 22 nt, Human
uugcaguaacaggugugagcau

SEQ ID NO: 15742 - RNA, 24 nt, Human
uugcaguuacaaagcuaccaggaa

SEQ ID NO: 15743 - RNA, 24 nt, Human
uugcaguuuaaggcauuucuggcu

SEQ ID NO: 15744 - RNA, 24 nt, Human
uugcauagacagcugaagaguccu

SEQ ID NO: 15745 - RNA, 24 nt, Human
uugcaucaaaaaucgaagaagcac

SEQ ID NO: 15746 - RNA, 24 nt, Human
uugcauccaagucaccuuccccaa

SEQ ID NO: 15747 - RNA, 24 nt, Human
uugcaucucuaaucagcugccagu

SEQ ID NO: 15748 - RNA, 24 nt, Human
uugcauguagaguucgacgcugga

SEQ ID NO: 15749 - RNA, 24 nt, Human
uugccaaaacaacacugcccgaga

SEQ ID NO: 15750 - RNA, 24 nt, Human
uugccagucuccucauccauguau

SEQ ID NO: 15751 - RNA, 24 nt, Human
uugccauccucgaacuugaacagu

SEQ ID NO: 15752 - RNA, 22 nt, Human
uugcccaggcuggagugcagug

SEQ ID NO: 15753 - RNA, 24 nt, Human
uugccggcucaacuucuccgacuc

SEQ ID NO: 15754 - RNA, 22 nt, Human
uugccuaaugcacaaaggugag

SEQ ID NO: 15755 - RNA, 24 nt, Human
uugccucuuccuccuccuguccgg

SEQ ID NO: 15756 - RNA, 22 nt, Human
uugccuggagacauuucuacug

SEQ ID NO: 15757 - RNA, 24 nt, Human
uugcgggagaugcugaagaguaug

SEQ ID NO: 15758 - RNA, 24 nt, Human
uugcucagcaggaaugcaggggua

SEQ ID NO: 15759 - RNA, 24 nt, Human
uugcugccaguccccauccugaag

SEQ ID NO: 15760 - RNA, 22 nt, Human
uugcugcuuaagucuugcccac

SEQ ID NO: 15761 - RNA, 24 nt, Human
uugcugggagaaucucauuuuggc

SEQ ID NO: 15762 - RNA, 24 nt, Human
uugcuggguuuagcucucagcagc

SEQ ID NO: 15763 - RNA, 24 nt, Human
uugcuguccuucuccaauugugag

SEQ ID NO: 15764 - RNA, 24 nt, Human
uugcuguuuggcagauggugaggg

SEQ ID NO: 15765 - RNA, 24 nt, Human
uugcuuccuguauuggcugcaagu

SEQ ID NO: 15766 - RNA, 24 nt, Human
uugcuucuacuuuugaggcgcuuc

SEQ ID NO: 15767 - RNA, 22 nt, Human
uugcuugauccauugaugaaca

SEQ ID NO: 15768 - RNA, 22 nt, Human
uugcuuuuuuggguuuacuggg

SEQ ID NO: 15769 - RNA, 24 nt, Human
uuggaacugguauaaauacaucaa

SEQ ID NO: 15770 - RNA, 24 nt, Human
uuggaaggggcguuguccaguucc

SEQ ID NO: 15771 - RNA, 24 nt, Human
uuggaaguuuacuuaguuagaaug

SEQ ID NO: 15772 - RNA, 24 nt, Human
uuggacugaccccgacaggcauau

SEQ ID NO: 15773 - RNA, 24 nt, Human
uuggagaaccuguucugacuuuag

SEQ ID NO: 15774 - RNA, 24 nt, Human
uuggagauaaacagggcucucgac

SEQ ID NO: 15775 - RNA, 22 nt, Human
uuggagcagauguguauaguua

SEQ ID NO: 15776 - RNA, 24 nt, Human
uuggagcagggacuguggaguuua

SEQ ID NO: 15777 - RNA, 24 nt, Human
uuggagcgagugcagguaccgcca

SEQ ID NO: 15778 - RNA, 22 nt, Human
uuggaggacccauccuuugugg

SEQ ID NO: 15779 - RNA, 22 nt, Human
uuggaggcauucauuccccuca

SEQ ID NO: 15780 - RNA, 24 nt, Human
uuggauauuuucaccucugggaua

SEQ ID NO: 15781 - RNA, 24 nt, Human
uuggaugccacuccccuguguuga

SEQ ID NO: 15782 - RNA, 24 nt, Human
uuggaugugaaaaggaugucaggg

SEQ ID NO: 15783 - RNA, 24 nt, Human
uuggcagcaucuuggaccucaugc

SEQ ID NO: 15784 - RNA, 23 nt, Human
uuggcagccaugaucuuugcaug

SEQ ID NO: 15785 - RNA, 24 nt, Human
uuggcagucuacuaauuccuguau

SEQ ID NO: 15786 - RNA, 24 nt, Human
uuggccccgcaacuccuugaccua

SEQ ID NO: 15787 - RNA, 24 nt, Human
uuggccucuggacacucaucggcc

SEQ ID NO: 15788 - RNA, 22 nt, Human
uuggccuguggggugaacagcu

SEQ ID NO: 15789 - RNA, 24 nt, Human
uuggcugacaccguggaggguaaa

SEQ ID NO: 15790 - RNA, 22 nt, Human
uugggaaauaagcugauaguaa

SEQ ID NO: 15791 - RNA, 24 nt, Human
uugggcagaagagggugcagaaaa

SEQ ID NO: 15792 - RNA, 24 nt, Human
uuggggcagaacuagguaccaagc

SEQ ID NO: 15793 - RNA, 24 nt, Human
uuggguggaccuggacugaggcgu

SEQ ID NO: 15794 - RNA, 22 nt, Human
uugguaaagggaccuagagaug

SEQ ID NO: 15795 - RNA, 24 nt, Human
uugguccaggguucaagauuugag

SEQ ID NO: 15796 - RNA, 22 nt, Human
uugguccccuucaaccagcuac

SEQ ID NO: 15797 - RNA, 24 nt, Human
uuggucuuggaggcgaagccgaaa

SEQ ID NO: 15798 - RNA, 24 nt, Human
uuggugaccgaauuacuagugacu

SEQ ID NO: 15799 - RNA, 22 nt, Human
uuggugccaauuggucgugguc

SEQ ID NO: 15800 - RNA, 24 nt, Human
uuggugccuucuuucaucaugccu

SEQ ID NO: 15801 - RNA, 24 nt, Human
uuggugcugaagauaaacacuuuu

SEQ ID NO: 15802 - RNA, 24 nt, Human
uugguggccaagaaucucuucguu

SEQ ID NO: 15803 - RNA, 24 nt, Human
uugguucaaagggauggaaaguca

SEQ ID NO: 15804 - RNA, 24 nt, Human
uugguucaagggauggaaaaguca

SEQ ID NO: 15805 - RNA, 24 nt, Human
uugguuccaacgcgauggcaaguc

SEQ ID NO: 15806 - RNA, 24 nt, Human
uugguuccacgggauggaaaguca

SEQ ID NO: 15807 - RNA, 24 nt, Human
uugguuccacgggcaugugacagu

SEQ ID NO: 15808 - RNA, 24 nt, Human
uugguucuuauugacugaauuuac

SEQ ID NO: 15809 - RNA, 22 nt, Human
uugguugggugcugugguuggu

SEQ ID NO: 15810 - RNA, 22 nt, Human
uugguuggugaugagcauugaa

SEQ ID NO: 15811 - RNA, 24 nt, Human
uugguugugauauguuaaccugca

SEQ ID NO: 15812 - RNA, 24 nt, Human
uuguaaccaacuccugccagaccu

SEQ ID NO: 15813 - RNA, 24 nt, Human
uuguaagaguggaauuaacugccc

SEQ ID NO: 15814 - RNA, 22 nt, Human
uuguaccaugaacugacagacc

SEQ ID NO: 15815 - RNA, 22 nt, Human
uuguaguuucauguuguugguu

SEQ ID NO: 15816 - RNA, 22 nt, Human
uuguaugcugggaagcgggagg

SEQ ID NO: 15817 - RNA, 22 nt, Human
uugucagaggcugguagggugu

SEQ ID NO: 15818 - RNA, 24 nt, Human
uugugcccuucgcgacgauuuucu

SEQ ID NO: 15819 - RNA, 24 nt, Human
uugugcuccucagcuuucucagug

SEQ ID NO: 15820 - RNA, 22 nt, Human
uugugcuuguacugaccaugua

SEQ ID NO: 15821 - RNA, 23 nt, Human
uuguggugguagagccagaagau

SEQ ID NO: 15822 - RNA, 22 nt, Human
uugugugccuuaucauguguua

SEQ ID NO: 15823 - RNA, 22 nt, Human
uuguugcugcaugauugcgaga

SEQ ID NO: 15824 - RNA, 24 nt, Human
uuguugguguccguggcgcaggug

SEQ ID NO: 15825 - RNA, 22 nt, Human
uuguuguuaaaguggccuuuaa

SEQ ID NO: 15826 - RNA, 24 nt, Human
uuguuugccccccggcugaucucc

SEQ ID NO: 15827 - RNA, 22 nt, Human
uuguuuucuuucuccucuucua

SEQ ID NO: 15828 - RNA, 24 nt, Human
uuuaaacaaauuccauggaguuua

SEQ ID NO: 15829 - RNA, 24 nt, Human
uuuaaagucagcaagaaugaggag

SEQ ID NO: 15830 - RNA, 22 nt, Human
uuuaacaauggauaaguucugu

SEQ ID NO: 15831 - RNA, 24 nt, Human
uuuaaccaaagaagauguguagug

SEQ ID NO: 15832 - RNA, 22 nt, Human
uuuaaccccccgggguucccac

SEQ ID NO: 15833 - RNA, 23 nt, Human
uuuaacuuugcaaacccauuguc

SEQ ID NO: 15834 - RNA, 24 nt, Human
uuuaagcaauaaaaauuggcaugu

SEQ ID NO: 15835 - RNA, 24 nt, Human
uuuaagcacucaugcaaagguaaa

SEQ ID NO: 15836 - RNA, 24 nt, Human
uuuaaguagaacaaacuaaauaca

SEQ ID NO: 15837 - RNA, 24 nt, Human
uuuaauaaaauaauccagugguac

SEQ ID NO: 15838 - RNA, 24 nt, Human
uuuacaacaacuaagggaguguau

SEQ ID NO: 15839 - RNA, 24 nt, Human
uuuacagaggaacuguaguucaca

SEQ ID NO: 15840 - RNA, 19 nt, Human
uuuacauuugaaucugcca

SEQ ID NO: 15841 - RNA, 24 nt, Human
uuuacuggaagauaacucucaccu

SEQ ID NO: 15842 - RNA, 22 nt, Human
uuuacuucuacagggagacuac

SEQ ID NO: 15843 - RNA, 24 nt, Human
uuuagcacuuuuacuucaaaucag

SEQ ID NO: 15844 - RNA, 24 nt, Human
uuuauauuuuugcaaaugucagga

SEQ ID NO: 15845 - RNA, 24 nt, Human
uuuaucaguuaauaauauuaauca

SEQ ID NO: 15846 - RNA, 19 nt, Human
uuuaucuuuuugcugaggg

SEQ ID NO: 15847 - RNA, 22 nt, Human
uuucaaaacaaagcuuucccag

SEQ ID NO: 15848 - RNA, 24 nt, Human
uuucaagcauuuuugccagcacag

SEQ ID NO: 15849 - RNA, 24 nt, Human
uuucacacauggacuccaccguua

SEQ ID NO: 15850 - RNA, 24 nt, Human
uuucacagaguauauaauuuaggu

SEQ ID NO: 15851 - RNA, 24 nt, Human
uuucacagcucuccuccccuacug

SEQ ID NO: 15852 - RNA, 24 nt, Human
uuucaccauguuggccaggcucgu

SEQ ID NO: 15853 - RNA, 24 nt, Human
uuucacggucgcagccaucuugcu

SEQ ID NO: 15854 - RNA, 24 nt, Human
uuucagccuuucugcggaagcugu

SEQ ID NO: 15855 - RNA, 22 nt, Human
uuucauauggauauuugagaau

SEQ ID NO: 15856 - RNA, 24 nt, Human
uuucaucgacuuaucuaugagcau

SEQ ID NO: 15857 - RNA, 24 nt, Human
uuucauugauuuucaccauugguu

SEQ ID NO: 15858 - RNA, 24 nt, Human
uuuccacagaagcaccaccuauca

SEQ ID NO: 15859 - RNA, 22 nt, Human
uuuccacagcggccaauucuuc

SEQ ID NO: 15860 - RNA, 22 nt, Human
uuuccacauguggaaguggggu

SEQ ID NO: 15861 - RNA, 24 nt, Human
uuuccagcauuuccaucuuuacca

SEQ ID NO: 15862 - RNA, 24 nt, Human
uuuccaggagguaguggguggcau

SEQ ID NO: 15863 - RNA, 24 nt, Human
uuuccagucacacaucaaggcgcu

SEQ ID NO: 15864 - RNA, 24 nt, Human
uuuccggcgccgacucugaggccc

SEQ ID NO: 15865 - RNA, 24 nt, Human
uuuccuggccccucacucauuuca

SEQ ID NO: 15866 - RNA, 24 nt, Human
uuuccuguggguaagcagcuguuu

SEQ ID NO: 15867 - RNA, 24 nt, Human
uuuccugugguuuuccaggacugu

SEQ ID NO: 15868 - RNA, 19 nt, Human
uuucgcagagcugaagauc

SEQ ID NO: 15869 - RNA, 24 nt, Human
uuucgcucuuguugcccaagcugg

SEQ ID NO: 15870 - RNA, 24 nt, Human
uuucucaggaggugauucaggaac

SEQ ID NO: 15871 - RNA, 22 nt, Human
uuucucccacucuaauagauga

SEQ ID NO: 15872 - RNA, 22 nt, Human
uuucucuugaacccuaauuuuu

SEQ ID NO: 15873 - RNA, 22 nt, Human
uuucuggagggcaagugcaggg

SEQ ID NO: 15874 - RNA, 22 nt, Human
uuucuuguaggcucacucacca

SEQ ID NO: 15875 - RNA, 24 nt, Human
uuugaaaccaguuuuuaucccuuc

SEQ ID NO: 15876 - RNA, 24 nt, Human
uuugaacacugaaaccauuguugg

SEQ ID NO: 15877 - RNA, 24 nt, Human
uuugaacagcuucagcguggccuu

SEQ ID NO: 15878 - RNA, 24 nt, Human
uuugaacauucacugcggggcuua

SEQ ID NO: 15879 - RNA, 24 nt, Human
uuugaagucuccauucguuguaca

SEQ ID NO: 15880 - RNA, 24 nt, Human
uuugacaaaagaggaugcagaguu

SEQ ID NO: 15881 - RNA, 24 nt, Human
uuugacuuuaugcuagaagaugag

SEQ ID NO: 15882 - RNA, 22 nt, Human
uuugagcguauuugugucaguc

SEQ ID NO: 15883 - RNA, 24 nt, Human
uuugaucaggaaacgugguuacua

SEQ ID NO: 15884 - RNA, 24 nt, Human
uuugaugcaagaaaggccucucuu

SEQ ID NO: 15885 - RNA, 24 nt, Human
uuugauggccuuagcagguucugu

SEQ ID NO: 15886 - RNA, 18 nt, Human
uuugaugguggugucuag

SEQ ID NO: 15887 - RNA, 23 nt, Human
uuugcaaaucugcggaaagugcu

SEQ ID NO: 15888 - RNA, 23 nt, Human
uuugcacaccacaacagccagac

SEQ ID NO: 15889 - RNA, 22 nt, Human
uuugcacacuuuccaaguugcc

SEQ ID NO: 15890 - RNA, 24 nt, Human
uuugcacuggagagcugugcccac

SEQ ID NO: 15891 - RNA, 24 nt, Human
uuugcagauuccggauacgacagc

SEQ ID NO: 15892 - RNA, 22 nt, Human
uuugcaguguucaucaguauuu

SEQ ID NO: 15893 - RNA, 19 nt, Human
uuugcauaaaacaugcauu

SEQ ID NO: 15894 - RNA, 24 nt, Human
uuugccuggcagguucaggcucag

SEQ ID NO: 15895 - RNA, 24 nt, Human
uuugcuagucaccaacuucugggu

SEQ ID NO: 15896 - RNA, 24 nt, Human
uuugcugaaguucauggaugguac

SEQ ID NO: 15897 - RNA, 24 nt, Human
uuugcuguuuuccaucauguguua

SEQ ID NO: 15898 - RNA, 24 nt, Human
uuugcuugccuuuauuagcuggaa

SEQ ID NO: 15899 - RNA, 24 nt, Human
uuuggagagggugucuuucuguaa

SEQ ID NO: 15900 - RNA, 22 nt, Human
uuuggauuccugguuccuacag

SEQ ID NO: 15901 - RNA, 24 nt, Human
uuuggauucugaaaacuaacuggc

SEQ ID NO: 15902 - RNA, 24 nt, Human
uuuggcaaagacuuggugcagaug

SEQ ID NO: 15903 - RNA, 22 nt, Human
uuuggcucuguguccucaccca

SEQ ID NO: 15904 - RNA, 22 nt, Human
uuugguacuagacauguuugcu

SEQ ID NO: 15905 - RNA, 22 nt, Human
uuugguaucuuggcaggagggu

SEQ ID NO: 15906 - RNA, 24 nt, Human
uuugguggaguuugagaccagccu

SEQ ID NO: 15907 - RNA, 24 nt, Human
uuugguggucucuucacauggacg

SEQ ID NO: 15908 - RNA, 22 nt, Human
uuuguaauagcaaaauacugga

SEQ ID NO: 15909 - RNA, 24 nt, Human
uuuguagaaucagacuguucuuug

SEQ ID NO: 15910 - RNA, 24 nt, Human
uuuguagacuuggaacccacaguc

SEQ ID NO: 15911 - RNA, 24 nt, Human
uuuguagucaugggggucucacua

SEQ ID NO: 15912 - RNA, 24 nt, Human
uuuguauauauauuuaaacacaug

SEQ ID NO: 15913 - RNA, 24 nt, Human
uuuguauuuaccccaaaaucuuuu

SEQ ID NO: 15914 - RNA, 24 nt, Human
uuuguccuuaaauuaaccuuugcu

SEQ ID NO: 15915 - RNA, 24 nt, Human
uuugucucugaccucccaggaagu

SEQ ID NO: 15916 - RNA, 24 nt, Human
uuugucucuggauucgauggcucu

SEQ ID NO: 15917 - RNA, 24 nt, Human
uuugucuuuccauccagucuauuc

SEQ ID NO: 15918 - RNA, 24 nt, Human
uuugugcgccgaggucauccccgu

SEQ ID NO: 15919 - RNA, 24 nt, Human
uuugugcugaggcaggacacagcg

SEQ ID NO: 15920 - RNA, 24 nt, Human
uuuguggacagcgagaccaugccu

SEQ ID NO: 15921 - RNA, 24 nt, Human
uuuguggagcugccguugacgugc

SEQ ID NO: 15922 - RNA, 22 nt, Human
uuuguucucaaggacuaucagc

SEQ ID NO: 15923 - RNA, 22 nt, Human
uuuguuugcuccuucugccauu

SEQ ID NO: 15924 - RNA, 24 nt, Human
uuuuaaagaaagaacagaucgagu

SEQ ID NO: 15925 - RNA, 24 nt, Human
uuuuaaguuugcccuaugguggcc

SEQ ID NO: 15926 - RNA, 24 nt, Human
uuuuauggacaggcaauuuaguca

SEQ ID NO: 15927 - RNA, 24 nt, Human
uuuucagccaaaaagagcccacuu

SEQ ID NO: 15928 - RNA, 24 nt, Human
uuuucagguuuaucaacuguuuau

SEQ ID NO: 15929 - RNA, 24 nt, Human
uuuucaguuucauccauguauuuc

SEQ ID NO: 15930 - RNA, 24 nt, Human
uuuuccagacgauuguuuggugga

SEQ ID NO: 15931 - RNA, 24 nt, Human
uuuuccguuccuacagucccgguu

SEQ ID NO: 15932 - RNA, 24 nt, Human
uuuuccuuuacuaagaaaaguauu

SEQ ID NO: 15933 - RNA, 24 nt, Human
uuuucugagaaaccugacucaaug

SEQ ID NO: 15934 - RNA, 24 nt, Human
uuuuguaggagacagggucucccu

SEQ ID NO: 15935 - RNA, 24 nt, Human
uuuugugaugacagcuuggcgggu

SEQ ID NO: 15936 - RNA, 24 nt, Human
uuuuguuuacugagaguaagauca

SEQ ID NO: 15937 - RNA, 22 nt, Human
uuuuuaucuuuuucuccagaug

SEQ ID NO: 15938 - RNA, 22 nt, Human
uuuuucuuaugccucagcucug

SEQ ID NO: 15939 - RNA, 22 nt, Human
uuuuuguucuaaugaucacugu

SEQ ID NO: 15940 - RNA, 24 nt, Human
uuuuuuagauuaguguuucuuaaa

SEQ ID NO: 15941 - RNA, 22 nt, Human
uuuuuugugagaugugaaucuu

SEQ ID NO: 15942 - RNA, 22 nt, Human
aaaaaguuucagauuuuggagu

SEQ ID NO: 15943 - RNA, 24 nt, Human
aaaaaucugauugguggggaucuc

SEQ ID NO: 15944 - RNA, 24 nt, Human
aaaaauguuugccaagggaacuga

SEQ ID NO: 15945 - RNA, 22 nt, Human
aaaaccagggccuucaucuagg

SEQ ID NO: 15946 - RNA, 22 nt, Human
aaaagugccugcugcugcuucu

SEQ ID NO: 15947 - RNA, 24 nt, Human
aaaaugcuucuaagaaccuguuug

SEQ ID NO: 15948 - RNA, 24 nt, Human
aaacaugugagagaaaccauaaag

SEQ ID NO: 15949 - RNA, 22 nt, Human
aaacauuguuuauuugagacag

SEQ ID NO: 15950 - RNA, 24 nt, Human
aaacguccuccucaggcaguuguc

SEQ ID NO: 15951 - RNA, 24 nt, Human
aaacuaguucuuaggaacagacuc

SEQ ID NO: 15952 - RNA, 24 nt, Human
aaacugcucacaaaaauaagucuu

SEQ ID NO: 15953 - RNA, 22 nt, Human
aaacuuuuggcuguggggaccc

SEQ ID NO: 15954 - RNA, 22 nt, Human
aaagaacauugguuugcucuuc

SEQ ID NO: 15955 - RNA, 24 nt, Human
aaagaacuguaaaugcaauguaaa

SEQ ID NO: 15956 - RNA, 24 nt, Human
aaagaagacagacuucaguuggga

SEQ ID NO: 15957 - RNA, 22 nt, Human
aaagaauucuccuuuugggcuu

SEQ ID NO: 15958 - RNA, 22 nt, Human
aaagacagagucugccaugcag

SEQ ID NO: 15959 - RNA, 22 nt, Human
aaagagcucacaggcuuugggg

SEQ ID NO: 15960 - RNA, 22 nt, Human
aaagagguucugauucuggccu

SEQ ID NO: 15961 - RNA, 23 nt, Human
aaagaguauuugaacuuguugac

SEQ ID NO: 15962 - RNA, 24 nt, Human
aaagcagaaaaagcacugagaaaa

SEQ ID NO: 15963 - RNA, 24 nt, Human
aaagcagguggaguugguugaauc

SEQ ID NO: 15964 - RNA, 24 nt, Human
aaagcuaugaaacuguauagggcu

SEQ ID NO: 15965 - RNA, 22 nt, Human
aaagcuuuaccugugagguuuu

SEQ ID NO: 15966 - RNA, 24 nt, Human
aaagucacacaguccaggcuugau

SEQ ID NO: 15967 - RNA, 24 nt, Human
aaagugcucggauuagaggcauga

SEQ ID NO: 15968 - RNA, 22 nt, Human
aaagugcugggauuacaggcau

SEQ ID NO: 15969 - RNA, 22 nt, Human
aaaguggcuggaguggagucuu

SEQ ID NO: 15970 - RNA, 24 nt, Human
aaaguucauauagaaucaaaaaag

SEQ ID NO: 15971 - RNA, 22 nt, Human
aaauacaaaaauuagccaggca

SEQ ID NO: 15972 - RNA, 24 nt, Human
aaauagugaauuugauaugaaauc

SEQ ID NO: 15973 - RNA, 22 nt, Human
aaauccagaaucuagacugaau

SEQ ID NO: 15974 - RNA, 22 nt, Human
aaaugucaaaaaggcaaaaugg

SEQ ID NO: 15975 - RNA, 24 nt, Human
aaaugugcgaaaaauaaaugcuug

SEQ ID NO: 15976 - RNA, 24 nt, Human
aaauguguuuguggcauauaggac

SEQ ID NO: 15977 - RNA, 22 nt, Human
aaauucaucuaacuuccaggaa

SEQ ID NO: 15978 - RNA, 24 nt, Human
aacaagaucacucaaggugaagga

SEQ ID NO: 15979 - RNA, 24 nt, Human
aacaccauuuauugauuagggugu

SEQ ID NO: 15980 - RNA, 24 nt, Human
aacacucuguuuaaugaagugucc

SEQ ID NO: 15981 - RNA, 23 nt, Human
aacacuucuugcuaccagggaug

SEQ ID NO: 15982 - RNA, 24 nt, Human
aacaggaggagauguuaaaguaac

SEQ ID NO: 15983 - RNA, 24 nt, Human
aacagugucuuuucuccaaaacuu

SEQ ID NO: 15984 - RNA, 22 nt, Human
aacauagggagacccugucucu

SEQ ID NO: 15985 - RNA, 24 nt, Human
aacaucauccagccagguguucag

SEQ ID NO: 15986 - RNA, 22 nt, Human
aacaugaggaggauguaaugcu

SEQ ID NO: 15987 - RNA, 24 nt, Human
aaccaggagaugcugcgaugauga

SEQ ID NO: 15988 - RNA, 24 nt, Human
aaccaggaggugagugccuuuggg

SEQ ID NO: 15989 - RNA, 24 nt, Human
aaccaugcuggagaccagagcaac

SEQ ID NO: 15990 - RNA, 22 nt, Human
aacccgacacaguagcauuugu

SEQ ID NO: 15991 - RNA, 22 nt, Human
aaccugcugguaaagcacuggc

SEQ ID NO: 15992 - RNA, 22 nt, Human
aaccugucucuguuuuucguaa

SEQ ID NO: 15993 - RNA, 24 nt, Human
aaccugugaauuggacgaccaucu

SEQ ID NO: 15994 - RNA, 24 nt, Human
aaccuguugacagaucuucagaga

SEQ ID NO: 15995 - RNA, 22 nt, Human
aacggccacgccuaacaauuau

SEQ ID NO: 15996 - RNA, 22 nt, Human
aacguaguuccugagagauagc

SEQ ID NO: 15997 - RNA, 24 nt, Human
aacguccuuuucauuuugguuuag

SEQ ID NO: 15998 - RNA, 24 nt, Human
aacuacuuagguugguaccagcag

SEQ ID NO: 15999 - RNA, 22 nt, Human
aacuccuugccugaucuaaacu

SEQ ID NO: 16000 - RNA, 24 nt, Human
aacucuuugggaaugcagccuagu

SEQ ID NO: 16001 - RNA, 22 nt, Human
aacuguccaugagagaauauaa

SEQ ID NO: 16002 - RNA, 24 nt, Human
aacuguguguugauuucugguucc

SEQ ID NO: 16003 - RNA, 24 nt, Human
aacuguuuaauaggaauuuggaga

SEQ ID NO: 16004 - RNA, 24 nt, Human
aagaaaauauguuguaauaaugcu

SEQ ID NO: 16005 - RNA, 24 nt, Human
aagaacaaggcagcauguagugcu

SEQ ID NO: 16006 - RNA, 21 nt, Human
aagaacacacggcaaacuguu

SEQ ID NO: 16007 - RNA, 24 nt, Human
aagaacacuuuuuggggcagccuu

SEQ ID NO: 16008 - RNA, 24 nt, Human
aagaacuacauccaaggcaucaac

SEQ ID NO: 16009 - RNA, 24 nt, Human
aagaauacaaggaaagggguguca

SEQ ID NO: 16010 - RNA, 24 nt, Human
aagaauccgucgcuaugauuucuc

SEQ ID NO: 16011 - RNA, 22 nt, Human
aagaaugugcccucaccaaagg

SEQ ID NO: 16012 - RNA, 18 nt, Human
aagaauugacaggcuuga

SEQ ID NO: 16013 - RNA, 22 nt, Human
aagacacauaagcaaaagucua

SEQ ID NO: 16014 - RNA, 22 nt, Human
aagaccauuucuggcugggcag

SEQ ID NO: 16015 - RNA, 22 nt, Human
aagaccccgauaccucguguuc

SEQ ID NO: 16016 - RNA, 24 nt, Human
aagacccucauagccgccuacucc

SEQ ID NO: 16017 - RNA, 23 nt, Human
aagagcacugaucguacuggcuc

SEQ ID NO: 16018 - RNA, 24 nt, Human
aagagccaggagcuacucagcaac

SEQ ID NO: 16019 - RNA, 22 nt, Human
aagaggaaaguuuguuagugga

SEQ ID NO: 16020 - RNA, 24 nt, Human
aagaguccaccuugcagcuggugc

SEQ ID NO: 16021 - RNA, 22 nt, Human
aagaguguguaggccagccccg

SEQ ID NO: 16022 - RNA, 24 nt, Human
aagaguucacaccugaugaaugua

SEQ ID NO: 16023 - RNA, 22 nt, Human
aagaucccuaaacucugcauug

SEQ ID NO: 16024 - RNA, 24 nt, Human
aagauugcuuuucuugaaaugcuc

SEQ ID NO: 16025 - RNA, 24 nt, Human
aagcaagcugaagggaaaaggggg

SEQ ID NO: 16026 - RNA, 24 nt, Human
aagcacaacuacacacuuugccca

SEQ ID NO: 16027 - RNA, 24 nt, Human
aagcacacccuuuuaagacuacuu

SEQ ID NO: 16028 - RNA, 24 nt, Human
aagcacuuuuguugagugacaacc

SEQ ID NO: 16029 - RNA, 24 nt, Human
aagcagaagcagauucggcgcggg

SEQ ID NO: 16030 - RNA, 24 nt, Human
aagcagcacucccugggggcagga

SEQ ID NO: 16031 - RNA, 22 nt, Human
aagcagccuuggaccaggaggg

SEQ ID NO: 16032 - RNA, 24 nt, Human
aagcagcgcgggcagcgagcgaga

SEQ ID NO: 16033 - RNA, 24 nt, Human
aagcagcuuauuguagguguggcg

SEQ ID NO: 16034 - RNA, 24 nt, Human
aagcagcuucauaaccgaagauug

SEQ ID NO: 16035 - RNA, 24 nt, Human
aagcaggagcuuguccaggaaugu

SEQ ID NO: 16036 - RNA, 23 nt, Human
aagcagugugaugucgacucccu

SEQ ID NO: 16037 - RNA, 24 nt, Human
aagcauauuuuucagcaaguacag

SEQ ID NO: 16038 - RNA, 24 nt, Human
aagcaugccauuucuguuuucuug

SEQ ID NO: 16039 - RNA, 24 nt, Human
aagcauuuugagaacagguuggca

SEQ ID NO: 16040 - RNA, 24 nt, Human
aagccaccuaugacgcagccaccc

SEQ ID NO: 16041 - RNA, 24 nt, Human
aagcccauacauaacaguggaggu

SEQ ID NO: 16042 - RNA, 22 nt, Human
aagcccauggcaaauaggaaga

SEQ ID NO: 16043 - RNA, 24 nt, Human
aagccccauuucuuugagaagugg

SEQ ID NO: 16044 - RNA, 24 nt, Human
aagccccccaaagaacaagggaaa

SEQ ID NO: 16045 - RNA, 24 nt, Human
aagccgcgcuguuccugcugcugg

SEQ ID NO: 16046 - RNA, 24 nt, Human
aagccugagccaaaccaugagugg

SEQ ID NO: 16047 - RNA, 22 nt, Human
aagccuguugaugucucugguc

SEQ ID NO: 16048 - RNA, 24 nt, Human
aagcgaccagcuacauuuaccaaa

SEQ ID NO: 16049 - RNA, 24 nt, Human
aagcgggcugaugacuguaccugc

SEQ ID NO: 16050 - RNA, 22 nt, Human
aagcucaguggugggugacaca

SEQ ID NO: 16051 - RNA, 24 nt, Human
aagcugacagagaugugagagguc

SEQ ID NO: 16052 - RNA, 24 nt, Human
aagcugaugauccaacaauggggg

SEQ ID NO: 16053 - RNA, 24 nt, Human
aagcugauugucucucccugcagc

SEQ ID NO: 16054 - RNA, 24 nt, Human
aagcugauuucagaaaacaaugca

SEQ ID NO: 16055 - RNA, 24 nt, Human
aagcugcauguugugcacauguac

SEQ ID NO: 16056 - RNA, 21 nt, Human
aagcugcugcagaccaucggg

SEQ ID NO: 16057 - RNA, 24 nt, Human
aagcugguuuugcuggugaucaga

SEQ ID NO: 16058 - RNA, 24 nt, Human
aagcuugcuguggccauggugcug

SEQ ID NO: 16059 - RNA, 24 nt, Human
aagcuuuuccaccgagguuuuagu

SEQ ID NO: 16060 - RNA, 22 nt, Human
aaggaaaugucaaaaagggaaa

SEQ ID NO: 16061 - RNA, 22 nt, Human
aaggacacagcaguauuggacc

SEQ ID NO: 16062 - RNA, 24 nt, Human
aaggaccccaggucagagacugga

SEQ ID NO: 16063 - RNA, 22 nt, Human
aaggagagagggcaaaaccaca

SEQ ID NO: 16064 - RNA, 22 nt, Human
aaggagaggagucauugggaua

SEQ ID NO: 16065 - RNA, 24 nt, Human
aaggagcagggaagcugcccgagg

SEQ ID NO: 16066 - RNA, 24 nt, Human
aaggagcagguguguucuuagaag

SEQ ID NO: 16067 - RNA, 24 nt, Human
aaggagcaugauaguaucuauuua

SEQ ID NO: 16068 - RNA, 24 nt, Human
aaggagccccaaagagaagggacg

SEQ ID NO: 16069 - RNA, 24 nt, Human
aaggagcgguuccaugccagcgug

SEQ ID NO: 16070 - RNA, 24 nt, Human
aaggagcuuugguucggagacagg

SEQ ID NO: 16071 - RNA, 22 nt, Human
aaggcacuugcccagagcugca

SEQ ID NO: 16072 - RNA, 24 nt, Human
aaggcuccaggaacuccuccguac

SEQ ID NO: 16073 - RNA, 22 nt, Human
aaggcuuggacucagccuaggu

SEQ ID NO: 16074 - RNA, 24 nt, Human
aagggaaugauagcauugaaggac

SEQ ID NO: 16075 - RNA, 24 nt, Human
aagggcaagaggagacaggugccu

SEQ ID NO: 16076 - RNA, 24 nt, Human
aagggccuguaccaaggcuuuaac

SEQ ID NO: 16077 - RNA, 22 nt, Human
aaggggacagcaucaccaugga

SEQ ID NO: 16078 - RNA, 24 nt, Human
aaggggucugcggccucgucucca

SEQ ID NO: 16079 - RNA, 24 nt, Human
aagggucuggcuauguugccuagg

SEQ ID NO: 16080 - RNA, 22 nt, Human
aagguaauggucaucuacuuug

SEQ ID NO: 16081 - RNA, 24 nt, Human
aaggugaccguaaggagucccuug

SEQ ID NO: 16082 - RNA, 22 nt, Human
aaggugagaacuauaguacuua

SEQ ID NO: 16083 - RNA, 22 nt, Human
aaggugauuggaguccuccacc

SEQ ID NO: 16084 - RNA, 24 nt, Human
aaggugauugugaaacaguugcug

SEQ ID NO: 16085 - RNA, 24 nt, Human
aaggugccccaagaaacgagaggc

SEQ ID NO: 16086 - RNA, 24 nt, Human
aaggugcugacuuccuuggggaga

SEQ ID NO: 16087 - RNA, 22 nt, Human
aaguaaggaguuggucacuugc

SEQ ID NO: 16088 - RNA, 22 nt, Human
aagucaccugaaaacucaacua

SEQ ID NO: 16089 - RNA, 22 nt, Human
aagucuugcucugucacccagg

SEQ ID NO: 16090 - RNA, 22 nt, Human
aagugagacaaacuucccugcc

SEQ ID NO: 16091 - RNA, 24 nt, Human
aagugcccgccaaagcuguggccc

SEQ ID NO: 16092 - RNA, 22 nt, Human
aaguggauaccuuugggcugag

SEQ ID NO: 16093 - RNA, 24 nt, Human
aagugucuuuuugggucgacaucc

SEQ ID NO: 16094 - RNA, 24 nt, Human
aaguguugggauuacaggugugag

SEQ ID NO: 16095 - RNA, 24 nt, Human
aaguuccuuccaaaucacuuuucu

SEQ ID NO: 16096 - RNA, 22 nt, Human
aaguugucgcuauugugcuuca

SEQ ID NO: 16097 - RNA, 22 nt, Human
aaguuuuggggguuuguuuuuc

SEQ ID NO: 16098 - RNA, 24 nt, Human
aaguuuuucaauccuucauggaaa

SEQ ID NO: 16099 - RNA, 22 nt, Human
aaucagagaggguccugccuca

SEQ ID NO: 16100 - RNA, 24 nt, Human
aaucccaggccacggugcuucuag

SEQ ID NO: 16101 - RNA, 22 nt, Human
aaucggacccauuuaaaccgga

SEQ ID NO: 16102 - RNA, 22 nt, Human
aaucugaaagaacucccccauc

SEQ ID NO: 16103 - RNA, 24 nt, Human
aaucugccuuuggucuguugauuu

SEQ ID NO: 16104 - RNA, 24 nt, Human
aaugacaagggaauugggaugggg

SEQ ID NO: 16105 - RNA, 24 nt, Human
aaugaccccaagaccuuugagggc

SEQ ID NO: 16106 - RNA, 24 nt, Human
aaugacuccgucaccaagagcagu

SEQ ID NO: 16107 - RNA, 22 nt, Human
aaugagaguuuguuuuaggggu

SEQ ID NO: 16108 - RNA, 22 nt, Human
aaugaguccuuuagugccauug

SEQ ID NO: 16109 - RNA, 22 nt, Human
aaugcaaauucuugggcucugc

SEQ ID NO: 16110 - RNA, 24 nt, Human
aaugcacuguggaauuugagggcc

SEQ ID NO: 16111 - RNA, 22 nt, Human
aaugcugacuguguccuugguu

SEQ ID NO: 16112 - RNA, 22 nt, Human
aaugcugugccagagcugcacc

SEQ ID NO: 16113 - RNA, 22 nt, Human
aauggcagagagcugugcuuca

SEQ ID NO: 16114 - RNA, 22 nt, Human
aauggcaucuaugaagcagaca

SEQ ID NO: 16115 - RNA, 24 nt, Human
aaugguacagcaguuacaagagga

SEQ ID NO: 16116 - RNA, 22 nt, Human
aaugucaugaaugugggaaggc

SEQ ID NO: 16117 - RNA, 24 nt, Human
aauguccccuccagggccccucug

SEQ ID NO: 16118 - RNA, 22 nt, Human
aaugugugggagaacagucuuu

SEQ ID NO: 16119 - RNA, 22 nt, Human
aauuacugucuagaaagcacca

SEQ ID NO: 16120 - RNA, 22 nt, Human
aauuacuuuaggaaaacuccuc

SEQ ID NO: 16121 - RNA, 24 nt, Human
acucagguugaguucuguggccag

SEQ ID NO: 16122 - RNA, 22 nt, Human
acuccaauggcugugggagacu

SEQ ID NO: 16123 - RNA, 24 nt, Human
acuccacucacgcgacaucaccac

SEQ ID NO: 16124 - RNA, 24 nt, Human
acuccaggcuuggucuucugggca

SEQ ID NO: 16125 - RNA, 24 nt, Human
acuccaucuuggucauguggccaa

SEQ ID NO: 16126 - RNA, 24 nt, Human
acuccguuucccguggugccccgg

SEQ ID NO: 16127 - RNA, 24 nt, Human
acucgaguaaagcugcuguuucag

SEQ ID NO: 16128 - RNA, 24 nt, Human
acucuguugcccaggcuggaggcg

SEQ ID NO: 16129 - RNA, 24 nt, Human
acugaaguucugcagaacaguauc

SEQ ID NO: 16130 - RNA, 24 nt, Human
acugaccaaggauugcccuugugc

SEQ ID NO: 16131 - RNA, 22 nt, Human
acugcaacaccuccuggguuca

SEQ ID NO: 16132 - RNA, 24 nt, Human
acugcaccugaagcccagccaaug

SEQ ID NO: 16133 - RNA, 24 nt, Human
acugcacuccaaccugggcaacag

SEQ ID NO: 16134 - RNA, 24 nt, Human
acugcacuccagccugggcaagag

SEQ ID NO: 16135 - RNA, 22 nt, Human
acugcacuccagccugggugac

SEQ ID NO: 16136 - RNA, 22 nt, Human
acugcacuccagucugggugac

SEQ ID NO: 16137 - RNA, 22 nt, Human
acugcacuccugccuaggugac

SEQ ID NO: 16138 - RNA, 22 nt, Human
acugcacucuagccuaggugau

SEQ ID NO: 16139 - RNA, 24 nt, Human
acugcagagauuaaaaguuuccuu

SEQ ID NO: 16140 - RNA, 24 nt, Human
acugcagccuugacuuccugggcu

SEQ ID NO: 16141 - RNA, 22 nt, Human
acugcagcuucagggacuugug

SEQ ID NO: 16142 - RNA, 24 nt, Human
acugcagucgagcuugggcgacag

SEQ ID NO: 16143 - RNA, 24 nt, Human
acugccauccuaaaaauauuaaau

SEQ ID NO: 16144 - RNA, 22 nt, Human
acugccauuguuuugaguggaa

SEQ ID NO: 16145 - RNA, 24 nt, Human
acugccucgccguuuuggagcaga

SEQ ID NO: 16146 - RNA, 24 nt, Human
acugcuguucuagacugugggggu

SEQ ID NO: 16147 - RNA, 22 nt, Human
acuggagggguucaaagguucg

SEQ ID NO: 16148 - RNA, 24 nt, Human
acuggauucggaaugugcugauuu

SEQ ID NO: 16149 - RNA, 22 nt, Human
acuggcaaaugcaaucuuuagg

SEQ ID NO: 16150 - RNA, 22 nt, Human
acuggcacagacaucugucaag

SEQ ID NO: 16151 - RNA, 22 nt, Human
acuggcccucaaaucuucgcuc

SEQ ID NO: 16152 - RNA, 24 nt, Human
acugguauaaaacacaguuuaaac

SEQ ID NO: 16153 - RNA, 24 nt, Human
acugguuucuucacucugaagcag

SEQ ID NO: 16154 - RNA, 22 nt, Human
acuguaccugggaggagcuuag

SEQ ID NO: 16155 - RNA, 22 nt, Human
acuguacugcagccugggagac

SEQ ID NO: 16156 - RNA, 24 nt, Human
acuguauuuauguugcuauggggc

SEQ ID NO: 16157 - RNA, 24 nt, Human
acugucucuuguuuuuggagguga

SEQ ID NO: 16158 - RNA, 24 nt, Human
acuguuuuauuuauaccaugcaua

SEQ ID NO: 16159 - RNA, 22 nt, Human
acuuagaacagccuaugggaag

SEQ ID NO: 16160 - RNA, 24 nt, Human
acuucaggcacauggugcugauga

SEQ ID NO: 16161 - RNA, 22 nt, Human
acuucauuggcuuucugcucuu

SEQ ID NO: 16162 - RNA, 24 nt, Human
acuugcuguaggucugcuugagga

SEQ ID NO: 16163 - RNA, 24 nt, Human
acuuggugaccuugccagcuccag

SEQ ID NO: 16164 - RNA, 24 nt, Human
acuuuaauagaaccaaaguugcag

SEQ ID NO: 16165 - RNA, 24 nt, Human
acuuucaggagaggcaagcagauu

SEQ ID NO: 16166 - RNA, 22 nt, Human
acuuucugugcaaacuuaacca

SEQ ID NO: 16167 - RNA, 24 nt, Human
acuuugaugauuugaaaggagaac

SEQ ID NO: 16168 - RNA, 24 nt, Human
agaaagacugucgcuagcauuuuu

SEQ ID NO: 16169 - RNA, 24 nt, Human
agaaagacuuaagggagcagaggg

SEQ ID NO: 16170 - RNA, 24 nt, Human
agaaagcaggcaccagggcugacc

SEQ ID NO: 16171 - RNA, 24 nt, Human
agaaaguaaggggcagagucauac

SEQ ID NO: 16172 - RNA, 22 nt, Human
agaaauauccuugauguguuug

SEQ ID NO: 16173 - RNA, 22 nt, Human
agaacacacagcaaggaaaggu

SEQ ID NO: 16174 - RNA, 22 nt, Human
agaacuucauuuaugaucucga

SEQ ID NO: 16175 - RNA, 22 nt, Human
agaaggcucuccugaauccugg

SEQ ID NO: 16176 - RNA, 22 nt, Human
agaagguuggggcuggaggucu

SEQ ID NO: 16177 - RNA, 22 nt, Human
agaaguaguaguagcaguagua

SEQ ID NO: 16178 - RNA, 22 nt, Human
agaaguguaaauaaguauguau

SEQ ID NO: 16179 - RNA, 22 nt, Human
agaaguguggucaguuucaucc

SEQ ID NO: 16180 - RNA, 24 nt, Human
agaaguugacagccaggugaaugu

SEQ ID NO: 16181 - RNA, 22 nt, Human
agaauuguggcuggacaucugu

SEQ ID NO: 16182 - RNA, 24 nt, Human
agacauagucaaaaugaaaacaua

SEQ ID NO: 16183 - RNA, 24 nt, Human
agacaugcugagguagaauuuaca

SEQ ID NO: 16184 - RNA, 24 nt, Human
agacauggagggcuuucggcaucg

SEQ ID NO: 16185 - RNA, 22 nt, Human
agacauggauagucuggaagac

SEQ ID NO: 16186 - RNA, 22 nt, Human
agacauuuggagccaacuuucc

SEQ ID NO: 16187 - RNA, 24 nt, Human
agacuagaaaaaguucggcugauu

SEQ ID NO: 16188 - RNA, 22 nt, Human
agacuccaucuuuucugggaga

SEQ ID NO: 16189 - RNA, 22 nt, Human
agacuguuccgucagacucagu

SEQ ID NO: 16190 - RNA, 24 nt, Human
agagaacacugugauuaagggaac

SEQ ID NO: 16191 - RNA, 24 nt, Human
agagaagagcggcauugugcuccu

SEQ ID NO: 16192 - RNA, 19 nt, Human
agagaggcauuuagcugau

SEQ ID NO: 16193 - RNA, 22 nt, Human
agagagggucagggggaggcug

SEQ ID NO: 16194 - RNA, 24 nt, Human
agagauacugaugagaccuauugc

SEQ ID NO: 16195 - RNA, 24 nt, Human
agagaucauugauuucuuccuggg

SEQ ID NO: 16196 - RNA, 24 nt, Human
agagauggggugaugauuaugaug

SEQ ID NO: 16197 - RNA, 24 nt, Human
agagauggugaagggccugugcgg

SEQ ID NO: 16198 - RNA, 24 nt, Human
agagcacagcagcacugugccugu

SEQ ID NO: 16199 - RNA, 24 nt, Human
agagcaccaggagcagguagaaga

SEQ ID NO: 16200 - RNA, 24 nt, Human
agagcacuguccagagcuuccucc

SEQ ID NO: 16201 - RNA, 24 nt, Human
agagcaguucuaccacuacaagga

SEQ ID NO: 16202 - RNA, 24 nt, Human
agagcccaucccuguccggggacu

SEQ ID NO: 16203 - RNA, 22 nt, Human
agagccuggacaagaacagcga

SEQ ID NO: 16204 - RNA, 24 nt, Human
agagcucgccgugcgccccgacgg

SEQ ID NO: 16205 - RNA, 24 nt, Human
agaggaaaggaagcuuugccucca

SEQ ID NO: 16206 - RNA, 24 nt, Human
agaggaagagaggacagagaggcc

SEQ ID NO: 16207 - RNA, 24 nt, Human
agaggacagaagcagaccacucug

SEQ ID NO: 16208 - RNA, 24 nt, Human
agaggaccucuaugacugcagggu

SEQ ID NO: 16209 - RNA, 22 nt, Human
agaggagaugcgugauaccaag

SEQ ID NO: 16210 - RNA, 22 nt, Human
agagggaagcagguucauaguu

SEQ ID NO: 16211 - RNA, 24 nt, Human
agagggaugcgaggcuggccuucc

SEQ ID NO: 16212 - RNA, 24 nt, Human
agagggauggaacagagggugaga

SEQ ID NO: 16213 - RNA, 24 nt, Human
agagguacuguugcagccgcugca

SEQ ID NO: 16214 - RNA, 24 nt, Human
agagguccuuagauagagaggaga

SEQ ID NO: 16215 - RNA, 24 nt, Human
agagguucugcgguuuaauauccc

SEQ ID NO: 16216 - RNA, 24 nt, Human
agagguuggcaagcaugguggaga

SEQ ID NO: 16217 - RNA, 24 nt, Human
agagucccugcuguguacuagaac

SEQ ID NO: 16218 - RNA, 22 nt, Human
agaguggagagaaacaacucug

SEQ ID NO: 16219 - RNA, 24 nt, Human
agaguuguucauccaggaagacag

SEQ ID NO: 16220 - RNA, 24 nt, Human
agaguuguucauccagggagacag

SEQ ID NO: 16221 - RNA, 24 nt, Human
agauagaccaguucuguugagggu

SEQ ID NO: 16222 - RNA, 24 nt, Human
agaucagacagaguaccuagaaga

SEQ ID NO: 16223 - RNA, 24 nt, Human
agaugcagaaggagaucaccgccc

SEQ ID NO: 16224 - RNA, 24 nt, Human
agaugcuaaagaaaacccuuaugg

SEQ ID NO: 16225 - RNA, 24 nt, Human
agaugcucugcuguccuguguggu

SEQ ID NO: 16226 - RNA, 22 nt, Human
agauggccuccugcuggauaug

SEQ ID NO: 16227 - RNA, 22 nt, Human
agauggugauaaaugugguacc

SEQ ID NO: 16228 - RNA, 22 nt, Human
agaugucuaccaguuggaaagg

SEQ ID NO: 16229 - RNA, 22 nt, Human
agaugucucauaauuuaggcca

SEQ ID NO: 16230 - RNA, 22 nt, Human
agauguuuugggaugaggagac

SEQ ID NO: 16231 - RNA, 22 nt, Human
agauuagaagaagaaucucuau

SEQ ID NO: 16232 - RNA, 22 nt, Human
agauuauuuaagacaggaacca

SEQ ID NO: 16233 - RNA, 22 nt, Human
agcaagaugguagcauuggaga

SEQ ID NO: 16234 - RNA, 23 nt, Human
agcaagcugaagggaaaaggggg

SEQ ID NO: 16235 - RNA, 22 nt, Human
agcagagccaccaaauuuagug

SEQ ID NO: 16236 - RNA, 22 nt, Human
agcagcccauaacaguuugugg

SEQ ID NO: 16237 - RNA, 22 nt, Human
agcagcucugccugguccagga

SEQ ID NO: 16238 - RNA, 24 nt, Human
agcaggugugaaggcgacaggacc

SEQ ID NO: 16239 - RNA, 24 nt, Human
agcagguucuucgugaguuccucg

SEQ ID NO: 16240 - RNA, 24 nt, Human
agcaguguggaugguugguuggga

SEQ ID NO: 16241 - RNA, 24 nt, Human
agcaguuuguugaagaagccuugg

SEQ ID NO: 16242 - RNA, 24 nt, Human
agcaguuuuuaggucugucaguac

SEQ ID NO: 16243 - RNA, 22 nt, Human
agcaucugcacauauuuccugc

SEQ ID NO: 16244 - RNA, 24 nt, Human
agcauuagguauuagugggaaaug

SEQ ID NO: 16245 - RNA, 22 nt, Human
agccacugagacagauggcugu

SEQ ID NO: 16246 - RNA, 24 nt, Human
agccagaaaccaggguggcuucca

SEQ ID NO: 16247 - RNA, 22 nt, Human
agccagaacuguggauacacac

SEQ ID NO: 16248 - RNA, 24 nt, Human
agccaggaggucaaggcugcagug

SEQ ID NO: 16249 - RNA, 22 nt, Human
agccaucaucacagaagagcau

SEQ ID NO: 16250 - RNA, 22 nt, Human
agccaucugaucgaccuuagac

SEQ ID NO: 16251 - RNA, 22 nt, Human
agccauguaugaggguuuccag

SEQ ID NO: 16252 - RNA, 22 nt, Human
agccccaaccuccuggcuuggu

SEQ ID NO: 16253 - RNA, 24 nt, Human
agccccauccccgcgcuggugggg

SEQ ID NO: 16254 - RNA, 24 nt, Human
agcccuggacuaccugcacucgga

SEQ ID NO: 16255 - RNA, 24 nt, Human
agccgcaaguuccugcugcuuggu

SEQ ID NO: 16256 - RNA, 22 nt, Human
agccgcauguucaugauugaga

SEQ ID NO: 16257 - RNA, 24 nt, Human
agccgcuggugaccugggugaaaa

SEQ ID NO: 16258 - RNA, 24 nt, Human
agccggaauggcauggucugugaa

SEQ ID NO: 16259 - RNA, 24 nt, Human
agccgguaaugcccucauggaugg

SEQ ID NO: 16260 - RNA, 24 nt, Human
agccucugccaagcgguuuguaag

SEQ ID NO: 16261 - RNA, 24 nt, Human
agccuuuauugggucagggcuugc

SEQ ID NO: 16262 - RNA, 22 nt, Human
agcggaaggcaggaugggacca

SEQ ID NO: 16263 - RNA, 22 nt, Human
agcggagaccugagcuaugagu

SEQ ID NO: 16264 - RNA, 22 nt, Human
agcggggauguagcucucucug

SEQ ID NO: 16265 - RNA, 24 nt, Human
agcuaugcguacccuaauucugaa

SEQ ID NO: 16266 - RNA, 22 nt, Human
agcuauuuuguggcuucaucaa

SEQ ID NO: 16267 - RNA, 24 nt, Human
agcucagacagaaaguuuggccug

SEQ ID NO: 16268 - RNA, 22 nt, Human
agcucucaggagggacaaagau

SEQ ID NO: 16269 - RNA, 22 nt, Human
agcugagaaagcgaagaggugg

SEQ ID NO: 16270 - RNA, 22 nt, Human
agcugcauucaugagguagcaa

SEQ ID NO: 16271 - RNA, 22 nt, Human
agcugccaguugaagaacauuu

SEQ ID NO: 16272 - RNA, 24 nt, Human
agcuggaacuacacagguguguac

SEQ ID NO: 16273 - RNA, 24 nt, Human
agcuggaauuacaggcaugagcca

SEQ ID NO: 16274 - RNA, 22 nt, Human
agcugguguguagcggguaccu

SEQ ID NO: 16275 - RNA, 24 nt, Human
agcugguuuggaacuccuggccuc

SEQ ID NO: 16276 - RNA, 24 nt, Human
agcuguucagcguacucuuuuaga

SEQ ID NO: 16277 - RNA, 22 nt, Human
agcuucuggaaggcaaggcuug

SEQ ID NO: 16278 - RNA, 22 nt, Human
agcuuuuugccauggcacuggu

SEQ ID NO: 16279 - RNA, 24 nt, Human
aggaaacauaaagugcuucuagca

SEQ ID NO: 16280 - RNA, 24 nt, Human
aggaaaccugcaaggcaaguucuc

SEQ ID NO: 16281 - RNA, 24 nt, Human
aggaaauuacaguuagaggucaca

SEQ ID NO: 16282 - RNA, 24 nt, Human
aggaacggaaugugauccaaucug

SEQ ID NO: 16283 - RNA, 24 nt, Human
aggaacuuaagaaguauggaguga

SEQ ID NO: 16284 - RNA, 24 nt, Human
aggaagaaauggguugagaagcaa

SEQ ID NO: 16285 - RNA, 24 nt, Human
aggaagaaguucaagauugaugac

SEQ ID NO: 16286 - RNA, 24 nt, Human
aggaagcacguggaggagggacgg

SEQ ID NO: 16287 - RNA, 24 nt, Human
aggaagcgucuuaccccucagcgc

SEQ ID NO: 16288 - RNA, 24 nt, Human
aggaagcugcugccgacgcacccg

SEQ ID NO: 16289 - RNA, 24 nt, Human
aggaagcuguccccagagcucccu

SEQ ID NO: 16290 - RNA, 24 nt, Human
aggaaggaaaagauaaaagguuuc

SEQ ID NO: 16291 - RNA, 24 nt, Human
aggaaggccgaccaggcaagaagc

SEQ ID NO: 16292 - RNA, 24 nt, Human
aggaagucagcacuuacauuacga

SEQ ID NO: 16293 - RNA, 24 nt, Human
aggaagugauaauaguggcaacau

SEQ ID NO: 16294 - RNA, 24 nt, Human
aggaagugccggcaagucugaucu

SEQ ID NO: 16295 - RNA, 24 nt, Human
aggaaguuguccagaaacuugcgu

SEQ ID NO: 16296 - RNA, 24 nt, Human
aggaaucaguacaagucaucaggg

SEQ ID NO: 16297 - RNA, 24 nt, Human
aggaaugagguuuccuggucggcu

SEQ ID NO: 16298 - RNA, 21 nt, Human
aggaauguaaagaagugccua

SEQ ID NO: 16299 - RNA, 24 nt, Human
aggaauguuuggguggcgucaagg

SEQ ID NO: 16300 - RNA, 24 nt, Human
aggacacaaagcgggcggaggaca

SEQ ID NO: 16301 - RNA, 24 nt, Human
aggacaggagaaaaggcagcaaga

SEQ ID NO: 16302 - RNA, 22 nt, Human
aggaggcagagauugcagugag

SEQ ID NO: 16303 - RNA, 24 nt, Human
aggaggcugagguugcagugagcc

SEQ ID NO: 16304 - RNA, 24 nt, Human
aggagggguaggcugggaggggcu

SEQ ID NO: 16305 - RNA, 24 nt, Human
aggaggucaaggaccgcugcaccc

SEQ ID NO: 16306 - RNA, 22 nt, Human
aggagucaucaucuaaagaauu

SEQ ID NO: 16307 - RNA, 22 nt, Human
aggaguguagugucccagcccu

SEQ ID NO: 16308 - RNA, 22 nt, Human
aggaugaagccaaagcagagac

SEQ ID NO: 16309 - RNA, 24 nt, Human
aggaugcagaaggagaucaccgcc

SEQ ID NO: 16310 - RNA, 24 nt, Human
aggaugcccauguggagcacagau

SEQ ID NO: 16311 - RNA, 24 nt, Human
aggaugcucaugcagaagcucagu

SEQ ID NO: 16312 - RNA, 24 nt, Human
aggcaagaagaugacauucacuua

SEQ ID NO: 16313 - RNA, 24 nt, Human
aggcaagagaaaugcuuguuucuu

SEQ ID NO: 16314 - RNA, 22 nt, Human
aggcaagcucuuggcagaguca

SEQ ID NO: 16315 - RNA, 24 nt, Human
aggcaaggugacgggacuggaagc

SEQ ID NO: 16316 - RNA, 22 nt, Human
aggcacagcguagaucuggaaa

SEQ ID NO: 16317 - RNA, 24 nt, Human
aggcaccagauucugcggcccggc

SEQ ID NO: 16318 - RNA, 22 nt, Human
aggcagaagagaagcugcagag

SEQ ID NO: 16319 - RNA, 22 nt, Human
aggcagagcacagacaggcugc

SEQ ID NO: 16320 - RNA, 24 nt, Human
aggcagaggggagacuugcagcuc

SEQ ID NO: 16321 - RNA, 24 nt, Human
aggcagccccgaucggaagcaggu

SEQ ID NO: 16322 - RNA, 23 nt, Human
aggcagccguggaaucagggcag

SEQ ID NO: 16323 - RNA, 24 nt, Human
aggcagcggcuguggcagcccggc

SEQ ID NO: 16324 - RNA, 24 nt, Human
aggcagcuccacugucugugcugg

SEQ ID NO: 16325 - RNA, 24 nt, Human
aggcagcuucggacaggugugguc

SEQ ID NO: 16326 - RNA, 24 nt, Human
aggcaggagguggaaaccccaggg

SEQ ID NO: 16327 - RNA, 22 nt, Human
aggcaggagugcaaugguguga

SEQ ID NO: 16328 - RNA, 24 nt, Human
aggcaggccuaaagggugcgauug

SEQ ID NO: 16329 - RNA, 22 nt, Human
aggcagggcuccgcugcgccuc

SEQ ID NO: 16330 - RNA, 24 nt, Human
aggcagguuaaguuccuugaugcc

SEQ ID NO: 16331 - RNA, 24 nt, Human
aggcaguccugggaccuccuguuc

SEQ ID NO: 16332 - RNA, 24 nt, Human
aggcaguggcgauggcgcccuuuc

SEQ ID NO: 16333 - RNA, 24 nt, Human
aggcaguggguggggaaggggaca

SEQ ID NO: 16334 - RNA, 22 nt, Human
aggcagugugguguggugguua

SEQ ID NO: 16335 - RNA, 24 nt, Human
aggcaguugcagucaccugggacu

SEQ ID NO: 16336 - RNA, 22 nt, Human
aggcauggacauuucggcagcu

SEQ ID NO: 16337 - RNA, 24 nt, Human
aggcauuaucauucuucaccuacu

SEQ ID NO: 16338 - RNA, 24 nt, Human
aggccagggauacaaagcggggag

SEQ ID NO: 16339 - RNA, 24 nt, Human
aggcccugccuuggcauguguguc

SEQ ID NO: 16340 - RNA, 22 nt, Human
aggcccuugaagggaagagaac

SEQ ID NO: 16341 - RNA, 24 nt, Human
aggccgagguccgcggccaggugc

SEQ ID NO: 16342 - RNA, 24 nt, Human
aggccgcccauuuggccccgcgcc

SEQ ID NO: 16343 - RNA, 24 nt, Human
aggcgaugcgccuagggccgggcu

SEQ ID NO: 16344 - RNA, 24 nt, Human
aggcgcccgaacugcggcgcgcgg

SEQ ID NO: 16345 - RNA, 24 nt, Human
aggcggaagugcaggguugugauc

SEQ ID NO: 16346 - RNA, 24 nt, Human
aggcgggugaaggcuguggguguc

SEQ ID NO: 16347 - RNA, 24 nt, Human
aggcgguggguucucucuagcuuu

SEQ ID NO: 16348 - RNA, 24 nt, Human
aggcguuggggacacugcuggguc

SEQ ID NO: 16349 - RNA, 22 nt, Human
aggcugagaugauuagguuggc

SEQ ID NO: 16350 - RNA, 24 nt, Human
aggcugaucccaggcacuguugca

SEQ ID NO: 16351 - RNA, 22 nt, Human
aggcugcaguguaguggcauga

SEQ ID NO: 16352 - RNA, 22 nt, Human
aggcuggucuugacuccugggc

SEQ ID NO: 16353 - RNA, 22 nt, Human
aggcuucucuccaguaugcauu

SEQ ID NO: 16354 - RNA, 24 nt, Human
aggcuuuuacaccacaagugcagu

SEQ ID NO: 16355 - RNA, 24 nt, Human
aggcuuuuacggugauugcugauu

SEQ ID NO: 16356 - RNA, 22 nt, Human
agggaaaacagcugaagaccaa

SEQ ID NO: 16357 - RNA, 24 nt, Human
agggaaccagcauggcaccuacca

SEQ ID NO: 16358 - RNA, 24 nt, Human
agggaaggacugcugggauuggcc

SEQ ID NO: 16359 - RNA, 24 nt, Human
agggaaggacugcuggguuggcca

SEQ ID NO: 16360 - RNA, 24 nt, Human
agggaagugugcggagggcuucca

SEQ ID NO: 16361 - RNA, 24 nt, Human
agggaauucuugccagucccuuaa

SEQ ID NO: 16362 - RNA, 24 nt, Human
agggaccaaaugcuucuaggaguc

SEQ ID NO: 16363 - RNA, 24 nt, Human
agggaccaauuggccauccuaggc

SEQ ID NO: 16364 - RNA, 24 nt, Human
agggaccccaggucagagacugga

SEQ ID NO: 16365 - RNA, 24 nt, Human
agggagacagugaaguaauuaugg

SEQ ID NO: 16366 - RNA, 21 nt, Human
agggagcagcuugauaaguca

SEQ ID NO: 16367 - RNA, 24 nt, Human
agggagccacgauaauucuccaga

SEQ ID NO: 16368 - RNA, 24 nt, Human
agggagccuucaagcgagccuggc

SEQ ID NO: 16369 - RNA, 24 nt, Human
agggaggacagcaggcugggggcg

SEQ ID NO: 16370 - RNA, 22 nt, Human
agggagugguacggguaucacu

SEQ ID NO: 16371 - RNA, 22 nt, Human
agggaguuuacauguuuucuaa

SEQ ID NO: 16372 - RNA, 24 nt, Human
agggauggaggggaggguguugag

SEQ ID NO: 16373 - RNA, 22 nt, Human
agggcaugugaacgggugauug

SEQ ID NO: 16374 - RNA, 22 nt, Human
agggccuauuaccaggagagga

SEQ ID NO: 16375 - RNA, 22 nt, Human
agggcugccccauucgggaauc

SEQ ID NO: 16376 - RNA, 22 nt, Human
aggggacaggugaccugggcuc

SEQ ID NO: 16377 - RNA, 24 nt, Human
aggggauguucauggucagcugcg

SEQ ID NO: 16378 - RNA, 24 nt, Human
aggggggcggaaaauucgcaaggu

SEQ ID NO: 16379 - RNA, 24 nt, Human
aggggguggcggugccaggguccu

SEQ ID NO: 16380 - RNA, 24 nt, Human
agggguuuuggggucgaccuccug

SEQ ID NO: 16381 - RNA, 24 nt, Human
agggugcaggagcugcauccggag

SEQ ID NO: 16382 - RNA, 24 nt, Human
agggugguguaggagaucaaauaa

SEQ ID NO: 16383 - RNA, 22 nt, Human
aggguuccaaaaauucucuggu

SEQ ID NO: 16384 - RNA, 22 nt, Human
agguagggaggguagaugcucu

SEQ ID NO: 16385 - RNA, 24 nt, Human
agguaggugaagcagagaaagaag

SEQ ID NO: 16386 - RNA, 22 nt, Human
agguauacugggcaccauuuga

SEQ ID NO: 16387 - RNA, 22 nt, Human
agguaucagacuucagaaguag

SEQ ID NO: 16388 - RNA, 22 nt, Human
aggucacguccugugaugucau

SEQ ID NO: 16389 - RNA, 22 nt, Human
aggucagugcccacguuguugu

SEQ ID NO: 16390 - RNA, 22 nt, Human
aggucccuccuugagucucaug

SEQ ID NO: 16391 - RNA, 24 nt, Human
agguccuagcucugcuacuuacuc

SEQ ID NO: 16392 - RNA, 22 nt, Human
aggucuccuggccucagugaug

SEQ ID NO: 16393 - RNA, 22 nt, Human
aggucuggagcuggagagaaca

SEQ ID NO: 16394 - RNA, 22 nt, Human
aggugaagugaaguggugacua

SEQ ID NO: 16395 - RNA, 24 nt, Human
aggugagaagcggacccaucacuu

SEQ ID NO: 16396 - RNA, 22 nt, Human
aggugagaggaucacuugagcc

SEQ ID NO: 16397 - RNA, 24 nt, Human
aggugcugacuuccuugggagaug

SEQ ID NO: 16398 - RNA, 24 nt, Human
aggugggggcaaguauaugucaga

SEQ ID NO: 16399 - RNA, 22 nt, Human
aggugguacuuuuaagguaucc

SEQ ID NO: 16400 - RNA, 24 nt, Human
aggugucggauggacuuuuggcuc

SEQ ID NO: 16401 - RNA, 24 nt, Human
agguucacaaaacaaguguaguag

SEQ ID NO: 16402 - RNA, 22 nt, Human
agguucaucaauaacucagaga

SEQ ID NO: 16403 - RNA, 24 nt, Human
agguucuggagaacacuucagugc

SEQ ID NO: 16404 - RNA, 22 nt, Human
agguuuuuagucuauaaguuca

SEQ ID NO: 16405 - RNA, 24 nt, Human
aguaaagauaaucugggcugcucc

SEQ ID NO: 16406 - RNA, 22 nt, Human
aguaaucccagcaauuugggag

SEQ ID NO: 16407 - RNA, 24 nt, Human
aguacagaucguuucucaucucua

SEQ ID NO: 16408 - RNA, 22 nt, Human
aguagaagaauaaaaaucauuc

SEQ ID NO: 16409 - RNA, 24 nt, Human
aguagccccccuccucaacccaga

SEQ ID NO: 16410 - RNA, 22 nt, Human
aguagcuuugcaaucuggaagg

SEQ ID NO: 16411 - RNA, 24 nt, Human
aguaguuuuggucagggguuaaua

SEQ ID NO: 16412 - RNA, 22 nt, Human
aguauguauuccaggcugguug

SEQ ID NO: 16413 - RNA, 22 nt, Human
aguauuacagcagguacugguu

SEQ ID NO: 16414 - RNA, 24 nt, Human
agucaauuuguuuuguaccugugu

SEQ ID NO: 16415 - RNA, 22 nt, Human
agucagacguuuggcaacagca

SEQ ID NO: 16416 - RNA, 22 nt, Human
agucauggagcgaccaacggca

SEQ ID NO: 16417 - RNA, 22 nt, Human
agucauuuugcaccagguaaua

SEQ ID NO: 16418 - RNA, 24 nt, Human
aguccaugugcagucuccauguac

SEQ ID NO: 16419 - RNA, 22 nt, Human
agucccccucucauaccaaagg

SEQ ID NO: 16420 - RNA, 24 nt, Human
aguccuggcuagacaaguccacac

SEQ ID NO: 16421 - RNA, 22 nt, Human
agucucaaguuuucacugaucu

SEQ ID NO: 16422 - RNA, 22 nt, Human
agucucccacuagcuguaggau

SEQ ID NO: 16423 - RNA, 22 nt, Human
agucucuaucauaugguuucac

SEQ ID NO: 16424 - RNA, 22 nt, Human
agucuucucaucugugccagca

SEQ ID NO: 16425 - RNA, 24 nt, Human
agugaagacugaggucugcccuuc

SEQ ID NO: 16426 - RNA, 22 nt, Human
agugaagcgaguugggccagag

SEQ ID NO: 16427 - RNA, 23 nt, Human
agugaagcuuaucagaagauggg

SEQ ID NO: 16428 - RNA, 24 nt, Human
agugacacgugaaugauaauguga

SEQ ID NO: 16429 - RNA, 24 nt, Human
agugagcaauuucugucccuuuua

SEQ ID NO: 16430 - RNA, 22 nt, Human
agugaggaaggaguuuggccac

SEQ ID NO: 16431 - RNA, 24 nt, Human
agugcagaaacuuacuuugaaaag

SEQ ID NO: 16432 - RNA, 24 nt, Human
agugcagaccucugacccuggagu

SEQ ID NO: 16433 - RNA, 22 nt, Human
agugcagguucacaggcugggc

SEQ ID NO: 16434 - RNA, 22 nt, Human
agugcuuccagcaguucccaga

SEQ ID NO: 16435 - RNA, 24 nt, Human
aguggaagcuuugacaucauuaac

SEQ ID NO: 16436 - RNA, 24 nt, Human
aguggaaucauacaguauuugucu

SEQ ID NO: 16437 - RNA, 24 nt, Human
aguggacagcacuuaguagcugug

SEQ ID NO: 16438 - RNA, 24 nt, Human
aguggagagccacacgugugaaau

SEQ ID NO: 16439 - RNA, 24 nt, Human
aguggaugagcuguacagagaagc

SEQ ID NO: 16440 - RNA, 24 nt, Human
aguggauggcaacugauggaacag

SEQ ID NO: 16441 - RNA, 24 nt, Human
aguggauuuugccggcugguugug

SEQ ID NO: 16442 - RNA, 24 nt, Human
aguggcuauaaauacagaugaagc

SEQ ID NO: 16443 - RNA, 22 nt, Human
aguggcuuuagaccagucagua

SEQ ID NO: 16444 - RNA, 24 nt, Human
aguggugugaucacagcucagugu

SEQ ID NO: 16445 - RNA, 22 nt, Human
agugguuucagggacuucugua

SEQ ID NO: 16446 - RNA, 24 nt, Human
agugucuccaccaggcggcuucaa

SEQ ID NO: 16447 - RNA, 22 nt, Human
aguguguacacggcagcagucc

SEQ ID NO: 16448 - RNA, 24 nt, Human
aguuacuaguuuaaugggugaaaa

SEQ ID NO: 16449 - RNA, 24 nt, Human
aguucagaagagguuuggcuuucc

SEQ ID NO: 16450 - RNA, 24 nt, Human
aguucagacaucaauguuccuucc

SEQ ID NO: 16451 - RNA, 23 nt, Human
aguucaguuguggagaaugggac

SEQ ID NO: 16452 - RNA, 22 nt, Human
aguuccauggaaaacaacaaag

SEQ ID NO: 16453 - RNA, 22 nt, Human
aguucuuagaggacugcuuugc

SEQ ID NO: 16454 - RNA, 24 nt, Human
aguugcuccagaaaaaccuguaaa

SEQ ID NO: 16455 - RNA, 24 nt, Human
aguugcucuaaguggauuggauau

SEQ ID NO: 16456 - RNA, 22 nt, Human
aguuggagaccgcuguuacgag

SEQ ID NO: 16457 - RNA, 24 nt, Human
aguugguugaauuuguggaugugg

SEQ ID NO: 16458 - RNA, 24 nt, Human
aguuguauuucaagguuuggucca

SEQ ID NO: 16459 - RNA, 22 nt, Human
aguugucauggggucauucccu

SEQ ID NO: 16460 - RNA, 24 nt, Human
aguuguguugucaauuucaugcuu

SEQ ID NO: 16461 - RNA, 22 nt, Human
auaaagcagguuaacaaagcug

SEQ ID NO: 16462 - RNA, 22 nt, Human
auaaagcguuguaauacacagg

SEQ ID NO: 16463 - RNA, 22 nt, Human
auaaaggucaaacaucagugag

SEQ ID NO: 16464 - RNA, 24 nt, Human
auaacacuuagcaaacacugaucu

SEQ ID NO: 16465 - RNA, 22 nt, Human
auaacaugcugagaacugaggc

SEQ ID NO: 16466 - RNA, 22 nt, Human
auaacugugaagaggcaauugu

SEQ ID NO: 16467 - RNA, 24 nt, Human
auaauguaguauauacuaaauaaa

SEQ ID NO: 16468 - RNA, 22 nt, Human
auacagcucucucuggggacuu

SEQ ID NO: 16469 - RNA, 24 nt, Human
auacugcggcugaucaaaggagcu

SEQ ID NO: 16470 - RNA, 22 nt, Human
auacugugucucuaaaagcuga

SEQ ID NO: 16471 - RNA, 22 nt, Human
auagaagagcagugggguagaa

SEQ ID NO: 16472 - RNA, 24 nt, Human
auagcucacugcagccucuaccuc

SEQ ID NO: 16473 - RNA, 24 nt, Human
auagcucuagggaucucagcaggg

SEQ ID NO: 16474 - RNA, 24 nt, Human
auaguacaaauuagaugcagcgua

SEQ ID NO: 16475 - RNA, 24 nt, Human
auaguacuggugacguggugcggc

SEQ ID NO: 16476 - RNA, 22 nt, Human
auaucauugaaggagccuuucg

SEQ ID NO: 16477 - RNA, 22 nt, Human
auaugcggaggugggccgaguu

SEQ ID NO: 16478 - RNA, 24 nt, Human
aucaaguucaggcacagcccuggu

SEQ ID NO: 16479 - RNA, 22 nt, Human
aucacauugccagggauuacca

SEQ ID NO: 16480 - RNA, 24 nt, Human
aucaccaugagcagagcucucauu

SEQ ID NO: 16481 - RNA, 22 nt, Human
aucacuauuaaugugugcuagu

SEQ ID NO: 16482 - RNA, 22 nt, Human
aucacuuugcagggauuacuaa

SEQ ID NO: 16483 - RNA, 24 nt, Human
aucagcuccgacuuggacgggcac

SEQ ID NO: 16484 - RNA, 24 nt, Human
aucauccuggugcccucgucuugg

SEQ ID NO: 16485 - RNA, 24 nt, Human
aucaucuucaucuacgagaagcgc

SEQ ID NO: 16486 - RNA, 24 nt, Human
aucaugucgcacaaacaaauuuac

SEQ ID NO: 16487 - RNA, 22 nt, Human
auccagugucauugugcaucau

SEQ ID NO: 16488 - RNA, 24 nt, Human
auccaugagaucucccacaguugg

SEQ ID NO: 16489 - RNA, 24 nt, Human
auccgagugugaauucccugcaag

SEQ ID NO: 16490 - RNA, 24 nt, Human
auccgcugccaguccccacugagg

SEQ ID NO: 16491 - RNA, 24 nt, Human
auccucagaagaucuguguguaca

SEQ ID NO: 16492 - RNA, 24 nt, Human
auccuguucucuuccacucugcca

SEQ ID NO: 16493 - RNA, 24 nt, Human
aucgagcauuucuggagggagcug

SEQ ID NO: 16494 - RNA, 24 nt, Human
aucguuccgccugggcgggauucu

SEQ ID NO: 16495 - RNA, 24 nt, Human
aucuauguuagcguuccuggaucc

SEQ ID NO: 16496 - RNA, 22 nt, Human
aucucaggccucgugcuggaac

SEQ ID NO: 16497 - RNA, 22 nt, Human
aucugccaccgagaucugucgc

SEQ ID NO: 16498 - RNA, 22 nt, Human
aucugucacacguuuggaaccc

SEQ ID NO: 16499 - RNA, 22 nt, Human
aucugugugacuggcuccuuuu

SEQ ID NO: 16500 - RNA, 24 nt, Human
aucuucacuuagaugugucugaug

SEQ ID NO: 16501 - RNA, 22 nt, Human
aucuucuccaguuuucacauag

SEQ ID NO: 16502 - RNA, 24 nt, Human
augaaaucuagucauuaaagaguc

SEQ ID NO: 16503 - RNA, 24 nt, Human
augaaauuuaucaccagacagcuu

SEQ ID NO: 16504 - RNA, 24 nt, Human
augaagaugaaccuacuguaguac

SEQ ID NO: 16505 - RNA, 24 nt, Human
augaagcuugugaccaaguggagg

SEQ ID NO: 16506 - RNA, 24 nt, Human
augaaguugucggaguccccaucg

SEQ ID NO: 16507 - RNA, 22 nt, Human
augaccaggaauugagagacug

SEQ ID NO: 16508 - RNA, 22 nt, Human
augacccuucuggaacugcuuc

SEQ ID NO: 16509 - RNA, 22 nt, Human
augaccugcagucagggcccag

SEQ ID NO: 16510 - RNA, 24 nt, Human
augaccuucaggccauucagaaag

SEQ ID NO: 16511 - RNA, 22 nt, Human
augagaguaggaguuugggcuc

SEQ ID NO: 16512 - RNA, 22 nt, Human
augagagugacagggguuagaa

SEQ ID NO: 16513 - RNA, 22 nt, Human
augaggucugugucacuguggu

SEQ ID NO: 16514 - RNA, 22 nt, Human
augauagguaccaacuaucuga

SEQ ID NO: 16515 - RNA, 24 nt, Human
augauccaccugccucggccuccc

SEQ ID NO: 16516 - RNA, 22 nt, Human
augaucuaugaagugagagaug

SEQ ID NO: 16517 - RNA, 22 nt, Human
augauugugccaauaagccagg

SEQ ID NO: 16518 - RNA, 24 nt, Human
augcaaaauaaccaagaaguuaaa

SEQ ID NO: 16519 - RNA, 22 nt, Human
augcacagucuugagucuugca

SEQ ID NO: 16520 - RNA, 24 nt, Human
augcaccucacuaaggcucaucug

SEQ ID NO: 16521 - RNA, 24 nt, Human
augcagaagucgagaccauggagg

SEQ ID NO: 16522 - RNA, 24 nt, Human
augcagacuggcauuaaggcugug

SEQ ID NO: 16523 - RNA, 24 nt, Human
augcagccuaaaaggugguugaaa

SEQ ID NO: 16524 - RNA, 24 nt, Human
augcagcugcugcccgcgggcuug

SEQ ID NO: 16525 - RNA, 24 nt, Human
augcaggcccugugggagcccacg

SEQ ID NO: 16526 - RNA, 17 nt, Human
augcagucacauaggau

SEQ ID NO: 16527 - RNA, 22 nt, Human
augcaucuuugcauauuucacc

SEQ ID NO: 16528 - RNA, 24 nt, Human
augcccaucuuuggauuucuaaug

SEQ ID NO: 16529 - RNA, 24 nt, Human
augcccgaggagaagcugguugag

SEQ ID NO: 16530 - RNA, 24 nt, Human
augccuccucuggguggugauacc

SEQ ID NO: 16531 - RNA, 22 nt, Human
augcgugaucacauagccaaga

SEQ ID NO: 16532 - RNA, 24 nt, Human
augcugcccugggacccagcuggu

SEQ ID NO: 16533 - RNA, 22 nt, Human
augcugccuucaauccauuuaa

SEQ ID NO: 16534 - RNA, 23 nt, Human
augcugcggauauacaggaucug

SEQ ID NO: 16535 - RNA, 24 nt, Human
augcuguauuuuaacacuuuguau

SEQ ID NO: 16536 - RNA, 22 nt, Human
augcugucuuacaugaaugcag

SEQ ID NO: 16537 - RNA, 22 nt, Human
augcuuccggcaggagacacaa

SEQ ID NO: 16538 - RNA, 24 nt, Human
augcuucuaucuccaguugcucuu

SEQ ID NO: 16539 - RNA, 22 nt, Human
auggacacagagucccagacgu

SEQ ID NO: 16540 - RNA, 22 nt, Human
auggacagaguauguugucuca

SEQ ID NO: 16541 - RNA, 22 nt, Human
auggacaguauuagccaucauu

SEQ ID NO: 16542 - RNA, 22 nt, Human
auggagcccugaauguugaccu

SEQ ID NO: 16543 - RNA, 24 nt, Human
auggagcuaaaaguugauuuucau

SEQ ID NO: 16544 - RNA, 24 nt, Human
auggaucccucugugcuucuggac

SEQ ID NO: 16545 - RNA, 22 nt, Human
auggcagaaagaauagaggcua

SEQ ID NO: 16546 - RNA, 22 nt, Human
auggcauggugcccaucgugga

SEQ ID NO: 16547 - RNA, 22 nt, Human
auggccauggugguuucucuac

SEQ ID NO: 16548 - RNA, 24 nt, Human
auggccccuccgggaaaacugugg

SEQ ID NO: 16549 - RNA, 24 nt, Human
auggccccuccgggaaacuguggc

SEQ ID NO: 16550 - RNA, 22 nt, Human
auggccgcuuucucaaguuuga

SEQ ID NO: 16551 - RNA, 24 nt, Human
augggacugggaaggaggggugug

SEQ ID NO: 16552 - RNA, 22 nt, Human
augggcaaauacugggagcugg

SEQ ID NO: 16553 - RNA, 23 nt, Human
augggcccuccaagaguuggaau

SEQ ID NO: 16554 - RNA, 22 nt, Human
augggggguguucugcuuggca

SEQ ID NO: 16555 - RNA, 24 nt, Human
augguaauggagguaaaguguguc

SEQ ID NO: 16556 - RNA, 19 nt, Human
augguaguucaguuggggu

SEQ ID NO: 16557 - RNA, 24 nt, Human
augguggcccuugcaaccuuaaga

SEQ ID NO: 16558 - RNA, 24 nt, Human
auguagugugucuucuugaguagg

SEQ ID NO: 16559 - RNA, 24 nt, Human
augucaaauccugguauccuuccc

SEQ ID NO: 16560 - RNA, 24 nt, Human
augucaucuugaaggcuuuuccac

SEQ ID NO: 16561 - RNA, 24 nt, Human
augugcugugugcucuuugaaagg

SEQ ID NO: 16562 - RNA, 22 nt, Human
auguggcuauccauuauagaga

SEQ ID NO: 16563 - RNA, 22 nt, Human
augugggguugggauucuguga

SEQ ID NO: 16564 - RNA, 23 nt, Human
augugguuaaaguugucugcaau

SEQ ID NO: 16565 - RNA, 22 nt, Human
auguguguguuacaggggcugc

SEQ ID NO: 16566 - RNA, 22 nt, Human
auuacagccauuuugaugagug

SEQ ID NO: 16567 - RNA, 22 nt, Human
auuaguguguguggguuuguau

SEQ ID NO: 16568 - RNA, 22 nt, Human
auuaugcagccugugaacagcg

SEQ ID NO: 16569 - RNA, 22 nt, Human
auuauggugcccgacgggaaca

SEQ ID NO: 16570 - RNA, 22 nt, Human
auucagcucugugcucucacag

SEQ ID NO: 16571 - RNA, 24 nt, Human
auucaguaaacaagugcugaaaaa

SEQ ID NO: 16572 - RNA, 22 nt, Human
auucauacugccaacagucugc

SEQ ID NO: 16573 - RNA, 24 nt, Human
auuccaaucugauacccaaagaga

SEQ ID NO: 16574 - RNA, 24 nt, Human
auuccagaaaccagugaagaugug

SEQ ID NO: 16575 - RNA, 22 nt, Human
auuccuuuaacaaguauguguc

SEQ ID NO: 16576 - RNA, 22 nt, Human
auucucacaugcaagugaaguc

SEQ ID NO: 16577 - RNA, 22 nt, Human
auugaagcucacguugauguca

SEQ ID NO: 16578 - RNA, 24 nt, Human
auugacuuacagcagggagagaau

SEQ ID NO: 16579 - RNA, 24 nt, Human
auugauggucagccaggugccuuc

SEQ ID NO: 16580 - RNA, 24 nt, Human
auugcacuccagccugggcgacaa

SEQ ID NO: 16581 - RNA, 22 nt, Human
auugcacuccagccugggugac

SEQ ID NO: 16582 - RNA, 24 nt, Human
auugcacugcagccugggcaauaa

SEQ ID NO: 16583 - RNA, 24 nt, Human
auugcagcagcagcagcuucuugg

SEQ ID NO: 16584 - RNA, 22 nt, Human
auugcagccucgaacuccuggg

SEQ ID NO: 16585 - RNA, 22 nt, Human
auuggauaugguuggaguggca

SEQ ID NO: 16586 - RNA, 24 nt, Human
auuggugguauuuugguauguggc

SEQ ID NO: 16587 - RNA, 22 nt, Human
auuguacuccagccugggugac

SEQ ID NO: 16588 - RNA, 24 nt, Human
auugugcauaucagggauacccuc

SEQ ID NO: 16589 - RNA, 20 nt, Human
auugugcccuguggcuuccu

SEQ ID NO: 16590 - RNA, 24 nt, Human
auugugcucuuuccagauccucaa

SEQ ID NO: 16591 - RNA, 24 nt, Human
auuuauguggaagcugaacaggua

SEQ ID NO: 16592 - RNA, 24 nt, Human
auuucauucacuggggaggaacaa

SEQ ID NO: 16593 - RNA, 22 nt, Human
auuugaggaggcuuuacagcca

SEQ ID NO: 16594 - RNA, 24 nt, Human
auuugcuggggggaaggacaaccc

SEQ ID NO: 16595 - RNA, 24 nt, Human
auuuggguggaaaacagggugcua

SEQ ID NO: 16596 - RNA, 22 nt, Human
auuuugguauagaggagggguu

SEQ ID NO: 16597 - RNA, 22 nt, Human
auuuuuagaggaauccauuuua

SEQ ID NO: 16598 - RNA, 22 nt, Human
auuuuuccacacacagacucag

SEQ ID NO: 16599 - RNA, 22 nt, Human
auuuuucugcauuuguauugga

SEQ ID NO: 16600 - RNA, 22 nt, Human
caaaaagaauguugcauguguu

SEQ ID NO: 16601 - RNA, 24 nt, Human
caaaacucucaugauggagaacca

SEQ ID NO: 16602 - RNA, 24 nt, Human
caaaaggagcugcaauuuuaaagu

SEQ ID NO: 16603 - RNA, 22 nt, Human
caaacuugccuguuccaucuuu

SEQ ID NO: 16604 - RNA, 22 nt, Human
caaagugagguacacuguugcc

SEQ ID NO: 16605 - RNA, 18 nt, Human
caaaguuuucagauaggc

SEQ ID NO: 16606 - RNA, 24 nt, Human
caaaugacuuaguaaucuaauaug

SEQ ID NO: 16607 - RNA, 24 nt, Human
caaaugccagcagaggccuuuugg

SEQ ID NO: 16608 - RNA, 22 nt, Human
caaauguauaaauguacuuucu

SEQ ID NO: 16609 - RNA, 24 nt, Human
caacaacucgagacaacagagacc

SEQ ID NO: 16610 - RNA, 24 nt, Human
caacacacacgcugcuguaucucc

SEQ ID NO: 16611 - RNA, 24 nt, Human
caacccuuucacaaaaccagggaa

SEQ ID NO: 16612 - RNA, 24 nt, Human
caagaccgagaucccuaagguucu

SEQ ID NO: 16613 - RNA, 22 nt, Human
caagaccugccagauucugugc

SEQ ID NO: 16614 - RNA, 24 nt, Human
caagagccagauggugucagagga

SEQ ID NO: 16615 - RNA, 24 nt, Human
caagaggaaagcauuccucaaacc

SEQ ID NO: 16616 - RNA, 24 nt, Human
caagccauccccuuugcuuuuaca

SEQ ID NO: 16617 - RNA, 24 nt, Human
caagcucaggcgcgguggucguug

SEQ ID NO: 16618 - RNA, 24 nt, Human
caagcucuaaaauuuugguucugu

SEQ ID NO: 16619 - RNA, 24 nt, Human
caaggccacacaagguggauggac

SEQ ID NO: 16620 - RNA, 24 nt, Human
caagggccuggcuccucuuccugu

SEQ ID NO: 16621 - RNA, 24 nt, Human
caagguagucacagacuucuggag

SEQ ID NO: 16622 - RNA, 24 nt, Human
caagguuaaaugccucccucucgg

SEQ ID NO: 16623 - RNA, 24 nt, Human
caagguucauuauucacagcccgg

SEQ ID NO: 16624 - RNA, 22 nt, Human
caaguauguggaaauagcgcgg

SEQ ID NO: 16625 - RNA, 24 nt, Human
caagugaaccucccgccuuugccu

SEQ ID NO: 16626 - RNA, 24 nt, Human
caagugucuugaugguagacaagg

SEQ ID NO: 16627 - RNA, 22 nt, Human
caaguuuucccguggcccugcc

SEQ ID NO: 16628 - RNA, 24 nt, Human
caauccugguucuuuugacacaag

SEQ ID NO: 16629 - RNA, 24 nt, Human
caaugaggccaccggcggcaagua

SEQ ID NO: 16630 - RNA, 22 nt, Human
caaugauuaguuuuuuccccca

SEQ ID NO: 16631 - RNA, 22 nt, Human
caaugcacauggacaucaggcu

SEQ ID NO: 16632 - RNA, 21 nt, Human
caaugcacgcugguauucugc

SEQ ID NO: 16633 - RNA, 24 nt, Human
caaugcaguccuggauggagccga

SEQ ID NO: 16634 - RNA, 24 nt, Human
caaugccccuguuggaauucggca

SEQ ID NO: 16635 - RNA, 24 nt, Human
caauugguuccaagacgcguaggc

SEQ ID NO: 16636 - RNA, 22 nt, Human
cacaacuugucuuggugauauu

SEQ ID NO: 16637 - RNA, 24 nt, Human
cacaagccugguuauuugaggaug

SEQ ID NO: 16638 - RNA, 24 nt, Human
cacaaguuuuccaacuaugaacuc

SEQ ID NO: 16639 - RNA, 22 nt, Human
cacaauauagcaaauagagggu

SEQ ID NO: 16640 - RNA, 22 nt, Human
cacacaugaguuauguaccaac

SEQ ID NO: 16641 - RNA, 24 nt, Human
cacaccaccugcugcaugcggcug

SEQ ID NO: 16642 - RNA, 22 nt, Human
cacaccuguuucuguggcaugg

SEQ ID NO: 16643 - RNA, 24 nt, Human
cacacguucagccacccaccuuca

SEQ ID NO: 16644 - RNA, 24 nt, Human
cacacuguuaaaggguuuuuuggg

SEQ ID NO: 16645 - RNA, 24 nt, Human
cacagcaaacguuccaggccuggg

SEQ ID NO: 16646 - RNA, 24 nt, Human
cacaggaaagacugcuggcugacu

SEQ ID NO: 16647 - RNA, 24 nt, Human
cacaggacucuggguuccugcucu

SEQ ID NO: 16648 - RNA, 24 nt, Human
cacaggguucaccgccauuucuuc

SEQ ID NO: 16649 - RNA, 24 nt, Human
cacaggguucugccucuggcccga

SEQ ID NO: 16650 - RNA, 24 nt, Human
cacagugucaagucuuguuuugag

SEQ ID NO: 16651 - RNA, 22 nt, Human
cacauccuacugacacuguccu

SEQ ID NO: 16652 - RNA, 24 nt, Human
cacaucuugacaauggggaagggu

SEQ ID NO: 16653 - RNA, 24 nt, Human
cacauggagguuagggagagcccu

SEQ ID NO: 16654 - RNA, 23 nt, Human
cacauguauguccagccuguagu

SEQ ID NO: 16655 - RNA, 24 nt, Human
caccacaucaaaaugaggggugug

SEQ ID NO: 16656 - RNA, 24 nt, Human
caccagcaggagguccugcccccu

SEQ ID NO: 16657 - RNA, 24 nt, Human
caccagggccucaucagcaaccug

SEQ ID NO: 16658 - RNA, 24 nt, Human
caccaguaggccuuugugaagugg

SEQ ID NO: 16659 - RNA, 24 nt, Human
caccauacuuaaaauccuguccaa

SEQ ID NO: 16660 - RNA, 22 nt, Human
caccauguuggccaggcugguc

SEQ ID NO: 16661 - RNA, 24 nt, Human
cacccacuccucagccuccagggc

SEQ ID NO: 16662 - RNA, 22 nt, Human
cacccagagucuaggcuggagu

SEQ ID NO: 16663 - RNA, 24 nt, Human
cacccagcccaagaggcccauguc

SEQ ID NO: 16664 - RNA, 22 nt, Human
cacccaggcuggagugcagugg

SEQ ID NO: 16665 - RNA, 24 nt, Human
cacccaugugaccaaggaacguug

SEQ ID NO: 16666 - RNA, 20 nt, Human
caccccacuccaccaguccc

SEQ ID NO: 16667 - RNA, 24 nt, Human
caccccgucuggagggcaggaggu

SEQ ID NO: 16668 - RNA, 24 nt, Human
caccccucaaaccuuggcuccuuu

SEQ ID NO: 16669 - RNA, 24 nt, Human
caccccugccccgccgacccagca

SEQ ID NO: 16670 - RNA, 24 nt, Human
cacccgacagcuucgugcacaugu

SEQ ID NO: 16671 - RNA, 24 nt, Human
cacccgagcuacgccgugccgcac

SEQ ID NO: 16672 - RNA, 24 nt, Human
cacccgcugcgaugcuggcgguca

SEQ ID NO: 16673 - RNA, 24 nt, Human
cacccuaagagccgcccccugugc

SEQ ID NO: 16674 - RNA, 24 nt, Human
cacccugaagugcagaggguugcu

SEQ ID NO: 16675 - RNA, 24 nt, Human
cacccuggagaaggugggcgaccg

SEQ ID NO: 16676 - RNA, 23 nt, Human
cacccuggggcaguagcagggcc

SEQ ID NO: 16677 - RNA, 24 nt, Human
cacccugucaaaacggaccaauca

SEQ ID NO: 16678 - RNA, 23 nt, Human
cacccuuagaggggagaacgaag

SEQ ID NO: 16679 - RNA, 24 nt, Human
caccgcaacgggcaaacaugagcc

SEQ ID NO: 16680 - RNA, 24 nt, Human
caccgcacccuccgccucccaggc

SEQ ID NO: 16681 - RNA, 24 nt, Human
caccgcgugucggcacguccagcc

SEQ ID NO: 16682 - RNA, 24 nt, Human
caccggcaaaguaccgacaucgac

SEQ ID NO: 16683 - RNA, 24 nt, Human
caccggccccgaagcugaguuguu

SEQ ID NO: 16684 - RNA, 23 nt, Human
caccguaaaagaggcuccagcua

SEQ ID NO: 16685 - RNA, 24 nt, Human
caccucacgcccagcucccauccu

SEQ ID NO: 16686 - RNA, 20 nt, Human
caccugagggauccaguggc

SEQ ID NO: 16687 - RNA, 24 nt, Human
caccugcagcuaugaugcccuucc

SEQ ID NO: 16688 - RNA, 20 nt, Human
caccugcuauuuggaugcag

SEQ ID NO: 16689 - RNA, 21 nt, Human
caccuggacaauaggaauucg

SEQ ID NO: 16690 - RNA, 24 nt, Human
caccuggugaugaaaucccaucau

SEQ ID NO: 16691 - RNA, 24 nt, Human
caccuuguggccccuagcaggccc

SEQ ID NO: 16692 - RNA, 24 nt, Human
cacgaugggcacaaugccauucug

SEQ ID NO: 16693 - RNA, 24 nt, Human
cacgcagaaaaaguauguagcgac

SEQ ID NO: 16694 - RNA, 24 nt, Human
cacuacaccauuggcaaggagauc

SEQ ID NO: 16695 - RNA, 24 nt, Human
cacucagcuuauuacagguaggua

SEQ ID NO: 16696 - RNA, 22 nt, Human
cacucauugggucuaagggaga

SEQ ID NO: 16697 - RNA, 24 nt, Human
cacucgguguacguccuggaggac

SEQ ID NO: 16698 - RNA, 24 nt, Human
cacucucuuccaagaaagaccuug

SEQ ID NO: 16699 - RNA, 24 nt, Human
cacugagucuccugucccugagaa

SEQ ID NO: 16700 - RNA, 22 nt, Human
cacugcaacccccgccucccag

SEQ ID NO: 16701 - RNA, 22 nt, Human
cacugcaaccuccaccuccugg

SEQ ID NO: 16702 - RNA, 22 nt, Human
cacugcaaccuccaccucucgg

SEQ ID NO: 16703 - RNA, 22 nt, Human
cacugcaaccuccgccucuggg

SEQ ID NO: 16704 - RNA, 22 nt, Human
cacugcaaccucugucuccugg

SEQ ID NO: 16705 - RNA, 22 nt, Human
cacugcaaccuucaccuuccgg

SEQ ID NO: 16706 - RNA, 22 nt, Human
cacugcaaugacugucagaaca

SEQ ID NO: 16707 - RNA, 22 nt, Human
cacugcacuccagccugggcaa

SEQ ID NO: 16708 - RNA, 22 nt, Human
cacugcacuccagccuggguga

SEQ ID NO: 16709 - RNA, 22 nt, Human
cacugcacucuggccugccuga

SEQ ID NO: 16710 - RNA, 24 nt, Human
cacugcgugacaaugacccaagcc

SEQ ID NO: 16711 - RNA, 24 nt, Human
cacugcguucucacacuagugugc

SEQ ID NO: 16712 - RNA, 24 nt, Human
cacugcucuccgggccucuccugc

SEQ ID NO: 16713 - RNA, 24 nt, Human
cacugcuuuaguaaaaauggaaua

SEQ ID NO: 16714 - RNA, 24 nt, Human
cacuggaucacaaguucguuuggu

SEQ ID NO: 16715 - RNA, 22 nt, Human
cacuggccacaagaaugagaaa

SEQ ID NO: 16716 - RNA, 24 nt, Human
cacugggagcagcuccaacauugg

SEQ ID NO: 16717 - RNA, 24 nt, Human
cacugggccaucugcacucugcuc

SEQ ID NO: 16718 - RNA, 22 nt, Human
cacugggcccagccuauuugca

SEQ ID NO: 16719 - RNA, 24 nt, Human
cacuggguauauaacugguugcca

SEQ ID NO: 16720 - RNA, 24 nt, Human
cacugggugggacgggguacugga

SEQ ID NO: 16721 - RNA, 21 nt, Human
cacuggucaagacaacuuugc

SEQ ID NO: 16722 - RNA, 24 nt, Human
cacuguacuccagccugggcaaca

SEQ ID NO: 16723 - RNA, 24 nt, Human
cacugugugggccucuauguggcc

SEQ ID NO: 16724 - RNA, 22 nt, Human
cacuuaggaaugugucuguugc

SEQ ID NO: 16725 - RNA, 24 nt, Human
cacuucuugcuuccugcuuugcag

SEQ ID NO: 16726 - RNA, 22 nt, Human
cacuuuugaugaccuagcccug

SEQ ID NO: 16727 - RNA, 22 nt, Human
cagaaagaacgaacagcugugg

SEQ ID NO: 16728 - RNA, 24 nt, Human
cagaacaaugcuaaaguagcugug

SEQ ID NO: 16729 - RNA, 22 nt, Human
cagaaccauguagagucuaccu

SEQ ID NO: 16730 - RNA, 24 nt, Human
cagaaggguuaauuuucgcugcag

SEQ ID NO: 16731 - RNA, 22 nt, Human
cagaauggaugagaagcaccgu

SEQ ID NO: 16732 - RNA, 24 nt, Human
cagaccuuaccuuuccagcucaaa

SEQ ID NO: 16733 - RNA, 22 nt, Human
cagaccuuuuauugggucccca

SEQ ID NO: 16734 - RNA, 22 nt, Human
cagagcagcuccugcauguuau

SEQ ID NO: 16735 - RNA, 22 nt, Human
cagagcugccuuucccuuccug

SEQ ID NO: 16736 - RNA, 22 nt, Human
cagaggacaugaaaacucgcuc

SEQ ID NO: 16737 - RNA, 22 nt, Human
cagaggagagagacucuaucuc

SEQ ID NO: 16738 - RNA, 24 nt, Human
cagaggguugccuauggugggcac

SEQ ID NO: 16739 - RNA, 22 nt, Human
cagaguacugugauagacucag

SEQ ID NO: 16740 - RNA, 22 nt, Human
cagaucacauccauccgucacc

SEQ ID NO: 16741 - RNA, 22 nt, Human
cagaucagaacuccuugggaaa

SEQ ID NO: 16742 - RNA, 22 nt, Human
cagaucugggauacagcugugg

SEQ ID NO: 16743 - RNA, 24 nt, Human
cagcaaauccagcugcugcugcgg

SEQ ID NO: 16744 - RNA, 24 nt, Human
cagcacaaucccccgcucagcugg

SEQ ID NO: 16745 - RNA, 23 nt, Human
cagcacacaaccagaaccuagag

SEQ ID NO: 16746 - RNA, 24 nt, Human
cagcacacagagugugggaggaga

SEQ ID NO: 16747 - RNA, 24 nt, Human
cagcacccugccuugucuccagga

SEQ ID NO: 16748 - RNA, 23 nt, Human
cagcagacguggcaauaugugug

SEQ ID NO: 16749 - RNA, 24 nt, Human
cagcagacuccacuccacuuggcu

SEQ ID NO: 16750 - RNA, 22 nt, Human
cagcagagcccauguguucaug

SEQ ID NO: 16751 - RNA, 24 nt, Human
cagcagagucagggauggguccau

SEQ ID NO: 16752 - RNA, 24 nt, Human
cagcagaucccagugaaggguuuu

SEQ ID NO: 16753 - RNA, 24 nt, Human
cagcagcacaggccaggcugggca

SEQ ID NO: 16754 - RNA, 24 nt, Human
cagcagcacgcagugagagccucg

SEQ ID NO: 16755 - RNA, 24 nt, Human
cagcagcagguuugugcugguccc

SEQ ID NO: 16756 - RNA, 24 nt, Human
cagcagcccagcagggauguccuc

SEQ ID NO: 16757 - RNA, 21 nt, Human
cagcagccugcuccccgcacu

SEQ ID NO: 16758 - RNA, 24 nt, Human
cagcagcgucuacuuccgcagcgu

SEQ ID NO: 16759 - RNA, 24 nt, Human
cagcagcuggacgcugagcugagg

SEQ ID NO: 16760 - RNA, 24 nt, Human
cagcaggcugaugaauaagaucua

SEQ ID NO: 16761 - RNA, 24 nt, Human
cagcaggucuugaguuuggcaacu

SEQ ID NO: 16762 - RNA, 24 nt, Human
cagcaggugauuucuuaaugcuuu

SEQ ID NO: 16763 - RNA, 24 nt, Human
cagcaguaagcaacaauggcugau

SEQ ID NO: 16764 - RNA, 24 nt, Human
cagcaguguacugggaucauuagg

SEQ ID NO: 16765 - RNA, 22 nt, Human
cagcaguguugcgaaucaucac

SEQ ID NO: 16766 - RNA, 24 nt, Human
aaaaagcuaucuuaagcuggaaca

SEQ ID NO: 16767 - RNA, 24 nt, Human
aaaacacacauaauacaaguuuuc

SEQ ID NO: 16768 - RNA, 22 nt, Human
aaaacaccagagaagugcagaa

SEQ ID NO: 16769 - RNA, 24 nt, Human
aaaacuuuuagcgccagucuugag

SEQ ID NO: 16770 - RNA, 22 nt, Human
aaaagaggagaaaaaagcugua

SEQ ID NO: 16771 - RNA, 22 nt, Human
aaaagauuuagccaggcacagu

SEQ ID NO: 16772 - RNA, 22 nt, Human
aaaagcuugcugagugguacag

SEQ ID NO: 16773 - RNA, 24 nt, Human
aaaaggacacaggaaccagccagc

SEQ ID NO: 16774 - RNA, 24 nt, Human
aaaagugcaugauggugagagccc

SEQ ID NO: 16775 - RNA, 22 nt, Human
aaaaugccuacaggcaguagcc

SEQ ID NO: 16776 - RNA, 22 nt, Human
aaaaugcuuacaggcaguagcc

SEQ ID NO: 16777 - RNA, 22 nt, Human
aaacaaccuugguguguucuca

SEQ ID NO: 16778 - RNA, 24 nt, Human
aaaccagaacauuuuccccacuau

SEQ ID NO: 16779 - RNA, 24 nt, Human
aaaccagcaggaaaaccucugcuc

SEQ ID NO: 16780 - RNA, 24 nt, Human
aaaccagguauccaaaggcgaaag

SEQ ID NO: 16781 - RNA, 22 nt, Human
aaacccuagcaccugagagcca

SEQ ID NO: 16782 - RNA, 22 nt, Human
aaacgaaaacacuccuauauuu

SEQ ID NO: 16783 - RNA, 22 nt, Human
aaacuagcgaggucugcuguac

SEQ ID NO: 16784 - RNA, 23 nt, Human
aaagaacuaaagggcaagcaggg

SEQ ID NO: 16785 - RNA, 22 nt, Human
aaagaauguucuuuuucaaaaa

SEQ ID NO: 16786 - RNA, 22 nt, Human
aaagacaguucagugacaaguu

SEQ ID NO: 16787 - RNA, 24 nt, Human
aaagaccaagggaaugcaaguccc

SEQ ID NO: 16788 - RNA, 24 nt, Human
aaagauccuggguaguucggauga

SEQ ID NO: 16789 - RNA, 24 nt, Human
aaagaugguaaacauacaguaguc

SEQ ID NO: 16790 - RNA, 24 nt, Human
aaagcaaaacuuucgcuauucuau

SEQ ID NO: 16791 - RNA, 22 nt, Human
aaagcaggagggacuagagaaa

SEQ ID NO: 16792 - RNA, 22 nt, Human
aaagcugagccugagagacaga

SEQ ID NO: 16793 - RNA, 22 nt, Human
aaagcuuuguucauuguaucug

SEQ ID NO: 16794 - RNA, 24 nt, Human
aaaggaacuugcuccauuguuuga

SEQ ID NO: 16795 - RNA, 23 nt, Human
aaaggacaauuuuuaagcugcug

SEQ ID NO: 16796 - RNA, 22 nt, Human
aaaggaguuugugacauugaca

SEQ ID NO: 16797 - RNA, 24 nt, Human
aaaggcacuuugaaccuccuguaa

SEQ ID NO: 16798 - RNA, 22 nt, Human
aaaggcagacggugaaugccuu

SEQ ID NO: 16799 - RNA, 24 nt, Human
aaaggcccggccaccuaaaggcac

SEQ ID NO: 16800 - RNA, 24 nt, Human
aaagggaaugauagcauugaagga

SEQ ID NO: 16801 - RNA, 22 nt, Human
aaagguauagagaugggaaggg

SEQ ID NO: 16802 - RNA, 24 nt, Human
aaagguccugguucacccuggaga

SEQ ID NO: 16803 - RNA, 24 nt, Human
aaagguucuagggcagggaaaaug

SEQ ID NO: 16804 - RNA, 24 nt, Human
aaagucacuuucacgaggugguca

SEQ ID NO: 16805 - RNA, 22 nt, Human
aaagucauauauacgcaaggua

SEQ ID NO: 16806 - RNA, 24 nt, Human
aaagugaagacauuuucugucagg

SEQ ID NO: 16807 - RNA, 24 nt, Human
aaagugacccagaggaggugaacu

SEQ ID NO: 16808 - RNA, 24 nt, Human
aaagugccacuuugaaugguuguu

SEQ ID NO: 16809 - RNA, 22 nt, Human
aaagugcucauagugcagguag

SEQ ID NO: 16810 - RNA, 24 nt, Human
aaagugcuggcguuacagguauga

SEQ ID NO: 16811 - RNA, 24 nt, Human
aaagugcugggauuacaggcauga

SEQ ID NO: 16812 - RNA, 22 nt, Human
aaauaggucaaucagacuauga

SEQ ID NO: 16813 - RNA, 22 nt, Human
aaauccuggggaucuggaggga

SEQ ID NO: 16814 - RNA, 22 nt, Human
aaaucggaucuuggggagaguc

SEQ ID NO: 16815 - RNA, 22 nt, Human
aaaugguaugcagguaugacuu

SEQ ID NO: 16816 - RNA, 20 nt, Human
aaauucuugugugucuccua

SEQ ID NO: 16817 - RNA, 22 nt, Human
aaauugccgagaugauguuugg

SEQ ID NO: 16818 - RNA, 24 nt, Human
aacaaauuucacauaugguaaacc

SEQ ID NO: 16819 - RNA, 24 nt, Human
aacaagaggaguauguauucccgu

SEQ ID NO: 16820 - RNA, 21 nt, Human
aacaauccuagugaagccugu

SEQ ID NO: 16821 - RNA, 24 nt, Human
aacacagagaaacuuucagccaga

SEQ ID NO: 16822 - RNA, 24 nt, Human
aacacauacagaacugaauuaaga

SEQ ID NO: 16823 - RNA, 24 nt, Human
aacacauuacugauagaggaaguc

SEQ ID NO: 16824 - RNA, 22 nt, Human
aacaccacagacagcugcagga

SEQ ID NO: 16825 - RNA, 24 nt, Human
aacaccauaggaguugccaucaga

SEQ ID NO: 16826 - RNA, 24 nt, Human
aacacucugguacagaucuccaga

SEQ ID NO: 16827 - RNA, 24 nt, Human
aacacugcccagcuuugaggagau

SEQ ID NO: 16828 - RNA, 24 nt, Human
aacacuuuaaaaccguggggugga

SEQ ID NO: 16829 - RNA, 24 nt, Human
aacacuuuguuguagcugcccucc

SEQ ID NO: 16830 - RNA, 24 nt, Human
aacaggauaaaagccugguuacca

SEQ ID NO: 16831 - RNA, 24 nt, Human
aacagguuugaacuucuuaacuuc

SEQ ID NO: 16832 - RNA, 24 nt, Human
aacaguguaggucuuggugaagcc

SEQ ID NO: 16833 - RNA, 22 nt, Human
aacauaguacacugcagccucc

SEQ ID NO: 16834 - RNA, 24 nt, Human
aacauuccagaggucgcccagcuc

SEQ ID NO: 16835 - RNA, 24 nt, Human
aacauuuugcccugaacugaagag

SEQ ID NO: 16836 - RNA, 22 nt, Human
aaccaaugcagacuggcauuaa

SEQ ID NO: 16837 - RNA, 22 nt, Human
aaccacauaaauuuaccccacc

SEQ ID NO: 16838 - RNA, 22 nt, Human
aaccaggacccaaggugcccuu

SEQ ID NO: 16839 - RNA, 24 nt, Human
aaccagucccaaccccauaagugu

SEQ ID NO: 16840 - RNA, 24 nt, Human
aaccaguuucacuuguaccaagac

SEQ ID NO: 16841 - RNA, 24 nt, Human
aaccauggacauggaucuucuuua

SEQ ID NO: 16842 - RNA, 22 nt, Human
aaccauguuuuagcauaauggg

SEQ ID NO: 16843 - RNA, 21 nt, Human
aacccccugcucaccgccagc

SEQ ID NO: 16844 - RNA, 24 nt, Human
aacccggcauucccaguuuaauug

SEQ ID NO: 16845 - RNA, 24 nt, Human
aacccgggagguggaacuugcagu

SEQ ID NO: 16846 - RNA, 24 nt, Human
aacccguauuuucuggcuaccagu

SEQ ID NO: 16847 - RNA, 22 nt, Human
aacccuguguuaacaaugagaa

SEQ ID NO: 16848 - RNA, 24 nt, Human
aaccucuucuguggagucugcgug

SEQ ID NO: 16849 - RNA, 24 nt, Human
aaccugggcauuggccuagcuauc

SEQ ID NO: 16850 - RNA, 22 nt, Human
aaccuggugucagcagccuuuc

SEQ ID NO: 16851 - RNA, 23 nt, Human
aaccuguugacagaucuucagag

SEQ ID NO: 16852 - RNA, 24 nt, Human
aaccuuccuaaaccuggccuuggc

SEQ ID NO: 16853 - RNA, 22 nt, Human
aacgaugggcuggauuguuuug

SEQ ID NO: 16854 - RNA, 24 nt, Human
aacgccguugccaccgaggaggcg

SEQ ID NO: 16855 - RNA, 24 nt, Human
aacggcugagggugggggcagugu

SEQ ID NO: 16856 - RNA, 24 nt, Human
aacguccuuuguaaagacugccuu

SEQ ID NO: 16857 - RNA, 24 nt, Human
aacuaaauagugaauauacauaca

SEQ ID NO: 16858 - RNA, 24 nt, Human
aacuauccgggaagagacuuguga

SEQ ID NO: 16859 - RNA, 22 nt, Human
aacuccuggacuauauugugaa

SEQ ID NO: 16860 - RNA, 22 nt, Human
aacugccccacuaagucccugc

SEQ ID NO: 16861 - RNA, 23 nt, Human
aacugcguggcuaucacacugac

SEQ ID NO: 16862 - RNA, 22 nt, Human
aacuuguggcuguuuuugccac

SEQ ID NO: 16863 - RNA, 22 nt, Human
aacuuucacuucccacugugag

SEQ ID NO: 16864 - RNA, 22 nt, Human
aacuuucuggcuuuggggagag

SEQ ID NO: 16865 - RNA, 24 nt, Human
aagaaaccuuuagaaggacuuaga

SEQ ID NO: 16866 - RNA, 24 nt, Human
aagaaacucacagauaaguccauu

SEQ ID NO: 16867 - RNA, 22 nt, Human
aagaaagcaaguaaacgcauga

SEQ ID NO: 16868 - RNA, 24 nt, Human
aagaaauuucacagcaguuuauua

SEQ ID NO: 16869 - RNA, 24 nt, Human
aagaaccccgcacucugugagagg

SEQ ID NO: 16870 - RNA, 24 nt, Human
aagaagaucuagaacgacuucucu

SEQ ID NO: 16871 - RNA, 24 nt, Human
aagaagaugauacgucaugcuucc

SEQ ID NO: 16872 - RNA, 24 nt, Human
aagaagcaaauaacaucuaguacc

SEQ ID NO: 16873 - RNA, 24 nt, Human
aagaagcccgaucgaguccccuga

SEQ ID NO: 16874 - RNA, 24 nt, Human
aagaaguucuugaguggcguguaa

SEQ ID NO: 16875 - RNA, 24 nt, Human
aagaaguugacagccaggugaaug

SEQ ID NO: 16876 - RNA, 24 nt, Human
aagaaguugaucuugugugaugac

SEQ ID NO: 16877 - RNA, 24 nt, Human
aagaauguuagaaguucaagccag

SEQ ID NO: 16878 - RNA, 24 nt, Human
aagacccccaauaguggagagggc

SEQ ID NO: 16879 - RNA, 24 nt, Human
aagacuccgagggcaggaaugugg

SEQ ID NO: 16880 - RNA, 22 nt, Human
aagagagcugucaguuacagag

SEQ ID NO: 16881 - RNA, 22 nt, Human
aagagcguauucuuggagcuga

SEQ ID NO: 16882 - RNA, 22 nt, Human
aagagcuaaaacugaugacagu

SEQ ID NO: 16883 - RNA, 22 nt, Human
aagagcuggagaccaaggccgu

SEQ ID NO: 16884 - RNA, 24 nt, Human
aagagcuucugcuaggugcagggc

SEQ ID NO: 16885 - RNA, 24 nt, Human
aagaggaagcuagguugaaaucac

SEQ ID NO: 16886 - RNA, 24 nt, Human
aagaguucuccugaugauugaaug

SEQ ID NO: 16887 - RNA, 22 nt, Human
aagauggaaaagggagauaugg

SEQ ID NO: 16888 - RNA, 24 nt, Human
aagcaaacauuucgacuaaagggg

SEQ ID NO: 16889 - RNA, 24 nt, Human
aagcaacuagaacaugauucagaa

SEQ ID NO: 16890 - RNA, 24 nt, Human
aagcaacuccucaguacguuuugg

SEQ ID NO: 16891 - RNA, 22 nt, Human
aagcaaguuacaauucaaaaag

SEQ ID NO: 16892 - RNA, 22 nt, Human
aagcacaaaagacuuguugaga

SEQ ID NO: 16893 - RNA, 22 nt, Human
aagcaccuagucuccuuguucu

SEQ ID NO: 16894 - RNA, 24 nt, Human
aagcagaggcuucucuccccaaga

SEQ ID NO: 16895 - RNA, 24 nt, Human
aagcagauacuugagccauugugc

SEQ ID NO: 16896 - RNA, 24 nt, Human
aagcagcauggaaaagauggguug

SEQ ID NO: 16897 - RNA, 24 nt, Human
aagcagccuaagcuuucauucuca

SEQ ID NO: 16898 - RNA, 24 nt, Human
aagcagccucuugucacagguuga

SEQ ID NO: 16899 - RNA, 24 nt, Human
aagcagcucuuucgacguguagca

SEQ ID NO: 16900 - RNA, 24 nt, Human
aagcaguccucccacuuggccucc

SEQ ID NO: 16901 - RNA, 24 nt, Human
aagcaugcagugguaugaaugauc

SEQ ID NO: 16902 - RNA, 22 nt, Human
aagcaugugcugguggucauug

SEQ ID NO: 16903 - RNA, 22 nt, Human
aagcccaggagaaugcugcaau

SEQ ID NO: 16904 - RNA, 22 nt, Human
aagccucauaauuggccuuugu

SEQ ID NO: 16905 - RNA, 22 nt, Human
aagccuccgugcugcuggaucu

SEQ ID NO: 16906 - RNA, 24 nt, Human
aagcgaccccaaaguggauagucu

SEQ ID NO: 16907 - RNA, 24 nt, Human
aagcgccugcgcaaggccaagaag

SEQ ID NO: 16908 - RNA, 24 nt, Human
aagcggccgggggucaucuaacag

SEQ ID NO: 16909 - RNA, 24 nt, Human
aagcuccaguggggaccuuguuaa

SEQ ID NO: 16910 - RNA, 22 nt, Human
aagcugaggcagggcuugcaug

SEQ ID NO: 16911 - RNA, 24 nt, Human
aagcugcaacaaggugauaaaggu

SEQ ID NO: 16912 - RNA, 24 nt, Human
aagcugcagaccuucgccaagagg

SEQ ID NO: 16913 - RNA, 24 nt, Human
aagcugcauguggauccugagaac

SEQ ID NO: 16914 - RNA, 22 nt, Human
aagcugccccaccagcucugcc

SEQ ID NO: 16915 - RNA, 24 nt, Human
aagcugccccccauuucuguaacc

SEQ ID NO: 16916 - RNA, 24 nt, Human
aagcuggccugaaaggcaccuggg

SEQ ID NO: 16917 - RNA, 22 nt, Human
aagcuggccuguaccugcugag

SEQ ID NO: 16918 - RNA, 24 nt, Human
aagcugguacgccugcagguaccg

SEQ ID NO: 16919 - RNA, 22 nt, Human
aagcuggucacaacauuuuucu

SEQ ID NO: 16920 - RNA, 22 nt, Human
aagcuggugaucguuggggaug

SEQ ID NO: 16921 - RNA, 19 nt, Human
aagcuguuacacccauuuc

SEQ ID NO: 16922 - RNA, 24 nt, Human
aagcuguucccaucaaggauggca

SEQ ID NO: 16923 - RNA, 24 nt, Human
aagcuucauagggauggacaucau

SEQ ID NO: 16924 - RNA, 24 nt, Human
aagcuucgcuggcuugccggcccc

SEQ ID NO: 16925 - RNA, 22 nt, Human
aagcuuuucaaagcauggaugg

SEQ ID NO: 16926 - RNA, 22 nt, Human
aaggaaauguggaggaggcaga

SEQ ID NO: 16927 - RNA, 24 nt, Human
aaggacacaaaaggaagcugugug

SEQ ID NO: 16928 - RNA, 22 nt, Human
aaggacccuacccagucauuuu

SEQ ID NO: 16929 - RNA, 24 nt, Human
aaggagcagcucgaggccaggagg

SEQ ID NO: 16930 - RNA, 24 nt, Human
aaggagcgccuguaccuccuggcg

SEQ ID NO: 16931 - RNA, 24 nt, Human
aaggagcugucggugcugucgcuc

SEQ ID NO: 16932 - RNA, 24 nt, Human
aaggaggacaucucugcuugccug

SEQ ID NO: 16933 - RNA, 24 nt, Human
aaggaggcuuggcggugguugggc

SEQ ID NO: 16934 - RNA, 24 nt, Human
aaggaugcugcuagacuaaggaau

SEQ ID NO: 16935 - RNA, 20 nt, Human
aaggauggauggauggaugg

SEQ ID NO: 16936 - RNA, 24 nt, Human
aaggauuuggguuggggcacccag

SEQ ID NO: 16937 - RNA, 22 nt, Human
aaggcaguggcagaagauguca

SEQ ID NO: 16938 - RNA, 24 nt, Human
aaggcauuuucggcuucacugaca

SEQ ID NO: 16939 - RNA, 22 nt, Human
aaggcccugccucuuaauacug

SEQ ID NO: 16940 - RNA, 22 nt, Human
aaggccuggaaaucugccuuua

SEQ ID NO: 16941 - RNA, 24 nt, Human
aaggcgagcgagggcgagaguggg

SEQ ID NO: 16942 - RNA, 24 nt, Human
aaggcugggcugcugauauguaua

SEQ ID NO: 16943 - RNA, 24 nt, Human
aaggcuuugcacagcuauuguuca

SEQ ID NO: 16944 - RNA, 24 nt, Human
aagggacccagcugggucugggcc

SEQ ID NO: 16945 - RNA, 22 nt, Human
aagggcaaguucugagaaagag

SEQ ID NO: 16946 - RNA, 22 nt, Human
aagggccucaggugacuuucau

SEQ ID NO: 16947 - RNA, 24 nt, Human
aaggggcccuuccccauuugcaaa

SEQ ID NO: 16948 - RNA, 22 nt, Human
aaggggcguggcaccagcacca

SEQ ID NO: 16949 - RNA, 24 nt, Human
aaggguccuagguagggggagguu

SEQ ID NO: 16950 - RNA, 24 nt, Human
aagggugccucuaaaagcuugaca

SEQ ID NO: 16951 - RNA, 22 nt, Human
aagguagauaaaggcuucacgu

SEQ ID NO: 16952 - RNA, 24 nt, Human
aagguaguuucguggaugccacag

SEQ ID NO: 16953 - RNA, 18 nt, Human
aaggucccaggagaccag

SEQ ID NO: 16954 - RNA, 24 nt, Human
aaggugcgugaggaguaugccgac

SEQ ID NO: 16955 - RNA, 24 nt, Human
aaggugcuggagaacaucgaacug

SEQ ID NO: 16956 - RNA, 24 nt, Human
aaggugcuggaggugccaagugaa

SEQ ID NO: 16957 - RNA, 24 nt, Human
aaggugcuucauggagaggugauu

SEQ ID NO: 16958 - RNA, 22 nt, Human
aagguggugucauguuuugggg

SEQ ID NO: 16959 - RNA, 24 nt, Human
aagguuacuucucaaauuagggaa

SEQ ID NO: 16960 - RNA, 24 nt, Human
aagguucuggccuccugucuuagc

SEQ ID NO: 16961 - RNA, 24 nt, Human
aagguugucagguaguaaggugga

SEQ ID NO: 16962 - RNA, 24 nt, Human
aagguugucucaacuacagcuauc

SEQ ID NO: 16963 - RNA, 24 nt, Human
aaguaccacccuuugggggugguc

SEQ ID NO: 16964 - RNA, 24 nt, Human
aaguauacuugaggagggugacgg

SEQ ID NO: 16965 - RNA, 22 nt, Human
aaguauggugcacuggucaaua

SEQ ID NO: 16966 - RNA, 24 nt, Human
aaguaugugccgccgagcccugcg

SEQ ID NO: 16967 - RNA, 22 nt, Human
aaguccagcuaauuuuuguauu

SEQ ID NO: 16968 - RNA, 22 nt, Human
aagucuguauuuguuguuguga

SEQ ID NO: 16969 - RNA, 24 nt, Human
aagugcagccucaagauggcugau

SEQ ID NO: 16970 - RNA, 24 nt, Human
aagugccuccgugaggagauucac

SEQ ID NO: 16971 - RNA, 24 nt, Human
aagugcuccccaucaucugaagaa

SEQ ID NO: 16972 - RNA, 22 nt, Human
aagugcuggaauuacaggcaug

SEQ ID NO: 16973 - RNA, 24 nt, Human
aaguggauacaagucuggcauugg

SEQ ID NO: 16974 - RNA, 24 nt, Human
aaguggcaacgcgaauuuggguau

SEQ ID NO: 16975 - RNA, 22 nt, Human
aaguggguccagggcacucagg

SEQ ID NO: 16976 - RNA, 24 nt, Human
aaguguccucggccggcgcagccc

SEQ ID NO: 16977 - RNA, 24 nt, Human
aagugugucuaucaguaguggucc

SEQ ID NO: 16978 - RNA, 22 nt, Human
aaguuaagagcucccaggccug

SEQ ID NO: 16979 - RNA, 24 nt, Human
aaguuuaguuuuauuauggacacu

SEQ ID NO: 16980 - RNA, 22 nt, Human
aauagcuugguuaaaugaaggg

SEQ ID NO: 16981 - RNA, 22 nt, Human
aaucaauguucccaggggaaaa

SEQ ID NO: 16982 - RNA, 24 nt, Human
aaucacuugagcccaggaguuuga

SEQ ID NO: 16983 - RNA, 22 nt, Human
aaucuccauuuguaaaugugac

SEQ ID NO: 16984 - RNA, 22 nt, Human
aaucuucacuaaaauggacaag

SEQ ID NO: 16985 - RNA, 22 nt, Human
aaugaagccacagagauuugcu

SEQ ID NO: 16986 - RNA, 22 nt, Human
aaugacacaaaagcugcuauuu

SEQ ID NO: 16987 - RNA, 22 nt, Human
aaugauccaccugccucggccu

SEQ ID NO: 16988 - RNA, 24 nt, Human
aauggcacugggggcaaguccauc

SEQ ID NO: 16989 - RNA, 24 nt, Human
aaugggacugcugaagaguggaca

SEQ ID NO: 16990 - RNA, 24 nt, Human
aaugguauguacugguggcagaua

SEQ ID NO: 16991 - RNA, 24 nt, Human
aaugugcugguaacugcuuugcuu

SEQ ID NO: 16992 - RNA, 22 nt, Human
aauuaacuggguucucagaugc

SEQ ID NO: 16993 - RNA, 22 nt, Human
aauuaagaaaaucgagcacccu

SEQ ID NO: 16994 - RNA, 24 nt, Human
aauuacacugaggcggugagacga

SEQ ID NO: 16995 - RNA, 24 nt, Human
aauucaaauaggagcuaggagaca

SEQ ID NO: 16996 - RNA, 22 nt, Human
aauucacagagggaggaaaguu

SEQ ID NO: 16997 - RNA, 24 nt, Human
aauugugucaugauuaauguguau

SEQ ID NO: 16998 - RNA, 24 nt, Human
cagcauauuguacuggccugcugc

SEQ ID NO: 16999 - RNA, 24 nt, Human
cagcaucguggccgagcuggaccg

SEQ ID NO: 17000 - RNA, 24 nt, Human
cagcaugcuggggagugcggucag

SEQ ID NO: 17001 - RNA, 24 nt, Human
cagcauugugcagauacacacccc

SEQ ID NO: 17002 - RNA, 24 nt, Human
cagccaauuaagccgacugaguuc

SEQ ID NO: 17003 - RNA, 24 nt, Human
cagccaccucccaggaagaucugg

SEQ ID NO: 17004 - RNA, 24 nt, Human
cagcccaucuggguaccuguuggu

SEQ ID NO: 17005 - RNA, 21 nt, Human
cagccccccugcacgcagccc

SEQ ID NO: 17006 - RNA, 24 nt, Human
cagccguggcucucuagucuucgu

SEQ ID NO: 17007 - RNA, 24 nt, Human
cagccugacaucugucccuucaac

SEQ ID NO: 17008 - RNA, 24 nt, Human
cagccugcaucgaagaaguacugc

SEQ ID NO: 17009 - RNA, 24 nt, Human
cagccugcccgacaucgucuucac

SEQ ID NO: 17010 - RNA, 24 nt, Human
cagcgcauggagggguagugcugg

SEQ ID NO: 17011 - RNA, 24 nt, Human
cagcgccccgcgcggcccugcaag

SEQ ID NO: 17012 - RNA, 24 nt, Human
cagcgcggaacccccuaggcgacc

SEQ ID NO: 17013 - RNA, 24 nt, Human
cagcgcuggugucgggccaagcag

SEQ ID NO: 17014 - RNA, 24 nt, Human
cagcguggggaccacucuucccgg

SEQ ID NO: 17015 - RNA, 24 nt, Human
cagcgugggggcccugcaggccau

SEQ ID NO: 17016 - RNA, 24 nt, Human
cagcucaaauggaauauugucgca

SEQ ID NO: 17017 - RNA, 24 nt, Human
cagcucgggagguccaguaggcug

SEQ ID NO: 17018 - RNA, 24 nt, Human
cagcugaugaacucugggauaggc

SEQ ID NO: 17019 - RNA, 24 nt, Human
cagcugcagcugagacugcggcgg

SEQ ID NO: 17020 - RNA, 24 nt, Human
cagcugccgcaaagucucguccac

SEQ ID NO: 17021 - RNA, 24 nt, Human
cagcugccuggguuguggccgccc

SEQ ID NO: 17022 - RNA, 24 nt, Human
cagcuggugguucuccagggccag

SEQ ID NO: 17023 - RNA, 22 nt, Human
cagcuguacuugacagucaacc

SEQ ID NO: 17024 - RNA, 24 nt, Human
caggacacaauguggcugaccugg

SEQ ID NO: 17025 - RNA, 24 nt, Human
caggagccacggaaccgcaguagg

SEQ ID NO: 17026 - RNA, 24 nt, Human
caggagccagcuguagguguccuu

SEQ ID NO: 17027 - RNA, 24 nt, Human
caggagccaggcuuuagggacggg

SEQ ID NO: 17028 - RNA, 24 nt, Human
caggagcccggggcgcccgcggcg

SEQ ID NO: 17029 - RNA, 22 nt, Human
caggagcugccuaugaaagagg

SEQ ID NO: 17030 - RNA, 24 nt, Human
caggaggcugcuuagcaguuuuga

SEQ ID NO: 17031 - RNA, 22 nt, Human
caggccccgaaugcuuaugaug

SEQ ID NO: 17032 - RNA, 24 nt, Human
caggcccugugggagcccacggug

SEQ ID NO: 17033 - RNA, 24 nt, Human
caggccuaucgcuggaugauugac

SEQ ID NO: 17034 - RNA, 22 nt, Human
caggccugcuggguuaacugcu

SEQ ID NO: 17035 - RNA, 22 nt, Human
caggccuuguccacaagcgaau

SEQ ID NO: 17036 - RNA, 24 nt, Human
cagggccaaagccaccuccagcgc

SEQ ID NO: 17037 - RNA, 24 nt, Human
cagggcccugugguuggacuucac

SEQ ID NO: 17038 - RNA, 22 nt, Human
caggggcaaaggcgauuaucac

SEQ ID NO: 17039 - RNA, 24 nt, Human
caggggcuccuguccugggccagg

SEQ ID NO: 17040 - RNA, 22 nt, Human
cagguacgucugaagucccacc

SEQ ID NO: 17041 - RNA, 22 nt, Human
caggugcaaguguuaaagggua

SEQ ID NO: 17042 - RNA, 24 nt, Human
caggugccucugccauagcuucug

SEQ ID NO: 17043 - RNA, 24 nt, Human
caggugguugcuuugaacuuuauu

SEQ ID NO: 17044 - RNA, 24 nt, Human
cagguguccucauguugcugaaau

SEQ ID NO: 17045 - RNA, 24 nt, Human
cagguuauuuucauuguguuauug

SEQ ID NO: 17046 - RNA, 22 nt, Human
cagguuggucuugaacucuugg

SEQ ID NO: 17047 - RNA, 24 nt, Human
caguacguugcucagcuccucccg

SEQ ID NO: 17048 - RNA, 24 nt, Human
caguacuuauuagcugcaggagcu

SEQ ID NO: 17049 - RNA, 24 nt, Human
caguagcccggccgcgugaccagg

SEQ ID NO: 17050 - RNA, 24 nt, Human
caguaggauuuaauauaugcaggg

SEQ ID NO: 17051 - RNA, 24 nt, Human
caguauccugccgagucuguucug

SEQ ID NO: 17052 - RNA, 24 nt, Human
cagucccuggaggcggugccggcu

SEQ ID NO: 17053 - RNA, 24 nt, Human
caguccgcgcaaacaugcaggugc

SEQ ID NO: 17054 - RNA, 22 nt, Human
cagugcacaccuggaaacucug

SEQ ID NO: 17055 - RNA, 22 nt, Human
cagugcuccuggaaacuuagcu

SEQ ID NO: 17056 - RNA, 22 nt, Human
cagugggaaaaguuugucucau

SEQ ID NO: 17057 - RNA, 24 nt, Human
caguuuccuaaaaugugccuccuc

SEQ ID NO: 17058 - RNA, 24 nt, Human
cauaaacauuuuucucauguuuug

SEQ ID NO: 17059 - RNA, 24 nt, Human
cauaaagagcaaagcaguuguggu

SEQ ID NO: 17060 - RNA, 22 nt, Human
cauaaaguaaaagcuaauacua

SEQ ID NO: 17061 - RNA, 21 nt, Human
cauagcaauggcaacuaucca

SEQ ID NO: 17062 - RNA, 24 nt, Human
caucacaguggagccccuggcccg

SEQ ID NO: 17063 - RNA, 24 nt, Human
caucacugagaagguguuuucgag

SEQ ID NO: 17064 - RNA, 22 nt, Human
caucacuguuugauuucuugac

SEQ ID NO: 17065 - RNA, 24 nt, Human
caucagaggcccccuuagggccca

SEQ ID NO: 17066 - RNA, 24 nt, Human
caucaggcgcccuuugaggccagg

SEQ ID NO: 17067 - RNA, 24 nt, Human
cauccagacugcuguacggaccaa

SEQ ID NO: 17068 - RNA, 24 nt, Human
cauccagccgccgcuugacauggg

SEQ ID NO: 17069 - RNA, 24 nt, Human
cauccagcuugggaacccgggaca

SEQ ID NO: 17070 - RNA, 24 nt, Human
cauccaucuucccuggaagucucc

SEQ ID NO: 17071 - RNA, 24 nt, Human
caucccaaugccagaccuuccucc

SEQ ID NO: 17072 - RNA, 24 nt, Human
cauccggguuuaaagcgauucucc

SEQ ID NO: 17073 - RNA, 24 nt, Human
cauccgguugauagcucggcgccu

SEQ ID NO: 17074 - RNA, 24 nt, Human
cauccuucaucuggacaagggaaa

SEQ ID NO: 17075 - RNA, 23 nt, Human
caucgcccuggauggucuucuug

SEQ ID NO: 17076 - RNA, 24 nt, Human
caucgcucgucucuuccuacucuc

SEQ ID NO: 17077 - RNA, 24 nt, Human
caucggauuuugcagcuucugggc

SEQ ID NO: 17078 - RNA, 24 nt, Human
caucgugugaacuauagaguuugu

SEQ ID NO: 17079 - RNA, 18 nt, Human
caucucaugguacggcug

SEQ ID NO: 17080 - RNA, 21 nt, Human
caucuggauggagaagaggca

SEQ ID NO: 17081 - RNA, 24 nt, Human
caucuggcuauuuugucccagcgg

SEQ ID NO: 17082 - RNA, 24 nt, Human
caucugggccucucuggucaaaac

SEQ ID NO: 17083 - RNA, 22 nt, Human
caugaaacugggaggcgaccgu

SEQ ID NO: 17084 - RNA, 24 nt, Human
caugcacacagcucucuguaccuu

SEQ ID NO: 17085 - RNA, 24 nt, Human
caugcacggaggacacgcccauug

SEQ ID NO: 17086 - RNA, 24 nt, Human
caugcagguuguagcagguaucag

SEQ ID NO: 17087 - RNA, 24 nt, Human
caugcgccugguggaggccugugg

SEQ ID NO: 17088 - RNA, 24 nt, Human
caugcuguuccuguggcauaagca

SEQ ID NO: 17089 - RNA, 24 nt, Human
cauggagcagugccggguggccca

SEQ ID NO: 17090 - RNA, 23 nt, Human
cauggcacaguacgguggcagac

SEQ ID NO: 17091 - RNA, 24 nt, Human
cauggcagccuuuuccuuagaaca

SEQ ID NO: 17092 - RNA, 22 nt, Human
cauggucuggauaguugguggc

SEQ ID NO: 17093 - RNA, 24 nt, Human
caugguguccaccgaugugcacac

SEQ ID NO: 17094 - RNA, 22 nt, Human
cauguaaucccagcuacucagg

SEQ ID NO: 17095 - RNA, 22 nt, Human
cauguacaacaggaaccgugug

SEQ ID NO: 17096 - RNA, 22 nt, Human
caugucaucucaaugcgcugca

SEQ ID NO: 17097 - RNA, 24 nt, Human
cauuaggaugucagcugacccuug

SEQ ID NO: 17098 - RNA, 24 nt, Human
cauuaguaugacagaggggggcug

SEQ ID NO: 17099 - RNA, 24 nt, Human
cauucacugugcuaucggcaauga

SEQ ID NO: 17100 - RNA, 24 nt, Human
cauucauugucuuacaugcagagc

SEQ ID NO: 17101 - RNA, 24 nt, Human
cauuccuuccacauucggcuaugg

SEQ ID NO: 17102 - RNA, 24 nt, Human
cauucuagcccauuaggcucccag

SEQ ID NO: 17103 - RNA, 24 nt, Human
cauucugccucuuccuucucuugu

SEQ ID NO: 17104 - RNA, 24 nt, Human
cauucuucacugagugcugcugac

SEQ ID NO: 17105 - RNA, 24 nt, Human
cauucuugcugucuggauccagag

SEQ ID NO: 17106 - RNA, 24 nt, Human
cauucuuuaaaucugagucucucc

SEQ ID NO: 17107 - RNA, 24 nt, Human
cauugagaagcugguggagcggga

SEQ ID NO: 17108 - RNA, 22 nt, Human
cauugcacuccagccuaggcaa

SEQ ID NO: 17109 - RNA, 22 nt, Human
cauugcacuccagccuggguga

SEQ ID NO: 17110 - RNA, 24 nt, Human
cauugcacuccagccuggugacaa

SEQ ID NO: 17111 - RNA, 24 nt, Human
cauugcacuccaggccugggcaac

SEQ ID NO: 17112 - RNA, 22 nt, Human
cauugcacucuagccugggcaa

SEQ ID NO: 17113 - RNA, 24 nt, Human
cauugccuuauuucugcuagauca

SEQ ID NO: 17114 - RNA, 24 nt, Human
cauugcugaggccugggcucgccu

SEQ ID NO: 17115 - RNA, 22 nt, Human
cauuguaguaguuuguacaguc

SEQ ID NO: 17116 - RNA, 24 nt, Human
cauugugccucgauaguggcagcu

SEQ ID NO: 17117 - RNA, 22 nt, Human
cauuuagguuuuuagaaaggaa

SEQ ID NO: 17118 - RNA, 24 nt, Human
cauuucacuuucacugucugagau

SEQ ID NO: 17119 - RNA, 24 nt, Human
cauuuccucgcgagugacgcugga

SEQ ID NO: 17120 - RNA, 24 nt, Human
cauuucuucugcacaucuacuugc

SEQ ID NO: 17121 - RNA, 22 nt, Human
cauuucuuggcaauguggugcc

SEQ ID NO: 17122 - RNA, 24 nt, Human
cauuuuggguugccgugcucccaa

SEQ ID NO: 17123 - RNA, 22 nt, Human
ccaaagugcuaggauuacagcc

SEQ ID NO: 17124 - RNA, 22 nt, Human
ccaauaccccauggauaccaag

SEQ ID NO: 17125 - RNA, 24 nt, Human
ccaauguuaauuuaguuaacaacu

SEQ ID NO: 17126 - RNA, 24 nt, Human
ccacacagauucugcauggccccu

SEQ ID NO: 17127 - RNA, 24 nt, Human
ccacacaggcucauucucaacugg

SEQ ID NO: 17128 - RNA, 24 nt, Human
ccacagggcugcacuagcacagcc

SEQ ID NO: 17129 - RNA, 24 nt, Human
ccacauguaugaggacacauauaa

SEQ ID NO: 17130 - RNA, 22 nt, Human
ccacauuuguggggaagaucug

SEQ ID NO: 17131 - RNA, 22 nt, Human
ccacccuuccauucuuccucuu

SEQ ID NO: 17132 - RNA, 24 nt, Human
ccaccgagcucuggacgcugagga

SEQ ID NO: 17133 - RNA, 24 nt, Human
ccaccgggaccuggucagcacaga

SEQ ID NO: 17134 - RNA, 24 nt, Human
ccaccugggucuggacugcaugag

SEQ ID NO: 17135 - RNA, 24 nt, Human
ccacgcugucagcugaggugucaa

SEQ ID NO: 17136 - RNA, 22 nt, Human
ccacucaugugaaaauugauuu

SEQ ID NO: 17137 - RNA, 24 nt, Human
ccacugcacuccagccugggagac

SEQ ID NO: 17138 - RNA, 24 nt, Human
ccacugcacuccagccugggcaac

SEQ ID NO: 17139 - RNA, 24 nt, Human
ccacugcacucuagccugggggag

SEQ ID NO: 17140 - RNA, 24 nt, Human
ccacugcgcuccagccugggcaac

SEQ ID NO: 17141 - RNA, 24 nt, Human
ccacugcgcuucuggaaaccuacc

SEQ ID NO: 17142 - RNA, 24 nt, Human
ccacugcugcugcuccagcugagg

SEQ ID NO: 17143 - RNA, 22 nt, Human
ccagaagcuucuuugaaaggga

SEQ ID NO: 17144 - RNA, 22 nt, Human
ccagaauaccuguuuacucagu

SEQ ID NO: 17145 - RNA, 24 nt, Human
ccagaaugggacauggguucaucu

SEQ ID NO: 17146 - RNA, 22 nt, Human
ccagaauuuacagacaugaacg

SEQ ID NO: 17147 - RNA, 24 nt, Human
ccagaccauugucuuccaacccca

SEQ ID NO: 17148 - RNA, 24 nt, Human
ccagagcagguccaggugaguucu

SEQ ID NO: 17149 - RNA, 24 nt, Human
ccagcaaacaaaucaacgccuuga

SEQ ID NO: 17150 - RNA, 24 nt, Human
ccagcaaacucuucucuucccacu

SEQ ID NO: 17151 - RNA, 24 nt, Human
ccagcaagcaggaucgccgccgac

SEQ ID NO: 17152 - RNA, 24 nt, Human
ccagcacgucgaagcgcuccaugg

SEQ ID NO: 17153 - RNA, 24 nt, Human
ccagcacguucuagggaugggggc

SEQ ID NO: 17154 - RNA, 24 nt, Human
ccagccccggauaccuggacugcu

SEQ ID NO: 17155 - RNA, 20 nt, Human
ccagccgugaagccaaacug

SEQ ID NO: 17156 - RNA, 22 nt, Human
ccagccugagguuccuggaggg

SEQ ID NO: 17157 - RNA, 24 nt, Human
ccagcucguggagcagguccaccg

SEQ ID NO: 17158 - RNA, 24 nt, Human
ccaggccagguggagcucugcacg

SEQ ID NO: 17159 - RNA, 24 nt, Human
ccaggcugaagccuguuccugcgg

SEQ ID NO: 17160 - RNA, 22 nt, Human
ccaggcuggagugcaguggugc

SEQ ID NO: 17161 - RNA, 22 nt, Human
ccaggcuggagugcaguggugu

SEQ ID NO: 17162 - RNA, 22 nt, Human
ccaggcuguuuucaaacuuggg

SEQ ID NO: 17163 - RNA, 24 nt, Human
ccaggcuucccaaacagcuccaac

SEQ ID NO: 17164 - RNA, 22 nt, Human
ccagggaacacucauuucccua

SEQ ID NO: 17165 - RNA, 24 nt, Human
ccagggucaccagcaugaaugcuc

SEQ ID NO: 17166 - RNA, 22 nt, Human
ccagggucacccuccuuuagga

SEQ ID NO: 17167 - RNA, 22 nt, Human
ccaggugugaucucauccuuug

SEQ ID NO: 17168 - RNA, 24 nt, Human
ccaguagugaguucuugucggggg

SEQ ID NO: 17169 - RNA, 24 nt, Human
ccagucuugcaagguuaacuucuc

SEQ ID NO: 17170 - RNA, 24 nt, Human
ccagugcagucucuuggcaucucu

SEQ ID NO: 17171 - RNA, 22 nt, Human
ccauaucuuugcauccuucaau

SEQ ID NO: 17172 - RNA, 22 nt, Human
ccauccgaggcaagucuucuga

SEQ ID NO: 17173 - RNA, 24 nt, Human
ccauccguggggccaucauccugg

SEQ ID NO: 17174 - RNA, 22 nt, Human
ccaucugccaucauuacccuag

SEQ ID NO: 17175 - RNA, 24 nt, Human
ccaugccaucacugacaccagaag

SEQ ID NO: 17176 - RNA, 24 nt, Human
ccauugcugaaaaggucgaggccu

SEQ ID NO: 17177 - RNA, 22 nt, Human
ccauuugcuuuuuuggguuuac

SEQ ID NO: 17178 - RNA, 22 nt, Human
cccacacuuggaaucagccauu

SEQ ID NO: 17179 - RNA, 22 nt, Human
cccacauguauguguuuguuga

SEQ ID NO: 17180 - RNA, 22 nt, Human
cccagaccucaugacaucucau

SEQ ID NO: 17181 - RNA, 24 nt, Human
cccagagugguaacuggcagucuu

SEQ ID NO: 17182 - RNA, 22 nt, Human
cccagcugaccaagcaggccug

SEQ ID NO: 17183 - RNA, 24 nt, Human
cccaggaagcuacaagagacaggc

SEQ ID NO: 17184 - RNA, 22 nt, Human
cccaggaggcagagcuugcagu

SEQ ID NO: 17185 - RNA, 22 nt, Human
cccaggagguggagguuacagu

SEQ ID NO: 17186 - RNA, 22 nt, Human
cccaggcuggagugcaguggug

SEQ ID NO: 17187 - RNA, 21 nt, Human
cccauaguuccgcgcgugccc

SEQ ID NO: 17188 - RNA, 24 nt, Human
ccccacagcuccggaagugcuugg

SEQ ID NO: 17189 - RNA, 24 nt, Human
ccccagagcuaauuacauccacac

SEQ ID NO: 17190 - RNA, 24 nt, Human
ccccagaggguuucccaaguuggg

SEQ ID NO: 17191 - RNA, 24 nt, Human
ccccagaugggucagcuucggagg

SEQ ID NO: 17192 - RNA, 24 nt, Human
ccccagcucugcuggucccggggc

SEQ ID NO: 17193 - RNA, 24 nt, Human
ccccaguaccuccaagcaaguagc

SEQ ID NO: 17194 - RNA, 22 nt, Human
ccccaguucaauccgaccaugc

SEQ ID NO: 17195 - RNA, 24 nt, Human
ccccccaacagcuuccucagcuuc

SEQ ID NO: 17196 - RNA, 24 nt, Human
cccccgguccagagggccuuccca

SEQ ID NO: 17197 - RNA, 24 nt, Human
cccccuuugcaggcagucuuuuga

SEQ ID NO: 17198 - RNA, 24 nt, Human
ccccucgcuggugacugcugcgcc

SEQ ID NO: 17199 - RNA, 20 nt, Human
ccccugaggcgcagccgccu

SEQ ID NO: 17200 - RNA, 24 nt, Human
ccccugccacgugggccacuucag

SEQ ID NO: 17201 - RNA, 23 nt, Human
ccccugcgcugccagcuggagcc

SEQ ID NO: 17202 - RNA, 24 nt, Human
ccccuggggaacaggccgucgcgg

SEQ ID NO: 17203 - RNA, 24 nt, Human
ccccuggggcagcgaccagauccu

SEQ ID NO: 17204 - RNA, 24 nt, Human
ccccugggucuuaguuugcucauu

SEQ ID NO: 17205 - RNA, 24 nt, Human
ccccuggguucuuuggaauggucc

SEQ ID NO: 17206 - RNA, 24 nt, Human
ccccugguggcagcgaccagaucc

SEQ ID NO: 17207 - RNA, 24 nt, Human
ccccugucugucugcauuugucuc

SEQ ID NO: 17208 - RNA, 23 nt, Human
ccccuuguggccgucugcacugc

SEQ ID NO: 17209 - RNA, 24 nt, Human
ccccuuuggcaguggcugcccagu

SEQ ID NO: 17210 - RNA, 24 nt, Human
cccgccaguguccucagcugccuc

SEQ ID NO: 17211 - RNA, 22 nt, Human
cccggagguugaagcuacagug

SEQ ID NO: 17212 - RNA, 24 nt, Human
cccggcaggcuugggucgggagac

SEQ ID NO: 17213 - RNA, 22 nt, Human
cccgggaggcaaagguugcagu

SEQ ID NO: 17214 - RNA, 22 nt, Human
cccuccuucucgugucugcauu

SEQ ID NO: 17215 - RNA, 21 nt, Human
cccugaguucuagagcccuuu

SEQ ID NO: 17216 - RNA, 22 nt, Human
cccugggcugguguuugacuug

SEQ ID NO: 17217 - RNA, 24 nt, Human
cccugguaggcccauccuccccgu

SEQ ID NO: 17218 - RNA, 22 nt, Human
cccugguuacaggaagaaguuc

SEQ ID NO: 17219 - RNA, 22 nt, Human
cccuuggauaucgccaggauga

SEQ ID NO: 17220 - RNA, 22 nt, Human
cccuuuccauguacuggggguu

SEQ ID NO: 17221 - RNA, 22 nt, Human
ccgaaccacacgacagugcuca

SEQ ID NO: 17222 - RNA, 22 nt, Human
ccgagugguaacaugggagugu

SEQ ID NO: 17223 - RNA, 24 nt, Human
ccgcaauccuuccaacucucagcc

SEQ ID NO: 17224 - RNA, 24 nt, Human
ccgcacccgccgccucccgccccc

SEQ ID NO: 17225 - RNA, 24 nt, Human
ccgcagggcaucugccuccuggcu

SEQ ID NO: 17226 - RNA, 17 nt, Human
ccgccgccgccgccucg

SEQ ID NO: 17227 - RNA, 24 nt, Human
ccgccgccguuuccugauugguug

SEQ ID NO: 17228 - RNA, 22 nt, Human
ccgccgcgggcucguccuccuc

SEQ ID NO: 17229 - RNA, 24 nt, Human
ccgcgccgaccggcugcagccgca

SEQ ID NO: 17230 - RNA, 24 nt, Human
ccgcggccggcacauccucucggu

SEQ ID NO: 17231 - RNA, 24 nt, Human
ccgcguuguccgauguucaugagu

SEQ ID NO: 17232 - RNA, 24 nt, Human
ccgcuaaugaaagcugggcacugc

SEQ ID NO: 17233 - RNA, 24 nt, Human
ccgcucuuccuggcgugucaucuc

SEQ ID NO: 17234 - RNA, 24 nt, Human
ccgcuggggcuggaggcacgggcc

SEQ ID NO: 17235 - RNA, 24 nt, Human
ccgguccugggcugaagagauggg

SEQ ID NO: 17236 - RNA, 22 nt, Human
ccuacuuuucuggguccccagg

SEQ ID NO: 17237 - RNA, 22 nt, Human
ccuauguccccucaaccucauc

SEQ ID NO: 17238 - RNA, 24 nt, Human
ccucaaggcugccaucugucuugu

SEQ ID NO: 17239 - RNA, 24 nt, Human
ccucacagacggccaggagccagg

SEQ ID NO: 17240 - RNA, 24 nt, Human
ccucacagcugggggaggucagaa

SEQ ID NO: 17241 - RNA, 22 nt, Human
ccucagccuccagaauagcugg

SEQ ID NO: 17242 - RNA, 24 nt, Human
ccucaggaagaaaaccgcuggccc

SEQ ID NO: 17243 - RNA, 22 nt, Human
ccuccaaaugacagacaucauc

SEQ ID NO: 17244 - RNA, 24 nt, Human
ccuccagacaaaguuaacuccuau

SEQ ID NO: 17245 - RNA, 24 nt, Human
ccuccagcucggacaacuaggcgu

SEQ ID NO: 17246 - RNA, 24 nt, Human
ccuccagggacauugauuuucuca

SEQ ID NO: 17247 - RNA, 24 nt, Human
ccuccaugccuauguggugguaca

SEQ ID NO: 17248 - RNA, 24 nt, Human
ccucccagcugacagguccugccc

SEQ ID NO: 17249 - RNA, 24 nt, Human
ccucccgcaagaaaaugguguugu

SEQ ID NO: 17250 - RNA, 22 nt, Human
ccucccggagacuguuucuccc

SEQ ID NO: 17251 - RNA, 24 nt, Human
ccucccugaaccccuggcuuccag

SEQ ID NO: 17252 - RNA, 24 nt, Human
ccucccuucaccgccaccaccccc

SEQ ID NO: 17253 - RNA, 22 nt, Human
ccuccugucugcccuggcugau

SEQ ID NO: 17254 - RNA, 24 nt, Human
ccucgaccuccugggcuccagcgu

SEQ ID NO: 17255 - RNA, 24 nt, Human
ccucgguugggaccguuucucggc

SEQ ID NO: 17256 - RNA, 24 nt, Human
ccucuauccuuaucugucuggucg

SEQ ID NO: 17257 - RNA, 22 nt, Human
ccucuccauguacccauucccc

SEQ ID NO: 17258 - RNA, 24 nt, Human
ccucucugaccgguuggccaggga

SEQ ID NO: 17259 - RNA, 22 nt, Human
ccucugaucaucucccaugaga

SEQ ID NO: 17260 - RNA, 24 nt, Human
ccucugggagcccaacauggaucc

SEQ ID NO: 17261 - RNA, 23 nt, Human
ccucuggggugaagcugccucuu

SEQ ID NO: 17262 - RNA, 22 nt, Human
ccucuguaacuuuucuuggcag

SEQ ID NO: 17263 - RNA, 24 nt, Human
ccugaaguaucugaaaaauaugaa

SEQ ID NO: 17264 - RNA, 24 nt, Human
ccugaccucgugauccacccaccu

SEQ ID NO: 17265 - RNA, 24 nt, Human
ccugaccucgugauugaaauucug

SEQ ID NO: 17266 - RNA, 22 nt, Human
ccugagcucugggagcccacac

SEQ ID NO: 17267 - RNA, 24 nt, Human
ccugaggugaggggcaggccuggg

SEQ ID NO: 17268 - RNA, 22 nt, Human
ccugcaacaccauccugggaga

SEQ ID NO: 17269 - RNA, 24 nt, Human
ccugcacccacaagacucagagcc

SEQ ID NO: 17270 - RNA, 22 nt, Human
ccugcacccuggccugcagccu

SEQ ID NO: 17271 - RNA, 24 nt, Human
ccugcagauccucaucaaggucaa

SEQ ID NO: 17272 - RNA, 24 nt, Human
ccugcagccccggcgcugggcuuu

SEQ ID NO: 17273 - RNA, 24 nt, Human
ccugcaggccccugccccaccucc

SEQ ID NO: 17274 - RNA, 24 nt, Human
ccugcagggcucggccguaggaga

SEQ ID NO: 17275 - RNA, 24 nt, Human
ccugcagucccagcuacuuagaug

SEQ ID NO: 17276 - RNA, 24 nt, Human
ccugcagugcacgguuucuuccag

SEQ ID NO: 17277 - RNA, 24 nt, Human
ccugccacucuaugagcuuaagaa

SEQ ID NO: 17278 - RNA, 24 nt, Human
ccugccccaaggugaacgucguca

SEQ ID NO: 17279 - RNA, 24 nt, Human
ccugcgguuuguggucucuuccac

SEQ ID NO: 17280 - RNA, 22 nt, Human
ccuggagugacagguguagccu

SEQ ID NO: 17281 - RNA, 24 nt, Human
ccuggccaaaauggagaaagccug

SEQ ID NO: 17282 - RNA, 22 nt, Human
ccuggcccacccagguccccug

SEQ ID NO: 17283 - RNA, 24 nt, Human
ccuggcccugggcgccgcgccgac

SEQ ID NO: 17284 - RNA, 24 nt, Human
ccuggccuccauucagggagaaac

SEQ ID NO: 17285 - RNA, 22 nt, Human
ccuggcuaauuuuuguauuugu

SEQ ID NO: 17286 - RNA, 24 nt, Human
ccuggcugaaggccuuacucgagu

SEQ ID NO: 17287 - RNA, 22 nt, Human
ccuggcuuaggaagcucacaag

SEQ ID NO: 17288 - RNA, 23 nt, Human
ccuggcuucaggagggagcggag

SEQ ID NO: 17289 - RNA, 24 nt, Human
ccuggcuucaggagggagcggagc

SEQ ID NO: 17290 - RNA, 22 nt, Human
ccugggaagugcggguugcagu

SEQ ID NO: 17291 - RNA, 24 nt, Human
ccugggcucaagcaauccacccac

SEQ ID NO: 17292 - RNA, 24 nt, Human
ccugggguucuuaggagugaggag

SEQ ID NO: 17293 - RNA, 22 nt, Human
ccuguaaucccagcuacucggg

SEQ ID NO: 17294 - RNA, 24 nt, Human
ccugucaccccaccauggagaaaa

SEQ ID NO: 17295 - RNA, 22 nt, Human
ccugucucuggacuccugcaca

SEQ ID NO: 17296 - RNA, 24 nt, Human
ccuuacggaugccgaacuggcccg

SEQ ID NO: 17297 - RNA, 24 nt, Human
ccuucaggaaguucaggcuuuugu

SEQ ID NO: 17298 - RNA, 22 nt, Human
ccuucccucaaaggcugcugag

SEQ ID NO: 17299 - RNA, 24 nt, Human
ccuugcagcgguugcgccgagacc

SEQ ID NO: 17300 - RNA, 24 nt, Human
ccuugcugguggcuuugggggccc

SEQ ID NO: 17301 - RNA, 24 nt, Human
ccuuggaccacagccuuccagaca

SEQ ID NO: 17302 - RNA, 24 nt, Human
ccuuggguagacaaaauccaacau

SEQ ID NO: 17303 - RNA, 24 nt, Human
ccuuucagcuaacauucauggaug

SEQ ID NO: 17304 - RNA, 20 nt, Human
cgacgagaagcuguguaucc

SEQ ID NO: 17305 - RNA, 24 nt, Human
cgacgggaacaugcccuaugaccu

SEQ ID NO: 17306 - RNA, 23 nt, Human
cgacugacuccagccugggugac

SEQ ID NO: 17307 - RNA, 24 nt, Human
cgagacagcggcgagagaagggag

SEQ ID NO: 17308 - RNA, 23 nt, Human
cgagcacacgggcuacacggggc

SEQ ID NO: 17309 - RNA, 24 nt, Human
cgagccgaaccgagauuuggaagg

SEQ ID NO: 17310 - RNA, 24 nt, Human
cgaggcccuggagcaggccaucau

SEQ ID NO: 17311 - RNA, 24 nt, Human
cgaggccuccgcgcucuacggccg

SEQ ID NO: 17312 - RNA, 24 nt, Human
cgaggcugcuccuguggaaguggc

SEQ ID NO: 17313 - RNA, 24 nt, Human
cgagggaccuggcacguacauccc

SEQ ID NO: 17314 - RNA, 24 nt, Human
cgaggggaccugcacauucagucc

SEQ ID NO: 17315 - RNA, 24 nt, Human
cgaguacaggcacagugccacgac

SEQ ID NO: 17316 - RNA, 22 nt, Human
cgcaaccuucucacacuacaaa

SEQ ID NO: 17317 - RNA, 24 nt, Human
cgccaggguagcgguguagcugcg

SEQ ID NO: 17318 - RNA, 24 nt, Human
cgccauagccccuuggauucccuc

SEQ ID NO: 17319 - RNA, 24 nt, Human
cgccggagcucccacccucuucag

SEQ ID NO: 17320 - RNA, 22 nt, Human
cgccgggucgcgaugugacauu

SEQ ID NO: 17321 - RNA, 24 nt, Human
cgccguggagcaggggguggcgcu

SEQ ID NO: 17322 - RNA, 24 nt, Human
cgccguggagcugcagugcuggug

SEQ ID NO: 17323 - RNA, 22 nt, Human
cgccucaggccauaccugggcu

SEQ ID NO: 17324 - RNA, 24 nt, Human
cgcgaagaggcuggacucggauuc

SEQ ID NO: 17325 - RNA, 24 nt, Human
cgcgcggacuggacgccacgccgc

SEQ ID NO: 17326 - RNA, 24 nt, Human
cggaaugaaauaugacugaggacu

SEQ ID NO: 17327 - RNA, 22 nt, Human
cggauccuggacucaugcaucu

SEQ ID NO: 17328 - RNA, 22 nt, Human
cggaucguccuuacagcuguag

SEQ ID NO: 17329 - RNA, 24 nt, Human
cggcacgggcagacaacgcgagcc

SEQ ID NO: 17330 - RNA, 24 nt, Human
cggcagagaaguguggcuaagggg

SEQ ID NO: 17331 - RNA, 21 nt, Human
cggcagcggcggcgcgaggag

SEQ ID NO: 17332 - RNA, 24 nt, Human
cggcaucaucauggcaauugucau

SEQ ID NO: 17333 - RNA, 24 nt, Human
cggcaucucccaggcucuucugga

SEQ ID NO: 17334 - RNA, 24 nt, Human
cggcaugggcugcaggagccgcgg

SEQ ID NO: 17335 - RNA, 24 nt, Human
cggcauuaggggcucggcgccccc

SEQ ID NO: 17336 - RNA, 24 nt, Human
cggcccgggacugguggaucuccc

SEQ ID NO: 17337 - RNA, 24 nt, Human
cggccgggccggguuggggggcug

SEQ ID NO: 17338 - RNA, 24 nt, Human
cggcgcucuagaggcagagggagg

SEQ ID NO: 17339 - RNA, 24 nt, Human
cggcguguccucccugcagcgcgg

SEQ ID NO: 17340 - RNA, 24 nt, Human
cgggagaaaauccaccauaauaaa

SEQ ID NO: 17341 - RNA, 24 nt, Human
cgggagggcaaggucgagccguug

SEQ ID NO: 17342 - RNA, 24 nt, Human
cgggaucggagucuccucugcugg

SEQ ID NO: 17343 - RNA, 24 nt, Human
cgggcaccaagacugugccggaca

SEQ ID NO: 17344 - RNA, 24 nt, Human
cgggcgcgggcgcuagacgccucg

SEQ ID NO: 17345 - RNA, 24 nt, Human
cgggcuguacgacgaccgugggcg

SEQ ID NO: 17346 - RNA, 24 nt, Human
cggggcccagccuugguccccagc

SEQ ID NO: 17347 - RNA, 24 nt, Human
cggggcugcaggcggcgcagagca

SEQ ID NO: 17348 - RNA, 22 nt, Human
cggguccaggaaucaagggaua

SEQ ID NO: 17349 - RNA, 22 nt, Human
cggguccuauacuucagcaucu

SEQ ID NO: 17350 - RNA, 24 nt, Human
cgguauggagagcggcacacgccg

SEQ ID NO: 17351 - RNA, 24 nt, Human
cgguuuguccacaacuuccagagc

SEQ ID NO: 17352 - RNA, 24 nt, Human
cguaaaccacaaaagaguagcauu

SEQ ID NO: 17353 - RNA, 20 nt, Human
cgucaagggggacgagugcc

SEQ ID NO: 17354 - RNA, 24 nt, Human
cguccuggaggcugccagcguccu

SEQ ID NO: 17355 - RNA, 24 nt, Human
cgucuauaucaccuugaagaagua

SEQ ID NO: 17356 - RNA, 24 nt, Human
cgugaagacauaccagcucaacag

SEQ ID NO: 17357 - RNA, 24 nt, Human
cgugcaggcgcugaagcgcgcggg

SEQ ID NO: 17358 - RNA, 24 nt, Human
cgugcaucuuggucucaaugucga

SEQ ID NO: 17359 - RNA, 22 nt, Human
cgugcugcuaugagaaucuaau

SEQ ID NO: 17360 - RNA, 24 nt, Human
cguggagugggagagcagcgggca

SEQ ID NO: 17361 - RNA, 24 nt, Human
cguggcggaagaugcguuuggcuc

SEQ ID NO: 17362 - RNA, 20 nt, Human
cgugguggugcacgccugua

SEQ ID NO: 17363 - RNA, 24 nt, Human
cgugguguccuaccccuucgacac

SEQ ID NO: 17364 - RNA, 24 nt, Human
cgugguugccaucgugcuauagau

SEQ ID NO: 17365 - RNA, 22 nt, Human
cguguaaucccagcuacuuggg

SEQ ID NO: 17366 - RNA, 24 nt, Human
cguguagaaacaacgcgcagcacg

SEQ ID NO: 17367 - RNA, 22 nt, Human
cgugucuaaccuggacugcgug

SEQ ID NO: 17368 - RNA, 22 nt, Human
cuaauuuugguauuuuuaguag

SEQ ID NO: 17369 - RNA, 22 nt, Human
cuaauuuuuguauuuuuaauag

SEQ ID NO: 17370 - RNA, 21 nt, Human
aaaaaagcaauaauccuacuc

SEQ ID NO: 17371 - RNA, 22 nt, Human
aaaaaagcucaaaacaguguua

SEQ ID NO: 17372 - RNA, 25 nt, Human
aaaaaaguuuggaacccuggucccu

SEQ ID NO: 17373 - RNA, 19 nt, Human
aaaaaaucaaagcucuccu

SEQ ID NO: 17374 - RNA, 21 nt, Human
aaaaaaugggagugggccggg

SEQ ID NO: 17375 - RNA, 22 nt, Human
aaaaaauugcaggauuuauaca

SEQ ID NO: 17376 - RNA, 32 nt, Human
aaaaacaaaaacaagccccagaaucagugggu

SEQ ID NO: 17377 - RNA, 32 nt, Human
aaaaacaaaacaaaacaaaacaaaugacagua

SEQ ID NO: 17378 - RNA, 32 nt, Human
aaaaacaaaacaaaacaaacacauuguuuuuc

SEQ ID NO: 17379 - RNA, 32 nt, Human
aaaaacaaaacaacuacauuguuucauugcuc

SEQ ID NO: 17380 - RNA, 32 nt, Human
aaaaacaaaacacacaccacacacacgcgcuu

SEQ ID NO: 17381 - RNA, 32 nt, Human
aaaaacaaaagacaugguacgcauuccagggc

SEQ ID NO: 17382 - RNA, 32 nt, Human
aaaaacaaaaucugacauauacauacauacag

SEQ ID NO: 17383 - RNA, 32 nt, Human
aaaaacaaaccccaaccuucucuccuugccac

SEQ ID NO: 17384 - RNA, 32 nt, Human
aaaaacaaaccugaaaacugcuuggcauuuga

SEQ ID NO: 17385 - RNA, 21 nt, Human
aaaaacaaaugaauacaggaa

SEQ ID NO: 17386 - RNA, 32 nt, Human
aaaaacaaauuagcugggcgugguggcgggcg

SEQ ID NO: 17387 - RNA, 32 nt, Human
aaaaacaacacaggcugggcgcgguggcucac

SEQ ID NO: 17388 - RNA, 26 nt, Human
aaaaacaacauacaagaccacaggaa

SEQ ID NO: 17389 - RNA, 32 nt, Human
aaaaacaaccagccaggauuaaagguauuaua

SEQ ID NO: 17390 - RNA, 32 nt, Human
aaaaacaagaacagccaaggguuguucgccag

SEQ ID NO: 17391 - RNA, 32 nt, Human
aaaaacaagaggaggggccaggcgagguggcu

SEQ ID NO: 17392 - RNA, 32 nt, Human
aaaaacaaggcucagaaagaauggaaagaaag

SEQ ID NO: 17393 - RNA, 32 nt, Human
aaaaacaaucacacccuuaaccuuuaagccag

SEQ ID NO: 17394 - RNA, 32 nt, Human
aaaaacaaucugacaguagcaguguagaauuu

SEQ ID NO: 17395 - RNA, 32 nt, Human
aaaaacacaaauuagccaggcguggugguaca

SEQ ID NO: 17396 - RNA, 32 nt, Human
aaaaacacagaagcaaaagcuaugaugcauua

SEQ ID NO: 17397 - RNA, 32 nt, Human
aaaaacacauaaacaaauaguuucaguagguc

SEQ ID NO: 17398 - RNA, 32 nt, Human
aaaaacacccagcugggugcaguggcucgcac

SEQ ID NO: 17399 - RNA, 32 nt, Human
aaaaacacccuugucauguauuuucuguaugu

SEQ ID NO: 17400 - RNA, 32 nt, Human
aaaaacacuacaaauguagagaauguggccaa

SEQ ID NO: 17401 - RNA, 32 nt, Human
aaaaacacuauuaccuguuucuagucacuuua

SEQ ID NO: 17402 - RNA, 32 nt, Human
aaaaacacuggacacaaggcuugggugaacag

SEQ ID NO: 17403 - RNA, 32 nt, Human
aaaaacacuuaaggagcuaaacuuaccuucgg

SEQ ID NO: 17404 - RNA, 32 nt, Human
aaaaacacuuuucuaaggacugaagauuggca

SEQ ID NO: 17405 - RNA, 32 nt, Human
aaaaacagaaagagcaucuggggagcgaguga

SEQ ID NO: 17406 - RNA, 32 nt, Human
aaaaacagaauccagucuugacaacauaucca

SEQ ID NO: 17407 - RNA, 23 nt, Human
aaaaacagacacccagcugccga

SEQ ID NO: 17408 - RNA, 32 nt, Human
aaaaacagacuugccugcaauagccagcagua

SEQ ID NO: 17409 - RNA, 32 nt, Human
aaaaacagagccucucuguagagaugcuuaaa

SEQ ID NO: 17410 - RNA, 32 nt, Human
aaaaacagauggagaauaaugucuacaugcaa

SEQ ID NO: 17411 - RNA, 32 nt, Human
aaaaacagcagaacuucugaaaccucuggguc

SEQ ID NO: 17412 - RNA, 32 nt, Human
aaaaacagcagggcuggacggauguugggagu

SEQ ID NO: 17413 - RNA, 32 nt, Human
aaaaacagccaacauccccugugaauugcagu

SEQ ID NO: 17414 - RNA, 32 nt, Human
aaaaacagccuaugauaguuugaaucccccuc

SEQ ID NO: 17415 - RNA, 32 nt, Human
aaaaacagcgccaaagcagucagcauuggaag

SEQ ID NO: 17416 - RNA, 32 nt, Human
aaaaacagcuucaucucugccucucuccaccc

SEQ ID NO: 17417 - RNA, 32 nt, Human
aaaaacaggaaaauaguuguuccaauauauaa

SEQ ID NO: 17418 - RNA, 32 nt, Human
aaaaacaggcagcugguuugcuguggugguuu

SEQ ID NO: 17419 - RNA, 32 nt, Human
aaaaacaggcuggcgugguggcucacaccugu

SEQ ID NO: 17420 - RNA, 32 nt, Human
aaaaacaggcugggcgugguggcucacaccug

SEQ ID NO: 17421 - RNA, 32 nt, Human
aaaaacagggaacuuuguaacugugaaauacu

SEQ ID NO: 17422 - RNA, 32 nt, Human
aaaaacagguggaagagggaaggguccaauua

SEQ ID NO: 17423 - RNA, 32 nt, Human
aaaaacauaagaauuguuucgccaaaugaaug

SEQ ID NO: 17424 - RNA, 32 nt, Human
aaaaacauaugcaaaucucaguguucucacua

SEQ ID NO: 17425 - RNA, 32 nt, Human
aaaaacaucaugggaaaaaugcuuagagguua

SEQ ID NO: 17426 - RNA, 32 nt, Human
aaaaacaucuggaagaaaaugacuaaaacugu

SEQ ID NO: 17427 - RNA, 32 nt, Human
aaaaacaucuggauaucaagguggaaauggcc

SEQ ID NO: 17428 - RNA, 32 nt, Human
aaaaacauguacagucucauaacacauacuuu

SEQ ID NO: 17429 - RNA, 21 nt, Human
aaaaacauguacugagaugaa

SEQ ID NO: 17430 - RNA, 32 nt, Human
aaaaacauguacugagaugaaucuaauuuuua

SEQ ID NO: 17431 - RNA, 31 nt, Human
aaaaacaugucugcuucucauuuaaauaaga

SEQ ID NO: 17432 - RNA, 32 nt, Human
aaaaacauuacuucgccuccccaaaccaaucc

SEQ ID NO: 17433 - RNA, 32 nt, Human
aaaaacauugaugcgcuggcuuggggauuuga

SEQ ID NO: 17434 - RNA, 32 nt, Human
aaaaacauugcugccgccuacuucuuccagcu

SEQ ID NO: 17435 - RNA, 32 nt, Human
aaaaacauugugugaauauauguuuguaugug

SEQ ID NO: 17436 - RNA, 32 nt, Human
aaaaaccaaccaaccaaccaaccaaccaacaa

SEQ ID NO: 17437 - RNA, 32 nt, Human
aaaaaccaacgccaccaugucggagaccagca

SEQ ID NO: 17438 - RNA, 32 nt, Human
aaaaaccaacugcugggaaacugugaaaagcc

SEQ ID NO: 17439 - RNA, 32 nt, Human
aaaaaccaagcagcaaagugcaguggcauguc

SEQ ID NO: 17440 - RNA, 25 nt, Human
aaaaaccaaucagaaaacacaggaa

SEQ ID NO: 17441 - RNA, 32 nt, Human
aaaaaccaaugacaaccaaacugaaaccgaaa

SEQ ID NO: 17442 - RNA, 32 nt, Human
aaaaaccaccacccuccagccugggcaacgua

SEQ ID NO: 17443 - RNA, 32 nt, Human
aaaaaccacucccaguccccagcccuucacau

SEQ ID NO: 17444 - RNA, 31 nt, Human
aaaaaccagagaguugggcuggagagaaaag

SEQ ID NO: 17445 - RNA, 32 nt, Human
aaaaaccagagucacugacagagggaacagca

SEQ ID NO: 17446 - RNA, 32 nt, Human
aaaaaccagagucacugacagagggaacugca

SEQ ID NO: 17447 - RNA, 32 nt, Human
aaaaaccagcuccuagauucacugaucuuuuu

SEQ ID NO: 17448 - RNA, 32 nt, Human
aaaaaccaggagugaaaaaggaaaguagaagg

SEQ ID NO: 17449 - RNA, 32 nt, Human
aaaaaccaguccucucuaaucucaggugggac

SEQ ID NO: 17450 - RNA, 32 nt, Human
aaaaaccagugaaauucuacaagugucccuuu

SEQ ID NO: 17451 - RNA, 32 nt, Human
aaaaaccauaaaaucacuggguuccacaucag

SEQ ID NO: 17452 - RNA, 32 nt, Human
aaaaaccaugggaaggugggaaagcagagaaa

SEQ ID NO: 17453 - RNA, 32 nt, Human
aaaaacccaacucuuuguggauuuuuaucaac

SEQ ID NO: 17454 - RNA, 32 nt, Human
aaaaaccccaccauucagccuagucaacaaca

SEQ ID NO: 17455 - RNA, 32 nt, Human
aaaaaccccuaaauuacagaauuggaauuugu

SEQ ID NO: 17456 - RNA, 32 nt, Human
aaaaaccccucacuuaaaaauggcagucucaa

SEQ ID NO: 17457 - RNA, 32 nt, Human
aaaaacccuagacucagccagacucuggcaga

SEQ ID NO: 17458 - RNA, 32 nt, Human
aaaaaccuacagcugcuuagguccagcuucuu

SEQ ID NO: 17459 - RNA, 32 nt, Human
aaaaaccugaguaucauugcaugaauuuuuau

SEQ ID NO: 17460 - RNA, 32 nt, Human
aaaaaccugcagggcuagaguuuggggugaga

SEQ ID NO: 17461 - RNA, 23 nt, Human
aaaaaccugccucuugucugccu

SEQ ID NO: 17462 - RNA, 32 nt, Human
aaaaaccugccugccugguugggccuucagcu

SEQ ID NO: 17463 - RNA, 32 nt, Human
aaaaaccugcucaucguucagcuuccaaaauu

SEQ ID NO: 17464 - RNA, 32 nt, Human
aaaaaccuguggacauaaugaauuuugagaca

SEQ ID NO: 17465 - RNA, 32 nt, Human
aaaaaccuguucugcuauuccugggcccacaa

SEQ ID NO: 17466 - RNA, 32 nt, Human
aaaaaccuuaccaccaaacauaccaaaaugca

SEQ ID NO: 17467 - RNA, 32 nt, Human
aaaaaccuucaggccacaaagcaaaaaguugc

SEQ ID NO: 17468 - RNA, 32 nt, Human
aaaaaccuucagucgaaguacacaccuuacug

SEQ ID NO: 17469 - RNA, 32 nt, Human
aaaaaccuuguccuggcuucagcuuccaacua

SEQ ID NO: 17470 - RNA, 32 nt, Human
aaaaacgaagccagccuggaccauacacugcc

SEQ ID NO: 17471 - RNA, 32 nt, Human
aaaaacgacaacaagcuucuucccagggugag

SEQ ID NO: 17472 - RNA, 32 nt, Human
aaaaacgacuccugaccuuucccagccuccuc

SEQ ID NO: 17473 - RNA, 32 nt, Human
aaaaacgaggacuccuuaauucugcuagaguu

SEQ ID NO: 17474 - RNA, 32 nt, Human
aaaaacgaggccucugcaagccacuuuuccau

SEQ ID NO: 17475 - RNA, 32 nt, Human
aaaaacgauaccuucaaaguuugcggccuaga

SEQ ID NO: 17476 - RNA, 32 nt, Human
aaaaacgcacagaaaaauuagccaggcauggu

SEQ ID NO: 17477 - RNA, 32 nt, Human
aaaaacgggguuucaccguguuagccaggaug

SEQ ID NO: 17478 - RNA, 32 nt, Human
aaaaacguagcuaccguacacacacaucaauc

SEQ ID NO: 17479 - RNA, 32 nt, Human
aaaaacguguaaaccugugagccaccccaagc

SEQ ID NO: 17480 - RNA, 32 nt, Human
aaaaacuaaauggugcuuuauauuuagauugg

SEQ ID NO: 17481 - RNA, 24 nt, Human
aaaaacuaacugaaagcacaugaa

SEQ ID NO: 17482 - RNA, 32 nt, Human
aaaaacuaccucaagagaccuggcccuguuaa

SEQ ID NO: 17483 - RNA, 32 nt, Human
aaaaacuagcacccuucuguccacucagcaau

SEQ ID NO: 17484 - RNA, 32 nt, Human
aaaaacuagguuuaaggagaugagcuacuguu

SEQ ID NO: 17485 - RNA, 32 nt, Human
aaaaacucaacucaaaacucagucucaaaaau

SEQ ID NO: 17486 - RNA, 32 nt, Human
aaaaacucaccaggaagcuccauuuuguguca

SEQ ID NO: 17487 - RNA, 32 nt, Human
aaaaacucaguuuucggcugggcacaguggcu

SEQ ID NO: 17488 - RNA, 32 nt, Human
aaaaacucauagaagauaucauguaggcccug

SEQ ID NO: 17489 - RNA, 32 nt, Human
aaaaacucccuggauuaggcaagagaaaagga

SEQ ID NO: 17490 - RNA, 32 nt, Human
aaaaacuccuuugaccaggugguuuugccuuc

SEQ ID NO: 17491 - RNA, 32 nt, Human
aaaaacucugacuauucccauuucucaguuua

SEQ ID NO: 17492 - RNA, 32 nt, Human
aaaaacucuucuacuuucaucuauucuuuccc

SEQ ID NO: 17493 - RNA, 32 nt, Human
aaaaacucuugccucugcuuucccccacucug

SEQ ID NO: 17494 - RNA, 32 nt, Human
aaaaacugaaaaaucugguucauucuucagau

SEQ ID NO: 17495 - RNA, 32 nt, Human
aaaaacugaaaaccuuugguccugggaauuua

SEQ ID NO: 17496 - RNA, 32 nt, Human
aaaaacugaauacaagauaccaaaaaugaaaa

SEQ ID NO: 17497 - RNA, 32 nt, Human
aaaaacugacuuucuguugucuaccucaggcc

SEQ ID NO: 17498 - RNA, 32 nt, Human
aaaaacugaggaagcugagcuggagaaggaag

SEQ ID NO: 17499 - RNA, 32 nt, Human
aaaaacugaucugcuuagaauguggcccuggu

SEQ ID NO: 17500 - RNA, 32 nt, Human
aaaaacugaucuuaagagcagacuuaaaguag

SEQ ID NO: 17501 - RNA, 32 nt, Human
aaaaacugauguuuaaaaguccacuuuuaaaa

SEQ ID NO: 17502 - RNA, 32 nt, Human
aaaaacugcauuggcugggugcaguggcucau

SEQ ID NO: 17503 - RNA, 31 nt, Human
aaaaacugccucuguuguguuucucacugga

SEQ ID NO: 17504 - RNA, 32 nt, Human
aaaaacuggaagccuucccccagcaaggcaga

SEQ ID NO: 17505 - RNA, 32 nt, Human
aaaaacuggagaaauaggaauuugugaacccc

SEQ ID NO: 17506 - RNA, 25 nt, Human
aaaaacuggaguucugcuuccuuga

SEQ ID NO: 17507 - RNA, 32 nt, Human
aaaaacuggcugcuaacuggccugagccaggc

SEQ ID NO: 17508 - RNA, 32 nt, Human
aaaaacuguaaaaccacacacuuugauauuug

SEQ ID NO: 17509 - RNA, 32 nt, Human
aaaaacugugaaugacaaaaucuggcaggaac

SEQ ID NO: 17510 - RNA, 32 nt, Human
aaaaacuguuuggaagaguagcguugagguuu

SEQ ID NO: 17511 - RNA, 32 nt, Human
aaaaacuguuuguguaccagcaccuguaaucc

SEQ ID NO: 17512 - RNA, 32 nt, Human
aaaaacuuagcugagugugguggugcaugccu

SEQ ID NO: 17513 - RNA, 32 nt, Human
aaaaacuuagugaaaauguauuagcacgauua

SEQ ID NO: 17514 - RNA, 32 nt, Human
aaaaacuucaucagaaauuaaauuuaaugcaa

SEQ ID NO: 17515 - RNA, 32 nt, Human
aaaaacuuccuuuacagagguucggacuaaca

SEQ ID NO: 17516 - RNA, 32 nt, Human
aaaaacuucggaggcagagcaagguuuggugu

SEQ ID NO: 17517 - RNA, 32 nt, Human
aaaaacuugaaucguucacauuucucagcucu

SEQ ID NO: 17518 - RNA, 32 nt, Human
aaaaacuugaggaggauaaaaauauguuggaa

SEQ ID NO: 17519 - RNA, 32 nt, Human
aaaaacuugucuucccuucugauuguggugcu

SEQ ID NO: 17520 - RNA, 32 nt, Human
aaaaacuuuaugccucacccuggcacaguagc

SEQ ID NO: 17521 - RNA, 32 nt, Human
aaaaacuuucuuccucucucuccaagaggaua

SEQ ID NO: 17522 - RNA, 32 nt, Human
aaaaagaaaaacacaaacauucaaagcuuagg

SEQ ID NO: 17523 - RNA, 32 nt, Human
aaaaagaaaacacacacccacccacacacaca

SEQ ID NO: 17524 - RNA, 32 nt, Human
aaaaagaaaacauaggacauuuuauucagaaa

SEQ ID NO: 17525 - RNA, 32 nt, Human
aaaaagaaaagacuccuaugaagaacuguuuu

SEQ ID NO: 17526 - RNA, 32 nt, Human
aaaaagaaaaggaugagaagauccucagugaa

SEQ ID NO: 17527 - RNA, 32 nt, Human
aaaaagaaaaugcagacagaaugugggacugg

SEQ ID NO: 17528 - RNA, 32 nt, Human
aaaaagaaaaugucagaggaauuugaagccaa

SEQ ID NO: 17529 - RNA, 21 nt, Human
aaaaagaaacaaaguuauggg

SEQ ID NO: 17530 - RNA, 21 nt, Human
aaaaagaaacaacuuguagga

SEQ ID NO: 17531 - RNA, 32 nt, Human
aaaaagaaagaaaggaaaagauuucauaagca

SEQ ID NO: 17532 - RNA, 32 nt, Human
aaaaagaaagaaugagucuucagaugaaauau

SEQ ID NO: 17533 - RNA, 23 nt, Human
aaaaagaaagagagagggccggg

SEQ ID NO: 17534 - RNA, 32 nt, Human
aaaaagaaagccaaaccacuguacuuauauuu

SEQ ID NO: 17535 - RNA, 32 nt, Human
aaaaagaaagugagacacugggcagaaaacag

SEQ ID NO: 17536 - RNA, 32 nt, Human
aaaaagaaaguugcagaacagacauauuuuug

SEQ ID NO: 17537 - RNA, 32 nt, Human
aaaaagaaaugcugcauuuucaguucuauuga

SEQ ID NO: 17538 - RNA, 32 nt, Human
aaaaagaacaagccccaagcugugcauuuaca

SEQ ID NO: 17539 - RNA, 32 nt, Human
aaaaagaacucaaccuguuucucuugaguaac

SEQ ID NO: 17540 - RNA, 32 nt, Human
aaaaagaagaaacccaggcagacaggcaguug

SEQ ID NO: 17541 - RNA, 32 nt, Human
aaaaagaagaaacugacuuguacuggaucauc

SEQ ID NO: 17542 - RNA, 32 nt, Human
aaaaagaagaagagaagcugaagcauugcucc

SEQ ID NO: 17543 - RNA, 32 nt, Human
aaaaagaagagaagagaaagaagaaacaaugc

SEQ ID NO: 17544 - RNA, 32 nt, Human
aaaaagaagauaaggaaauggaagcuacagac

SEQ ID NO: 17545 - RNA, 32 nt, Human
aaaaagaagcagcacgagucuccauacaucau

SEQ ID NO: 17546 - RNA, 32 nt, Human
aaaaagaagcuagggcugggcgcgguggcuca

SEQ ID NO: 17547 - RNA, 32 nt, Human
aaaaagaaggcugggugcaguggcucuugccu

SEQ ID NO: 17548 - RNA, 32 nt, Human
aaaaagaagguagaguagaggccuauugccac

SEQ ID NO: 17549 - RNA, 32 nt, Human
aaaaagaaguagagacagggagacagggucuc

SEQ ID NO: 17550 - RNA, 32 nt, Human
aaaaagaaguauuuccagaaucucauauaaaa

SEQ ID NO: 17551 - RNA, 32 nt, Human
aaaaagaaugagcguuuggugaaauucuuaau

SEQ ID NO: 17552 - RNA, 32 nt, Human
aaaaagacaccaggaggcaggcugcgggguag

SEQ ID NO: 17553 - RNA, 32 nt, Human
aaaaagacacggcgcuggcaagugauaggaac

SEQ ID NO: 17554 - RNA, 32 nt, Human
aaaaagacagggccagguuaggcuugggugag

SEQ ID NO: 17555 - RNA, 32 nt, Human
aaaaagacaguauuuugccaaauuaaacagaa

SEQ ID NO: 17556 - RNA, 32 nt, Human
aaaaagaccaaaacacacuucuccagcaacac

SEQ ID NO: 17557 - RNA, 32 nt, Human
aaaaagaccagccuucccaacaugccuccugc

SEQ ID NO: 17558 - RNA, 32 nt, Human
aaaaagacccccagcaauaaaaagugggucac

SEQ ID NO: 17559 - RNA, 32 nt, Human
aaaaagacucacugacauccugacaucucagg

SEQ ID NO: 17560 - RNA, 32 nt, Human
aaaaagacugagggagcaacaauguggaaagg

SEQ ID NO: 17561 - RNA, 32 nt, Human
aaaaagacugauuuuuaaaguauggcauuuuu

SEQ ID NO: 17562 - RNA, 32 nt, Human
aaaaagacuguacugcaguguaguaauggaau

SEQ ID NO: 17563 - RNA, 32 nt, Human
aaaaagacuguuauccugcuacacacuccugu

SEQ ID NO: 17564 - RNA, 32 nt, Human
aaaaagagaacagcagcuuucuagggacagcu

SEQ ID NO: 17565 - RNA, 32 nt, Human
aaaaagagaagaggaaauaaaccagacagugc

SEQ ID NO: 17566 - RNA, 32 nt, Human
aaaaagagaagcaagccagacaugguggcuca

SEQ ID NO: 17567 - RNA, 32 nt, Human
aaaaagagaaggaagaaagaaaagaaauaaga

SEQ ID NO: 17568 - RNA, 32 nt, Human
aaaaagagaauagucaagaaaaagaggaaaua

SEQ ID NO: 17569 - RNA, 32 nt, Human
aaaaagagacagcaacuggcccagggucacca

SEQ ID NO: 17570 - RNA, 32 nt, Human
aaaaagagacauauaugauauugcuguuauau

SEQ ID NO: 17571 - RNA, 32 nt, Human
aaaaagagagggagguauggacugggggccag

SEQ ID NO: 17572 - RNA, 32 nt, Human
aaaaagagauaugacaagggaaauuaaucagg

SEQ ID NO: 17573 - RNA, 32 nt, Human
aaaaagagauggguuuucgccauguugcccag

SEQ ID NO: 17574 - RNA, 32 nt, Human
aaaaagagcagaaggaaggaagaaggaaggac

SEQ ID NO: 17575 - RNA, 32 nt, Human
aaaaagagcuggcuggccuaaaaaccuaaaua

SEQ ID NO: 17576 - RNA, 32 nt, Human
aaaaagagcuucaggccaggcgugguggcuca

SEQ ID NO: 17577 - RNA, 32 nt, Human
aaaaagagcuucgacuucucucuuggguggag

SEQ ID NO: 17578 - RNA, 32 nt, Human
aaaaagaggagagagauagaggaaggugaauu

SEQ ID NO: 17579 - RNA, 32 nt, Human
aaaaagaggagagaggcuuucgguggacacgu

SEQ ID NO: 17580 - RNA, 31 nt, Human
aaaaagaggagggggcauaaagacuggauaa

SEQ ID NO: 17581 - RNA, 32 nt, Human
aaaaagaggagggggcauaaagacuggauaaa

SEQ ID NO: 17582 - RNA, 32 nt, Human
aaaaagaggcaaauucagauuuggaaacaggg

SEQ ID NO: 17583 - RNA, 32 nt, Human
aaaaagaggcugaggaaggagaggaugacaga

SEQ ID NO: 17584 - RNA, 32 nt, Human
aaaaagagucauacauauuccauuuguccuuu

SEQ ID NO: 17585 - RNA, 32 nt, Human
aaaaagaguuuucuuuaguauagccacaaaug

SEQ ID NO: 17586 - RNA, 32 nt, Human
aaaaagaucaguaauaucaaagagcaccugga

SEQ ID NO: 17587 - RNA, 32 nt, Human
aaaaagaucuccagcuccacacauguuuccac

SEQ ID NO: 17588 - RNA, 32 nt, Human
aaaaagaucucugccucucuucucucugccuc

SEQ ID NO: 17589 - RNA, 32 nt, Human
aaaaagaugcucagauauuaugugucaaggau

SEQ ID NO: 17590 - RNA, 31 nt, Human
aaaaagaugcuggggagcagagcuguaaugc

SEQ ID NO: 17591 - RNA, 31 nt, Human
aaaaagauguucucugggaccucucucaggc

SEQ ID NO: 17592 - RNA, 32 nt, Human
aaaaagauguucucugggaccucucucaggcu

SEQ ID NO: 17593 - RNA, 32 nt, Human
aaaaagauuacaucagucaugauucaugaacc

SEQ ID NO: 17594 - RNA, 32 nt, Human
aaaaagcaaagacugagguacugugaauggag

SEQ ID NO: 17595 - RNA, 32 nt, Human
aaaaagcaaagucauggaaaagaaaugcaaau

SEQ ID NO: 17596 - RNA, 32 nt, Human
aaaaagcaaccagggcuauuuguacaguugaa

SEQ ID NO: 17597 - RNA, 32 nt, Human
aaaaagcaacccaguccccaaccugcacucua

SEQ ID NO: 17598 - RNA, 32 nt, Human
aaaaagcaagaaaagaaagagaagacugagaa

SEQ ID NO: 17599 - RNA, 32 nt, Human
aaaaagcaagggcagcggcauucacacagacc

SEQ ID NO: 17600 - RNA, 32 nt, Human
aaaaagcaaugucuucucuggaauggggcuuc

SEQ ID NO: 17601 - RNA, 32 nt, Human
aaaaagcacacagauggcuugucucaggagug

SEQ ID NO: 17602 - RNA, 32 nt, Human
aaaaagcaccguugagguugcagugagccgag

SEQ ID NO: 17603 - RNA, 32 nt, Human
aaaaagcacggcaagcucauuacguucuuacg

SEQ ID NO: 17604 - RNA, 32 nt, Human
aaaaagcagcacaaauacaaacaguuguguau

SEQ ID NO: 17605 - RNA, 32 nt, Human
aaaaagcagcacagcaaagcccaaguugcuga

SEQ ID NO: 17606 - RNA, 32 nt, Human
aaaaagcagugaauuguaagugugaggugugu

SEQ ID NO: 17607 - RNA, 32 nt, Human
aaaaagcauaccuuucaauuuugcuacuuggu

SEQ ID NO: 17608 - RNA, 32 nt, Human
aaaaagcauacuccagaggaagcugaggcaug

SEQ ID NO: 17609 - RNA, 32 nt, Human
aaaaagcauaguuucaguuugcaugaauuuuu

SEQ ID NO: 17610 - RNA, 32 nt, Human
aaaaagcauccuucagccucuuccuguccuuu

SEQ ID NO: 17611 - RNA, 32 nt, Human
aaaaagcaucuuuugugaaagacagggagcaa

SEQ ID NO: 17612 - RNA, 32 nt, Human
aaaaagcaugacauuuagaaguagaagacuua

SEQ ID NO: 17613 - RNA, 32 nt, Human
aaaaagcauuucaccuuuaccacuuggcaggu

SEQ ID NO: 17614 - RNA, 32 nt, Human
aaaaagccaaaagguggccaggcuugguggcu

SEQ ID NO: 17615 - RNA, 32 nt, Human
aaaaagccaacauuccucugcuucauaggugu

SEQ ID NO: 17616 - RNA, 32 nt, Human
aaaaagccacagaagacacagagcagggaagg

SEQ ID NO: 17617 - RNA, 32 nt, Human
aaaaagccaccugagcuccugaggccaugucu

SEQ ID NO: 17618 - RNA, 32 nt, Human
aaaaagccacucauccccuuguguacucagua

SEQ ID NO: 17619 - RNA, 32 nt, Human
aaaaagccagagaggcuggugagggagcagga

SEQ ID NO: 17620 - RNA, 32 nt, Human
aaaaagccagccuuggcccugcagccuccacc

SEQ ID NO: 17621 - RNA, 32 nt, Human
aaaaagccauguccuagauccccaaggcguga

SEQ ID NO: 17622 - RNA, 32 nt, Human
aaaaagccccuuccccuggauucauguuucuu

SEQ ID NO: 17623 - RNA, 32 nt, Human
aaaaagcccgaauaucucaccugacgagcaga

SEQ ID NO: 17624 - RNA, 32 nt, Human
aaaaagcccuuucaccugagcuuugggaaaga

SEQ ID NO: 17625 - RNA, 32 nt, Human
aaaaagccucagcauuuuaucauuccauggaa

SEQ ID NO: 17626 - RNA, 32 nt, Human
aaaaagccucuguuaccugaaaggaggucaag

SEQ ID NO: 17627 - RNA, 32 nt, Human
aaaaagccugaacagcugaggaagcucuucau

SEQ ID NO: 17628 - RNA, 32 nt, Human
aaaaagccuggaaaacacaaggcuccugcugu

SEQ ID NO: 17629 - RNA, 32 nt, Human
aaaaagccuuaccaguggcuucagaggaagag

SEQ ID NO: 17630 - RNA, 32 nt, Human
aaaaagcgagaaaggugagcuauugggaaauu

SEQ ID NO: 17631 - RNA, 32 nt, Human
aaaaagcuaaugugcagggauauugccuuauu

SEQ ID NO: 17632 - RNA, 32 nt, Human
aaaaagcuccuguaauuugcacuuucucccaa

SEQ ID NO: 17633 - RNA, 32 nt, Human
aaaaagcucuggggcugucugaggcucuggaa

SEQ ID NO: 17634 - RNA, 32 nt, Human
aaaaagcugcaaccccagcccaucagaaggug

SEQ ID NO: 17635 - RNA, 32 nt, Human
aaaaagcugguggaacuuacucuuucuuuuaa

SEQ ID NO: 17636 - RNA, 32 nt, Human
aaaaagcuucagcggucacugaaagugcuuac

SEQ ID NO: 17637 - RNA, 32 nt, Human
aaaaagcuugauacauuugauuuuucauuaga

SEQ ID NO: 17638 - RNA, 32 nt, Human
aaaaagcuugcugagaaggcugugcuggcggc

SEQ ID NO: 17639 - RNA, 32 nt, Human
aaaaagcuuuuugauuucccaaaggagggaca

SEQ ID NO: 17640 - RNA, 32 nt, Human
aaaaaggaaaagugcuuuccuccucugcagga

SEQ ID NO: 17641 - RNA, 32 nt, Human
aaaaaggaaagaaagaaagaaaaagaaagaaa

SEQ ID NO: 17642 - RNA, 32 nt, Human
aaaaaggaaagaaagaaagaaaagaaaagaaa

SEQ ID NO: 17643 - RNA, 32 nt, Human
aaaaaggaaagucaacugggaguuuacugaca

SEQ ID NO: 17644 - RNA, 31 nt, Human
aaaaaggaacaaguaacuaggagagaaaaau

SEQ ID NO: 17645 - RNA, 32 nt, Human
aaaaaggaacuuccucgaacuaaagcaguuaa

SEQ ID NO: 17646 - RNA, 32 nt, Human
aaaaaggaagaagaguggaagugaagaaggug

SEQ ID NO: 17647 - RNA, 32 nt, Human
aaaaaggaagagagaggaagggagaagggaga

SEQ ID NO: 17648 - RNA, 32 nt, Human
aaaaaggaagggccucuccuguggaaagggaa

SEQ ID NO: 17649 - RNA, 32 nt, Human
aaaaaggaauagggguagaguguuacagagag

SEQ ID NO: 17650 - RNA, 32 nt, Human
aaaaaggaccaccugaugcucagucccgagag

SEQ ID NO: 17651 - RNA, 32 nt, Human
aaaaaggagaaaagggaaaagcagaaaggaaa

SEQ ID NO: 17652 - RNA, 32 nt, Human
aaaaaggagaagagauauuuuggguucaaaaa

SEQ ID NO: 17653 - RNA, 32 nt, Human
aaaaaggagacucgagcagauauuaagcaagc

SEQ ID NO: 17654 - RNA, 32 nt, Human
  misc_feature (20)..(20): n is a, c, g or u
aaaaaggagaggaggaaacnagugaggcaggg

SEQ ID NO: 17655 - RNA, 32 nt, Human
aaaaaggagauaaggacacagacacgaacaga

SEQ ID NO: 17656 - RNA, 31 nt, Human
aaaaaggagcugcaugcuucacuggaguuga

SEQ ID NO: 17657 - RNA, 32 nt, Human
aaaaaggaggaaaagaugacuaugauggcuca

SEQ ID NO: 17658 - RNA, 32 nt, Human
aaaaaggauccuguuugcuguguaauccugag

SEQ ID NO: 17659 - RNA, 32 nt, Human
aaaaaggauuccgucuccuucaaagaaguuuu

SEQ ID NO: 17660 - RNA, 32 nt, Human
aaaaaggauucugccucuuuaguccucacugu

SEQ ID NO: 17661 - RNA, 32 nt, Human
aaaaaggcaaaggacuccuacucacauaccca

SEQ ID NO: 17662 - RNA, 32 nt, Human
aaaaaggcaaagggaagccggaagagacugga

SEQ ID NO: 17663 - RNA, 32 nt, Human
aaaaaggcaagccacagaaauguguauagcgc

SEQ ID NO: 17664 - RNA, 32 nt, Human
aaaaaggcacagaagguugucaugggcuguuc

SEQ ID NO: 17665 - RNA, 32 nt, Human
aaaaaggcaguauguuaaaaauuuuagauuau

SEQ ID NO: 17666 - RNA, 32 nt, Human
aaaaaggcauacaggcagcgagcgcuaaggga

SEQ ID NO: 17667 - RNA, 32 nt, Human
aaaaaggccagaauagcugggcccagcaggag

SEQ ID NO: 17668 - RNA, 32 nt, Human
aaaaaggcuggguuugcagggaugaacacauc

SEQ ID NO: 17669 - RNA, 32 nt, Human
aaaaaggcuuccgggcuguccucugcccagug

SEQ ID NO: 17670 - RNA, 32 nt, Human
aaaaagggacacaccccacuucgguaaaagaa

SEQ ID NO: 17671 - RNA, 32 nt, Human
aaaaagggaccacugacguccugcucuacucu

SEQ ID NO: 17672 - RNA, 32 nt, Human
aaaaagggagagagcaggaaagcgagcacagg

SEQ ID NO: 17673 - RNA, 32 nt, Human
aaaaagggagagugagaaagaggaugagaggg

SEQ ID NO: 17674 - RNA, 32 nt, Human
aaaaagggaggagagagaaggagaaaugagaa

SEQ ID NO: 17675 - RNA, 32 nt, Human
aaaaagggaggcaauugagggaaaggccugcu

SEQ ID NO: 17676 - RNA, 32 nt, Human
aaaaagggagugggggaggagguggaggaucc

SEQ ID NO: 17677 - RNA, 32 nt, Human
aaaaagggaugggggaaauggagauggcacgg

SEQ ID NO: 17678 - RNA, 32 nt, Human
aaaaagggcagaugccccauacgugcugcucg

SEQ ID NO: 17679 - RNA, 32 nt, Human
aaaaagggcccucuccagggaagaacccagag

SEQ ID NO: 17680 - RNA, 32 nt, Human
aaaaaggggcagcaggggguguguuuguggac

SEQ ID NO: 17681 - RNA, 32 nt, Human
aaaaagggggaauaugggagggcagagugggg

SEQ ID NO: 17682 - RNA, 32 nt, Human
aaaaaggguaucagauucuauugugacuucau

SEQ ID NO: 17683 - RNA, 32 nt, Human
aaaaaggguguuugggggaacagcugcagacc

SEQ ID NO: 17684 - RNA, 32 nt, Human
aaaaagguauuuuuauauguucuuuuuaacaa

SEQ ID NO: 17685 - RNA, 32 nt, Human
aaaaaggugaaauaagccuacuauaaggaaua

SEQ ID NO: 17686 - RNA, 32 nt, Human
aaaaagguuacuucuugguucucagcugguuc

SEQ ID NO: 17687 - RNA, 32 nt, Human
aaaaagguugucauggcaucucuugcacagua

SEQ ID NO: 17688 - RNA, 32 nt, Human
aaaaaguaaacauuuaaaauuagccaggcaug

SEQ ID NO: 17689 - RNA, 32 nt, Human
aaaaaguaacacccucccuuuuuccugacagu

SEQ ID NO: 17690 - RNA, 32 nt, Human
aaaaaguaagccacugccucuuaccuaaaggu

SEQ ID NO: 17691 - RNA, 32 nt, Human
aaaaaguaagucucucuuccuccuucucaccc

SEQ ID NO: 17692 - RNA, 32 nt, Human
aaaaaguacagaguccagggaaaagacuugcu

SEQ ID NO: 17693 - RNA, 32 nt, Human
aaaaaguagcuguuccuugugccugaggagau

SEQ ID NO: 17694 - RNA, 32 nt, Human
aaaaaguauaggagaaacugaagaauguacac

SEQ ID NO: 17695 - RNA, 32 nt, Human
aaaaaguauauagugacauuuuuaguaugaaa

SEQ ID NO: 17696 - RNA, 32 nt, Human
aaaaagucaagaaacaacagaugcuggcgagg

SEQ ID NO: 17697 - RNA, 32 nt, Human
aaaaagucaagaaccacagcacuugaguuaaa

SEQ ID NO: 17698 - RNA, 32 nt, Human
aaaaagucaccuccauucucuaccucccaugc

SEQ ID NO: 17699 - RNA, 32 nt, Human
aaaaaguccauggcuucuaaaagaggucccug

SEQ ID NO: 17700 - RNA, 32 nt, Human
aaaaaguccaugucuuuuuaucuuuaaaauau

SEQ ID NO: 17701 - RNA, 32 nt, Human
aaaaagucguuuucaguuggguccccagcauu

SEQ ID NO: 17702 - RNA, 32 nt, Human
aaaaagucuaacucuucugcuugucuuuacaa

SEQ ID NO: 17703 - RNA, 32 nt, Human
aaaaagucuuuuguuugugaacacugaugcaa

SEQ ID NO: 17704 - RNA, 32 nt, Human
aaaaagugaacugagaaagaaaaagggaaaau

SEQ ID NO: 17705 - RNA, 32 nt, Human
aaaaagugaagugaaaacaaucagggcacauu

SEQ ID NO: 17706 - RNA, 32 nt, Human
aaaaagugaaugcacacgcccuuguuggcgug

SEQ ID NO: 17707 - RNA, 32 nt, Human
aaaaagugcaagacucaaugaggaaaugacaa

SEQ ID NO: 17708 - RNA, 32 nt, Human
aaaaagugggcuugcuacaucucuguucaaag

SEQ ID NO: 17709 - RNA, 32 nt, Human
aaaaagugggggagguggagggggaggcaggc

SEQ ID NO: 17710 - RNA, 32 nt, Human
aaaaaguguaucuugaccccaccaucaguacu

SEQ ID NO: 17711 - RNA, 32 nt, Human
aaaaagugucuuuugcaaucuugauguaaugc

SEQ ID NO: 17712 - RNA, 32 nt, Human
aaaaaguuaguccuucaugaaaaugaaagacc

SEQ ID NO: 17713 - RNA, 32 nt, Human
aaaaaguuccaucuaaaauaucaugcccagga

SEQ ID NO: 17714 - RNA, 32 nt, Human
aaaaaguugggaggggaacagggaaggaaggg

SEQ ID NO: 17715 - RNA, 32 nt, Human
aaaaaguugucucaguuccucucccaauugca

SEQ ID NO: 17716 - RNA, 32 nt, Human
aaaaaguuuaaaucacauaaaaagccaaucua

SEQ ID NO: 17717 - RNA, 32 nt, Human
aaaaaguuuaagaaauaugaaugugaguggua

SEQ ID NO: 17718 - RNA, 32 nt, Human
aaaaaguuugcuccuccauagauuuuugcugc

SEQ ID NO: 17719 - RNA, 32 nt, Human
aaaaauaaaaacaaaucacucccaagagcuua

SEQ ID NO: 17720 - RNA, 32 nt, Human
aaaaauaaaaacaaauccucaacauuuagaug

SEQ ID NO: 17721 - RNA, 32 nt, Human
aaaaauaaaaugcauuuaaacucauuugagag

SEQ ID NO: 17722 - RNA, 32 nt, Human
aaaaauaaaauugcuaaacaagaaaugaaaac

SEQ ID NO: 17723 - RNA, 22 nt, Human
aaaaauaaaauuuccuucaggu

SEQ ID NO: 17724 - RNA, 21 nt, Human
aaaaauaaacguauguguuca

SEQ ID NO: 17725 - RNA, 20 nt, Human
aaaaauaaagagcagagcuu

SEQ ID NO: 17726 - RNA, 32 nt, Human
aaaaauaaaucacugccaggcuucauucuucc

SEQ ID NO: 17727 - RNA, 23 nt, Human
aaaaauaaauucucccuuccggu

SEQ ID NO: 17728 - RNA, 32 nt, Human
aaaaauaacaggauuuuacagccuucugauga

SEQ ID NO: 17729 - RNA, 32 nt, Human
aaaaauaaccaauuaaaaauggguuaacagau

SEQ ID NO: 17730 - RNA, 32 nt, Human
aaaaauaacugcacugacuuuauaucuuuuga

SEQ ID NO: 17731 - RNA, 32 nt, Human
aaaaauaacuuaacauccuaacuacaagggag

SEQ ID NO: 17732 - RNA, 32 nt, Human
aaaaauaagccgucaaguaguaagaagaacuu

SEQ ID NO: 17733 - RNA, 32 nt, Human
aaaaauaagcuaccauauagcuuauaagucuc

SEQ ID NO: 17734 - RNA, 32 nt, Human
aaaaauaaggaaauuugugagcaggcacaaaa

SEQ ID NO: 17735 - RNA, 32 nt, Human
aaaaauaagugauuucuggggguggggcagaa

SEQ ID NO: 17736 - RNA, 27 nt, Human
aaaaauaaucaauuaauucuauguuaa

SEQ ID NO: 17737 - RNA, 32 nt, Human
aaaaauaaugcuuuucauuugaacuccugugc

SEQ ID NO: 17738 - RNA, 32 nt, Human
aaaaauaauuuaagaggacagaagacugguac

SEQ ID NO: 17739 - RNA, 32 nt, Human
aaaaauacaaaaauuggcugggcaugguggcg

SEQ ID NO: 17740 - RNA, 32 nt, Human
aaaaauacaauguuucaggcuaccacagugaa

SEQ ID NO: 17741 - RNA, 32 nt, Human
aaaaauacacaaauuagccuggugugguggcc

SEQ ID NO: 17742 - RNA, 32 nt, Human
aaaaauacacaaauuagcugcgugugguggcc

SEQ ID NO: 17743 - RNA, 32 nt, Human
aaaaauacagaauuagccaggcaugguggcgu

SEQ ID NO: 17744 - RNA, 32 nt, Human
aaaccagacaaagccgcgagcccagggauggg

SEQ ID NO: 17745 - RNA, 32 nt, Human
aaaccagaccaagaaguauggaggccacagag

SEQ ID NO: 17746 - RNA, 32 nt, Human
aaaccagagcugucuguggagcuguuuuccag

SEQ ID NO: 17747 - RNA, 32 nt, Human
aaaccagaggucaagaaaagcaguccagagau

SEQ ID NO: 17748 - RNA, 22 nt, Human
aaaccagaugcauccucagagg

SEQ ID NO: 17749 - RNA, 32 nt, Human
aaaccagauuugcuugagcugaugcuggaucg

SEQ ID NO: 17750 - RNA, 32 nt, Human
aaaccagcaauuucuuuuuccuuguggucuga

SEQ ID NO: 17751 - RNA, 32 nt, Human
aaaccagcagcgcuugacccagagccagaucc

SEQ ID NO: 17752 - RNA, 24 nt, Human
aaaccagcccaggccucccaggga

SEQ ID NO: 17753 - RNA, 32 nt, Human
aaaccagccggagggcaugcaugugggcugcu

SEQ ID NO: 17754 - RNA, 32 nt, Human
aaaccagccugaccaacauggugaaaccccgu

SEQ ID NO: 17755 - RNA, 32 nt, Human
aaaccagccugaccaaccuggagaaaccccgu

SEQ ID NO: 17756 - RNA, 32 nt, Human
aaaccagccugaccaacguggagaaaccccau

SEQ ID NO: 17757 - RNA, 32 nt, Human
aaaccagccugaccaacguggagaaaccucgu

SEQ ID NO: 17758 - RNA, 32 nt, Human
aaaccagccugaccaauauggugaaaccccuu

SEQ ID NO: 17759 - RNA, 32 nt, Human
aaaccagccugaccuuuccuuuagcauuagau

SEQ ID NO: 17760 - RNA, 32 nt, Human
aaaccagccuggauuucauacauggacuucug

SEQ ID NO: 17761 - RNA, 32 nt, Human
aaaccagccuuuucagcaucucacccauuagc

SEQ ID NO: 17762 - RNA, 32 nt, Human
aaaccagcugauauauucaguacucuggggga

SEQ ID NO: 17763 - RNA, 32 nt, Human
aaaccagcuuuacugccgguucuuggaaaccu

SEQ ID NO: 17764 - RNA, 32 nt, Human
aaaccaggaagaguugggcuguggaaggacau

SEQ ID NO: 17765 - RNA, 32 nt, Human
aaaccaggaaggcagagauugcagugagcuga

SEQ ID NO: 17766 - RNA, 32 nt, Human
aaaccaggaauucacuucccaccccagauaac

SEQ ID NO: 17767 - RNA, 22 nt, Human
aaaccaggacacuacccugaga

SEQ ID NO: 17768 - RNA, 32 nt, Human
aaaccaggacagcugaaucugcuuuuuaacaa

SEQ ID NO: 17769 - RNA, 23 nt, Human
aaaccaggacggccgcccgaaga

SEQ ID NO: 17770 - RNA, 32 nt, Human
aaaccaggacguccccuacaccuacccauggg

SEQ ID NO: 17771 - RNA, 32 nt, Human
aaaccaggaguaaaagagucaagugaccauca

SEQ ID NO: 17772 - RNA, 32 nt, Human
aaaccaggagugaaaaaggaaaguagaaggca

SEQ ID NO: 17773 - RNA, 32 nt, Human
aaaccaggccgacuaacaagguuuccagcagg

SEQ ID NO: 17774 - RNA, 32 nt, Human
aaaccaggcgacaucaugauggaaagaaagaa

SEQ ID NO: 17775 - RNA, 32 nt, Human
aaaccaggcucugccaggcgcaguggcucaug

SEQ ID NO: 17776 - RNA, 32 nt, Human
aaaccaggcugaugccgugcgggcuaaugagc

SEQ ID NO: 17777 - RNA, 23 nt, Human
aaaccaggcuuuaggcccagggg

SEQ ID NO: 17778 - RNA, 32 nt, Human
aaaccagggaggagaagcgggagccagcccuc

SEQ ID NO: 17779 - RNA, 32 nt, Human
aaaccagggcaguucuagaggagugcugguga

SEQ ID NO: 17780 - RNA, 32 nt, Human
aaaccagguauccacacauagcacuuuuauuc

SEQ ID NO: 17781 - RNA, 32 nt, Human
aaaccagguauucugcuacaguuuggagaaaa

SEQ ID NO: 17782 - RNA, 24 nt, Human
aaaccaggucaccauccucagagg

SEQ ID NO: 17783 - RNA, 32 nt, Human
aaaccaggugagugagcccucgugggaucugg

SEQ ID NO: 17784 - RNA, 22 nt, Human
aaaccagguggucaaucaggga

SEQ ID NO: 17785 - RNA, 26 nt, Human
aaaccagguuuuguuccgcccagugg

SEQ ID NO: 17786 - RNA, 32 nt, Human
aaaccagucugaccaacguggagaaaccccgu

SEQ ID NO: 17787 - RNA, 32 nt, Human
aaaccagugcugggacaaagauggggaaggug

SEQ ID NO: 17788 - RNA, 32 nt, Human
aaaccagugggugagaaagacaccuggucagg

SEQ ID NO: 17789 - RNA, 32 nt, Human
aaaccagugggugagaaggacaccuggucaag

SEQ ID NO: 17790 - RNA, 32 nt, Human
aaaccaguguuaaaaugucuuucaaaauuauu

SEQ ID NO: 17791 - RNA, 32 nt, Human
aaaccaguucaagaaagggaugaagguacaac

SEQ ID NO: 17792 - RNA, 32 nt, Human
aaaccaguucacugagaacacaggagcacuuc

SEQ ID NO: 17793 - RNA, 32 nt, Human
aaaccaguucccaaacacagucagacucuucc

SEQ ID NO: 17794 - RNA, 32 nt, Human
aaaccaguuuccuacaaucauuuuggaucacu

SEQ ID NO: 17795 - RNA, 32 nt, Human
aaaccaguuucucuuuucugcauaggaagguc

SEQ ID NO: 17796 - RNA, 32 nt, Human
aaaccauaauuaaaucaccuccuuucauuagg

SEQ ID NO: 17797 - RNA, 32 nt, Human
aaaccauaucauuccucccugggcuccuccaa

SEQ ID NO: 17798 - RNA, 32 nt, Human
aaaccaucaaacauguuccaaaaguaccagau

SEQ ID NO: 17799 - RNA, 32 nt, Human
aaaccaucacauaugaaucaucacaggucgau

SEQ ID NO: 17800 - RNA, 32 nt, Human
aaaccaucaucuagaauagaguuaauuuauua

SEQ ID NO: 17801 - RNA, 32 nt, Human
aaaccaucauucucagcaaacuauugcaagga

SEQ ID NO: 17802 - RNA, 32 nt, Human
aaaccauccagccauuugacacccuuuaugau

SEQ ID NO: 17803 - RNA, 32 nt, Human
aaaccauccaggccaacuccuggucaucccag

SEQ ID NO: 17804 - RNA, 32 nt, Human
aaaccaucccagagaaaauaagggacuuuugc

SEQ ID NO: 17805 - RNA, 32 nt, Human
aaaccaucucagaaaaaggaaaaugggcaauc

SEQ ID NO: 17806 - RNA, 32 nt, Human
aaaccaucucgcacacagcaaugaagguaguc

SEQ ID NO: 17807 - RNA, 32 nt, Human
aaaccaucugcccuccuccccuagcguugccc

SEQ ID NO: 17808 - RNA, 32 nt, Human
aaaccaucuggccccuucguuuugcucagagg

SEQ ID NO: 17809 - RNA, 32 nt, Human
aaaccaugaaauuucaaaaauuacuuggauga

SEQ ID NO: 17810 - RNA, 32 nt, Human
aaaccauggcugcugcuuucugcccagcucgc

SEQ ID NO: 17811 - RNA, 32 nt, Human
aaaccaugggcuauguuaauguccuaaugugu

SEQ ID NO: 17812 - RNA, 32 nt, Human
aaaccauggucugaaaggauuccugcucuggu

SEQ ID NO: 17813 - RNA, 32 nt, Human
aaaccauguauaucuguggaauacucaaugug

SEQ ID NO: 17814 - RNA, 32 nt, Human
aaaccauguguauguuauguuugucuauaaaa

SEQ ID NO: 17815 - RNA, 32 nt, Human
aaaccauguugcguucaaagaggugaacauua

SEQ ID NO: 17816 - RNA, 32 nt, Human
aaaccauuucuucuggcccagaagacaaacuu

SEQ ID NO: 17817 - RNA, 32 nt, Human
aaaccauuuucaccuucugucuccuccauguc

SEQ ID NO: 17818 - RNA, 32 nt, Human
aaacccaaaagggaaagagaaaguggaagaaa

SEQ ID NO: 17819 - RNA, 32 nt, Human
aaacccaaagggggaggguagggcagggcagg

SEQ ID NO: 17820 - RNA, 24 nt, Human
aaacccaaccuccuagagaagcac

SEQ ID NO: 17821 - RNA, 32 nt, Human
aaacccaaccuugccagcuggcccagcuucac

SEQ ID NO: 17822 - RNA, 32 nt, Human
aaacccaagaggcagagguugaguaagcugag

SEQ ID NO: 17823 - RNA, 32 nt, Human
aaacccaaguuugauguuaucuuuggaugugc

SEQ ID NO: 17824 - RNA, 32 nt, Human
aaacccaauccaaauggcgucuggaaguccaa

SEQ ID NO: 17825 - RNA, 19 nt, Human
aaacccacaaagcaucaaa

SEQ ID NO: 17826 - RNA, 32 nt, Human
aaacccacaaugccacacaggacaccgaccaa

SEQ ID NO: 17827 - RNA, 32 nt, Human
aaacccacacacaacaaaaccugauuugggag

SEQ ID NO: 17828 - RNA, 32 nt, Human
aaacccacacaggcacauuccacagggcauuu

SEQ ID NO: 17829 - RNA, 20 nt, Human
aaacccacaccacccugucc

SEQ ID NO: 17830 - RNA, 19 nt, Human
aaacccacaccuccugccc

SEQ ID NO: 17831 - RNA, 32 nt, Human
aaacccacacuuccagggacccuucagcacag

SEQ ID NO: 17832 - RNA, 32 nt, Human
aaacccacaggaugagagaaaagcuuggcgca

SEQ ID NO: 17833 - RNA, 32 nt, Human
aaacccacaggcggagguugcggugggcuggg

SEQ ID NO: 17834 - RNA, 30 nt, Human
aaacccacaguaaacgcaaaguaaaacuuu

SEQ ID NO: 17835 - RNA, 32 nt, Human
aaacccacagucaaggccaggcgcgguggcuc

SEQ ID NO: 17836 - RNA, 32 nt, Human
aaacccacccuccacguuggaaugagauucca

SEQ ID NO: 17837 - RNA, 21 nt, Human
aaacccaccucaccccggcuc

SEQ ID NO: 17838 - RNA, 32 nt, Human
aaacccaccuccuacuccuggcucagaccuuu

SEQ ID NO: 17839 - RNA, 19 nt, Human
aaacccaccugccucugcc

SEQ ID NO: 17840 - RNA, 32 nt, Human
aaacccaccugccucugccaggaacagccaac

SEQ ID NO: 17841 - RNA, 32 nt, Human
aaacccacuaaucacaucccacugacugaccc

SEQ ID NO: 17842 - RNA, 32 nt, Human
aaacccacuagucccagcuccugggguggcac

SEQ ID NO: 17843 - RNA, 31 nt, Human
aaacccagaaagcugccucacagaugcagac

SEQ ID NO: 17844 - RNA, 32 nt, Human
aaacccagaagaggaagaggaaagcaaaggag

SEQ ID NO: 17845 - RNA, 32 nt, Human
aaacccagaagaggagagcaaaggagucagga

SEQ ID NO: 17846 - RNA, 32 nt, Human
aaacccagaaggcagggguugcagugagccaa

SEQ ID NO: 17847 - RNA, 23 nt, Human
aaacccagacccaccuccugccc

SEQ ID NO: 17848 - RNA, 32 nt, Human
aaacccagcacuuugggagacugaggagggca

SEQ ID NO: 17849 - RNA, 32 nt, Human
aaacccagccagacuugcuucuagagguuuaa

SEQ ID NO: 17850 - RNA, 32 nt, Human
aaacccagccauuauuaaaaauuaaaucauag

SEQ ID NO: 17851 - RNA, 18 nt, Human
aaacccagccccuugccc

SEQ ID NO: 17852 - RNA, 32 nt, Human
aaacccagcccugccccugccuccugcaucca

SEQ ID NO: 17853 - RNA, 32 nt, Human
aaacccagcggagggcgggaagaaggaggagg

SEQ ID NO: 17854 - RNA, 32 nt, Human
aaacccagcuacucaggaggcuugaggcggga

SEQ ID NO: 17855 - RNA, 32 nt, Human
aaacccagcuacucaggagguuggggcagaau

SEQ ID NO: 17856 - RNA, 32 nt, Human
aaacccagcuacucgggaggcugaagcaggag

SEQ ID NO: 17857 - RNA, 32 nt, Human
aaacccagcuacucgggagguugaggcaggag

SEQ ID NO: 17858 - RNA, 32 nt, Human
aaacccagcuacugaggaggcugaggcaugag

SEQ ID NO: 17859 - RNA, 32 nt, Human
aaacccagcuacuugggaggcugaggcaggag

SEQ ID NO: 17860 - RNA, 32 nt, Human
aaacccagcuccccucuagaagaaggauucga

SEQ ID NO: 17861 - RNA, 32 nt, Human
aaacccagcugaggccugggccuagacugugg

SEQ ID NO: 17862 - RNA, 32 nt, Human
aaacccagcugcaccccuuccugggcacacgc

SEQ ID NO: 17863 - RNA, 22 nt, Human
aaacccagcuggcuaccagaga

SEQ ID NO: 17864 - RNA, 22 nt, Human
aaacccagcuugcccccagccc

SEQ ID NO: 17865 - RNA, 32 nt, Human
aaacccaggagagaaagacauagcagagaugg

SEQ ID NO: 17866 - RNA, 21 nt, Human
aaacccaggagaguguggaau

SEQ ID NO: 17867 - RNA, 32 nt, Human
aaacccaggaggcaaaggcugcagugagccaa

SEQ ID NO: 17868 - RNA, 32 nt, Human
aaacccaggaggcagagcuugcagugagccga

SEQ ID NO: 17869 - RNA, 32 nt, Human
aaacccaggaggcagagguugcagugagugaa

SEQ ID NO: 17870 - RNA, 32 nt, Human
aaacccaggaggcggagguugcagugagcuga

SEQ ID NO: 17871 - RNA, 32 nt, Human
aaacccaggaggcggagguugcagugaguuga

SEQ ID NO: 17872 - RNA, 32 nt, Human
aaacccaggaggcggugguuguaggaagcugu

SEQ ID NO: 17873 - RNA, 32 nt, Human
aaacccaggagguggagguugaaaugagcuga

SEQ ID NO: 17874 - RNA, 32 nt, Human
aaacccaggagguggagguugcagugagccga

SEQ ID NO: 17875 - RNA, 32 nt, Human
aaacccaggagguggagguugcagugagcuga

SEQ ID NO: 17876 - RNA, 32 nt, Human
aaacccaggaguucaagaccagccuggguaac

SEQ ID NO: 17877 - RNA, 32 nt, Human
aaacccaggcggcagagguugcagugagccaa

SEQ ID NO: 17878 - RNA, 32 nt, Human
aaacccaggcuccugcaggcacuggcacagcu

SEQ ID NO: 17879 - RNA, 32 nt, Human
aaacccaggguuuuguacuuggagaggaaaga

SEQ ID NO: 17880 - RNA, 32 nt, Human
aaacccagguggcggagguugcagugagccga

SEQ ID NO: 17881 - RNA, 32 nt, Human
aaacccagugacgcccuccaccgcuccaccgu

SEQ ID NO: 17882 - RNA, 31 nt, Human
aaacccagugagaggugagggggagugauga

SEQ ID NO: 17883 - RNA, 32 nt, Human
aaacccagugccuccucaacuccugggugggu

SEQ ID NO: 17884 - RNA, 32 nt, Human
aaacccagugguccgggaguucaggauugcau

SEQ ID NO: 17885 - RNA, 32 nt, Human
aaacccauagcauguacagcacaaagcguuug

SEQ ID NO: 17886 - RNA, 32 nt, Human
aaacccaucaucuaaggugacagagcagugcu

SEQ ID NO: 17887 - RNA, 32 nt, Human
aaacccaucuggagaaaacuaaaaagcucagu

SEQ ID NO: 17888 - RNA, 32 nt, Human
aaacccaugaggcaaugucaggaacagaagga

SEQ ID NO: 17889 - RNA, 32 nt, Human
aaaccccaaaaaccucuggugggagauaggaa

SEQ ID NO: 17890 - RNA, 31 nt, Human
aaaccccaaauguccauccacagacgaaugu

SEQ ID NO: 17891 - RNA, 19 nt, Human
aaaccccaacaacaucaag

SEQ ID NO: 17892 - RNA, 32 nt, Human
aaaccccaccuguauuaaaaauacaauaauua

SEQ ID NO: 17893 - RNA, 32 nt, Human
aaaccccacgcggcugucaacugugugcgugg

SEQ ID NO: 17894 - RNA, 32 nt, Human
aaaccccagcuacuugggaggcugaggcacua

SEQ ID NO: 17895 - RNA, 32 nt, Human
aaaccccagcuauuuucugaccaaaauguguu

SEQ ID NO: 17896 - RNA, 32 nt, Human
aaaccccaggagcugaaaagauugcaggauua

SEQ ID NO: 17897 - RNA, 19 nt, Human
aaaccccaucucccugccc

SEQ ID NO: 17898 - RNA, 32 nt, Human
aaaccccaucucuacaaaaauacaaaaauuaa

SEQ ID NO: 17899 - RNA, 32 nt, Human
aaaccccaucucuacaaaaauacaaaaauuag

SEQ ID NO: 17900 - RNA, 32 nt, Human
aaaccccaucucuacaaaaauuagcugggcgu

SEQ ID NO: 17901 - RNA, 32 nt, Human
aaacccccacuuccugccccaggcuggcgcgg

SEQ ID NO: 17902 - RNA, 32 nt, Human
aaacccccaguuccaaacccgagacuucaggc

SEQ ID NO: 17903 - RNA, 32 nt, Human
aaacccccaucuuguccgucuccacucucauc

SEQ ID NO: 17904 - RNA, 32 nt, Human
aaacccccaucuugucugucuccacucucaac

SEQ ID NO: 17905 - RNA, 32 nt, Human
aaacccccaucuugucugucuccacucucauc

SEQ ID NO: 17906 - RNA, 32 nt, Human
aaacccccauuucucauuagugcaaugucaua

SEQ ID NO: 17907 - RNA, 32 nt, Human
aaaccccgaccaccugcccaaccugcucuccu

SEQ ID NO: 17908 - RNA, 32 nt, Human
aaaccccgcaaaucagaguggggaaggugagu

SEQ ID NO: 17909 - RNA, 32 nt, Human
aaaccccgucucuacaaaaauacaaaaaucag

SEQ ID NO: 17910 - RNA, 32 nt, Human
aaaccccgucucuacaaaaauacaaaaauuag

SEQ ID NO: 17911 - RNA, 32 nt, Human
aaaccccgucucuacaaaaauagaaaaauuag

SEQ ID NO: 17912 - RNA, 32 nt, Human
aaaccccguggccaaaaucaauaaccaauuug

SEQ ID NO: 17913 - RNA, 20 nt, Human
aaaccccuaacuggcuggca

SEQ ID NO: 17914 - RNA, 32 nt, Human
aaaccccuacuucugguuuccuuuggaacccc

SEQ ID NO: 17915 - RNA, 32 nt, Human
aaaccccucuucuccccgcccucccccagcuc

SEQ ID NO: 17916 - RNA, 32 nt, Human
aaaccccuggcuuuugugcacacugcauacgu

SEQ ID NO: 17917 - RNA, 32 nt, Human
aaaccccuucuuucucuuuccguccaacaacu

SEQ ID NO: 17918 - RNA, 21 nt, Human
aaacccgacuugccccugccu

SEQ ID NO: 17919 - RNA, 32 nt, Human
aaacccgaggaccgccaccucuucccagugcu

SEQ ID NO: 17920 - RNA, 32 nt, Human
aaacccgcauuggauaucagagcugggagggc

SEQ ID NO: 17921 - RNA, 20 nt, Human
aaacccgccccaaccugcuc

SEQ ID NO: 17922 - RNA, 32 nt, Human
aaacccgcggaaggcgaggugccuggccugcc

SEQ ID NO: 17923 - RNA, 32 nt, Human
aaacccgggaaguggagguugcagugagccaa

SEQ ID NO: 17924 - RNA, 32 nt, Human
aaacccgggaggcagaggcugcagagagccaa

SEQ ID NO: 17925 - RNA, 32 nt, Human
aaacccgggaggcagagguugcagugacccaa

SEQ ID NO: 17926 - RNA, 32 nt, Human
aaacccgggaggcggagauugcagugagccaa

SEQ ID NO: 17927 - RNA, 32 nt, Human
aaacccgggaggcggagcuugcagugagccaa

SEQ ID NO: 17928 - RNA, 32 nt, Human
aaacccgggaggcggagguugcagugagccga

SEQ ID NO: 17929 - RNA, 32 nt, Human
aaacccgggaggugaaggaugcagugagccaa

SEQ ID NO: 17930 - RNA, 32 nt, Human
aaacccgggagguggagcuugcagugagccga

SEQ ID NO: 17931 - RNA, 32 nt, Human
aaacccgggccagagcagcggagcuucccagc

SEQ ID NO: 17932 - RNA, 31 nt, Human
aaacccgggguagguuccaugccaaguaaca

SEQ ID NO: 17933 - RNA, 32 nt, Human
aaacccuaaauuacaguaguuuaaucaaaguu

SEQ ID NO: 17934 - RNA, 32 nt, Human
aaacccuaaggcaccgagcccaaaaggcccca

SEQ ID NO: 17935 - RNA, 31 nt, Human
aaacccuaagugucccaacaguggagcacau

SEQ ID NO: 17936 - RNA, 32 nt, Human
aaacccuaccccucucucucccucucucaauu

SEQ ID NO: 17937 - RNA, 32 nt, Human
aaacccuacuaaaaauacaaaguuagccaggc

SEQ ID NO: 17938 - RNA, 32 nt, Human
aaacccucaaagcagacgugagagggacgguu

SEQ ID NO: 17939 - RNA, 32 nt, Human
aaacccucacagaguuuuccaccaacagggga

SEQ ID NO: 17940 - RNA, 32 nt, Human
aaacccucaccagauaaacuacaguuuguuua

SEQ ID NO: 17941 - RNA, 24 nt, Human
aaacccucacuccuggagauucca

SEQ ID NO: 17942 - RNA, 32 nt, Human
aaacccucagcuuuccgaaggaugggaaauac

SEQ ID NO: 17943 - RNA, 32 nt, Human
aaacccucaugguaguauuuccucuggcagcu

SEQ ID NO: 17944 - RNA, 32 nt, Human
aaacccuccaucauaaggaggaaguuauucaa

SEQ ID NO: 17945 - RNA, 23 nt, Human
aaacccuccccucugagacucca

SEQ ID NO: 17946 - RNA, 32 nt, Human
aaacccuccucaaaguucaaacuuaauuucag

SEQ ID NO: 17947 - RNA, 32 nt, Human
aaacccuccuggaugggauccugcugcccuuu

SEQ ID NO: 17948 - RNA, 32 nt, Human
aaacccucucccaguuccccugcagcucuuca

SEQ ID NO: 17949 - RNA, 32 nt, Human
aaacccucuccuccugcagguucaagcuccuc

SEQ ID NO: 17950 - RNA, 32 nt, Human
aaacccucuggccggguaauaggccugggucc

SEQ ID NO: 17951 - RNA, 32 nt, Human
aaacccucuggggccaucccagcuccagagcc

SEQ ID NO: 17952 - RNA, 32 nt, Human
aaacccucuguggagcuauaagccucuuggac

SEQ ID NO: 17953 - RNA, 32 nt, Human
aaacccugaaacucugauauucccaggaggau

SEQ ID NO: 17954 - RNA, 32 nt, Human
aaacccugaaauacaaaaauuagucaggcaug

SEQ ID NO: 17955 - RNA, 32 nt, Human
aaacccugaacagaggagguggcggugguggc

SEQ ID NO: 17956 - RNA, 32 nt, Human
aaacccugaaucucaucuggggugggggcccu

SEQ ID NO: 17957 - RNA, 18 nt, Human
aaacccugaccccugccc

SEQ ID NO: 17958 - RNA, 32 nt, Human
aaacccugaccuuccugucccugccuucgacc

SEQ ID NO: 17959 - RNA, 32 nt, Human
aaacccugagcuguuucucuguuccacuuucc

SEQ ID NO: 17960 - RNA, 32 nt, Human
aaacccugaugucuggcugaaagccgaagcau

SEQ ID NO: 17961 - RNA, 32 nt, Human
aaacccugcaaacccaaagagaauauuaauac

SEQ ID NO: 17962 - RNA, 32 nt, Human
aaacccugcacucuccccugagcacccacaga

SEQ ID NO: 17963 - RNA, 32 nt, Human
aaacccugcauccauccuuccuccagcaagcc

SEQ ID NO: 17964 - RNA, 32 nt, Human
aaacccugccaccauggugucuugccguacuu

SEQ ID NO: 17965 - RNA, 31 nt, Human
aaacccugcucaggauuccuguugaggagau

SEQ ID NO: 17966 - RNA, 23 nt, Human
aaacccugcugggaucccuuccu

SEQ ID NO: 17967 - RNA, 32 nt, Human
aaacccuggaggcagagguugcagugagccaa

SEQ ID NO: 17968 - RNA, 31 nt, Human
aaacccugggaugucuaaaugccaagaagag

SEQ ID NO: 17969 - RNA, 32 nt, Human
aaacccugggugccaguccaggagcuguggcu

SEQ ID NO: 17970 - RNA, 32 nt, Human
aaacccugucuacaaaaauuagccaggcauga

SEQ ID NO: 17971 - RNA, 32 nt, Human
aaacccugucucuacaaaaauacaaaaauuag

SEQ ID NO: 17972 - RNA, 32 nt, Human
aaacccugugucuugugucuguaguucaaaag

SEQ ID NO: 17973 - RNA, 21 nt, Human
aaacccuuaacugacaugggc

SEQ ID NO: 17974 - RNA, 32 nt, Human
aaacccuuccaaugccuaagugucuuucuccu

SEQ ID NO: 17975 - RNA, 32 nt, Human
aaacccuuccaguucuugccccagggcuggcc

SEQ ID NO: 17976 - RNA, 32 nt, Human
aaacccuucucccaucugccuucccuaucccc

SEQ ID NO: 17977 - RNA, 32 nt, Human
aaacccuugaaaagacaucaagcacagaagga

SEQ ID NO: 17978 - RNA, 21 nt, Human
aaacccuuguccuucuugaua

SEQ ID NO: 17979 - RNA, 32 nt, Human
aaacccuugucugccugacucccccagcuacu

SEQ ID NO: 17980 - RNA, 32 nt, Human
aaacccuuuaccugcagggagaucaggaaaga

SEQ ID NO: 17981 - RNA, 32 nt, Human
aaacccuuucauuccucccugggaaucagggu

SEQ ID NO: 17982 - RNA, 32 nt, Human
aaaccgacgacaaaucuuuuggcagauuuucu

SEQ ID NO: 17983 - RNA, 32 nt, Human
aaaccgacguuucagggaagaggggagagagc

SEQ ID NO: 17984 - RNA, 32 nt, Human
aaaccgacuggagcaggagcugggagaacugg

SEQ ID NO: 17985 - RNA, 23 nt, Human
aaaccgagccagggcugagccgg

SEQ ID NO: 17986 - RNA, 22 nt, Human
aaaccgagcuggggcugggaga

SEQ ID NO: 17987 - RNA, 32 nt, Human
aaaccgaugacuggugggaggagcagcgcugg

SEQ ID NO: 17988 - RNA, 32 nt, Human
aaaccgcauucagugcaccugccucagcuacc

SEQ ID NO: 17989 - RNA, 32 nt, Human
aaaccgcccagaggagcccuauuccacucugg

SEQ ID NO: 17990 - RNA, 32 nt, Human
aaaccgcccccggggcacugugcaguguggcu

SEQ ID NO: 17991 - RNA, 32 nt, Human
aaaccggaaggcagagguugcagugagccaag

SEQ ID NO: 17992 - RNA, 32 nt, Human
aaaccggaccccggaggcaccacccacauccg

SEQ ID NO: 17993 - RNA, 32 nt, Human
aaaccggacccuuuccaucaaggaggcguccu

SEQ ID NO: 17994 - RNA, 32 nt, Human
aaaccggagagggggugggggagccagccucc

SEQ ID NO: 17995 - RNA, 32 nt, Human
aaaccggaugcucagcccuggccuucaaggac

SEQ ID NO: 17996 - RNA, 32 nt, Human
aaaccggccacuucuaguaaaccacgucgugc

SEQ ID NO: 17997 - RNA, 32 nt, Human
aaaccggccugcuuuuuagcuccugggcccua

SEQ ID NO: 17998 - RNA, 32 nt, Human
aaaccgggaggcggagguugaggugagccgaa

SEQ ID NO: 17999 - RNA, 32 nt, Human
aaaccggggaggcggggguugcaaugagcuaa

SEQ ID NO: 18000 - RNA, 32 nt, Human
aaaccgucacccuuuaguuugcuugaacuuua

SEQ ID NO: 18001 - RNA, 32 nt, Human
aaaccguccaggaagggaggcugcagccccga

SEQ ID NO: 18002 - RNA, 32 nt, Human
aaaccgugggaaagacuuaggugucagggccc

SEQ ID NO: 18003 - RNA, 32 nt, Human
aaaccgugggauucugcuuuucauccucugug

SEQ ID NO: 18004 - RNA, 32 nt, Human
aaaccguggggcucucuggggucugggggaau

SEQ ID NO: 18005 - RNA, 18 nt, Human
aaaccuaaagacaucaaa

SEQ ID NO: 18006 - RNA, 32 nt, Human
aaaccuaaaggcugcaggcugccaggugugcu

SEQ ID NO: 18007 - RNA, 32 nt, Human
aaaccuaaguggucucuugucuauuaguuugg

SEQ ID NO: 18008 - RNA, 24 nt, Human
aaaccuaaucaguacagugggaaa

SEQ ID NO: 18009 - RNA, 18 nt, Human
aaaccuacaucccugcuc

SEQ ID NO: 18010 - RNA, 16 nt, Human
aaaccuagacaucaaa

SEQ ID NO: 18011 - RNA, 32 nt, Human
aaaccuagaguuguuucaucugcgccuaaagu

SEQ ID NO: 18012 - RNA, 19 nt, Human
aaaccuagcaagccccugc

SEQ ID NO: 18013 - RNA, 32 nt, Human
aaaccuagcuuguuuuucuccccuuuuuagag

SEQ ID NO: 18014 - RNA, 32 nt, Human
aaaccuaggagcuaaauaaaacagugugugca

SEQ ID NO: 18015 - RNA, 32 nt, Human
aaaccuauggaaccuacugcaaaaagauuguc

SEQ ID NO: 18016 - RNA, 32 nt, Human
aaaccuauuccacuuacauccaaggcacuguc

SEQ ID NO: 18017 - RNA, 32 nt, Human
aaaccuauucuuagcucacaggccauggagaa

SEQ ID NO: 18018 - RNA, 32 nt, Human
aaaccuauugguaaauuacagucagaaaaaga

SEQ ID NO: 18019 - RNA, 21 nt, Human
aaaccuauuucacaaaucaaa

SEQ ID NO: 18020 - RNA, 32 nt, Human
aaaccucaaacaguaccaaaccuuuauacacu

SEQ ID NO: 18021 - RNA, 32 nt, Human
aaaccucaaggccagcucaaugccugguaucu

SEQ ID NO: 18022 - RNA, 32 nt, Human
aaaccucacacagauaaggaccaagggcuggc

SEQ ID NO: 18023 - RNA, 32 nt, Human
aaaccucacaugcauacauacacauauauaca

SEQ ID NO: 18024 - RNA, 32 nt, Human
aaaccucacguccuuaacugugcucucccucc

SEQ ID NO: 18025 - RNA, 19 nt, Human
aaaccucacuaccccuccc

SEQ ID NO: 18026 - RNA, 32 nt, Human
aaaccucacugcaaauuuccucccaucacgaa

SEQ ID NO: 18027 - RNA, 20 nt, Human
aaaccucacugcacaucaga

SEQ ID NO: 18028 - RNA, 32 nt, Human
aaaccucacuggcccguuugcuuuucacgccc

SEQ ID NO: 18029 - RNA, 32 nt, Human
aaaccucacuuuacuuguuaaaagggauauau

SEQ ID NO: 18030 - RNA, 32 nt, Human
aaaccucagguagcuccugaagaucugugcuu

SEQ ID NO: 18031 - RNA, 32 nt, Human
aaaccucauaauucuuaacaccuggcauuucc

SEQ ID NO: 18032 - RNA, 21 nt, Human
aaaccuccaaaacuccugccc

SEQ ID NO: 18033 - RNA, 32 nt, Human
aaaccuccacaauauuuguaugaaagaaaaac

SEQ ID NO: 18034 - RNA, 22 nt, Human
aaaccuccacagcaacaucgaa

SEQ ID NO: 18035 - RNA, 32 nt, Human
aaaccuccagcagucccuaggaugauguagau

SEQ ID NO: 18036 - RNA, 32 nt, Human
aaaccuccagggcaaagcugaagguuucuugg

SEQ ID NO: 18037 - RNA, 32 nt, Human
aaaccuccagugccacaaaauaaagcucaagu

SEQ ID NO: 18038 - RNA, 32 nt, Human
aaaccuccaucuuuucccugucuucauccugu

SEQ ID NO: 18039 - RNA, 32 nt, Human
aaaccuccauuuugaucaucaggauuucaucu

SEQ ID NO: 18040 - RNA, 32 nt, Human
aaaccucccagaggacugugaggaccaugaag

SEQ ID NO: 18041 - RNA, 32 nt, Human
aaaccuccccuccaaacaccuucucacauucu

SEQ ID NO: 18042 - RNA, 32 nt, Human
aaaccuccucagccuucauuuguucguggaug

SEQ ID NO: 18043 - RNA, 32 nt, Human
aaaccucggcaucuucacuugcucgaucugga

SEQ ID NO: 18044 - RNA, 32 nt, Human
aaaccucucaacacagaaggaauacaggagaa

SEQ ID NO: 18045 - RNA, 21 nt, Human
aaaccucucaaggaaaaggac

SEQ ID NO: 18046 - RNA, 32 nt, Human
aaaccucucacagauaagacagaggcccaggg

SEQ ID NO: 18047 - RNA, 24 nt, Human
aaaccucuccccuccaaaaagcac

SEQ ID NO: 18048 - RNA, 32 nt, Human
aaaccucuccugaccccugccuguuggcagcc

SEQ ID NO: 18049 - RNA, 32 nt, Human
aaaccucucugcuagcucuucagucuacaaau

SEQ ID NO: 18050 - RNA, 32 nt, Human
aaaccucugcaucucugaucccuuccuuguua

SEQ ID NO: 18051 - RNA, 32 nt, Human
aaaccucugcuuggcccagcaggagugagggu

SEQ ID NO: 18052 - RNA, 32 nt, Human
aaaccucuguaaccccaacugaaaugaggagc

SEQ ID NO: 18053 - RNA, 22 nt, Human
aaaccucuuaaagaaaaagcau

SEQ ID NO: 18054 - RNA, 19 nt, Human
aaaccucuuccacccaccc

SEQ ID NO: 18055 - RNA, 32 nt, Human
aaaccugaaaaggaaacuacagaaugggaaag

SEQ ID NO: 18056 - RNA, 32 nt, Human
aaaccugaagaaaagaaguuuuagugaagaug

SEQ ID NO: 18057 - RNA, 32 nt, Human
aaaccugaauccagggccuuauaguucuccuc

SEQ ID NO: 18058 - RNA, 31 nt, Human
aaaccugaauggaacaaccuguugagagagc

SEQ ID NO: 18059 - RNA, 32 nt, Human
aaaccugacucugcuucucucauuugucuucc

SEQ ID NO: 18060 - RNA, 32 nt, Human
aaaccugagaggauggcuucagauggagcauc

SEQ ID NO: 18061 - RNA, 32 nt, Human
aaaccugagaggcagagguuacagugagccaa

SEQ ID NO: 18062 - RNA, 32 nt, Human
aaaccugagagguggagguuacagugaguuga

SEQ ID NO: 18063 - RNA, 32 nt, Human
aaaccugagagguggagguugcaguugagcca

SEQ ID NO: 18064 - RNA, 20 nt, Human
aaaccugagcacacaucaga

SEQ ID NO: 18065 - RNA, 30 nt, Human
aaaccugagcccugggcuccaggacaggca

SEQ ID NO: 18066 - RNA, 32 nt, Human
aaaccugagcuaaaaccaaugcaucagcugau

SEQ ID NO: 18067 - RNA, 32 nt, Human
aaaccugaguacauuuacaaagcugcaagugg

SEQ ID NO: 18068 - RNA, 32 nt, Human
aaaccugaugcagucuaaugucucacauucug

SEQ ID NO: 18069 - RNA, 32 nt, Human
aaaccugauugcaaauggcuucagaggucacc

SEQ ID NO: 18070 - RNA, 32 nt, Human
aaaccugcaauauuuuugcucucuucaaaagu

SEQ ID NO: 18071 - RNA, 17 nt, Human
aaaccugcacauccugc

SEQ ID NO: 18072 - RNA, 32 nt, Human
aaaccugcacaugugggcugggcgcgguggcu

SEQ ID NO: 18073 - RNA, 31 nt, Human
aaaccugcacuuucucugauauugguagcag

SEQ ID NO: 18074 - RNA, 31 nt, Human
aaaccugcacuuuuccuugcaugacagguuc

SEQ ID NO: 18075 - RNA, 32 nt, Human
aaaccugcagagcaguggcucccagcuguggc

SEQ ID NO: 18076 - RNA, 32 nt, Human
aaaccugcauucagaucccugccucucugccu

SEQ ID NO: 18077 - RNA, 21 nt, Human
aaaccugccccacucacaccc

SEQ ID NO: 18078 - RNA, 18 nt, Human
aaaccugccccccaaccc

SEQ ID NO: 18079 - RNA, 19 nt, Human
aaaccugcccccucugccu

SEQ ID NO: 18080 - RNA, 21 nt, Human
aaaccugccccuuggcugcuc

SEQ ID NO: 18081 - RNA, 20 nt, Human
aaaccugcccucgggcugcc

SEQ ID NO: 18082 - RNA, 32 nt, Human
aaaccugccuaccucauaggacagcugugagg

SEQ ID NO: 18083 - RNA, 17 nt, Human
aaaccugccuccaagcc

SEQ ID NO: 18084 - RNA, 17 nt, Human
aaaccugccucugugcc

SEQ ID NO: 18085 - RNA, 21 nt, Human
aaaccugccucuugucugccu

SEQ ID NO: 18086 - RNA, 22 nt, Human
aaaccugccugacuuccugcuc

SEQ ID NO: 18087 - RNA, 32 nt, Human
aaaccugccuggcaagguccuucccugggaau

SEQ ID NO: 18088 - RNA, 21 nt, Human
aaaccugccugggcucugccc

SEQ ID NO: 18089 - RNA, 19 nt, Human
aaaccugccuuccuagccc

SEQ ID NO: 18090 - RNA, 32 nt, Human
aaaccugccuuucccauaugcauaggugcacc

SEQ ID NO: 18091 - RNA, 18 nt, Human
aaaccugccuuugugccc

SEQ ID NO: 18092 - RNA, 16 nt, Human
aaaccugccuuuugcc

SEQ ID NO: 18093 - RNA, 32 nt, Human
aaaccugcgaauucaggucaacaauauggccc

SEQ ID NO: 18094 - RNA, 20 nt, Human
aaaccugcgggccccuaacc

SEQ ID NO: 18095 - RNA, 32 nt, Human
aaaccugcguucuccuaccucuuccaacccuc

SEQ ID NO: 18096 - RNA, 32 nt, Human
aaaccugcugcgagggccccucccagaggagc

SEQ ID NO: 18097 - RNA, 20 nt, Human
aaaccugcuggagccugccc

SEQ ID NO: 18098 - RNA, 32 nt, Human
aaaccuggaagaggaagaggaaagcaaaggag

SEQ ID NO: 18099 - RNA, 32 nt, Human
aaaccuggagaugaguuaauuucuuuugagga

SEQ ID NO: 18100 - RNA, 32 nt, Human
aaaccuggagcggucagagcaggauggccaga

SEQ ID NO: 18101 - RNA, 32 nt, Human
aaaccuggagggagacccccaaaacuucucag

SEQ ID NO: 18102 - RNA, 32 nt, Human
aaaccuggaugccaccuggagcugcuuccuga

SEQ ID NO: 18103 - RNA, 32 nt, Human
aaaccuggauuuagauaaugaaaccuuccaca

SEQ ID NO: 18104 - RNA, 32 nt, Human
aaaccuggcacagaaguggacaugcacucgga

SEQ ID NO: 18105 - RNA, 32 nt, Human
aaaccuggccaacauggugaaacccugucucu

SEQ ID NO: 18106 - RNA, 32 nt, Human
aaaccuggcccaggucugggcagaugucuuca

SEQ ID NO: 18107 - RNA, 32 nt, Human
aaaccugggagacggagguugcagugagccaa

SEQ ID NO: 18108 - RNA, 32 nt, Human
aaaccugggaggacccugagggagggucaggg

SEQ ID NO: 18109 - RNA, 32 nt, Human
aaaccugggaggcagaggugagcugagaucgc

SEQ ID NO: 18110 - RNA, 32 nt, Human
aaaccugggaggcgaagauugcagugagcuga

SEQ ID NO: 18111 - RNA, 32 nt, Human
aaaccugggaggcggagaguacagugagccaa

SEQ ID NO: 18112 - RNA, 32 nt, Human
aaaccugggaggcggagcuugcagugagccga

SEQ ID NO: 18113 - RNA, 32 nt, Human
aaaccugggagguggagguugcagugacccga

SEQ ID NO: 18114 - RNA, 32 nt, Human
aaaccugggaguuugaagcugcagugagccau

SEQ ID NO: 18115 - RNA, 32 nt, Human
aaaccugggauguggagguugcagugaacuga

SEQ ID NO: 18116 - RNA, 32 nt, Human
aaaccugguccucuugagguuauauuguggau

SEQ ID NO: 18117 - RNA, 32 nt, Human
aaaccuguauagcauguuacuauccugaaguc

SEQ ID NO: 18118 - RNA, 32 nt, Human
aaaccuguauuuuucuuggcugugccauaauc

SEQ ID NO: 18119 - RNA, 32 nt, Human
aaaccuguccaggaguugugucuuaaaauuga

SEQ ID NO: 18120 - RNA, 32 nt, Human
aaaccugucucccucaggcucaccuuccuaag

SEQ ID NO: 18121 - RNA, 22 nt, Human
aaaccugucuggccccuuaccc

SEQ ID NO: 18122 - RNA, 18 nt, Human
aaaccugugaacccaccc

SEQ ID NO: 18123 - RNA, 32 nt, Human
aaaccugugcagaugcccucucugaacuggcc

SEQ ID NO: 18124 - RNA, 32 nt, Human
aaaccugugccaggcugaauuacagugaaauu

SEQ ID NO: 18125 - RNA, 18 nt, Human
aaaccugugcccaugccc

SEQ ID NO: 18126 - RNA, 32 nt, Human
aaaccugugggugggguugggguggagaagua

SEQ ID NO: 18127 - RNA, 32 nt, Human
aaaccugugguguguggaagugaccacuggga

SEQ ID NO: 18128 - RNA, 32 nt, Human
aaaccuguuagccacuucucugugccauauac

SEQ ID NO: 18129 - RNA, 19 nt, Human
aaaccuguuguccaugccc

SEQ ID NO: 18130 - RNA, 19 nt, Human
aaaccuguugucucugccc

SEQ ID NO: 18131 - RNA, 32 nt, Human
aaaccuuaaaacugaauuuauguagaacacac

SEQ ID NO: 18132 - RNA, 20 nt, Human
aaaccuuacuacacauuaaa

SEQ ID NO: 18133 - RNA, 32 nt, Human
aaaccuuacugguauuguuccacagcacauag

SEQ ID NO: 18134 - RNA, 32 nt, Human
aaaccuuagaggacagcggcugccugucccuu

SEQ ID NO: 18135 - RNA, 32 nt, Human
aaaccuuagcagcuuccaugugguguugagca

SEQ ID NO: 18136 - RNA, 32 nt, Human
aaaccuuauagagugagauuaucauguacaag

SEQ ID NO: 18137 - RNA, 32 nt, Human
aaaccuucagccacaucuuucuuauuaguuua

SEQ ID NO: 18138 - RNA, 32 nt, Human
aaaccuucagccaggaggcuggcaagauggcc

SEQ ID NO: 18139 - RNA, 32 nt, Human
aaaccuucaggauugaaacugagccacacgca

SEQ ID NO: 18140 - RNA, 23 nt, Human
aaaccuucauggauagucuuuaa

SEQ ID NO: 18141 - RNA, 19 nt, Human
aaaccuucauggcaugaaa

SEQ ID NO: 18142 - RNA, 32 nt, Human
aaaccuuccccaggcuggacgugguggcucac

SEQ ID NO: 18143 - RNA, 32 nt, Human
aaaccuucccuccaauccucaccaugucucca

SEQ ID NO: 18144 - RNA, 32 nt, Human
aaaccuugaauccauuagccaggcuugggaug

SEQ ID NO: 18145 - RNA, 32 nt, Human
aaaccuugacauuucaaagacugccuugaaag

SEQ ID NO: 18146 - RNA, 32 nt, Human
aaaccuugagauaggcugggugcgguggcuca

SEQ ID NO: 18147 - RNA, 32 nt, Human
aaaccuugagggggagggugcucuggguuucc

SEQ ID NO: 18148 - RNA, 32 nt, Human
aaaccuugauucucucccuugaaaaacaggga

SEQ ID NO: 18149 - RNA, 32 nt, Human
aaaccuugcaugucaucauagacuucauacug

SEQ ID NO: 18150 - RNA, 18 nt, Human
aaaccuuggcuccuuccu

SEQ ID NO: 18151 - RNA, 32 nt, Human
aaaccuuguauaccaucauagacuucauagug

SEQ ID NO: 18152 - RNA, 32 nt, Human
aaaccuugugcaauuguaaauaaauuguuuag

SEQ ID NO: 18153 - RNA, 21 nt, Human
aaaccuuguuuaaacauuaaa

SEQ ID NO: 18154 - RNA, 32 nt, Human
aaaccuuguuuuuguggugaaggauccuaaag

SEQ ID NO: 18155 - RNA, 32 nt, Human
aaaccuuuaaugcaauccucagucagcaauuu

SEQ ID NO: 18156 - RNA, 19 nt, Human
aaaccuuucacuuuccaaa

SEQ ID NO: 18157 - RNA, 17 nt, Human
aaaccuuucagaaguca

SEQ ID NO: 18158 - RNA, 19 nt, Human
aaaccuuucagauaacaaa

SEQ ID NO: 18159 - RNA, 19 nt, Human
aaaccuuucagcuggcaga

SEQ ID NO: 18160 - RNA, 19 nt, Human
aaaccuuucaggaagucaa

SEQ ID NO: 18161 - RNA, 19 nt, Human
aaaccuuuccuacuucaaa

SEQ ID NO: 18162 - RNA, 32 nt, Human
aaaccuuugcauucauccuccuucuccaagac

SEQ ID NO: 18163 - RNA, 32 nt, Human
aaaccuuugggaucccauuuugaaguccagag

SEQ ID NO: 18164 - RNA, 32 nt, Human
aaaccuuuggucauuuguaagacaucucaugu

SEQ ID NO: 18165 - RNA, 32 nt, Human
aaaccuuugucaggcugggcgcgguggcucac

SEQ ID NO: 18166 - RNA, 32 nt, Human
aaaccuuuucauauacaucuuaccucauuuca

SEQ ID NO: 18167 - RNA, 23 nt, Human
aaaccuuuuccuuuucccuucuu

SEQ ID NO: 18168 - RNA, 21 nt, Human
aaaccuuuuuauauaaucaaa

SEQ ID NO: 18169 - RNA, 18 nt, Human
aaaccuuuuucagucaaa

SEQ ID NO: 18170 - RNA, 32 nt, Human
aaacgaaaaccucacugagcuaaggcuucuga

SEQ ID NO: 18171 - RNA, 32 nt, Human
aaacgaaaagcugggaauaaucacacuguuug

SEQ ID NO: 18172 - RNA, 32 nt, Human
aaacgaaaggaaagcggggaggggaaaacaga

SEQ ID NO: 18173 - RNA, 32 nt, Human
aaacgaaaugggaagaagauggguggagcuau

SEQ ID NO: 18174 - RNA, 32 nt, Human
aaacgaacugaacuagccugguggaaggaggc

SEQ ID NO: 18175 - RNA, 32 nt, Human
aaacgaagcauggcagaucuguccagcacuga

SEQ ID NO: 18176 - RNA, 32 nt, Human
aaacgaagccagacaacagauuuccaucagca

SEQ ID NO: 18177 - RNA, 32 nt, Human
aaacgaagccagccuggaccauacacugccug

SEQ ID NO: 18178 - RNA, 32 nt, Human
aaacgaagcccccuccuguauugacagcuggg

SEQ ID NO: 18179 - RNA, 32 nt, Human
aaacgacugugucacuuugcuuggggaggggg

SEQ ID NO: 18180 - RNA, 32 nt, Human
aaacgagcuggguaaguaggucucagcuguuc

SEQ ID NO: 18181 - RNA, 30 nt, Human
aaacgaggcacugggugugugugcaaagcc

SEQ ID NO: 18182 - RNA, 32 nt, Human
aaacgaggcugcaguggugguaguaggaagau

SEQ ID NO: 18183 - RNA, 32 nt, Human
aaacgagguguuggcagcaccaugcucucucu

SEQ ID NO: 18184 - RNA, 32 nt, Human
aaacgaguccuaauuuacaacagcuagucuuu

SEQ ID NO: 18185 - RNA, 32 nt, Human
aaacgcacaugcccacacagggagccaagucg

SEQ ID NO: 18186 - RNA, 32 nt, Human
aaacgcagagaaaagcuccauucuucccagga

SEQ ID NO: 18187 - RNA, 32 nt, Human
aaacgcagcuuaguugucucagaggacucaca

SEQ ID NO: 18188 - RNA, 32 nt, Human
aaacgcaggagucugcagcugcaaugaacugu

SEQ ID NO: 18189 - RNA, 32 nt, Human
aaacgcaucuggaaaauugauaaagaagcgau

SEQ ID NO: 18190 - RNA, 32 nt, Human
aaacgcauuucaaaugucaaccaggaaggcac

SEQ ID NO: 18191 - RNA, 32 nt, Human
aaacgccacggaggcucccugugggcuccugc

SEQ ID NO: 18192 - RNA, 32 nt, Human
aaacgcccgcugugggcggagccacccgaaag

SEQ ID NO: 18193 - RNA, 32 nt, Human
aaacgcccuccagucugagagcaggggaggga

SEQ ID NO: 18194 - RNA, 32 nt, Human
aaacgcccuuguccccgcccuccugagcuaug

SEQ ID NO: 18195 - RNA, 32 nt, Human
aaacgccgacucuucugcaccauggagccaga

SEQ ID NO: 18196 - RNA, 32 nt, Human
aaacgccugcugcucuugcccuugcccacggg

SEQ ID NO: 18197 - RNA, 32 nt, Human
aaacgccuguaaucccaacuacuugggaggcu

SEQ ID NO: 18198 - RNA, 32 nt, Human
aaacgccuguaggaagaaaaaggaugcauucc

SEQ ID NO: 18199 - RNA, 25 nt, Human
aaacgcgcgggggagccugagccgg

SEQ ID NO: 18200 - RNA, 32 nt, Human
aaacgcggugcuguugaguggguugccacugc

SEQ ID NO: 18201 - RNA, 32 nt, Human
aaacgcgugaugaagacagaaggcuccggggu

SEQ ID NO: 18202 - RNA, 32 nt, Human
aaacgcuaagaaaagggaguaggaagaacaag

SEQ ID NO: 18203 - RNA, 32 nt, Human
aaacgcugggauuacagucaugagccaccgug

SEQ ID NO: 18204 - RNA, 32 nt, Human
aaacgcuggggcgcccacccuggcagacuaac

SEQ ID NO: 18205 - RNA, 32 nt, Human
aaacgcuugaaccugggaggcugagcuugcag

SEQ ID NO: 18206 - RNA, 32 nt, Human
aaacggaaaacugcuguuuaagagaaaucuga

SEQ ID NO: 18207 - RNA, 32 nt, Human
aaacggaaguggccgucgguggcagguuuggg

SEQ ID NO: 18208 - RNA, 32 nt, Human
aaacggacugaggccaaugagaacagauggau

SEQ ID NO: 18209 - RNA, 32 nt, Human
aaacggagaacugcucucuuuaauuauuucaa

SEQ ID NO: 18210 - RNA, 32 nt, Human
aaacggagcccaucuaaccaaugcccagcaca

SEQ ID NO: 18211 - RNA, 32 nt, Human
aaacggagccugacacaugagcagucuuauua

SEQ ID NO: 18212 - RNA, 32 nt, Human
aaacggaggaagguucucuuugcgcuugccuu

SEQ ID NO: 18213 - RNA, 32 nt, Human
aaacggauagaacaggauuuucuaggaguuac

SEQ ID NO: 18214 - RNA, 32 nt, Human
aaacggcaacacacucaccuccauccaagaca

SEQ ID NO: 18215 - RNA, 32 nt, Human
aaacggccccacccuuaucucccuucacugac

SEQ ID NO: 18216 - RNA, 32 nt, Human
aaacggcgugcauggcaugcacguucagacag

SEQ ID NO: 18217 - RNA, 32 nt, Human
aaacggcugcagcuccugcccccaagccggcc

SEQ ID NO: 18218 - RNA, 32 nt, Human
aaacgggagcuguggaccacaggccagccagu

SEQ ID NO: 18219 - RNA, 32 nt, Human
aaacgggaggcggagguugcagugagccgaaa

SEQ ID NO: 18220 - RNA, 32 nt, Human
aaacggggagaaggguugaguuuucaugaaua

SEQ ID NO: 18221 - RNA, 32 nt, Human
aaacggggagaaugugugugagacagagugug

SEQ ID NO: 18222 - RNA, 32 nt, Human
aaacggggaggcagagggaggagggaaggcug

SEQ ID NO: 18223 - RNA, 32 nt, Human
aaacgggucguggagcuccgcaccacucccgc

SEQ ID NO: 18224 - RNA, 32 nt, Human
aaacggguggugugucucaggacaaaaggagg

SEQ ID NO: 18225 - RNA, 32 nt, Human
aaacgguagagugcuuggcugggcgcaguggc

SEQ ID NO: 18226 - RNA, 32 nt, Human
aaacggucuagugguggagcuguggggcugug

SEQ ID NO: 18227 - RNA, 32 nt, Human
aaacggugccuucagccacauccucugaauug

SEQ ID NO: 18228 - RNA, 32 nt, Human
aaacguaaaauacuuacuccauuuuuccugau

SEQ ID NO: 18229 - RNA, 32 nt, Human
aaacguacaccccaucuuuaacuccacagacc

SEQ ID NO: 18230 - RNA, 32 nt, Human
aaacgucaccuugccauacauucuguuucaac

SEQ ID NO: 18231 - RNA, 32 nt, Human
aaacgucaguuccuguaacauuaccuccacac

SEQ ID NO: 18232 - RNA, 32 nt, Human
aaacgucaugccaguaagccuccuguucaacu

SEQ ID NO: 18233 - RNA, 32 nt, Human
aaacguccggcucuucucaggccagguggcug

SEQ ID NO: 18234 - RNA, 32 nt, Human
aaacgucuucuugccaagcucauucuuagaac

SEQ ID NO: 18235 - RNA, 32 nt, Human
aaacgugaaaggcuguggcaucaggguagggg

SEQ ID NO: 18236 - RNA, 32 nt, Human
aaacgugaggacucaggaaaaauaaauaaaua

SEQ ID NO: 18237 - RNA, 32 nt, Human
aaacgugccugauccuguggcugggucccagg

SEQ ID NO: 18238 - RNA, 32 nt, Human
aaacgugccugcuucacuuucugccaugauuu

SEQ ID NO: 18239 - RNA, 32 nt, Human
aaacguggacguuguuuucugccuucccagga

SEQ ID NO: 18240 - RNA, 32 nt, Human
aaacguggcagagggcaagacgggcacucaca

SEQ ID NO: 18241 - RNA, 32 nt, Human
aaacguggcuggagagagaagugggagggagg

SEQ ID NO: 18242 - RNA, 32 nt, Human
aaacguguuuguauuguaggugguguuuguau

SEQ ID NO: 18243 - RNA, 32 nt, Human
aaacguucaugucauuuuagaggauuauaugg

SEQ ID NO: 18244 - RNA, 32 nt, Human
aaacguuccgcugagagcagggugggggcagc

SEQ ID NO: 18245 - RNA, 32 nt, Human
aaacguugauauucuuaaguaccauuucugau

SEQ ID NO: 18246 - RNA, 32 nt, Human
aaacguuuuaacaucuggagccuuugugggug

SEQ ID NO: 18247 - RNA, 32 nt, Human
aaacguuuuacaugaucugauacaaccauuaa

SEQ ID NO: 18248 - RNA, 32 nt, Human
aaacguuuucccuccuuuaauauugauaaagu

SEQ ID NO: 18249 - RNA, 32 nt, Human
aaacuaaaaaccagcagacaccccugaagaau

SEQ ID NO: 18250 - RNA, 21 nt, Human
aaacuaaaacaaaacagaaca

SEQ ID NO: 18251 - RNA, 32 nt, Human
aaacuaaaaccucgguggaaaagcuuuaaauu

SEQ ID NO: 18252 - RNA, 32 nt, Human
aaacuaaccaacaugcagcacaagaaggggag

SEQ ID NO: 18253 - RNA, 32 nt, Human
aaacuaaccagcugggauuacagguaugagcc

SEQ ID NO: 18254 - RNA, 32 nt, Human
aaacuaacuagcaaagacaaaaauucaggcag

SEQ ID NO: 18255 - RNA, 32 nt, Human
aaacuaagaugcacaaugucuccuucagguga

SEQ ID NO: 18256 - RNA, 23 nt, Human
aaacuaagcucaccaacaucaaa

SEQ ID NO: 18257 - RNA, 24 nt, Human
aaacuaaggcacuucacuuagaga

SEQ ID NO: 18258 - RNA, 32 nt, Human
aaacuaaggcucaggaggcuugagacuugcua

SEQ ID NO: 18259 - RNA, 32 nt, Human
aaacuaaggugaugagauauacaucuucuucc

SEQ ID NO: 18260 - RNA, 23 nt, Human
aaacuaaguauguuuauucaaga

SEQ ID NO: 18261 - RNA, 24 nt, Human
aaacuaagugcuuggaccuggaga

SEQ ID NO: 18262 - RNA, 32 nt, Human
aaacuaaguucaggggccauggaaaaugaaaa

SEQ ID NO: 18263 - RNA, 32 nt, Human
aaacuaauacaaaaugauggccauucaugugc

SEQ ID NO: 18264 - RNA, 32 nt, Human
aaacuaaucugucagguucacugguacauaaa

SEQ ID NO: 18265 - RNA, 32 nt, Human
aaacuaauggaaggcagacuauuuacagcuua

SEQ ID NO: 18266 - RNA, 32 nt, Human
aaacuaaugugucucaggcucaaguuuuuaua

SEQ ID NO: 18267 - RNA, 32 nt, Human
aaacuaauuauucaacaguacauaauuaagca

SEQ ID NO: 18268 - RNA, 32 nt, Human
aaacuaauuuggaagaagagugaggacaaaau

SEQ ID NO: 18269 - RNA, 32 nt, Human
aaacuacaaaccugaagaugugacaaugauuu

SEQ ID NO: 18270 - RNA, 32 nt, Human
aaacuacaaaccugagagaggcgcuaaugcuu

SEQ ID NO: 18271 - RNA, 32 nt, Human
aaacuacaaauuagggugggaaaagcucugua

SEQ ID NO: 18272 - RNA, 32 nt, Human
aaacuacaccuccacccacugggcugaagacc

SEQ ID NO: 18273 - RNA, 32 nt, Human
aaacuacagcuuagaaaacaccagagaguuca

SEQ ID NO: 18274 - RNA, 32 nt, Human
aaacuacaggcacaugccaccaugcccagcug

SEQ ID NO: 18275 - RNA, 32 nt, Human
aaacuaccaaaccaguggaugaagaccacuaa

SEQ ID NO: 18276 - RNA, 32 nt, Human
aaacuaccaagcucucccuuaucaagugaaua

SEQ ID NO: 18277 - RNA, 21 nt, Human
aaacuaccaucuccccugccc

SEQ ID NO: 18278 - RNA, 32 nt, Human
aaacuaccgucauucugcucauguuucuucuu

SEQ ID NO: 18279 - RNA, 32 nt, Human
aaacuaccgugagacaucacuucaccccgguu

SEQ ID NO: 18280 - RNA, 32 nt, Human
aaacuaccuaaccuuggcugugggccgauaau

SEQ ID NO: 18281 - RNA, 32 nt, Human
aaacuaccuaggaggcagaagcuaagugauuu

SEQ ID NO: 18282 - RNA, 32 nt, Human
aaacuacucacuucuuuauuucauccuuucga

SEQ ID NO: 18283 - RNA, 32 nt, Human
aaacuacucccugcuacucauugagacugguu

SEQ ID NO: 18284 - RNA, 32 nt, Human
aaacuacugagaugauaacugugaaauauuug

SEQ ID NO: 18285 - RNA, 32 nt, Human
aaacuacugcaacccucacauccucaaaggga

SEQ ID NO: 18286 - RNA, 32 nt, Human
aaacuacuugaauaguauuuugcugaagagca

SEQ ID NO: 18287 - RNA, 32 nt, Human
aaacuagaauacugcuagucucccaaguccug

SEQ ID NO: 18288 - RNA, 32 nt, Human
aaacuagacacauagaucaaugggacggauga

SEQ ID NO: 18289 - RNA, 32 nt, Human
aaacuagagacucaaagagggagugcauuuau

SEQ ID NO: 18290 - RNA, 32 nt, Human
aaacuagagaugggauuugggggugaauuugu

SEQ ID NO: 18291 - RNA, 22 nt, Human
aaacuagaguauucauccaggg

SEQ ID NO: 18292 - RNA, 32 nt, Human
aaacuagaucauuaacacugcgccugccccuc

SEQ ID NO: 18293 - RNA, 32 nt, Human
aaacuagaugcagaggaggucuugccagcacu

SEQ ID NO: 18294 - RNA, 32 nt, Human
aaacuagcucccagcccccauggggcagcagc

SEQ ID NO: 18295 - RNA, 32 nt, Human
aaacuaggaauugcagucugaggaucauuuag

SEQ ID NO: 18296 - RNA, 32 nt, Human
aaacuaggagucaaggaggacguggggagcug

SEQ ID NO: 18297 - RNA, 32 nt, Human
aaacuaggcuacauuucaaaauucagggcugu

SEQ ID NO: 18298 - RNA, 32 nt, Human
aaacuagggaaacuaguucuuugguuaaugaa

SEQ ID NO: 18299 - RNA, 32 nt, Human
aaacuagguccacuaucaacaggcuacuuacu

SEQ ID NO: 18300 - RNA, 32 nt, Human
aaacuaucaacaacaaggaagucugcucugua

SEQ ID NO: 18301 - RNA, 32 nt, Human
aaacuaucaccugggcuggagugcgauggcau

SEQ ID NO: 18302 - RNA, 32 nt, Human
aaacuaucaguauuuuacagauguuuuaauua

SEQ ID NO: 18303 - RNA, 32 nt, Human
aaacuaucucaaaucaccugaacaucaaguga

SEQ ID NO: 18304 - RNA, 32 nt, Human
aaacuauggaauugagggcacauccuuugugu

SEQ ID NO: 18305 - RNA, 32 nt, Human
aaacuauggcauggacaguaaggauucagaag

SEQ ID NO: 18306 - RNA, 32 nt, Human
aaacuauggcauggacaguaaggauucagagg

SEQ ID NO: 18307 - RNA, 32 nt, Human
aaacuauucacucaaauaauuaguaacugaua

SEQ ID NO: 18308 - RNA, 32 nt, Human
aaacuauugccugagaaaaagagggagacagg

SEQ ID NO: 18309 - RNA, 32 nt, Human
aaacuauuuaguaagaaucaacagugacuguc

SEQ ID NO: 18310 - RNA, 32 nt, Human
aaacuauuugagcuauacacaaaaagaaauuu

SEQ ID NO: 18311 - RNA, 32 nt, Human
aaacuauuuguucaaagaacccguuaguguug

SEQ ID NO: 18312 - RNA, 32 nt, Human
aaacuauuuugcagcauagcuacuuucagaau

SEQ ID NO: 18313 - RNA, 32 nt, Human
aaacuauuuugcaugcugcugcagccuuuaaa

SEQ ID NO: 18314 - RNA, 32 nt, Human
aaacucaaaagaaugcaacuguuugugucuca

SEQ ID NO: 18315 - RNA, 32 nt, Human
aaacucaaaaucaaaagacuuagcuucuagga

SEQ ID NO: 18316 - RNA, 32 nt, Human
aaacucaaaauggauucuuaggagcauuuuag

SEQ ID NO: 18317 - RNA, 32 nt, Human
aaacucaaauauuccuccuaucugcaccaaaa

SEQ ID NO: 18318 - RNA, 32 nt, Human
aaacucaaccaccaccugcagcuugucuccgg

SEQ ID NO: 18319 - RNA, 32 nt, Human
aaacucaagaaugauuuuucuaaaaauaugag

SEQ ID NO: 18320 - RNA, 32 nt, Human
aaacucaagacccauccucccgcugucacuuu

SEQ ID NO: 18321 - RNA, 32 nt, Human
aaacucaagccuugccuuuuaggaggccacca

SEQ ID NO: 18322 - RNA, 32 nt, Human
aaacucacaaauggagauugcaaagucuuggg

SEQ ID NO: 18323 - RNA, 32 nt, Human
aaacucacaaauggugugcuauucuugggcaa

SEQ ID NO: 18324 - RNA, 32 nt, Human
aaacucacacuucucaggguuaggugucagaa

SEQ ID NO: 18325 - RNA, 32 nt, Human
aaacucacccauaacagagagcagugucuccc

SEQ ID NO: 18326 - RNA, 32 nt, Human
aaacucaccucuacucuguauuuucuacaguu

SEQ ID NO: 18327 - RNA, 32 nt, Human
aaacucacgaagcagaggcugggcgugguggc

SEQ ID NO: 18328 - RNA, 32 nt, Human
aaacucacgcugcuccagccugaggcuuccag

SEQ ID NO: 18329 - RNA, 32 nt, Human
aaacucacucaguaucaugacaacagcauggg

SEQ ID NO: 18330 - RNA, 32 nt, Human
aaacucagacagggagggcgcagggccagaac

SEQ ID NO: 18331 - RNA, 21 nt, Human
aaacucagagggaacugagau

SEQ ID NO: 18332 - RNA, 32 nt, Human
aaacucagaggugauuggggagacugacacag

SEQ ID NO: 18333 - RNA, 32 nt, Human
aaacucagaucaucucgcccacccuggagagu

SEQ ID NO: 18334 - RNA, 32 nt, Human
aaacucagccuucaggacucuguccuccagca

SEQ ID NO: 18335 - RNA, 32 nt, Human
aaacucaggcagaaagcaaugaagaagaauua

SEQ ID NO: 18336 - RNA, 32 nt, Human
aaacucaggcccugccuuucugcuacacaauu

SEQ ID NO: 18337 - RNA, 32 nt, Human
aaacucaggcuggaauacacuggcauggucau

SEQ ID NO: 18338 - RNA, 32 nt, Human
aaacucaguaccugcugacccaggaccuacaa

SEQ ID NO: 18339 - RNA, 30 nt, Human
aaacucaguccguccaugcucuguggcauu

SEQ ID NO: 18340 - RNA, 32 nt, Human
aaacucagugaccucugccucucccacauucc

SEQ ID NO: 18341 - RNA, 32 nt, Human
aaacucaguggauaagcaucuuugucauauuu

SEQ ID NO: 18342 - RNA, 32 nt, Human
aaacucauagcacauccuccaguuacauggca

SEQ ID NO: 18343 - RNA, 32 nt, Human
aaacucauaugcagauggucucagaguucuau

SEQ ID NO: 18344 - RNA, 32 nt, Human
aaacucaucugauccuuucaucagcccuagag

SEQ ID NO: 18345 - RNA, 32 nt, Human
aaacucaugaacagugggucuugaugagcuuc

SEQ ID NO: 18346 - RNA, 32 nt, Human
aaacuccaaccagucacccaaccagagccucu

SEQ ID NO: 18347 - RNA, 18 nt, Human
aaacuccaaccccugccc

SEQ ID NO: 18348 - RNA, 32 nt, Human
aaacuccacaugguuccugccugcucauuucc

SEQ ID NO: 18349 - RNA, 32 nt, Human
aaacuccaccuauuuugcaaacaaacuuauuc

SEQ ID NO: 18350 - RNA, 32 nt, Human
aaacuccagaaaucuugucuguccucggaaga

SEQ ID NO: 18351 - RNA, 32 nt, Human
aaacuccagaggauaaguuuacacuuaacaag

SEQ ID NO: 18352 - RNA, 32 nt, Human
aaacuccagaguuggagccaggguucacagcc

SEQ ID NO: 18353 - RNA, 32 nt, Human
aaacuccagaugggcagaaggcagggugcaca

SEQ ID NO: 18354 - RNA, 32 nt, Human
aaacuccagccaggcuguacaggaagcauggc

SEQ ID NO: 18355 - RNA, 32 nt, Human
aaacuccagccauccuggaguugauauucacc

SEQ ID NO: 18356 - RNA, 32 nt, Human
aaacuccaggaggcggaggaggcuaguggcag

SEQ ID NO: 18357 - RNA, 32 nt, Human
aaacuccagggaccucuauccuccaggagucu

SEQ ID NO: 18358 - RNA, 32 nt, Human
aaacuccagucguggcuaaaaggggccacaua

SEQ ID NO: 18359 - RNA, 32 nt, Human
aaacuccauccagcuaagcgaucuugaacaag

SEQ ID NO: 18360 - RNA, 32 nt, Human
aaacuccaugaagacuuuugcagccaguuccc

SEQ ID NO: 18361 - RNA, 32 nt, Human
aaacuccauguuaguccucuuagaugacugcu

SEQ ID NO: 18362 - RNA, 28 nt, Human
aaacucccaaguguguucuuaucccaug

SEQ ID NO: 18363 - RNA, 32 nt, Human
aaacucccagaggugucagagguggcugugcc

SEQ ID NO: 18364 - RNA, 32 nt, Human
aaacucccagcagccccuacagagguggcaca

SEQ ID NO: 18365 - RNA, 32 nt, Human
aaacucccagccgccucauggcaaaugcccaa

SEQ ID NO: 18366 - RNA, 31 nt, Human
aaacuccccaugaucugacaugcagaaaucc

SEQ ID NO: 18367 - RNA, 32 nt, Human
aaacuccccgucccauauccugccucagcccg

SEQ ID NO: 18368 - RNA, 32 nt, Human
aaacuccccuaaaccacacacaggagagagcg

SEQ ID NO: 18369 - RNA, 32 nt, Human
aaacuccccugagaccuuacuccuuccagccc

SEQ ID NO: 18370 - RNA, 32 nt, Human
aaacucccgcagacuucucuguagaucgcuga

SEQ ID NO: 18371 - RNA, 32 nt, Human
aaacucccuucucuccccuguaacugcucauc

SEQ ID NO: 18372 - RNA, 32 nt, Human
aaacuccucaaguucaucuggcucagacaacc

SEQ ID NO: 18373 - RNA, 32 nt, Human
aaacuccuccuugagcacacaccuucucucaa

SEQ ID NO: 18374 - RNA, 32 nt, Human
aaacuccucuggagguuguuuuugaaagaaac

SEQ ID NO: 18375 - RNA, 21 nt, Human
aaacuccugaccucaagugau

SEQ ID NO: 18376 - RNA, 32 nt, Human
aaacuccugaccucaugauuugccugccucgg

SEQ ID NO: 18377 - RNA, 32 nt, Human
aaacuccugccguccugcgccugcuggggccu

SEQ ID NO: 18378 - RNA, 32 nt, Human
aaacuccugccugcccuccagacugucugccc

SEQ ID NO: 18379 - RNA, 32 nt, Human
aaacuccugggcugauuaauagugggauagca

SEQ ID NO: 18380 - RNA, 32 nt, Human
aaacuccuggguucaagccucagccugccaaa

SEQ ID NO: 18381 - RNA, 32 nt, Human
aaacuccuucugcgggaaggagagaaggagaa

SEQ ID NO: 18382 - RNA, 24 nt, Human
aaacuccuuggucaccugcuccaa

SEQ ID NO: 18383 - RNA, 32 nt, Human
aaacucgaauguuugguuagcaaccaagccua

SEQ ID NO: 18384 - RNA, 32 nt, Human
aaacucgcacacuaucuguggaacucauuuaa

SEQ ID NO: 18385 - RNA, 32 nt, Human
aaacucggacugcucucgucugccgugugguu

SEQ ID NO: 18386 - RNA, 32 nt, Human
aaacucggccucaaguugcgcccucuagguag

SEQ ID NO: 18387 - RNA, 32 nt, Human
aaacucgggagguagagguugcagugagccaa

SEQ ID NO: 18388 - RNA, 32 nt, Human
aaacucgggcaaguacugcagcuauuuggaaa

SEQ ID NO: 18389 - RNA, 32 nt, Human
aaacucgucucucggccuuucucuccugccuu

SEQ ID NO: 18390 - RNA, 32 nt, Human
aaacucgucugauguuuugaugccauuugucu

SEQ ID NO: 18391 - RNA, 32 nt, Human
aaacucgugggggauuuuugcauguauaagau

SEQ ID NO: 18392 - RNA, 32 nt, Human
aaacucgugguuuuucucucauuuucuucccu

SEQ ID NO: 18393 - RNA, 32 nt, Human
aaacucguuggaucaagagauccucccacugu

SEQ ID NO: 18394 - RNA, 32 nt, Human
aaacucuacuauauagcaguaauaucaaaagu

SEQ ID NO: 18395 - RNA, 32 nt, Human
aaacucuagaaacucuuuaucuucucaucuua

SEQ ID NO: 18396 - RNA, 32 nt, Human
aaacucuagugagacaaggcuugcuguuucua

SEQ ID NO: 18397 - RNA, 32 nt, Human
aaacucucacagucuuaaaccgugccaaaguc

SEQ ID NO: 18398 - RNA, 32 nt, Human
aaacucucaccgcagcugccagcccccugugc

SEQ ID NO: 18399 - RNA, 32 nt, Human
aaacucuccagccacucucuucuacgcugccu

SEQ ID NO: 18400 - RNA, 32 nt, Human
aaacucucucuuccuuucucucugccuguccc

SEQ ID NO: 18401 - RNA, 32 nt, Human
aaacucucugaaccccucccuccaucguuuuc

SEQ ID NO: 18402 - RNA, 32 nt, Human
aaacucucuuuccccauuucuaucucccagcc

SEQ ID NO: 18403 - RNA, 32 nt, Human
aaacucugacaaaggcuuuuccuuauagaaua

SEQ ID NO: 18404 - RNA, 32 nt, Human
aaacucugaggguggagccaggaagcuguguu

SEQ ID NO: 18405 - RNA, 32 nt, Human
aaacucugauguaacuucuucuaccucugaag

SEQ ID NO: 18406 - RNA, 32 nt, Human
aaacucugcauccuucucuaacaacgugacua

SEQ ID NO: 18407 - RNA, 32 nt, Human
aaacucugcccaacaggagagaucuaguuuuc

SEQ ID NO: 18408 - RNA, 32 nt, Human
aaacucugccucaggauuacagugccaacucc

SEQ ID NO: 18409 - RNA, 32 nt, Human
aaacucugggccuucagaugucacccuaaucc

SEQ ID NO: 18410 - RNA, 32 nt, Human
aaacucuggugaggguggugcagaucaucaug

SEQ ID NO: 18411 - RNA, 32 nt, Human
aaacucugguuaggagaaagauaagaaaaucu

SEQ ID NO: 18412 - RNA, 32 nt, Human
aaacucuguggaggaggaagaugggagcugau

SEQ ID NO: 18413 - RNA, 32 nt, Human
aaacucuguguguuuagggaguauacaaaaga

SEQ ID NO: 18414 - RNA, 32 nt, Human
aaacucuguuuuaagguugagaaaguuucaag

SEQ ID NO: 18415 - RNA, 32 nt, Human
aaacucuuaaggcuacugagauagaacgaaga

SEQ ID NO: 18416 - RNA, 32 nt, Human
aaacucuucaaggccaaggaacaguggucuaa

SEQ ID NO: 18417 - RNA, 32 nt, Human
aaacucuucuucuuccccaucaggaccauuuu

SEQ ID NO: 18418 - RNA, 32 nt, Human
aaacucuugacagaagcugugacaaccagaaa

SEQ ID NO: 18419 - RNA, 32 nt, Human
aaacucuugccagauaaccaguuucaugaacu

SEQ ID NO: 18420 - RNA, 32 nt, Human
aaacucuugcccauauuucaagccucuucagc

SEQ ID NO: 18421 - RNA, 32 nt, Human
aaacucuugucaagaauggcccagaggaaugc

SEQ ID NO: 18422 - RNA, 20 nt, Human
aaacucuuucuauaaagggu

SEQ ID NO: 18423 - RNA, 32 nt, Human
aaacucuuugaagauguuccaggauuuagcac

SEQ ID NO: 18424 - RNA, 32 nt, Human
aaacucuuuuugaucgacuuugcuuaaugggu

SEQ ID NO: 18425 - RNA, 32 nt, Human
aaacugaaaaacaauccaguaaauguacuuug

SEQ ID NO: 18426 - RNA, 22 nt, Human
aaacugaaagcugagcgugaac

SEQ ID NO: 18427 - RNA, 22 nt, Human
aaacugaaagcugagugugaac

SEQ ID NO: 18428 - RNA, 32 nt, Human
aaacugaaaggagauuuugauuaaaauuuugc

SEQ ID NO: 18429 - RNA, 32 nt, Human
aaacugaacaagccaccugccuucccugagac

SEQ ID NO: 18430 - RNA, 32 nt, Human
aaacugaagaccaagaaaacuuggacgguggu

SEQ ID NO: 18431 - RNA, 32 nt, Human
aaacugaagagccugaguuacucucauggcuu

SEQ ID NO: 18432 - RNA, 32 nt, Human
aaacugaaguuagcugggugugguggcucaug

SEQ ID NO: 18433 - RNA, 32 nt, Human
aaacugaauugacaaaugcauuguaacuacaa

SEQ ID NO: 18434 - RNA, 21 nt, Human
aaacugaauuuucacccccca

SEQ ID NO: 18435 - RNA, 32 nt, Human
aaacugacaagaaaaucugaccuucauccaua

SEQ ID NO: 18436 - RNA, 32 nt, Human
aaacugacagcucugagcuguggccuuaccuu

SEQ ID NO: 18437 - RNA, 32 nt, Human
aaacugacaugcccucccuucucccuggaucu

SEQ ID NO: 18438 - RNA, 32 nt, Human
aaacugaccucuuccuccuggcuaaauaaauu

SEQ ID NO: 18439 - RNA, 32 nt, Human
aaacugacuaaggucagagguggcuuucugag

SEQ ID NO: 18440 - RNA, 32 nt, Human
aaacugacuacacauacauaauacugcauuuu

SEQ ID NO: 18441 - RNA, 21 nt, Human
aaacugacucucaacaucaaa

SEQ ID NO: 18442 - RNA, 32 nt, Human
aaacugagacccagaaagguggaagcacuugu

SEQ ID NO: 18443 - RNA, 32 nt, Human
aaacugagaggcuacuuccuggggccacacag

SEQ ID NO: 18444 - RNA, 32 nt, Human
aaacugagauguagccccucuccuggaagugc

SEQ ID NO: 18445 - RNA, 32 nt, Human
aaacugagcagcgccaacucccugccagcggg

SEQ ID NO: 18446 - RNA, 32 nt, Human
aaacugagcagcugccggacgccugggucagg

SEQ ID NO: 18447 - RNA, 32 nt, Human
aaacugagcaggaaggguaaggaaguggcuag

SEQ ID NO: 18448 - RNA, 21 nt, Human
aaacugagcauuucuuuugcc

SEQ ID NO: 18449 - RNA, 32 nt, Human
aaacugagcucucuuccauuuuacuuacugcu

SEQ ID NO: 18450 - RNA, 23 nt, Human
aaacugaggcacuaucccagaga

SEQ ID NO: 18451 - RNA, 32 nt, Human
aaacugaggcccagagagguuaagugauugcc

SEQ ID NO: 18452 - RNA, 32 nt, Human
aaacugaggccuggagguaggaagggacuugc

SEQ ID NO: 18453 - RNA, 32 nt, Human
aaacugaggcucagagaggugaagucacuaag

SEQ ID NO: 18454 - RNA, 32 nt, Human
aaacugaggguugcccugggcccuacccuucc

SEQ ID NO: 18455 - RNA, 32 nt, Human
aaacugaggucucauggagaagccccggagua

SEQ ID NO: 18456 - RNA, 32 nt, Human
aaacugaguagcagaaaacagaggccacacuu

SEQ ID NO: 18457 - RNA, 32 nt, Human
aaacugagucauagaggauacagacuugccca

SEQ ID NO: 18458 - RNA, 32 nt, Human
aaacugagugccuguguagaucauccuagaau

SEQ ID NO: 18459 - RNA, 32 nt, Human
aaacugauacaacucagaaacugcucaauguc

SEQ ID NO: 18460 - RNA, 32 nt, Human
aaacugaugaagcugcagaaccaaugaggugg

SEQ ID NO: 18461 - RNA, 32 nt, Human
aaacugauggccaaccuagagcagcaaggagc

SEQ ID NO: 18462 - RNA, 32 nt, Human
aaacugaugucccugugaacaccugcacuaug

SEQ ID NO: 18463 - RNA, 32 nt, Human
aaacugauugcuaaggugaaacaauucaaugc

SEQ ID NO: 18464 - RNA, 32 nt, Human
aaacugauuucacuccagacugguguggccac

SEQ ID NO: 18465 - RNA, 32 nt, Human
aaacugcaaagcaguuugaugacacuguuuua

SEQ ID NO: 18466 - RNA, 32 nt, Human
aaacugcaacucuacaaaaauacaaaaauuag

SEQ ID NO: 18467 - RNA, 32 nt, Human
aaacugcacccugcgaaagagcagaaaacagg

SEQ ID NO: 18468 - RNA, 32 nt, Human
aaacugcagacugaaagaaacaugccugcagg

SEQ ID NO: 18469 - RNA, 32 nt, Human
aaacugcagcccggccaggcagcugggaccag

SEQ ID NO: 18470 - RNA, 32 nt, Human
aaacugcagcgcggugagagagcgagagagag

SEQ ID NO: 18471 - RNA, 32 nt, Human
aaacugcagcuggucuggcuuacuguuuugcc

SEQ ID NO: 18472 - RNA, 32 nt, Human
aaacugcaggaucuuccuucugaccccugcuu

SEQ ID NO: 18473 - RNA, 32 nt, Human
aaacugcaggcuuccccagaacugucaugaga

SEQ ID NO: 18474 - RNA, 32 nt, Human
aaacugcaucuuggcccuguugccugggcuga

SEQ ID NO: 18475 - RNA, 32 nt, Human
aaacugccaaccacaggaaacagccuggcaaa

SEQ ID NO: 18476 - RNA, 32 nt, Human
aaacugccaccugcgggcacauucccauaaau

SEQ ID NO: 18477 - RNA, 32 nt, Human
aaacugccaggugggagaagcagagccauggg

SEQ ID NO: 18478 - RNA, 32 nt, Human
aaacugccauagaauuaacaucugccaggaau

SEQ ID NO: 18479 - RNA, 32 nt, Human
aaacugcccagcccuucucugccuaauugcaa

SEQ ID NO: 18480 - RNA, 32 nt, Human
aaacugccccuuucuaaaaaugacccuaaacu

SEQ ID NO: 18481 - RNA, 32 nt, Human
aaacugcccuuaagagucauuuccuuguuauc

SEQ ID NO: 18482 - RNA, 32 nt, Human
aaacugccguaaccucugccguucaggaaccc

SEQ ID NO: 18483 - RNA, 32 nt, Human
aaacugccucaagucggccucuccaggcccag

SEQ ID NO: 18484 - RNA, 32 nt, Human
aaacugccucuucauguugccugcucaaguuu

SEQ ID NO: 18485 - RNA, 32 nt, Human
aaacugccugcacuucaucucuggagguucgc

SEQ ID NO: 18486 - RNA, 32 nt, Human
aaacugccugcucuucuaaauuguguguccca

SEQ ID NO: 18487 - RNA, 32 nt, Human
aaacugccuuccacuaaaccagucccuggugc

SEQ ID NO: 18488 - RNA, 32 nt, Human
aaacugcgggagcugggcgcucagugggggaa

SEQ ID NO: 18489 - RNA, 24 nt, Human
aaacugcuaaggccaucucagggg

SEQ ID NO: 18490 - RNA, 32 nt, Human
aaacugcuauuuucgcuuauuucuggaaugua

SEQ ID NO: 18491 - RNA, 32 nt, Human
aaacugcucaaucaaaagaauauuucaacucu

SEQ ID NO: 18492 - RNA, 32 nt, Human
aaacugcugaaaaagcugggugcagugaaaug

SEQ ID NO: 18493 - RNA, 32 nt, Human
aaacugcugagggagcuggcagaggacugcaa

SEQ ID NO: 18494 - RNA, 32 nt, Human
aaacugcugcagcuguuggccgaguggaccga

SEQ ID NO: 18495 - RNA, 32 nt, Human
aaacugcugcugcaggggguccugaaaacagc

SEQ ID NO: 18496 - RNA, 32 nt, Human
aaacugcugcuugaggagauucuacagccaga

SEQ ID NO: 18497 - RNA, 32 nt, Human
aaacuggaaacacucugaacccugccaucuug

SEQ ID NO: 18498 - RNA, 32 nt, Human
aaacuggaagcccccucugccucccagcuggg

SEQ ID NO: 18499 - RNA, 32 nt, Human
aaacuggaaggcagagguugcagugagccaag

SEQ ID NO: 18500 - RNA, 32 nt, Human
aaacuggaaggcagagguugcagugagccgag

SEQ ID NO: 18501 - RNA, 32 nt, Human
aaacuggaaggcucccuuucuguuugaaguuu

SEQ ID NO: 18502 - RNA, 32 nt, Human
aaacuggaccaugucaaccaguuucaggugua

SEQ ID NO: 18503 - RNA, 32 nt, Human
aaacuggaccccuuccuuacaccuuaugcaaa

SEQ ID NO: 18504 - RNA, 32 nt, Human
aaacuggacgugcacccccaugggauggagac

SEQ ID NO: 18505 - RNA, 32 nt, Human
aaacuggaggcugggcgcaguggcucacgccu

SEQ ID NO: 18506 - RNA, 32 nt, Human
aaacuggagugcuugaaggagcugcagacaga

SEQ ID NO: 18507 - RNA, 32 nt, Human
aaacuggaucccuuccuuacaccuuauacaaa

SEQ ID NO: 18508 - RNA, 32 nt, Human
aaacuggaucccuuccuuacaccuuaugcaaa

SEQ ID NO: 18509 - RNA, 32 nt, Human
aaacuggauuaguucuuuuacuucaguguuua

SEQ ID NO: 18510 - RNA, 31 nt, Human
aaacuggcaaaaggaacuuggauugcaggaa

SEQ ID NO: 18511 - RNA, 32 nt, Human
aaacuggcacagaaccagugguggugagagcu

SEQ ID NO: 18512 - RNA, 32 nt, Human
aaacuggccacggccgggaacggaggggacag

SEQ ID NO: 18513 - RNA, 32 nt, Human
aaacuggccauaaagaaauuaucugacuuacc

SEQ ID NO: 18514 - RNA, 32 nt, Human
aaacuggccuguuuacuucgucuccuaacaaa

SEQ ID NO: 18515 - RNA, 32 nt, Human
aaacuggcuccguugcacaaucuaguugcuua

SEQ ID NO: 18516 - RNA, 32 nt, Human
aaacuggcuccuuaaaguugguggugaagaca

SEQ ID NO: 18517 - RNA, 32 nt, Human
aaacuggcuucaaaacacagccauaauuagac

SEQ ID NO: 18518 - RNA, 32 nt, Human
aaacugggaaaaucacaggcucuuccacuuac

SEQ ID NO: 18519 - RNA, 32 nt, Human
aaacugggaaccccuuucccaccccaaccugc

SEQ ID NO: 18520 - RNA, 32 nt, Human
aaacugggaagaggacccucaccaggaaccac

SEQ ID NO: 18521 - RNA, 32 nt, Human
aaacugggacugccuuucccucuccucagccc

SEQ ID NO: 18522 - RNA, 32 nt, Human
aaacugggagagggaggaagggagaaagugag

SEQ ID NO: 18523 - RNA, 32 nt, Human
aaacugggaggcagggguuggagugagccagg

SEQ ID NO: 18524 - RNA, 32 nt, Human
aaacugggaggcggagcuugcagugagccgag

SEQ ID NO: 18525 - RNA, 26 nt, Human
aaacugggagguggagguugcaguga

SEQ ID NO: 18526 - RNA, 32 nt, Human
aaacugggagguggagguugcagugagccaag

SEQ ID NO: 18527 - RNA, 32 nt, Human
aaacugggauuggacaguaguggugcaucugg

SEQ ID NO: 18528 - RNA, 32 nt, Human
aaacugggcggcagccagaguucccugaagug

SEQ ID NO: 18529 - RNA, 32 nt, Human
aaacugggcucagcaugcuuguccucaaaaug

SEQ ID NO: 18530 - RNA, 32 nt, Human
aaacuggggaaugugucucugccuguaaacuc

SEQ ID NO: 18531 - RNA, 32 nt, Human
aaacuggggcacagagaggugaugucaucugc

SEQ ID NO: 18532 - RNA, 32 nt, Human
aaacuggggcugggccucuaucccuccucugc

SEQ ID NO: 18533 - RNA, 32 nt, Human
aaacugggggacucuccucccuucucucccca

SEQ ID NO: 18534 - RNA, 32 nt, Human
aaacuggguacaauaaauaagcuggauuauac

SEQ ID NO: 18535 - RNA, 31 nt, Human
aaacuggguggggcaggaugggugcccacac

SEQ ID NO: 18536 - RNA, 32 nt, Human
aaacugguaacaggcugggugcaauggcucac

SEQ ID NO: 18537 - RNA, 32 nt, Human
aaacuggucucaaacuccuggccucaagcaau

SEQ ID NO: 18538 - RNA, 32 nt, Human
aaacuggucucgaacuccugaccucgggaucc

SEQ ID NO: 18539 - RNA, 32 nt, Human
aaacuggucugcaaagagaaggaagaggaaag

SEQ ID NO: 18540 - RNA, 32 nt, Human
aaacuggucugccuuuacaaaguggaaguuca

SEQ ID NO: 18541 - RNA, 31 nt, Human
aaacuggugaagugagaaaaacagaaugcag

SEQ ID NO: 18542 - RNA, 32 nt, Human
aaacuggugucaucagcuguuucucccagcau

SEQ ID NO: 18543 - RNA, 32 nt, Human
aaacugguuugugguugaccuggggguuaggu

SEQ ID NO: 18544 - RNA, 32 nt, Human
aaacuguaaaaaucccuccuccccaguguaga

SEQ ID NO: 18545 - RNA, 32 nt, Human
aaacuguaaauaccuugaggcaggagugaggu

SEQ ID NO: 18546 - RNA, 32 nt, Human
aaacuguaaauacugcauuucuuuugcguaua

SEQ ID NO: 18547 - RNA, 32 nt, Human
aaacuguaacacaucacauaaaagauacuuua

SEQ ID NO: 18548 - RNA, 32 nt, Human
aaacuguaaggaaaaagaguguuaauaccaug

SEQ ID NO: 18549 - RNA, 32 nt, Human
aaacuguaccacugggccaagugcaguggauc

SEQ ID NO: 18550 - RNA, 32 nt, Human
aaacuguaucagguacauuccagccuguuggc

SEQ ID NO: 18551 - RNA, 23 nt, Human
aaacuguaucagucauccagaga

SEQ ID NO: 18552 - RNA, 32 nt, Human
aaacuguaugucuuauaagaaaacauguaaag

SEQ ID NO: 18553 - RNA, 32 nt, Human
aaacugucaaaacuaccucccaaccaagcccc

SEQ ID NO: 18554 - RNA, 32 nt, Human
aaacugucaucuccuuaugugcuaaugaguuu

SEQ ID NO: 18555 - RNA, 32 nt, Human
aaacuguccuuuuuggauuccugcugcuuuac

SEQ ID NO: 18556 - RNA, 32 nt, Human
aaacugucuuugucaccacguggggcucacuu

SEQ ID NO: 18557 - RNA, 32 nt, Human
aaacugugaaagucagaaaggccagcggggag

SEQ ID NO: 18558 - RNA, 32 nt, Human
aaacugugccuuguuucaacaguuuuugcuaa

SEQ ID NO: 18559 - RNA, 32 nt, Human
aaacugugcgagcacaacacacacaauccuuu

SEQ ID NO: 18560 - RNA, 32 nt, Human
aaacuguggaaguaauuuccaguucuuacacu

SEQ ID NO: 18561 - RNA, 32 nt, Human
aaacugugggaugcuccucccuucucuaccuc

SEQ ID NO: 18562 - RNA, 32 nt, Human
aaacuguggguuuauucuaaguuuacaauuau

SEQ ID NO: 18563 - RNA, 32 nt, Human
aaacuguggucuuugcuuuucucccaaacccg

SEQ ID NO: 18564 - RNA, 32 nt, Human
aaacugugguucgagcaaccugugggaaaucu

SEQ ID NO: 18565 - RNA, 32 nt, Human
aaacuguguaucuggcaggaaguggauuaucu

SEQ ID NO: 18566 - RNA, 32 nt, Human
aaacuguuaacuuauucaaagagaaaacaucu

SEQ ID NO: 18567 - RNA, 32 nt, Human
aaacuguuacucauuaacuuugcuuauaaugc

SEQ ID NO: 18568 - RNA, 32 nt, Human
aaacuguucauccugaaacaggcacaggugau

SEQ ID NO: 18569 - RNA, 32 nt, Human
aaacuguucuugggacugucucaacugugcaa

SEQ ID NO: 18570 - RNA, 32 nt, Human
aaacuguugcugcacacaucuguacucgucaa

SEQ ID NO: 18571 - RNA, 32 nt, Human
aaacuguuucuccaaagcguuuugcaaaaacu

SEQ ID NO: 18572 - RNA, 32 nt, Human
aaacuguuuuagagugaauccugggguguucu

SEQ ID NO: 18573 - RNA, 32 nt, Human
aaacuguuuuccacgacaucugcaccauuuua

SEQ ID NO: 18574 - RNA, 32 nt, Human
aaacuuaacaaugacuuguacucugaaaguuu

SEQ ID NO: 18575 - RNA, 32 nt, Human
aaacuuaaggaguuuugaaaaguaaugcaaau

SEQ ID NO: 18576 - RNA, 32 nt, Human
aaacuuaauguuccagcucuugaacuacacug

SEQ ID NO: 18577 - RNA, 32 nt, Human
aaacuuacaugcaggacaacaaaaugaugaaa

SEQ ID NO: 18578 - RNA, 32 nt, Human
aaacuuacuucauuguaacuauuugaaauaga

SEQ ID NO: 18579 - RNA, 32 nt, Human
aaacuuacuugggauuauuagcacuuucaaac

SEQ ID NO: 18580 - RNA, 32 nt, Human
aaacuuagacuauagacauaacuacaaagcca

SEQ ID NO: 18581 - RNA, 24 nt, Human
aaacuuagcacccuggagagucca

SEQ ID NO: 18582 - RNA, 31 nt, Human
aaacuuaggcacuuugcuauuucuuuucuaa

SEQ ID NO: 18583 - RNA, 32 nt, Human
aaacuuaggggacugagcuggggagggaggca

SEQ ID NO: 18584 - RNA, 32 nt, Human
aaacuuaguccuaaucccagcacuuugggagg

SEQ ID NO: 18585 - RNA, 32 nt, Human
aaacuucaagcugcuuucuuucuugaaaacua

SEQ ID NO: 18586 - RNA, 32 nt, Human
aaacuucacaugcucuuccugccuccuucauc

SEQ ID NO: 18587 - RNA, 32 nt, Human
aaacuucacugcaguggccacuucugaaucuc

SEQ ID NO: 18588 - RNA, 32 nt, Human
aaacuucagcaacccuacaguauauaagcuuu

SEQ ID NO: 18589 - RNA, 32 nt, Human
aaacuucagcaacuguuaauacucagaucaua

SEQ ID NO: 18590 - RNA, 32 nt, Human
aaacuucagcacagaaauagauguggacuuuc

SEQ ID NO: 18591 - RNA, 32 nt, Human
aaacuucaggcggagucccaggagagcagcgc

SEQ ID NO: 18592 - RNA, 32 nt, Human
aaacuucaugcucaccuauuggagauuuggga

SEQ ID NO: 18593 - RNA, 32 nt, Human
aaacuucauuagaacaaacuuuacuugauaug

SEQ ID NO: 18594 - RNA, 32 nt, Human
aaacuuccagcccucuguuaauugugugucuc

SEQ ID NO: 18595 - RNA, 32 nt, Human
aaacuuccaggggcagacaaagugauucgauc

SEQ ID NO: 18596 - RNA, 32 nt, Human
aaacuuccccuccacccaagccccugcuggcc

SEQ ID NO: 18597 - RNA, 32 nt, Human
aaacuuccgaguagcugggacuacaggcauga

SEQ ID NO: 18598 - RNA, 32 nt, Human
aaacuuccuucggaggaaaaagcccuaacgau

SEQ ID NO: 18599 - RNA, 32 nt, Human
aaacuucgguaccuaauacaaaaguuugauug

SEQ ID NO: 18600 - RNA, 32 nt, Human
aaacuucucaacuauauccuaugucugagagg

SEQ ID NO: 18601 - RNA, 32 nt, Human
aaacuucuccccaaacuacaaccucaggaaaa

SEQ ID NO: 18602 - RNA, 32 nt, Human
aaacuucuguaguucuuuuggccaguguguuu

SEQ ID NO: 18603 - RNA, 32 nt, Human
aaacuugaacagcgaaagcagagcauguuauu

SEQ ID NO: 18604 - RNA, 32 nt, Human
aaacuugaaguccaagccgugcugcugauucc

SEQ ID NO: 18605 - RNA, 32 nt, Human
aaacuugaccaaggaagaguuccuguccugaa

SEQ ID NO: 18606 - RNA, 32 nt, Human
aaacuugagaaggcuugugcccaaagcuugaa

SEQ ID NO: 18607 - RNA, 32 nt, Human
aaacuugagucucccuagaggugaaaggugag

SEQ ID NO: 18608 - RNA, 32 nt, Human
aaacuugaucuugggacuucaggguuggccau

SEQ ID NO: 18609 - RNA, 32 nt, Human
aaacuugaugcagaaagccaaauaggucaauu

SEQ ID NO: 18610 - RNA, 32 nt, Human
aaacuugauucuguuucucuacuuauuguaaa

SEQ ID NO: 18611 - RNA, 32 nt, Human
aaacuugcaaggaaagcugccgucucuuuggc

SEQ ID NO: 18612 - RNA, 32 nt, Human
aaacuugcacacaacguuucacaaaaucuuuu

SEQ ID NO: 18613 - RNA, 32 nt, Human
aaacuugcaucugucugaccucaaagcccugc

SEQ ID NO: 18614 - RNA, 32 nt, Human
aaacuugccuuccuaaaaaccaagauggaugc

SEQ ID NO: 18615 - RNA, 32 nt, Human
aaacuugcucuucaacucuguauacaagcaga

SEQ ID NO: 18616 - RNA, 32 nt, Human
aaacuugcugcuuaaugauuugcucacaucua

SEQ ID NO: 18617 - RNA, 32 nt, Human
aaacuugcuggguggugucugcgggaaacagu

SEQ ID NO: 18618 - RNA, 32 nt, Human
aaacuugcuugaaguuccagaaucacuaaggg

SEQ ID NO: 18619 - RNA, 32 nt, Human
aaacuugcuugaccuccacuuuucaggagacu

SEQ ID NO: 18620 - RNA, 32 nt, Human
aaacuuggccaggaguuuccacucgguccgac

SEQ ID NO: 18621 - RNA, 32 nt, Human
aaacuuggccagguucuccagcaaguauaagu

SEQ ID NO: 18622 - RNA, 22 nt, Human
aaacuugggaaggugagggauu

SEQ ID NO: 18623 - RNA, 23 nt, Human
aaacuuggggggacuuccucccu

SEQ ID NO: 18624 - RNA, 32 nt, Human
aaacuugggugagaguggcccaugaagcccuu

SEQ ID NO: 18625 - RNA, 32 nt, Human
aaacuuggucucaagugauucuacugccucag

SEQ ID NO: 18626 - RNA, 32 nt, Human
aaacuuggugauugucagcugugccccugacc

SEQ ID NO: 18627 - RNA, 32 nt, Human
aaacuugguguuagagaacaucuagagagaga

SEQ ID NO: 18628 - RNA, 32 nt, Human
aaacuugguuaggacucuggcuugccuucccc

SEQ ID NO: 18629 - RNA, 32 nt, Human
aaacuuguaaccacccuuuucuaacagcaaua

SEQ ID NO: 18630 - RNA, 32 nt, Human
aaacuuguaacugcuccacagcucccuggaua

SEQ ID NO: 18631 - RNA, 32 nt, Human
aaacuugugaaacccucggucauggacuggau

SEQ ID NO: 18632 - RNA, 32 nt, Human
aaacuuguucugaguccauucaaauguguuuu

SEQ ID NO: 18633 - RNA, 32 nt, Human
aaacuuguuuaccaggaucagaauggccaugu

SEQ ID NO: 18634 - RNA, 32 nt, Human
aaacuuuaacagaaauugucucuuaauacauu

SEQ ID NO: 18635 - RNA, 32 nt, Human
aaacuuuaauauguauuuuauguauguuuaca

SEQ ID NO: 18636 - RNA, 32 nt, Human
aaacuuuacaugccugauggcaccuuacucca

SEQ ID NO: 18637 - RNA, 32 nt, Human
aaacuuuagaaaauuguugacaucaucugugg

SEQ ID NO: 18638 - RNA, 32 nt, Human
aaacuuuagaugauaaaauuagccgggcgugg

SEQ ID NO: 18639 - RNA, 32 nt, Human
aaacuuucagccacaucuuucuucuuaguuua

SEQ ID NO: 18640 - RNA, 32 nt, Human
aaacuuucaguaggaauguugcuaugaucaag

SEQ ID NO: 18641 - RNA, 32 nt, Human
aaacuuuccaucccaaaggcagucuccguggu

SEQ ID NO: 18642 - RNA, 32 nt, Human
aaacuuuccucuuccugccuagaggccccacc

SEQ ID NO: 18643 - RNA, 21 nt, Human
aaacuuuccuuaagccuucaa

SEQ ID NO: 18644 - RNA, 32 nt, Human
aaacuuucuaacaauauagucuuuggauuugu

SEQ ID NO: 18645 - RNA, 32 nt, Human
aaacuuucuaccccucccuucaaucuuauccu

SEQ ID NO: 18646 - RNA, 32 nt, Human
aaacuuucucucuccauguaaucacacuuagu

SEQ ID NO: 18647 - RNA, 32 nt, Human
aaacuuucucugaucuccucucucucuguguc

SEQ ID NO: 18648 - RNA, 32 nt, Human
aaacuuucugccuuccccaacaccuuugugcc

SEQ ID NO: 18649 - RNA, 32 nt, Human
aaacuuucuguggaagggccagagaguaaaua

SEQ ID NO: 18650 - RNA, 32 nt, Human
aaacuuugaaguggguucuucuagucagcuua

SEQ ID NO: 18651 - RNA, 32 nt, Human
aaacuuugacuaauagagcccaggaaggccau

SEQ ID NO: 18652 - RNA, 32 nt, Human
aaacuuugagaguuuacaucagaaagaaaaca

SEQ ID NO: 18653 - RNA, 32 nt, Human
aaacuuugaggaauaaugaaaagcuuuuaaag

SEQ ID NO: 18654 - RNA, 32 nt, Human
aaacuuugccuggucccucuagcugcuggugg

SEQ ID NO: 18655 - RNA, 32 nt, Human
aaacuuugcuucaggcuggguagugguagagg

SEQ ID NO: 18656 - RNA, 32 nt, Human
aaacuuuguaacuuuuguuacugugaauucaa

SEQ ID NO: 18657 - RNA, 32 nt, Human
aaacuuugugcaaagaauagauaguucugccu

SEQ ID NO: 18658 - RNA, 32 nt, Human
aaacuuugugugugugcguguguguauacaua

SEQ ID NO: 18659 - RNA, 32 nt, Human
aaacuuuuaaccaauccucacaccuuauugca

SEQ ID NO: 18660 - RNA, 32 nt, Human
aaacuuuuaugcuggcugggcgcgguggcuua

SEQ ID NO: 18661 - RNA, 32 nt, Human
aaacuuuuccacaguuuuacauucaugugguu

SEQ ID NO: 18662 - RNA, 23 nt, Human
aaacuuuuccagaaaguuuccaa

SEQ ID NO: 18663 - RNA, 32 nt, Human
aaacuuuuccagagaaagauccugauugucau

SEQ ID NO: 18664 - RNA, 20 nt, Human
aaacuuuucuuccccuuccu

SEQ ID NO: 18665 - RNA, 32 nt, Human
aaacuuuuguguccugagcacuggagagaaag

SEQ ID NO: 18666 - RNA, 18 nt, Human
aaagaaaaacccuuucaa

SEQ ID NO: 18667 - RNA, 32 nt, Human
aaagaaaaacgacuuggggaggccguacccgu

SEQ ID NO: 18668 - RNA, 32 nt, Human
aaagaaaaagaaagaaaugaagaaaagagagg

SEQ ID NO: 18669 - RNA, 32 nt, Human
aaagaaaaagcauacacacugggaaggaagaa

SEQ ID NO: 18670 - RNA, 32 nt, Human
aaagaaaaaguauguugugccuucuucuuaag

SEQ ID NO: 18671 - RNA, 18 nt, Human
aaagaaaaauagguucaa

SEQ ID NO: 18672 - RNA, 32 nt, Human
aaagaaaaaucuaggccgggugcaguggcuca

SEQ ID NO: 18673 - RNA, 32 nt, Human
aaagaaaacacaauacaaucaggaguuuucaa

SEQ ID NO: 18674 - RNA, 32 nt, Human
aaagaaaacagguuggaacauacauauagccu

SEQ ID NO: 18675 - RNA, 17 nt, Human
aaagaaaaccacuucaa

SEQ ID NO: 18676 - RNA, 21 nt, Human
aaagaaaacccagugguucaa

SEQ ID NO: 18677 - RNA, 16 nt, Human
aaagaaaaccccucaa

SEQ ID NO: 18678 - RNA, 17 nt, Human
aaagaaaacccuuucag

SEQ ID NO: 18679 - RNA, 18 nt, Human
aaagaaaaccuuucuuca

SEQ ID NO: 18680 - RNA, 32 nt, Human
aaagaaaacgaucccuuccuucuuccacuuuc

SEQ ID NO: 18681 - RNA, 32 nt, Human
aaagaaaacuaacaaccaaccaaccaaccaac

SEQ ID NO: 18682 - RNA, 18 nt, Human
aaagaaaacuuguguuca

SEQ ID NO: 18683 - RNA, 21 nt, Human
aaagaaaagaaaucuaccuca

SEQ ID NO: 18684 - RNA, 32 nt, Human
aaagaaaagaauucuaaugaccugccuugaau

SEQ ID NO: 18685 - RNA, 32 nt, Human
aaagaaaagaggaggaggaggaggaagaaaga

SEQ ID NO: 18686 - RNA, 32 nt, Human
aaagaaaauaaauaugaucaaaagucauaaaa

SEQ ID NO: 18687 - RNA, 32 nt, Human
aaagaaaauacuuauaaaaagacuucauuuuu

SEQ ID NO: 18688 - RNA, 17 nt, Human
aaagaaaauccccucag

SEQ ID NO: 18689 - RNA, 32 nt, Human
aaagaaaauccugacaugcacacccauuaaaa

SEQ ID NO: 18690 - RNA, 18 nt, Human
aaagaaaaugaggcucaa

SEQ ID NO: 18691 - RNA, 32 nt, Human
aaagaaaaugcacaaugguugacagaauagug

SEQ ID NO: 18692 - RNA, 32 nt, Human
aaagaaaauggccuucuugacugugaagagcu

SEQ ID NO: 18693 - RNA, 32 nt, Human
aaagaaaauuuccaagcaugguaucaucucac

SEQ ID NO: 18694 - RNA, 32 nt, Human
aaagaaacaaaaagaagaaccuguucuauguu

SEQ ID NO: 18695 - RNA, 32 nt, Human
aaagaaacaaaccaaaccaaccagcucuugga

SEQ ID NO: 18696 - RNA, 32 nt, Human
aaagaaacagaagagugagaagaaaggagagg

SEQ ID NO: 18697 - RNA, 32 nt, Human
aaagaaacagcagaguaaaagccagacucauu

SEQ ID NO: 18698 - RNA, 17 nt, Human
aaagaaacaugguucaa

SEQ ID NO: 18699 - RNA, 32 nt, Human
aaagaaaccaagcuggauuuugcagugcauau

SEQ ID NO: 18700 - RNA, 32 nt, Human
aaagaaaccacccuuuguucccaacuccacuu

SEQ ID NO: 18701 - RNA, 32 nt, Human
aaagaaacccuacaaaugugaagaauguggca

SEQ ID NO: 18702 - RNA, 32 nt, Human
aaagaaacgugaaugcauaaauauguauaaug

SEQ ID NO: 18703 - RNA, 32 nt, Human
aaagaaacguucgccccagucucuccacagcu

SEQ ID NO: 18704 - RNA, 32 nt, Human
aaagaaacuaaguuacuugucugcagucaaau

SEQ ID NO: 18705 - RNA, 32 nt, Human
aaagaaacuaggguccauaugagggaaaaccc

SEQ ID NO: 18706 - RNA, 31 nt, Human
aaagaaacugagagagguaagacuguacagg

SEQ ID NO: 18707 - RNA, 32 nt, Human
aaagaaacugaggcccagggaggcuaagaguc

SEQ ID NO: 18708 - RNA, 32 nt, Human
aaagaaacugaggcccagggaggcugaguccu

SEQ ID NO: 18709 - RNA, 32 nt, Human
aaagaaagaaaaagaaagaaagaaaagaaaag

SEQ ID NO: 18710 - RNA, 32 nt, Human
aaagaaagaaaagaaaaagaagaaguagcugg

SEQ ID NO: 18711 - RNA, 32 nt, Human
aaagaaagaaagaaagaaagaaaacaguucca

SEQ ID NO: 18712 - RNA, 32 nt, Human
aaagaaagaaagaaagaaagaaaagaaagaaa

SEQ ID NO: 18713 - RNA, 32 nt, Human
aaagaaagaaagaaagaaagaaagaaaacagu

SEQ ID NO: 18714 - RNA, 32 nt, Human
aaagaaagaaagaaagaaagaaagaaaagaaa

SEQ ID NO: 18715 - RNA, 32 nt, Human
aaagaaagaaagaaagaaagaaagaaaauauc

SEQ ID NO: 18716 - RNA, 32 nt, Human
aaagaaagaaagaaagaaagaaaggaauccua

SEQ ID NO: 18717 - RNA, 31 nt, Human
aaagaaagaaagagggaaaaagagcuggugg

SEQ ID NO: 18718 - RNA, 32 nt, Human
aaagaaagagaaaaagaaagaaaggaaagaaa

SEQ ID NO: 18719 - RNA, 32 nt, Human
aaagaaagagaaaagaaaagaaaagcaaccac

SEQ ID NO: 18720 - RNA, 32 nt, Human
aaagaaagagagggagaaagagagggagaaag

SEQ ID NO: 18721 - RNA, 32 nt, Human
aaagaaagagggggaggaagaggaagagaaaa

SEQ ID NO: 18722 - RNA, 32 nt, Human
aaagaaagagguuuaucagacuuacaguucca

SEQ ID NO: 18723 - RNA, 32 nt, Human
aaagaaagaugcugaaaccaaugaagcaaucu

SEQ ID NO: 18724 - RNA, 32 nt, Human
aaagaaagcacccaacgcucuggcagggucug

SEQ ID NO: 18725 - RNA, 32 nt, Human
aaagaaagcccauggaagaggccacacucgga

SEQ ID NO: 18726 - RNA, 32 nt, Human
aaagaaagcugcauaguuauuuuaaauuuaau

SEQ ID NO: 18727 - RNA, 18 nt, Human
aaagaaagcugggguuaa

SEQ ID NO: 18728 - RNA, 32 nt, Human
aaagaaagcuguucuugacagcacucugagcc

SEQ ID NO: 18729 - RNA, 32 nt, Human
aaagaaaggaaggcauuccuuuuauuucuaau

SEQ ID NO: 18730 - RNA, 18 nt, Human
aaagaaaggacgguucga

SEQ ID NO: 18731 - RNA, 32 nt, Human
aaagaaaggacuagcauaugagacuucuggua

SEQ ID NO: 18732 - RNA, 32 nt, Human
aaagaaaggaggcuuuguaggggaagagggcc

SEQ ID NO: 18733 - RNA, 32 nt, Human
aaagaaaggcuauccaguagagcccagugcuc

SEQ ID NO: 18734 - RNA, 32 nt, Human
aaagaaagugcuacaauuccuaaucauuuuag

SEQ ID NO: 18735 - RNA, 32 nt, Human
aaagaaaguggaggggacacuccagaggcugu

SEQ ID NO: 18736 - RNA, 32 nt, Human
aaagaaauaaagugauguuaauaaaaguuuug

SEQ ID NO: 18737 - RNA, 32 nt, Human
aaagaaauacaguacuguuucuggacccuuau

SEQ ID NO: 18738 - RNA, 32 nt, Human
aaagaaauagccaaucaucuauugccugagag

SEQ ID NO: 18739 - RNA, 32 nt, Human
aaagaaauaggaagccacaaauuuguauggau

SEQ ID NO: 18740 - RNA, 32 nt, Human
aaagaaauauggaggaagguuaaaaggggauu

SEQ ID NO: 18741 - RNA, 32 nt, Human
aaagaaaucaaguguuuuuccuuuguaacgua

SEQ ID NO: 18742 - RNA, 18 nt, Human
aaagaaauccuaguuuaa

SEQ ID NO: 18743 - RNA, 32 nt, Human
aaagaaaugaagucccagcugccgagagaaac

SEQ ID NO: 18744 - RNA, 32 nt, Human
aaagaaaugaagucccagcugccgagagcaac

SEQ ID NO: 18745 - RNA, 32 nt, Human
aaagaaauggguucugggccaggugugguggc

SEQ ID NO: 18746 - RNA, 32 nt, Human
aaagaaaugugaagagaaagaagauaauuuuu

SEQ ID NO: 18747 - RNA, 32 nt, Human
aaagaaauguuuuacagaugaaggaauguuuu

SEQ ID NO: 18748 - RNA, 17 nt, Human
aaagaaauucggcucag

SEQ ID NO: 18749 - RNA, 32 nt, Human
aaagaaauuguauggggagugagcacacacca

SEQ ID NO: 18750 - RNA, 32 nt, Human
aaagaacaaaggagagaaaggagggaaaagcc

SEQ ID NO: 18751 - RNA, 32 nt, Human
aaagaacaaaggccagugcgaggcuuggcugg

SEQ ID NO: 18752 - RNA, 32 nt, Human
aaagaacaaauacaaaaauuagccgagcguug

SEQ ID NO: 18753 - RNA, 32 nt, Human
aaagaacaaucacuaaaccacacucaccccag

SEQ ID NO: 18754 - RNA, 32 nt, Human
aaagaacacaagaaagaaagagagggagaaag

SEQ ID NO: 18755 - RNA, 32 nt, Human
aaagaacacacauuuuuaauggagauuggcug

SEQ ID NO: 18756 - RNA, 32 nt, Human
aaagaacacacuguuccacuguauggcuuugg

SEQ ID NO: 18757 - RNA, 32 nt, Human
aaagaacagaacuuugcccacugcacacuugc

SEQ ID NO: 18758 - RNA, 32 nt, Human
aaagaacagagaggaggaggagggagaaaugg

SEQ ID NO: 18759 - RNA, 32 nt, Human
aaagaacagcuggacggagcugagaggagacc

SEQ ID NO: 18760 - RNA, 32 nt, Human
aaagaacaggaaauucugaauagaauugcacu

SEQ ID NO: 18761 - RNA, 32 nt, Human
aaagaacaggauucaaguccagaguuuucauc

SEQ ID NO: 18762 - RNA, 32 nt, Human
aaagaacaggcaggcugugccaguuuaguuaa

SEQ ID NO: 18763 - RNA, 32 nt, Human
aaagaacaguggaagagaagcauuuuauggaa

SEQ ID NO: 18764 - RNA, 31 nt, Human
aaagaacaguuucaguauugagauggcucag

SEQ ID NO: 18765 - RNA, 32 nt, Human
aaagaaccaacaaccucaacugccuacuccaa

SEQ ID NO: 18766 - RNA, 32 nt, Human
aaagaaccagagaggcucugagaaaccucggg

SEQ ID NO: 18767 - RNA, 32 nt, Human
aaagaacccaagguugagugcaacugggguug

SEQ ID NO: 18768 - RNA, 32 nt, Human
aaagaacccagcaacaaaccucccggcuagga

SEQ ID NO: 18769 - RNA, 32 nt, Human
aaagaacccucaauugaugaaaggcagggagu

SEQ ID NO: 18770 - RNA, 32 nt, Human
aaagaacccuggggacccuaauguuggacucu

SEQ ID NO: 18771 - RNA, 32 nt, Human
aaagaacccuuagacccucagagcuggaggug

SEQ ID NO: 18772 - RNA, 32 nt, Human
aaagaaccgcacaccacagacucccuccagcu

SEQ ID NO: 18773 - RNA, 32 nt, Human
aaagaaccguugcgacugguaacugaagugga

SEQ ID NO: 18774 - RNA, 32 nt, Human
aaagaaccuuuccauacuucguguucuguucu

SEQ ID NO: 18775 - RNA, 32 nt, Human
aaagaacgcuuuuagauuucaaaggagcaguu

SEQ ID NO: 18776 - RNA, 32 nt, Human
aaagaacuaaggauuuuuccauggacaugggc

SEQ ID NO: 18777 - RNA, 32 nt, Human
aaagaacucagaguugugugugcaaugcacac

SEQ ID NO: 18778 - RNA, 32 nt, Human
aaagaacucccagagguuccauucaugcccca

SEQ ID NO: 18779 - RNA, 32 nt, Human
aaagaacuccuccaaaucaacaaggcaaaaac

SEQ ID NO: 18780 - RNA, 32 nt, Human
aaagaacugccugaauuacugcaaugaaauag

SEQ ID NO: 18781 - RNA, 32 nt, Human
aaagaacugccugaauugcugcaaugaaauag

SEQ ID NO: 18782 - RNA, 32 nt, Human
aaagaacuggcguagaggcaacagagccaucu

SEQ ID NO: 18783 - RNA, 32 nt, Human
aaagaacuguagaugccccaaggaaccaacca

SEQ ID NO: 18784 - RNA, 32 nt, Human
aaagaacuuauguaaccaaauaccaccuguac

SEQ ID NO: 18785 - RNA, 32 nt, Human
aaagaacuuguucucuccuuaaaguugugaag

SEQ ID NO: 18786 - RNA, 20 nt, Human
aaagaagaaacuuugccuca

SEQ ID NO: 18787 - RNA, 32 nt, Human
aaagaagaaaguauguuccauacaugggagga

SEQ ID NO: 18788 - RNA, 32 nt, Human
aaagaagaaaucaagaccaccuccugcucugg

SEQ ID NO: 18789 - RNA, 23 nt, Human
aaagaagaaaugauaccaauccu

SEQ ID NO: 18790 - RNA, 18 nt, Human
aaagaagaacccaguuca

SEQ ID NO: 18791 - RNA, 32 nt, Human
aaagaagaagaaaaagaggaagaagaagaagg

SEQ ID NO: 18792 - RNA, 32 nt, Human
aaagaagaagaacggaaggaacagagggggca

SEQ ID NO: 18793 - RNA, 32 nt, Human
aaagaagaagccucuggacacugccagagaug

SEQ ID NO: 18794 - RNA, 32 nt, Human
aaagaagaagguguugggguaggauucuucag

SEQ ID NO: 18795 - RNA, 32 nt, Human
aaagaagaaugaacuauaauccuugaagauaa

SEQ ID NO: 18796 - RNA, 32 nt, Human
aaagaagaauuguaguggucauggacagcuaa

SEQ ID NO: 18797 - RNA, 18 nt, Human
aaagaagaccucagucaa

SEQ ID NO: 18798 - RNA, 32 nt, Human
aaagaagagaugagaaaugaugaaaagguugc

SEQ ID NO: 18799 - RNA, 32 nt, Human
aaagaagagcuaagcaaaacucccaucgaugu

SEQ ID NO: 18800 - RNA, 32 nt, Human
aaagaagagguaagcaaaacucccaucgaugu

SEQ ID NO: 18801 - RNA, 32 nt, Human
aaagaagaggucacuagauguugcagugaaaa

SEQ ID NO: 18802 - RNA, 32 nt, Human
aaagaagaguccuacccaggagggagagcgca

SEQ ID NO: 18803 - RNA, 32 nt, Human
aaagaagagucgaguccucugaggucugugcu

SEQ ID NO: 18804 - RNA, 32 nt, Human
aaagaagauaccucccucccaguccaccucau

SEQ ID NO: 18805 - RNA, 32 nt, Human
aaagaagaucugacaggaaagcuguauaauga

SEQ ID NO: 18806 - RNA, 32 nt, Human
aaagaagauugaccagcuugcuagaaaaauac

SEQ ID NO: 18807 - RNA, 32 nt, Human
aaagaagauugugguugccaagagaaagguaa

SEQ ID NO: 18808 - RNA, 18 nt, Human
aaagaagauuuggaucaa

SEQ ID NO: 18809 - RNA, 32 nt, Human
aaagaagauuuguaagaauuaaacuauauuua

SEQ ID NO: 18810 - RNA, 32 nt, Human
aaagaagcaccacucuagacuggcaagggccu

SEQ ID NO: 18811 - RNA, 32 nt, Human
aaagaagcagaaagagaaagaauuugcaacca

SEQ ID NO: 18812 - RNA, 32 nt, Human
aaagaagcagaggcauuugucaaguuaccuac

SEQ ID NO: 18813 - RNA, 32 nt, Human
aaagaagcaugcugccccuggccuuccaaauc

SEQ ID NO: 18814 - RNA, 19 nt, Human
aaagaagcaugugguuuaa

SEQ ID NO: 18815 - RNA, 32 nt, Human
aaagaagccaagcggaggcugcagcccgggcc

SEQ ID NO: 18816 - RNA, 32 nt, Human
aaagaagccagcaggcgaaaagcagggacugc

SEQ ID NO: 18817 - RNA, 32 nt, Human
aaagaagccaggguuugccacugugaagcuug

SEQ ID NO: 18818 - RNA, 32 nt, Human
aaagaagcccuaaagcagaaagcucuauacca

SEQ ID NO: 18819 - RNA, 32 nt, Human
aaagaagcccucaaccuccacccugucccaug

SEQ ID NO: 18820 - RNA, 21 nt, Human
aaagaagccuccaaaagggaa

SEQ ID NO: 18821 - RNA, 32 nt, Human
aaagaagccugagacucuccaacaggagagcu

SEQ ID NO: 18822 - RNA, 32 nt, Human
aaagaagccuggguccaggcucuccccuuccc

SEQ ID NO: 18823 - RNA, 32 nt, Human
aaagaagcgcccccagcuucugagagcccugg

SEQ ID NO: 18824 - RNA, 21 nt, Human
aaagaagcguauuacugggua

SEQ ID NO: 18825 - RNA, 32 nt, Human
aaagaagcucgggcugccauguggaaaagaau

SEQ ID NO: 18826 - RNA, 32 nt, Human
aaagaagcugauuuugaaacugcuuaauggua

SEQ ID NO: 18827 - RNA, 32 nt, Human
aaagaagcugcuggaauugagaacagaaauag

SEQ ID NO: 18828 - RNA, 32 nt, Human
aaagaagcuggguuuguggagaaucagagcau

SEQ ID NO: 18829 - RNA, 32 nt, Human
aaagaaggaacagacaaagguuugaaaaugau

SEQ ID NO: 18830 - RNA, 32 nt, Human
aaagaaggaacauuuccuauggugcugucuca

SEQ ID NO: 18831 - RNA, 32 nt, Human
aaagaaggaaggaagagagguagacagauaca

SEQ ID NO: 18832 - RNA, 32 nt, Human
aaagaaggacacaccauuccauagcacagaac

SEQ ID NO: 18833 - RNA, 32 nt, Human
aaagaaggagaagaaaacugaacugggaaaau

SEQ ID NO: 18834 - RNA, 32 nt, Human
aaagaaggagaagguucuugcaacuguuacaa

SEQ ID NO: 18835 - RNA, 32 nt, Human
aaagaaggagaagguuuuugcaacuguuacaa

SEQ ID NO: 18836 - RNA, 32 nt, Human
aaagaaggauacaaaggagaacucagcagaga

SEQ ID NO: 18837 - RNA, 31 nt, Human
aaagaaggcaacacaaauugcaagggagaag

SEQ ID NO: 18838 - RNA, 32 nt, Human
aaagaaggcaauaggcugggcgcaguggcuca

SEQ ID NO: 18839 - RNA, 32 nt, Human
aaagaaggcagcagugaaagaauuugaagaca

SEQ ID NO: 18840 - RNA, 32 nt, Human
aaagaaggcauccagcaagaacugcacaagaa

SEQ ID NO: 18841 - RNA, 32 nt, Human
aaagaagggacuaaaugcuggggagguaaauu

SEQ ID NO: 18842 - RNA, 32 nt, Human
aaagaagggcagauggcccucuugccuacuga

SEQ ID NO: 18843 - RNA, 32 nt, Human
aaagaagggcccauccuauuuccccucaucua

SEQ ID NO: 18844 - RNA, 32 nt, Human
aaagaagggcuggggccugccguucuuccucc

SEQ ID NO: 18845 - RNA, 32 nt, Human
aaagaaggggcaggucauauaaagaagcaaua

SEQ ID NO: 18846 - RNA, 32 nt, Human
aaagaagguaucucaggccaggcacaguggcc

SEQ ID NO: 18847 - RNA, 32 nt, Human
aaagaaggucaucuuggaugauuggaggacaa

SEQ ID NO: 18848 - RNA, 32 nt, Human
aaagaaguaaacgcagaacaucacauuaaagg

SEQ ID NO: 18849 - RNA, 32 nt, Human
aaagaaguaaaggaguuaggaggagacacuua

SEQ ID NO: 18850 - RNA, 31 nt, Human
aaagaaguagagagagaauuaaaaacuggcc

SEQ ID NO: 18851 - RNA, 32 nt, Human
aaagaaguaggcccagugugguggcuuguacc

SEQ ID NO: 18852 - RNA, 32 nt, Human
aaagaaguccuccucccuuucugggcuuccau

SEQ ID NO: 18853 - RNA, 32 nt, Human
aaagaaguccuuucucuuuauugaguucgagg

SEQ ID NO: 18854 - RNA, 32 nt, Human
aaagaagugagaugcaccuuauuuucaagaag

SEQ ID NO: 18855 - RNA, 20 nt, Human
aaagaagugauucggucccu

SEQ ID NO: 18856 - RNA, 32 nt, Human
aaagaaguucccuucucaucaucuucaucuca

SEQ ID NO: 18857 - RNA, 32 nt, Human
aaagaaguuccuucuuacagcuuggauucaac

SEQ ID NO: 18858 - RNA, 32 nt, Human
aaagaaguuucauaugcacagaagagcaguug

SEQ ID NO: 18859 - RNA, 32 nt, Human
aaagaauaaagaaagaaaagugcgaugcccag

SEQ ID NO: 18860 - RNA, 32 nt, Human
aaagaauaaccacugcacuccaaccugggcaa

SEQ ID NO: 18861 - RNA, 32 nt, Human
aaagaauaauucuaacugguacuccaauucag

SEQ ID NO: 18862 - RNA, 32 nt, Human
aaagaauagaaagagggagagguuggugccgc

SEQ ID NO: 18863 - RNA, 32 nt, Human
aaagaauagauguuauauuucuaaagaauuuc

SEQ ID NO: 18864 - RNA, 32 nt, Human
aaagaauagcugguuuuuagaaaccaaugcca

SEQ ID NO: 18865 - RNA, 32 nt, Human
aaagaauaggggcugaagacgccacucccaga

SEQ ID NO: 18866 - RNA, 32 nt, Human
aaagaauauagaaugcacuugugcacaaggau

SEQ ID NO: 18867 - RNA, 31 nt, Human
aaagaauaucugaccaucacagagauccaga

SEQ ID NO: 18868 - RNA, 32 nt, Human
aaagaauauguugugagcaucuuuccaugaua

SEQ ID NO: 18869 - RNA, 32 nt, Human
aaagaauauuucccucuccugcaucaagucug

SEQ ID NO: 18870 - RNA, 32 nt, Human
aaagaaucacccaggccagacacaauggcuca

SEQ ID NO: 18871 - RNA, 32 nt, Human
aaagaaucagaauaaauguaccugccauccag

SEQ ID NO: 18872 - RNA, 24 nt, Human
aaagaaucaguuuaauuuuucaca

SEQ ID NO: 18873 - RNA, 32 nt, Human
aaagaaucauuuuccccuguguggaagacacu

SEQ ID NO: 18874 - RNA, 32 nt, Human
aaagaaucccaauauugcuguauagaaagaga

SEQ ID NO: 18875 - RNA, 32 nt, Human
aaagaauccccuacgccacucccaccacaccc

SEQ ID NO: 18876 - RNA, 32 nt, Human
aaagaaucccuucacccccuccagggauggcu

SEQ ID NO: 18877 - RNA, 32 nt, Human
aaagaaucugcaacuuuccccaaaaagcagga

SEQ ID NO: 18878 - RNA, 32 nt, Human
aaagaaucugcagagggugcuacugaagaucc

SEQ ID NO: 18879 - RNA, 32 nt, Human
aaagaaugaauggauucuaggaauguuaggga

SEQ ID NO: 18880 - RNA, 32 nt, Human
aaagaaugaauuucuuucaagagaacuaauug

SEQ ID NO: 18881 - RNA, 32 nt, Human
aaagaaugagucagguggcacugaaagccaug

SEQ ID NO: 18882 - RNA, 32 nt, Human
aaagaaugauuccuggccagaguagugauacc

SEQ ID NO: 18883 - RNA, 32 nt, Human
aaagaauggacuuggagaagcaaaugggaaau

SEQ ID NO: 18884 - RNA, 18 nt, Human
aaagaaugucacugccug

SEQ ID NO: 18885 - RNA, 32 nt, Human
aaagaaugucacuuuuuaacagucccaggagc

SEQ ID NO: 18886 - RNA, 32 nt, Human
aaagaaugucucaucuccucugcccaaaaaug

SEQ ID NO: 18887 - RNA, 32 nt, Human
aaagaaugugggucagaauuucuaccacguuu

SEQ ID NO: 18888 - RNA, 19 nt, Human
aaagaauguucacguccug

SEQ ID NO: 18889 - RNA, 32 nt, Human
aaagaauuacauaugaagauucagaaccaucc

SEQ ID NO: 18890 - RNA, 32 nt, Human
aaagaauugaaggcugagaaacucagccucua

SEQ ID NO: 18891 - RNA, 32 nt, Human
aaagaauugagugcuuuuaaauacuuuuuaga

SEQ ID NO: 18892 - RNA, 32 nt, Human
aaagaauuggccuggcugggugcaguggcuca

SEQ ID NO: 18893 - RNA, 32 nt, Human
aaagacaaaacacauagacgcacacacucagg

SEQ ID NO: 18894 - RNA, 32 nt, Human
aaagacaaaacccaacuuugaccaagaagagc

SEQ ID NO: 18895 - RNA, 32 nt, Human
aaagacaaaguggcaacuguagaaaguguugc

SEQ ID NO: 18896 - RNA, 19 nt, Human
aaagacaacagaacuggaa

SEQ ID NO: 18897 - RNA, 32 nt, Human
aaagacaacagcucccuuucugcuucggacac

SEQ ID NO: 18898 - RNA, 32 nt, Human
aaagacaagaagcagcugccaagagaaggaga

SEQ ID NO: 18899 - RNA, 21 nt, Human
aaagacaagcugauugcugug

SEQ ID NO: 18900 - RNA, 32 nt, Human
aaagacaaggccccuggcagugcaguguugga

SEQ ID NO: 18901 - RNA, 32 nt, Human
aaagacaaucacugccaaccccucuuucgucu

SEQ ID NO: 18902 - RNA, 32 nt, Human
aaagacacaaugcacacuuaaaaugacucaau

SEQ ID NO: 18903 - RNA, 32 nt, Human
aaagacacacaaggacgucugcgcagcaagaa

SEQ ID NO: 18904 - RNA, 32 nt, Human
aaagacacauggccuucuuuguguacaugaca

SEQ ID NO: 18905 - RNA, 32 nt, Human
aaagacaccaacaacaaucaaaacugcacuuu

SEQ ID NO: 18906 - RNA, 32 nt, Human
aaagacaccaucuaugaaccaggaagcagggc

SEQ ID NO: 18907 - RNA, 32 nt, Human
aaagacaccccagccaccuggcucagagaggg

SEQ ID NO: 18908 - RNA, 32 nt, Human
aaagacacuacacugccucuccagaaaucagg

SEQ ID NO: 18909 - RNA, 32 nt, Human
aaagacacucccaccagcaccgugacaguuua

SEQ ID NO: 18910 - RNA, 32 nt, Human
aaagacacugagcacagcccagagccaauaaa

SEQ ID NO: 18911 - RNA, 32 nt, Human
aaagacacugagcuaguucagacauggccaug

SEQ ID NO: 18912 - RNA, 32 nt, Human
aaagacacugcagacuccacugugcugagguu

SEQ ID NO: 18913 - RNA, 32 nt, Human
aaagacacugccuauucuuucgucuguucuug

SEQ ID NO: 18914 - RNA, 32 nt, Human
aaagacagaaggcgaaggagacccccugccgu

SEQ ID NO: 18915 - RNA, 32 nt, Human
aaagacagacccagugagugaaucaggcaaag

SEQ ID NO: 18916 - RNA, 32 nt, Human
aaagacagagcgacgcagggacugggggcggg

SEQ ID NO: 18917 - RNA, 32 nt, Human
aaagacagaggaaggaaggagggagaagggaa

SEQ ID NO: 18918 - RNA, 32 nt, Human
aaagacagaggcgggaggauugagugaggcca

SEQ ID NO: 18919 - RNA, 32 nt, Human
aaagacagaggugggaggauugagugaggcca

SEQ ID NO: 18920 - RNA, 32 nt, Human
aaagacagagucucacucugucacucugucug

SEQ ID NO: 18921 - RNA, 32 nt, Human
aaagacagagucuugcucugucacccaggcug

SEQ ID NO: 18922 - RNA, 32 nt, Human
aaagacagaugggccggaugcaauggcucacg

SEQ ID NO: 18923 - RNA, 32 nt, Human
aaagacagaugucagugggcugcucuggcccu

SEQ ID NO: 18924 - RNA, 32 nt, Human
aaagacagcgagauccugagggccagccggga

SEQ ID NO: 18925 - RNA, 32 nt, Human
aaagacaggaaagucccugaaaucaacagagg

SEQ ID NO: 18926 - RNA, 32 nt, Human
aaagacaggaggaggaaauagguaauaggcua

SEQ ID NO: 18927 - RNA, 32 nt, Human
aaagacaggccugguuccuagcuguggggcug

SEQ ID NO: 18928 - RNA, 22 nt, Human
aaagacagggaauagugggauc

SEQ ID NO: 18929 - RNA, 32 nt, Human
aaagacagggucucacucugucacccaagcua

SEQ ID NO: 18930 - RNA, 32 nt, Human
aaagacagggucuugccauauugcccaggcug

SEQ ID NO: 18931 - RNA, 32 nt, Human
aaagacaggguuucaauuuccacacaugaucu

SEQ ID NO: 18932 - RNA, 32 nt, Human
aaagacaggguuucaccauauuggccaggcug

SEQ ID NO: 18933 - RNA, 32 nt, Human
aaagacaggguuucaccauguuggccaggcug

SEQ ID NO: 18934 - RNA, 32 nt, Human
aaagacaggguuucuccauguuggucaggcug

SEQ ID NO: 18935 - RNA, 32 nt, Human
aaagacaggguuuuuccauguugcccaggcug

SEQ ID NO: 18936 - RNA, 32 nt, Human
aaagacaguaaccuuucucuucaaagauaaaa

SEQ ID NO: 18937 - RNA, 32 nt, Human
aaagacaguagccaagaagauggcauagcaua

SEQ ID NO: 18938 - RNA, 32 nt, Human
aaagacagugggcagcuucuguuucuccuucu

SEQ ID NO: 18939 - RNA, 32 nt, Human
aaagacagugguuccugacucaggaagacagu

SEQ ID NO: 18940 - RNA, 32 nt, Human
aaagacaguuaaagcaaagaagagaagugacu

SEQ ID NO: 18941 - RNA, 32 nt, Human
aaagacauacaugcaaaguuccuuugcuuugg

SEQ ID NO: 18942 - RNA, 32 nt, Human
aaagacauacguaaguauguccauaauugccc

SEQ ID NO: 18943 - RNA, 23 nt, Human
aaagacauaggacuuaacuggaa

SEQ ID NO: 18944 - RNA, 32 nt, Human
aaagacaucauucacuucaucauaaccaaaau

SEQ ID NO: 18945 - RNA, 32 nt, Human
aaagacaucuuccuggccacguguugaccuau

SEQ ID NO: 18946 - RNA, 22 nt, Human
aaagacaugaaaacuugcugua

SEQ ID NO: 18947 - RNA, 32 nt, Human
aaagacaugcagaugaauuucuuuuggauuua

SEQ ID NO: 18948 - RNA, 32 nt, Human
aaagacauuccugggugacaggcacagugcag

SEQ ID NO: 18949 - RNA, 32 nt, Human
aaagacauugccucagcuacugaagguggcca

SEQ ID NO: 18950 - RNA, 32 nt, Human
aaagacauugucaccgagugugugugacucaa

SEQ ID NO: 18951 - RNA, 32 nt, Human
aaagaccaaaguaccagcagaaugguugucua

SEQ ID NO: 18952 - RNA, 32 nt, Human
aaagaccaagaagaaaacgaggcggcgcagag

SEQ ID NO: 18953 - RNA, 32 nt, Human
aaagaccaccaggacauccugggaacucuggg

SEQ ID NO: 18954 - RNA, 32 nt, Human
aaagaccacuccucaccccagcucaagccaug

SEQ ID NO: 18955 - RNA, 31 nt, Human
aaagaccagagaguugggcuggagagaaaag

SEQ ID NO: 18956 - RNA, 22 nt, Human
aaagaccagccugggcaacaua

SEQ ID NO: 18957 - RNA, 32 nt, Human
aaagaccagcucuaacgugagcgccucggccg

SEQ ID NO: 18958 - RNA, 32 nt, Human
aaagaccaggcccagagccaggggacagguug

SEQ ID NO: 18959 - RNA, 32 nt, Human
aaagaccagguggucgggcgcgguggcucacg

SEQ ID NO: 18960 - RNA, 32 nt, Human
aaagaccagguugaaaguucucccacaaugaa

SEQ ID NO: 18961 - RNA, 32 nt, Human
aaagaccaguccugccucuguuguagaagaca

SEQ ID NO: 18962 - RNA, 32 nt, Human
aaagaccagucuccaccaccaaagucauggcu

SEQ ID NO: 18963 - RNA, 32 nt, Human
aaagaccauccaccaucacccuuuuccccuuu

SEQ ID NO: 18964 - RNA, 32 nt, Human
aaagaccaugcauucagaucugaaguagugug

SEQ ID NO: 18965 - RNA, 32 nt, Human
aaagacccaaagcguugggauuacaggcauga

SEQ ID NO: 18966 - RNA, 32 nt, Human
aaagacccacacagaauccugacuguccuugu

SEQ ID NO: 18967 - RNA, 32 nt, Human
aaagaccccuaagggcccucugagagguuaug

SEQ ID NO: 18968 - RNA, 32 nt, Human
aaagacccugcacaaagccucagccuggugaa

SEQ ID NO: 18969 - RNA, 32 nt, Human
aaagacccuggagaaagaguggcauuucuucu

SEQ ID NO: 18970 - RNA, 32 nt, Human
aaagacccuuauggaacuggaagacgucuugu

SEQ ID NO: 18971 - RNA, 32 nt, Human
aaagaccgaaaggaagaggaagaggcaccggu

SEQ ID NO: 18972 - RNA, 32 nt, Human
aaagaccgaaggggagaaaguuaaagaaaucg

SEQ ID NO: 18973 - RNA, 32 nt, Human
aaagaccuacauuccucauuguuucauguuug

SEQ ID NO: 18974 - RNA, 32 nt, Human
aaagaccuaucaaaaugucccaccuuaagccc

SEQ ID NO: 18975 - RNA, 32 nt, Human
aaagaccuccacuguuccaaggauucuacccu

SEQ ID NO: 18976 - RNA, 32 nt, Human
aaagaccuggacaaauaaagaccaaucuuaac

SEQ ID NO: 18977 - RNA, 32 nt, Human
aaagaccuuugucaaggagagugcagucaacc

SEQ ID NO: 18978 - RNA, 32 nt, Human
aaagacgagguuucaccauguugaccaggcug

SEQ ID NO: 18979 - RNA, 18 nt, Human
aaagacgauaucacgguc

SEQ ID NO: 18980 - RNA, 32 nt, Human
aaagacgcaagcccagaggcccugccauuucu

SEQ ID NO: 18981 - RNA, 32 nt, Human
aaagacggaaagaaagaaagaaaacgagcgcg

SEQ ID NO: 18982 - RNA, 32 nt, Human
aaagacggacccaggaggagugcugguucuuc

SEQ ID NO: 18983 - RNA, 32 nt, Human
aaagacggagucucacucuguugcccaggcug

SEQ ID NO: 18984 - RNA, 32 nt, Human
aaagacggagucucgcucugucacccaggcug

SEQ ID NO: 18985 - RNA, 32 nt, Human
aaagacgggaggaucacuugaggccaggaguu

SEQ ID NO: 18986 - RNA, 32 nt, Human
aaagacggggcuucacuauauuggucaggcug

SEQ ID NO: 18987 - RNA, 32 nt, Human
aaagacgggguuucaccauguuggucaggcug

SEQ ID NO: 18988 - RNA, 32 nt, Human
aaagacgggguuucaucauguuggccagggug

SEQ ID NO: 18989 - RNA, 32 nt, Human
aaagacgggguuucgccuuguugcccagggug

SEQ ID NO: 18990 - RNA, 32 nt, Human
aaagacgggguuuugucauguugcucgggcua

SEQ ID NO: 18991 - RNA, 32 nt, Human
aaagacuacauuuuccauccacccuagaggcu

SEQ ID NO: 18992 - RNA, 32 nt, Human
aaagacuacauuuugauuauuucauuuacaua

SEQ ID NO: 18993 - RNA, 32 nt, Human
aaagacuacugggaggcugcugccuccuuccu

SEQ ID NO: 18994 - RNA, 32 nt, Human
aaagacuagcuugugagcaggcucaucaguau

SEQ ID NO: 18995 - RNA, 32 nt, Human
aaagacuauauacaucugaauuuuucauccua

SEQ ID NO: 18996 - RNA, 32 nt, Human
aaagacucagagagacauaaaggagaagauuu

SEQ ID NO: 18997 - RNA, 32 nt, Human
aaagacucagcagcacauggggcagguguccu

SEQ ID NO: 18998 - RNA, 32 nt, Human
aaagacucagccaagacaaggagguagagagg

SEQ ID NO: 18999 - RNA, 32 nt, Human
aaagacucagccacuggagucuguguuuccug

SEQ ID NO: 19000 - RNA, 32 nt, Human
aaagacucauccccagccuccaccuccugugu

SEQ ID NO: 19001 - RNA, 32 nt, Human
aaagacuccaaagaaauguaagggaaacugcc

SEQ ID NO: 19002 - RNA, 32 nt, Human
aaagacuccagaacccacucuaccuccucaau

SEQ ID NO: 19003 - RNA, 32 nt, Human
aaagacuccauccugcguuacucaucagaaaa

SEQ ID NO: 19004 - RNA, 32 nt, Human
aaagacucucagaccuuuugucacagggcuac

SEQ ID NO: 19005 - RNA, 32 nt, Human
aaagacucuucuugacacauuuugccuacacu

SEQ ID NO: 19006 - RNA, 32 nt, Human
aaagacugaagaggcuggagugcaguggcgca

SEQ ID NO: 19007 - RNA, 32 nt, Human
aaagacugaagucccaggcugggggugucaau

SEQ ID NO: 19008 - RNA, 32 nt, Human
aaagacugaagugacagauuaagaguucuuga

SEQ ID NO: 19009 - RNA, 32 nt, Human
aaagacugaccuugaauucagccuggguguuc

SEQ ID NO: 19010 - RNA, 32 nt, Human
aaagacugagaagcuggauuuaaucaucccug

SEQ ID NO: 19011 - RNA, 32 nt, Human
aaagacugagccaagucaccuccagggcagug

SEQ ID NO: 19012 - RNA, 32 nt, Human
aaagacugagccuuuuuggcaggaauaauaag

SEQ ID NO: 19013 - RNA, 21 nt, Human
aaagacugcaguaaacaaagc

SEQ ID NO: 19014 - RNA, 32 nt, Human
aaagacuggaaggugauacaugaaaaugucaa

SEQ ID NO: 19015 - RNA, 32 nt, Human
aaagacuggggagaggaaggcagaugggagaa

SEQ ID NO: 19016 - RNA, 19 nt, Human
aaagacuguaugccugugu

SEQ ID NO: 19017 - RNA, 32 nt, Human
aaagacuuaaucagcagugaauacucuccacc

SEQ ID NO: 19018 - RNA, 32 nt, Human
aaagacuuagugguucuguuuucuugagacau

SEQ ID NO: 19019 - RNA, 32 nt, Human
aaagacuucuuuuccugcugauuugcauugcu

SEQ ID NO: 19020 - RNA, 32 nt, Human
aaagacuugaagggacagaagugaagaaaaua

SEQ ID NO: 19021 - RNA, 32 nt, Human
aaagacuugcuugucuugggccugucaccucc

SEQ ID NO: 19022 - RNA, 32 nt, Human
aaagacuugugcaauacauuuugaggugaaac

SEQ ID NO: 19023 - RNA, 32 nt, Human
aaagacuugugccauuggcugcucuuucuagu

SEQ ID NO: 19024 - RNA, 32 nt, Human
aaagacuuguguuugucuuuguucugcugaug

SEQ ID NO: 19025 - RNA, 32 nt, Human
aaagacuuuaaaagugaucuacaugaggaacu

SEQ ID NO: 19026 - RNA, 32 nt, Human
aaagacuuuccucuuagucgagccaaguuaag

SEQ ID NO: 19027 - RNA, 32 nt, Human
aaagacuuugcuuuuauaaagcauuuagaaaa

SEQ ID NO: 19028 - RNA, 32 nt, Human
aaagacuuuugagucccauuuuguauucauau

SEQ ID NO: 19029 - RNA, 32 nt, Human
aaagacuuuuucucccuuccucagacaaucau

SEQ ID NO: 19030 - RNA, 22 nt, Human
aaagagaaaaauaacucuuuug

SEQ ID NO: 19031 - RNA, 20 nt, Human
aaagagaaaaccguagccuc

SEQ ID NO: 19032 - RNA, 32 nt, Human
aaagagaaaacguccaggcgagcccaguuguc

SEQ ID NO: 19033 - RNA, 21 nt, Human
aaagagaaaacuguggucucu

SEQ ID NO: 19034 - RNA, 32 nt, Human
aaagagaaaaggagagagguugagcgagcgag

SEQ ID NO: 19035 - RNA, 23 nt, Human
aaagagaaaaugcgucucuccug

SEQ ID NO: 19036 - RNA, 19 nt, Human
aaagagaaaaugcuuucuc

SEQ ID NO: 19037 - RNA, 22 nt, Human
aaagagaaaauuucugcucuug

SEQ ID NO: 19038 - RNA, 32 nt, Human
aaagagaaacacaucaggauuuauaauuuuua

SEQ ID NO: 19039 - RNA, 32 nt, Human
aaagagaaaccagguauucugcuacaguuugg

SEQ ID NO: 19040 - RNA, 32 nt, Human
aaagagaaacuaucuauuugcaccuuaaaaga

SEQ ID NO: 19041 - RNA, 31 nt, Human
aaagagaaagaauuuguuucacaguuuggau

SEQ ID NO: 19042 - RNA, 32 nt, Human
aaagagaaagagacauucacuuggagggcucu

SEQ ID NO: 19043 - RNA, 32 nt, Human
aaagagaaaugagacacucuaguugcaggaaa

SEQ ID NO: 19044 - RNA, 32 nt, Human
aaagagaaaugaugcagcuggugcccgagccu

SEQ ID NO: 19045 - RNA, 32 nt, Human
aaagagaacacaguuccuuuaagaacuggcag

SEQ ID NO: 19046 - RNA, 32 nt, Human
aaagagaacauacauucucacauuaguguacu

SEQ ID NO: 19047 - RNA, 32 nt, Human
aaagagaaccauugaaggaaucuuuuuaagug

SEQ ID NO: 19048 - RNA, 32 nt, Human
aaagagaagagaagaaaaagggaggagagaga

SEQ ID NO: 19049 - RNA, 19 nt, Human
aaagagaagaggagaggac

SEQ ID NO: 19050 - RNA, 32 nt, Human
aaagagaagcuucuuuaaaagcugcuauugau

SEQ ID NO: 19051 - RNA, 32 nt, Human
aaagagaaggaaggaaggagaaagagaaggaa

SEQ ID NO: 19052 - RNA, 16 nt, Human
aaagagaaggguucaa

SEQ ID NO: 19053 - RNA, 32 nt, Human
aaagagaagguagagaauuccaggcaacaguc

SEQ ID NO: 19054 - RNA, 32 nt, Human
aaagagaagucaauuccuucuuccucaccucu

SEQ ID NO: 19055 - RNA, 32 nt, Human
aaagagaaguuucuuuaguagccacuagacaa

SEQ ID NO: 19056 - RNA, 21 nt, Human
aaagagaaugccauucucuug

SEQ ID NO: 19057 - RNA, 32 nt, Human
aaagagaauugccaauacagaaaaggaguauc

SEQ ID NO: 19058 - RNA, 32 nt, Human
aaagagacaagaaauccuaguggccucccaga

SEQ ID NO: 19059 - RNA, 31 nt, Human
aaagagacagugagagaaagaaaaagaaaaa

SEQ ID NO: 19060 - RNA, 23 nt, Human
aaagagaccucacucuucucuug

SEQ ID NO: 19061 - RNA, 32 nt, Human
aaagagaccugcuugggaaggccaggccugga

SEQ ID NO: 19062 - RNA, 32 nt, Human
aaagagaccuguuaaaccauucagaaaaagcu

SEQ ID NO: 19063 - RNA, 20 nt, Human
aaagagaccuugaacuggaa

SEQ ID NO: 19064 - RNA, 32 nt, Human
aaagagacuaggugaagagagggcaggggagc

SEQ ID NO: 19065 - RNA, 32 nt, Human
aaagagacucgccuggcuccaccaacacccac

SEQ ID NO: 19066 - RNA, 32 nt, Human
aaagagacucucguguggagguuacagcagca

SEQ ID NO: 19067 - RNA, 32 nt, Human
aaagagagaagcaggaaaagaucuuccuuuuu

SEQ ID NO: 19068 - RNA, 32 nt, Human
aaagagagacagggucucaccauguugcccag

SEQ ID NO: 19069 - RNA, 32 nt, Human
aaagagagacgcaggucugggccaggcucaca

SEQ ID NO: 19070 - RNA, 32 nt, Human
aaagagagacuggccuagcuucccagccuaga

SEQ ID NO: 19071 - RNA, 32 nt, Human
aaagagagagaaaaggagagaggaagacacac

SEQ ID NO: 19072 - RNA, 32 nt, Human
aaagagagaggaaggaaggaaggaucauauua

SEQ ID NO: 19073 - RNA, 32 nt, Human
aaagagagaggagaaaauacagcucugauggc

SEQ ID NO: 19074 - RNA, 32 nt, Human
aaagagagaggaugucucucucagacuggcac

SEQ ID NO: 19075 - RNA, 32 nt, Human
aaagagagagugugugggucuauguaaaugca

SEQ ID NO: 19076 - RNA, 32 nt, Human
aaagagagaugggaucccacuauauugcacag

SEQ ID NO: 19077 - RNA, 32 nt, Human
aaagagagcaauugauaaggcaaauaagguaa

SEQ ID NO: 19078 - RNA, 32 nt, Human
aaagagagccaccuagugagggauuauucuca

SEQ ID NO: 19079 - RNA, 32 nt, Human
aaagagagcgugccucagguuacuugaacuug

SEQ ID NO: 19080 - RNA, 32 nt, Human
aaagagaggaagagagaagcaaacauguagga

SEQ ID NO: 19081 - RNA, 32 nt, Human
aaagagaggagagaaagaaaaagagaguggga

SEQ ID NO: 19082 - RNA, 32 nt, Human
aaagagaggagccgucgcaggagccgcacacg

SEQ ID NO: 19083 - RNA, 32 nt, Human
aaagagaggauguccaugcuuaauucuagaua

SEQ ID NO: 19084 - RNA, 32 nt, Human
aaagagaggccgccgcccugcccccgccccgc

SEQ ID NO: 19085 - RNA, 32 nt, Human
aaagagaggccgugguaggugaaggaaugccc

SEQ ID NO: 19086 - RNA, 31 nt, Human
aaagagagggcacugccucagggcuuacagu

SEQ ID NO: 19087 - RNA, 31 nt, Human
aaagagagugagaguagaagcugaaagacuu

SEQ ID NO: 19088 - RNA, 32 nt, Human
aaagagagugugaaagacugcucaguggcugg

SEQ ID NO: 19089 - RNA, 32 nt, Human
aaagagaguuaaaagcagcagccccggcaacu

SEQ ID NO: 19090 - RNA, 32 nt, Human
aaagagauaagaggaggaagcuaauaagagac

SEQ ID NO: 19091 - RNA, 32 nt, Human
aaagagauauuuccuuucuucuuuccuuauuc

SEQ ID NO: 19092 - RNA, 32 nt, Human
aaagagaucgagucacaaaaauucaggaagag

SEQ ID NO: 19093 - RNA, 32 nt, Human
aaagagaugauaccccaccgcccccucuuggu

SEQ ID NO: 19094 - RNA, 32 nt, Human
aaagagauggaagggcuacugugcagcuuuug

SEQ ID NO: 19095 - RNA, 32 nt, Human
aaagagauggcugauucugggugguccuggac

SEQ ID NO: 19096 - RNA, 32 nt, Human
aaagagaugggaguucaccugagggcaagaag

SEQ ID NO: 19097 - RNA, 23 nt, Human
aaagagauggggauuuggccccu

SEQ ID NO: 19098 - RNA, 32 nt, Human
aaagagauguacugcauuuuacccccacccua

SEQ ID NO: 19099 - RNA, 32 nt, Human
aaagagauucuuuaaaaugcugcuucuucuac

SEQ ID NO: 19100 - RNA, 32 nt, Human
aaagagauuuccugugacaggccaagucuuac

SEQ ID NO: 19101 - RNA, 32 nt, Human
aaagagauuuuguaaagaccuugcuguaaaga

SEQ ID NO: 19102 - RNA, 32 nt, Human
aaagagcaaaacuagacuucuaugugagaagu

SEQ ID NO: 19103 - RNA, 32 nt, Human
aaagagcaagaggccauuucuuuucaagauag

SEQ ID NO: 19104 - RNA, 32 nt, Human
aaagagcaaggaaaggaggaugagaaaggaag

SEQ ID NO: 19105 - RNA, 32 nt, Human
aaagagcaagggguugguggccccagaaugga

SEQ ID NO: 19106 - RNA, 32 nt, Human
aaagagcacauccugauaaauacuuucucucu

SEQ ID NO: 19107 - RNA, 32 nt, Human
aaagagcagcuuggccaggugaggaugaggca

SEQ ID NO: 19108 - RNA, 32 nt, Human
aaagagcaggagagacaggucgugggcagggu

SEQ ID NO: 19109 - RNA, 32 nt, Human
aaagagcaggcauccauuuccauacaggaaca

SEQ ID NO: 19110 - RNA, 32 nt, Human
aaagagcagguguggggguuaagcacuuauuu

SEQ ID NO: 19111 - RNA, 32 nt, Human
aaagagcaucuucucucccacugcaccccuuc

SEQ ID NO: 19112 - RNA, 32 nt, Human
aaagagcauggaauugguagaagucuugggau

SEQ ID NO: 19113 - RNA, 19 nt, Human
aaagagccaggcuuugaga

SEQ ID NO: 19114 - RNA, 32 nt, Human
aaagagccagggcuagggcuggaggggccaag

SEQ ID NO: 19115 - RNA, 32 nt, Human
aaagagcccagccugccaacaccucgauuuug

SEQ ID NO: 19116 - RNA, 32 nt, Human
aaagagcccugaggcaaacacucucuccugcu

SEQ ID NO: 19117 - RNA, 32 nt, Human
aaagagccuaggagggagccucagcauacccc

SEQ ID NO: 19118 - RNA, 32 nt, Human
aaagagccucaaaucagaccagcacugauuaa

SEQ ID NO: 19119 - RNA, 32 nt, Human
aaagagccugauugcugacccagucucaggcc

SEQ ID NO: 19120 - RNA, 32 nt, Human
aaagagcgugccuuuuuccuccaucauaaccg

SEQ ID NO: 19121 - RNA, 32 nt, Human
aaagagcuaaccccuucccacacuccacccac

SEQ ID NO: 19122 - RNA, 32 nt, Human
aaagagcuacuccaccccacucuggcuguagu

SEQ ID NO: 19123 - RNA, 18 nt, Human
aaagagcucuaggcgggg

SEQ ID NO: 19124 - RNA, 32 nt, Human
aaagagcugggaacagcuucagagucaggcuc

SEQ ID NO: 19125 - RNA, 32 nt, Human
aaagagcuggggcagaggcaggaagcaggggc

SEQ ID NO: 19126 - RNA, 32 nt, Human
aaagagcuuaucuaagaagggaagagaaagcc

SEQ ID NO: 19127 - RNA, 32 nt, Human
aaagagcuucaaggacaacuagcagacuacaa

SEQ ID NO: 19128 - RNA, 32 nt, Human
aaagaggaaauugagacacagagacagacaug

SEQ ID NO: 19129 - RNA, 17 nt, Human
aaagaggaaugguuuaa

SEQ ID NO: 19130 - RNA, 32 nt, Human
aaagaggacacacuggagcugcagagacugua

SEQ ID NO: 19131 - RNA, 32 nt, Human
aaagaggacauuuuagcuuucucaguugaagg

SEQ ID NO: 19132 - RNA, 17 nt, Human
aaagaggaccaguucag

SEQ ID NO: 19133 - RNA, 32 nt, Human
aaagaggacuccuccucauucccuuuaacaug

SEQ ID NO: 19134 - RNA, 32 nt, Human
aaagaggacugcccugacauuucuuuaccauc

SEQ ID NO: 19135 - RNA, 32 nt, Human
aaagaggacuuauuguugucauggcccaugag

SEQ ID NO: 19136 - RNA, 32 nt, Human
aaagaggagaaaagcucaagaggaaaagcuaa

SEQ ID NO: 19137 - RNA, 32 nt, Human
aaagaggagaaaggaagggaagcauuacuggg

SEQ ID NO: 19138 - RNA, 32 nt, Human
aaagaggagaagcuucaccuuugcuucacaag

SEQ ID NO: 19139 - RNA, 32 nt, Human
aaagaggagagaaagaaagaaagggcacgaga

SEQ ID NO: 19140 - RNA, 32 nt, Human
aaagaggagcccagggagacagauugcaagua

SEQ ID NO: 19141 - RNA, 32 nt, Human
aaagaggaggagagagaaaaagggcacaaaau

SEQ ID NO: 19142 - RNA, 32 nt, Human
aaagaggaggagaguugaaaagagaggagaag

SEQ ID NO: 19143 - RNA, 32 nt, Human
aaagaggauaccuggugacacgcccaggcuuu

SEQ ID NO: 19144 - RNA, 32 nt, Human
aaagaggauucaguuuccaucuucucaacuuu

SEQ ID NO: 19145 - RNA, 31 nt, Human
aaagaggauugugauguaucacuggacccag

SEQ ID NO: 19146 - RNA, 32 nt, Human
aaagaggcaaagucugauguuuugggaagauu

SEQ ID NO: 19147 - RNA, 32 nt, Human
aaagaggcagcucugagauuugugucuuucug

SEQ ID NO: 19148 - RNA, 32 nt, Human
aaagaggcaucugguucucucauguggaugga

SEQ ID NO: 19149 - RNA, 32 nt, Human
aaagaggcauuuaaagaguuaacaaggauacu

SEQ ID NO: 19150 - RNA, 20 nt, Human
aaagaggccaauuccucucc

SEQ ID NO: 19151 - RNA, 32 nt, Human
aaagaggccacaaaaagggccugcugacuccc

SEQ ID NO: 19152 - RNA, 32 nt, Human
aaagaggccagccuggccaacccugucucaaa

SEQ ID NO: 19153 - RNA, 32 nt, Human
aaagaggccagcgugugugggguggggagggc

SEQ ID NO: 19154 - RNA, 20 nt, Human
aaagaggccaucucacuaga

SEQ ID NO: 19155 - RNA, 32 nt, Human
aaagaggcccuggaggaggguggggcuggccg

SEQ ID NO: 19156 - RNA, 32 nt, Human
aaagaggccucuuccaacccacccucgggcug

SEQ ID NO: 19157 - RNA, 23 nt, Human
aaagaggcuauaaauuauucaca

SEQ ID NO: 19158 - RNA, 32 nt, Human
aaagaggcucaauuuucuagauggguggcaac

SEQ ID NO: 19159 - RNA, 32 nt, Human
aaagaggcuggcaaggguuguuuccagagggg

SEQ ID NO: 19160 - RNA, 32 nt, Human
aaagaggcuguucccagcuccagcucuaaccu

SEQ ID NO: 19161 - RNA, 32 nt, Human
aaagaggcuucaaaucuagaacugaauuauau

SEQ ID NO: 19162 - RNA, 19 nt, Human
aaagaggcuugccuugagg

SEQ ID NO: 19163 - RNA, 32 nt, Human
aaagaggcuuugcccaaggcugcauuccagua

SEQ ID NO: 19164 - RNA, 32 nt, Human
aaagaggcuuugcuuugcgcauaucaggcuua

SEQ ID NO: 19165 - RNA, 32 nt, Human
aaagagggaaggagggagagggggaggaaaug

SEQ ID NO: 19166 - RNA, 32 nt, Human
aaagagggacaggagagcaccaggaacaacac

SEQ ID NO: 19167 - RNA, 32 nt, Human
aaagagggagagaugaguggguuagcuaccug

SEQ ID NO: 19168 - RNA, 32 nt, Human
aaagagggagcgagggcaaauggggaguagag

SEQ ID NO: 19169 - RNA, 32 nt, Human
aaagagggaggaagagagggagggagggagga

SEQ ID NO: 19170 - RNA, 32 nt, Human
aaagagggauuaagguggcagguggagugaag

SEQ ID NO: 19171 - RNA, 32 nt, Human
aaagagggcaggaggaagccaggcaugucuuu

SEQ ID NO: 19172 - RNA, 32 nt, Human
aaagagggcagugaguuugauuugaugaaaug

SEQ ID NO: 19173 - RNA, 32 nt, Human
aaagagggccacaguggggagcaggggcaccu

SEQ ID NO: 19174 - RNA, 32 nt, Human
aaagaggggaaaauagugguagugcacuaauu

SEQ ID NO: 19175 - RNA, 32 nt, Human
aaagaggggaaaaugaguuuuuauggggcuga

SEQ ID NO: 19176 - RNA, 32 nt, Human
aaagaggggcuaggcugauggggaagggggcu

SEQ ID NO: 19177 - RNA, 32 nt, Human
aaagaggggcucaaacuuaacuccagcccuga

SEQ ID NO: 19178 - RNA, 32 nt, Human
aaagagguaagaaugaggggaaugggcacaau

SEQ ID NO: 19179 - RNA, 32 nt, Human
aaagagguaauuuuucuccuccucccagucau

SEQ ID NO: 19180 - RNA, 32 nt, Human
aaagaggucaccagaugcacaugggccgcaaa

SEQ ID NO: 19181 - RNA, 32 nt, Human
aaagagguguacuggacuuacaguuccacaug

SEQ ID NO: 19182 - RNA, 32 nt, Human
aaagagguguggugugaacacauacaacaugu

SEQ ID NO: 19183 - RNA, 32 nt, Human
aaagagguuaucucccucugugccaggccaga

SEQ ID NO: 19184 - RNA, 32 nt, Human
aaagaguaaaaauuaaaaaggccaggcccagu

SEQ ID NO: 19185 - RNA, 32 nt, Human
aaagaguaacaugcucuuucuacacagacaug

SEQ ID NO: 19186 - RNA, 32 nt, Human
aaagaguaacuggcauguuagucuugaaaaug

SEQ ID NO: 19187 - RNA, 32 nt, Human
aaagaguaauuccuauccugugugccucagaa

SEQ ID NO: 19188 - RNA, 32 nt, Human
aaagaguaugugaauaguagcaaaauauugau

SEQ ID NO: 19189 - RNA, 32 nt, Human
aaagaguauuugccaacagucaucauaauauc

SEQ ID NO: 19190 - RNA, 21 nt, Human
aaagagucacaauauuccaca

SEQ ID NO: 19191 - RNA, 21 nt, Human
aaagagucagaaaucuucaca

SEQ ID NO: 19192 - RNA, 32 nt, Human
aaagaguccaguuaggguggacuaacuuugga

SEQ ID NO: 19193 - RNA, 32 nt, Human
aaagaguccucagccuuccuguccugcaucug

SEQ ID NO: 19194 - RNA, 32 nt, Human
aaagagugagagaagauggaagggaagggcca

SEQ ID NO: 19195 - RNA, 32 nt, Human
aaagagugagucuucugauuggcagcuguggc

SEQ ID NO: 19196 - RNA, 19 nt, Human
aaagagugauuccuugagg

SEQ ID NO: 19197 - RNA, 32 nt, Human
aaagaguggauauauuuaaccauaacauacug

SEQ ID NO: 19198 - RNA, 31 nt, Human
aaagagugggugggaagacuagugaaaccca

SEQ ID NO: 19199 - RNA, 32 nt, Human
aaagagugucaaggaauaggguggggcaaugu

SEQ ID NO: 19200 - RNA, 32 nt, Human
aaagaguuaacggugugggccacuccagcuug

SEQ ID NO: 19201 - RNA, 32 nt, Human
aaagaguugcaagagaaguuacaguccaggug

SEQ ID NO: 19202 - RNA, 32 nt, Human
aaagaguuuggagaagacuggagccagccuug

SEQ ID NO: 19203 - RNA, 32 nt, Human
aaagaguuugugaaagguuucagucuaacugg

SEQ ID NO: 19204 - RNA, 32 nt, Human
aaagauaaaagcuucgaugaugaagaaucagu

SEQ ID NO: 19205 - RNA, 32 nt, Human
aaagauaaacacauagggugugauuucuauac

SEQ ID NO: 19206 - RNA, 32 nt, Human
aaagauaaaccaggaugagaggcugcaugaca

SEQ ID NO: 19207 - RNA, 32 nt, Human
aaagauaagguacaggaaugaaccuugguuua

SEQ ID NO: 19208 - RNA, 32 nt, Human
aaagauaccaacauucagaaauucauuucagc

SEQ ID NO: 19209 - RNA, 32 nt, Human
aaagauagaaaagagggaauaaucuuuccaaa

SEQ ID NO: 19210 - RNA, 32 nt, Human
aaagauagacuugggacagauaaggacagaga

SEQ ID NO: 19211 - RNA, 32 nt, Human
aaagauagacuuuugccuaaguggcuuagcug

SEQ ID NO: 19212 - RNA, 32 nt, Human
aaagauagggucuuucuauguugcccaggcuc

SEQ ID NO: 19213 - RNA, 32 nt, Human
aaagauaguugcaaccucaccucccucacuca

SEQ ID NO: 19214 - RNA, 32 nt, Human
aaagauaguuucuccuagcucagacuuaacca

SEQ ID NO: 19215 - RNA, 32 nt, Human
aaagauaucuguguccuaauccucagaacuug

SEQ ID NO: 19216 - RNA, 32 nt, Human
aaagauaugucugcacuuugaggucccuuuug

SEQ ID NO: 19217 - RNA, 32 nt, Human
aaagauauuaaccucaucacuacuaacucacu

SEQ ID NO: 19218 - RNA, 32 nt, Human
aaagauauuuguugucuuugaaugauuugcug

SEQ ID NO: 19219 - RNA, 32 nt, Human
aaagaucaacagcaaucugaagacucugacua

SEQ ID NO: 19220 - RNA, 32 nt, Human
aaagaucacacagcagcugcuccugacaggga

SEQ ID NO: 19221 - RNA, 32 nt, Human
aaagaucacauauacugauuuuaaaggcuccu

SEQ ID NO: 19222 - RNA, 32 nt, Human
aaagaucacgccacugcacuccagccugggcg

SEQ ID NO: 19223 - RNA, 32 nt, Human
aaagaucacuuugucaccagcccugggaccug

SEQ ID NO: 19224 - RNA, 32 nt, Human
aaagaucauuccacucagccugggacgauggg

SEQ ID NO: 19225 - RNA, 32 nt, Human
aaagauccaaacugagaaagcaggccgggcau

SEQ ID NO: 19226 - RNA, 28 nt, Human
aaagauccaagugcuuucuuuucauuuc

SEQ ID NO: 19227 - RNA, 32 nt, Human
aaagauccagagagugggggugaggggugggc

SEQ ID NO: 19228 - RNA, 28 nt, Human
aaagauccagcuguugccucauuccuug

SEQ ID NO: 19229 - RNA, 32 nt, Human
aaagaucgagaaaucaaaugaaguucuccuga

SEQ ID NO: 19230 - RNA, 32 nt, Human
aaagaucguaccgcugcacuccagccugggug

SEQ ID NO: 19231 - RNA, 32 nt, Human
aaagaucuacucucacaauauacucaacauua

SEQ ID NO: 19232 - RNA, 32 nt, Human
aaagaucugcagagcccugagcagggacucuu

SEQ ID NO: 19233 - RNA, 32 nt, Human
aaagaucugucuuccuccuuuuccaggccccu

SEQ ID NO: 19234 - RNA, 17 nt, Human
aaagaucugugcacuga

SEQ ID NO: 19235 - RNA, 32 nt, Human
aaagaucuguguguguuggggagcugucaugu

SEQ ID NO: 19236 - RNA, 32 nt, Human
aaagaugaaaggcuuauuauuaugauauaauc

SEQ ID NO: 19237 - RNA, 32 nt, Human
aaagaugaaggcagagaucggaguuuugcagc

SEQ ID NO: 19238 - RNA, 32 nt, Human
aaagaugaggagacagagguccaggguggguu

SEQ ID NO: 19239 - RNA, 32 nt, Human
aaagaugaggcagagguccaaguaaccgcuag

SEQ ID NO: 19240 - RNA, 32 nt, Human
aaagaugauccagugcagggucugagcuagaa

SEQ ID NO: 19241 - RNA, 32 nt, Human
aaagaugauccucccaacaccuugacaccucc

SEQ ID NO: 19242 - RNA, 32 nt, Human
aaagaugaugcugcaggaauccuucuuaaaaa

SEQ ID NO: 19243 - RNA, 32 nt, Human
aaagaugcaacuugcccagcugucuguuauga

SEQ ID NO: 19244 - RNA, 32 nt, Human
aaagaugcagccucacugcuucaacgcagauu

SEQ ID NO: 19245 - RNA, 32 nt, Human
aaagaugccaggauauuggggcugaggggagu

SEQ ID NO: 19246 - RNA, 32 nt, Human
aaagaugccaugaccuucaccgagggccagac

SEQ ID NO: 19247 - RNA, 32 nt, Human
aaagaugcccuauccaugagaugccuuuucau

SEQ ID NO: 19248 - RNA, 32 nt, Human
aaagaugccucaggcaggucucagccuggggg

SEQ ID NO: 19249 - RNA, 32 nt, Human
aaagaugcgaaaaccugaugagggcaaaccag

SEQ ID NO: 19250 - RNA, 32 nt, Human
aaagaugcucagggaaacacaggccucagcug

SEQ ID NO: 19251 - RNA, 32 nt, Human
aaagaugcugguucuggcuggacgcgguggcu

SEQ ID NO: 19252 - RNA, 32 nt, Human
aaagaugcuguucacauagcaccccaagaaag

SEQ ID NO: 19253 - RNA, 29 nt, Human
aaagauggaaacacuggagucugaauuga

SEQ ID NO: 19254 - RNA, 18 nt, Human
aaagauggaaacuaggga

SEQ ID NO: 19255 - RNA, 21 nt, Human
aaagauggacaaacagagauc

SEQ ID NO: 19256 - RNA, 32 nt, Human
aaagauggacuauucuucuuuaaucuggaauu

SEQ ID NO: 19257 - RNA, 21 nt, Human
aaagauggacuccgauggauc

SEQ ID NO: 19258 - RNA, 20 nt, Human
aaagauggagaaacaggauc

SEQ ID NO: 19259 - RNA, 32 nt, Human
aaagauggagaaacaggaucagaggguggaua

SEQ ID NO: 19260 - RNA, 32 nt, Human
aaagauggagagaagacugcagugagcggagu

SEQ ID NO: 19261 - RNA, 32 nt, Human
aaagauggagugagccacaggaaguuuggggc

SEQ ID NO: 19262 - RNA, 32 nt, Human
aaagauggcauuucaccauguuguacaggcug

SEQ ID NO: 19263 - RNA, 29 nt, Human
aaagauggccagguucucuacugugaugg

SEQ ID NO: 19264 - RNA, 29 nt, Human
aaagauggcuaaugcagaagugagugucc

SEQ ID NO: 19265 - RNA, 32 nt, Human
aaagauggcuucagagagguggucacaugcuu

SEQ ID NO: 19266 - RNA, 32 nt, Human
aaagaugggcaguuucuguggcauuuuaggca

SEQ ID NO: 19267 - RNA, 32 nt, Human
aaagaugggcuucaaauaaaagucugcagagu

SEQ ID NO: 19268 - RNA, 21 nt, Human
aaagaugggcuucaugggauu

SEQ ID NO: 19269 - RNA, 32 nt, Human
aaagauggggucucuauauguuucccaggcug

SEQ ID NO: 19270 - RNA, 32 nt, Human
aaagauggggucuggcuaucuugcccaggcuu

SEQ ID NO: 19271 - RNA, 32 nt, Human
aaagauggggucuugcucugucgccaggcugg

SEQ ID NO: 19272 - RNA, 32 nt, Human
aaagauggggucuuguuauauugccuaggcug

SEQ ID NO: 19273 - RNA, 32 nt, Human
aaagaugggguuucaccauguuggccaggcug

SEQ ID NO: 19274 - RNA, 29 nt, Human
aaagaugggguuucaccauguuggucagg

SEQ ID NO: 19275 - RNA, 32 nt, Human
aaagauggguagagucaucuuaucucaggaug

SEQ ID NO: 19276 - RNA, 29 nt, Human
aaagauggucaugaggccccuguggaguc

SEQ ID NO: 19277 - RNA, 32 nt, Human
aaagauggugugagccauacacacagcaggau

SEQ ID NO: 19278 - RNA, 32 nt, Human
aaagauguaaaauaugccagaugugugugagu

SEQ ID NO: 19279 - RNA, 32 nt, Human
aaagauguaaaugauucagguuuaaagcucua

SEQ ID NO: 19280 - RNA, 32 nt, Human
aaagauguauaugaauaaguaucagacccuuu

SEQ ID NO: 19281 - RNA, 32 nt, Human
aaagauguccaucaagggaggaaggguggguc

SEQ ID NO: 19282 - RNA, 32 nt, Human
aaagaugugaaugaguguuacaguugaaagcc

SEQ ID NO: 19283 - RNA, 29 nt, Human
aaagauguggagugggcugcuaccuccug

SEQ ID NO: 19284 - RNA, 32 nt, Human
aaagauguggauacaggaagauaaaagcauca

SEQ ID NO: 19285 - RNA, 32 nt, Human
aaagauguucaucacagcgucaacuguaagag

SEQ ID NO: 19286 - RNA, 32 nt, Human
aaagauguuccagugaggaacccugaucucuc

SEQ ID NO: 19287 - RNA, 32 nt, Human
aaagauuacaauaucuuuauuucaaagaucuu

SEQ ID NO: 19288 - RNA, 32 nt, Human
aaagauuauaaauauacuuuauaucaauuuuc

SEQ ID NO: 19289 - RNA, 32 nt, Human
aaagauuauuaaaaauauucccaaaaggcagg

SEQ ID NO: 19290 - RNA, 32 nt, Human
aaagauucagaacugaaaacuccaccuuccgu

SEQ ID NO: 19291 - RNA, 32 nt, Human
aaagauucauuucucucccacccucaacucca

SEQ ID NO: 19292 - RNA, 32 nt, Human
aaagauucauuuguuuugagcaauaaacuaau

SEQ ID NO: 19293 - RNA, 32 nt, Human
aaagauucauuuuucaaggagaagagccugca

SEQ ID NO: 19294 - RNA, 32 nt, Human
aaagauuccacuuuugguuauccuguaugcug

SEQ ID NO: 19295 - RNA, 32 nt, Human
aaagauuccaggacagagaugacagaggcuua

SEQ ID NO: 19296 - RNA, 32 nt, Human
aaagauuccuuuccuauccauccuuccaucca

SEQ ID NO: 19297 - RNA, 32 nt, Human
aaagauucuggcccaacuccaucgcugcgggg

SEQ ID NO: 19298 - RNA, 32 nt, Human
aaagauucuguaacucucuuuuagcaccaaau

SEQ ID NO: 19299 - RNA, 32 nt, Human
aaagauugugccacuacacuccagccugggag

SEQ ID NO: 19300 - RNA, 32 nt, Human
aaagauuuaguaggaguguaaagugacauucu

SEQ ID NO: 19301 - RNA, 32 nt, Human
aaagauuuccaucaccacagaaaggucggcug

SEQ ID NO: 19302 - RNA, 32 nt, Human
aaagauuucucaggaagacagcagagcagagg

SEQ ID NO: 19303 - RNA, 32 nt, Human
aaagauuucucuuuuauaccuuccucacuggc

SEQ ID NO: 19304 - RNA, 32 nt, Human
aaagauuucuuuucauuauucuccacuuuuuc

SEQ ID NO: 19305 - RNA, 32 nt, Human
aaagauuugugugguucugcuuuuacuguaac

SEQ ID NO: 19306 - RNA, 32 nt, Human
aaagauuuguuuuucccuuuucccaaggaagc

SEQ ID NO: 19307 - RNA, 32 nt, Human
aaagauuuuaaaguacuucucuagucauugaa

SEQ ID NO: 19308 - RNA, 32 nt, Human
aaagauuuuacaagaccuaauuuuggguuccu

SEQ ID NO: 19309 - RNA, 22 nt, Human
aaagauuuucuaaaugucacug

SEQ ID NO: 19310 - RNA, 31 nt, Human
aaagcaaaaauaaaaaccuguugcaaaguuc

SEQ ID NO: 19311 - RNA, 20 nt, Human
aaagcaaaacaaaacaaaca

SEQ ID NO: 19312 - RNA, 32 nt, Human
aaagcaaaccaaaagaaaaaucugaaauuucc

SEQ ID NO: 19313 - RNA, 31 nt, Human
aaagcaaagaacuucuuuacugauuccuugu

SEQ ID NO: 19314 - RNA, 32 nt, Human
aaagcaaagagucacugcaucaaugaaaguuc

SEQ ID NO: 19315 - RNA, 32 nt, Human
aaagcaaagguguggagaagguucagaggaga

SEQ ID NO: 19316 - RNA, 32 nt, Human
aaagcaaaucuauuuucucugcuguguauuaa

SEQ ID NO: 19317 - RNA, 32 nt, Human
aaagcaaaugacuaguaaacaugugggaaaaa

SEQ ID NO: 19318 - RNA, 18 nt, Human
aaagcaaauguggacuga

SEQ ID NO: 19319 - RNA, 32 nt, Human
aaagcaaauuuggcaaagacuaccugcuggag

SEQ ID NO: 19320 - RNA, 32 nt, Human
aaagcaacaagccuggacuuugcucuacaaca

SEQ ID NO: 19321 - RNA, 32 nt, Human
aaagcaacaaguccuaggagcacacaaagcaa

SEQ ID NO: 19322 - RNA, 32 nt, Human
aaagcaacaguguuuuguaguaccaggcugug

SEQ ID NO: 19323 - RNA, 32 nt, Human
aaagcaacaguuacggagggaggacaucauaa

SEQ ID NO: 19324 - RNA, 32 nt, Human
aaagcaacccaguccccaaccugcacucuacc

SEQ ID NO: 19325 - RNA, 23 nt, Human
aaagcaacccucaaugguuuuga

SEQ ID NO: 19326 - RNA, 32 nt, Human
aaagcaacgaacauucacucucucacagucug

SEQ ID NO: 19327 - RNA, 32 nt, Human
aaagcaacuuguccauugcugaagucgaaauu

SEQ ID NO: 19328 - RNA, 32 nt, Human
aaagcaagaaaagaaagagaagacugagaaua

SEQ ID NO: 19329 - RNA, 32 nt, Human
aaagcaagaagaaauguuuaaaagccagggga

SEQ ID NO: 19330 - RNA, 32 nt, Human
aaagcaagaagaaguguccuucucuguagcua

SEQ ID NO: 19331 - RNA, 32 nt, Human
aaagcaagaugaaguguccuucucuguagcua

SEQ ID NO: 19332 - RNA, 32 nt, Human
aaagcaagcaaagcaaaacaauaaacuagcag

SEQ ID NO: 19333 - RNA, 32 nt, Human
aaagcaagcaagaagaaagagaaagagagaag

SEQ ID NO: 19334 - RNA, 32 nt, Human
aaagcaaggaaagaguacugugugcugagaga

SEQ ID NO: 19335 - RNA, 23 nt, Human
aaagcaauauuuuucaucacaug

SEQ ID NO: 19336 - RNA, 32 nt, Human
aaagcaaugagguugucgagacugggaaaacu

SEQ ID NO: 19337 - RNA, 32 nt, Human
aaagcaauggcugagcuaagggaugggguacc

SEQ ID NO: 19338 - RNA, 31 nt, Human
aaagcaauuacuagaagaguuggagaagcau

SEQ ID NO: 19339 - RNA, 32 nt, Human
aaagcaauuccucugucuuccuugugaguugc

SEQ ID NO: 19340 - RNA, 32 nt, Human
aaagcaauuucguccaaagucugcaccucggu

SEQ ID NO: 19341 - RNA, 32 nt, Human
aaagcacaaacagugaggcccccacccgagag

SEQ ID NO: 19342 - RNA, 32 nt, Human
aaagcacaaagacagaaguaaagcuuuaugcu

SEQ ID NO: 19343 - RNA, 32 nt, Human
aaagcacaccucaugcugagcgcucucuuagg

SEQ ID NO: 19344 - RNA, 32 nt, Human
aaagcacaggcagaguggucagggcugaaguc

SEQ ID NO: 19345 - RNA, 20 nt, Human
aaagcacaguccccaugcug

SEQ ID NO: 19346 - RNA, 32 nt, Human
aaagcacauaaacccaaagggcaaacaauuua

SEQ ID NO: 19347 - RNA, 32 nt, Human
aaagcacauaagcuagaagaagaaauauuucu

SEQ ID NO: 19348 - RNA, 32 nt, Human
aaagcacaucauggcuuuaaguaccauguugu

SEQ ID NO: 19349 - RNA, 32 nt, Human
aaagcacaugcaucugcuauuguguuggguug

SEQ ID NO: 19350 - RNA, 32 nt, Human
aaagcaccaauuacugcccucugccucagcag

SEQ ID NO: 19351 - RNA, 32 nt, Human
aaagcaccaauuagcagucucuucccauuuuc

SEQ ID NO: 19352 - RNA, 32 nt, Human
aaagcaccagaaggagggugucuuagguccag

SEQ ID NO: 19353 - RNA, 32 nt, Human
aaagcaccagaagugauuuggaagagaaaucc

SEQ ID NO: 19354 - RNA, 32 nt, Human
aaagcacccagaggucaucugugugucccgag

SEQ ID NO: 19355 - RNA, 32 nt, Human
aaagcaccucaccccagcacagugccaccccu

SEQ ID NO: 19356 - RNA, 32 nt, Human
aaagcacgugauaacuuugaaggaggcugccu

SEQ ID NO: 19357 - RNA, 32 nt, Human
aaagcacuaaguuuucuuugaauguuccauug

SEQ ID NO: 19358 - RNA, 32 nt, Human
aaagcacuaugcuggucaugaacugcuucaaa

SEQ ID NO: 19359 - RNA, 31 nt, Human
aaagcacucaauaaauguuuguuuaaugaaa

SEQ ID NO: 19360 - RNA, 32 nt, Human
aaagcacuggaauccaggcuuccagcuccaua

SEQ ID NO: 19361 - RNA, 32 nt, Human
aaagcacuggggcaggggccagagcagcagca

SEQ ID NO: 19362 - RNA, 32 nt, Human
aaagcacuuaaccaggccccaagccuucaagg

SEQ ID NO: 19363 - RNA, 32 nt, Human
aaagcacuuccaucgcugaggaaaguucugcu

SEQ ID NO: 19364 - RNA, 32 nt, Human
aaagcagaaacauuaguuacaagugucuuaca

SEQ ID NO: 19365 - RNA, 32 nt, Human
aaagcagaaagagaaaugagacacucuaguug

SEQ ID NO: 19366 - RNA, 32 nt, Human
aaagcagacaacacucuagaacuggagagagg

SEQ ID NO: 19367 - RNA, 32 nt, Human
aaagcagacacuacuccaguaugucccaguag

SEQ ID NO: 19368 - RNA, 32 nt, Human
aaagcagacggggcguggguggggaaggggcu

SEQ ID NO: 19369 - RNA, 32 nt, Human
aaagcagacggugcuuggaugggcagggagaa

SEQ ID NO: 19370 - RNA, 32 nt, Human
aaagcagacugcaggccuccagcacuggcgca

SEQ ID NO: 19371 - RNA, 32 nt, Human
aaagcagacuugggaaccuggaagcacucugg

SEQ ID NO: 19372 - RNA, 32 nt, Human
aaagcagagaacagaggaggcccaacugagga

SEQ ID NO: 19373 - RNA, 32 nt, Human
aaagcagagaacagaggaggcccaucugagga

SEQ ID NO: 19374 - RNA, 32 nt, Human
aaagcagagagggaaaaacggagagugaagga

SEQ ID NO: 19375 - RNA, 32 nt, Human
aaagcagagagggagggcaggcgggagggagg

SEQ ID NO: 19376 - RNA, 32 nt, Human
aaagcagagaugggcuuucagcagaauaucaa

SEQ ID NO: 19377 - RNA, 32 nt, Human
aaagcagagcuggccugguugaaggaagggug

SEQ ID NO: 19378 - RNA, 32 nt, Human
aaagcagagucuuaaagagguuagagaggugg

SEQ ID NO: 19379 - RNA, 32 nt, Human
aaagcagaugcuguuuagcaccugccaaggag

SEQ ID NO: 19380 - RNA, 32 nt, Human
aaagcagaugugggagauuuuaagaagaaaag

SEQ ID NO: 19381 - RNA, 20 nt, Human
aaagcagcaagaacucaggg

SEQ ID NO: 19382 - RNA, 32 nt, Human
aaagcagcacuuaaggguggugcucuaauagc

SEQ ID NO: 19383 - RNA, 32 nt, Human
aaagcagcagccccggcaacucuggcuccagg

SEQ ID NO: 19384 - RNA, 19 nt, Human
aaagcagcaggacuguggg

SEQ ID NO: 19385 - RNA, 32 nt, Human
aaagcagcauugaagcagccuuuucccauugu

SEQ ID NO: 19386 - RNA, 32 nt, Human
aaagcagccauggaagagccugcagcucccuc

SEQ ID NO: 19387 - RNA, 32 nt, Human
aaagcagcccauuccugggcucagagacuccc

SEQ ID NO: 19388 - RNA, 32 nt, Human
aaagcagccccuuacccuuccugggcuucccc

SEQ ID NO: 19389 - RNA, 32 nt, Human
aaagcagccguugggagcccaggaggcggggc

SEQ ID NO: 19390 - RNA, 32 nt, Human
aaagcagccucccuucuccucucccuccacuc

SEQ ID NO: 19391 - RNA, 32 nt, Human
aaagcagccuuccugcucggugcacgaugcug

SEQ ID NO: 19392 - RNA, 32 nt, Human
aaagcagcgcggccgccgccuccgagggcugc

SEQ ID NO: 19393 - RNA, 32 nt, Human
aaagcagcuauggcuuuauuucccucuaccuu

SEQ ID NO: 19394 - RNA, 32 nt, Human
aaagcagcuuucuaaguuauugccuugguuau

SEQ ID NO: 19395 - RNA, 32 nt, Human
aaagcagcuuuugggggaaacugaggcagugg

SEQ ID NO: 19396 - RNA, 32 nt, Human
aaagcaggaaagcagauagagcagggaaaagg

SEQ ID NO: 19397 - RNA, 32 nt, Human
aaagcaggaaaguaugcuugggagaggccaag

SEQ ID NO: 19398 - RNA, 32 nt, Human
aaagcaggacacacgugaguccagccaacuca

SEQ ID NO: 19399 - RNA, 32 nt, Human
aaagcaggaggaaugcugacugguugaugaaa

SEQ ID NO: 19400 - RNA, 32 nt, Human
aaagcaggauguggcaguugcagugagaaagg

SEQ ID NO: 19401 - RNA, 32 nt, Human
aaagcaggcaggcagacagcugcugggggaaa

SEQ ID NO: 19402 - RNA, 23 nt, Human
aaagcaggcggaucaccugaggu

SEQ ID NO: 19403 - RNA, 32 nt, Human
aaagcaggcugccggagccagcagcggcaacc

SEQ ID NO: 19404 - RNA, 32 nt, Human
aaagcaggcugcuggagccagcaguggcagcc

SEQ ID NO: 19405 - RNA, 32 nt, Human
aaagcagggaauuuuuaaaaugugaguaauuu

SEQ ID NO: 19406 - RNA, 32 nt, Human
aaagcagggccaggccagaagcugguguccaa

SEQ ID NO: 19407 - RNA, 32 nt, Human
aaagcagggcuggggagaaugagauggacgca

SEQ ID NO: 19408 - RNA, 32 nt, Human
aaagcagggguuucuagaaguuggucaacaga

SEQ ID NO: 19409 - RNA, 32 nt, Human
aaagcagguggaucacgguaucaggaaacuga

SEQ ID NO: 19410 - RNA, 32 nt, Human
aaagcaguacuaagaggggaauuuguagcaau

SEQ ID NO: 19411 - RNA, 32 nt, Human
aaagcaguauuucucauuccugccuccucaau

SEQ ID NO: 19412 - RNA, 32 nt, Human
aaagcagucacaaguacagacacuucacuuag

SEQ ID NO: 19413 - RNA, 32 nt, Human
aaagcagucuguauuccaucaucuuccuuuuu

SEQ ID NO: 19414 - RNA, 32 nt, Human
aaagcagugaaugcaggauggugguugaaauu

SEQ ID NO: 19415 - RNA, 32 nt, Human
aaagcagugaauuuauuggagcaugccacgga

SEQ ID NO: 19416 - RNA, 21 nt, Human
aaagcagugacaaccauuggc

SEQ ID NO: 19417 - RNA, 32 nt, Human
aaagcagugagaaaguugaggugauaaacaac

SEQ ID NO: 19418 - RNA, 32 nt, Human
aaagcaguguacagacaccugccuucuuuaag

SEQ ID NO: 19419 - RNA, 32 nt, Human
aaagcagugucaagacaguaaggauucaaacc

SEQ ID NO: 19420 - RNA, 32 nt, Human
aaagcaguuuucuaucaccuaagugguuuuuc

SEQ ID NO: 19421 - RNA, 32 nt, Human
aaagcauacgugcuaugacucucuccaguuug

SEQ ID NO: 19422 - RNA, 32 nt, Human
aaagcauacuggagaauaagcuacaaagagcc

SEQ ID NO: 19423 - RNA, 32 nt, Human
aaagcauagcaaggcuguauggaucauuguga

SEQ ID NO: 19424 - RNA, 32 nt, Human
aaagcauagcaguucucuaggggagaggccug

SEQ ID NO: 19425 - RNA, 32 nt, Human
aaagcauaggaaaauccgagaaacauauggug

SEQ ID NO: 19426 - RNA, 32 nt, Human
aaagcaucagccuuuuaccaucaugucccugu

SEQ ID NO: 19427 - RNA, 32 nt, Human
aaagcaucagggaugcuaagugcagugaugag

SEQ ID NO: 19428 - RNA, 32 nt, Human
aaagcaucaguauuuauagcaaaaagagacuc

SEQ ID NO: 19429 - RNA, 32 nt, Human
aaagcaucauucuuuaauuacuguaccaucca

SEQ ID NO: 19430 - RNA, 32 nt, Human
aaagcaucauuucugccagcuucuuauggucc

SEQ ID NO: 19431 - RNA, 32 nt, Human
aaagcauccaggauucagugaagaacugacua

SEQ ID NO: 19432 - RNA, 32 nt, Human
aaagcaucuggaaauaggaagacagagaaggu

SEQ ID NO: 19433 - RNA, 32 nt, Human
aaagcaucuucccagggguccaccucccuuua

SEQ ID NO: 19434 - RNA, 32 nt, Human
aaagcaucuuugcucaacuccugggacugaac

SEQ ID NO: 19435 - RNA, 32 nt, Human
aaagcaugaauguuaacccacagaauccaagg

SEQ ID NO: 19436 - RNA, 32 nt, Human
aaagcaugaucaggaauccgaaugccuacaag

SEQ ID NO: 19437 - RNA, 32 nt, Human
aaagcaugcauucuagcacaacaagaugaaau

SEQ ID NO: 19438 - RNA, 32 nt, Human
aaagcaugccguucugcaccuacccaguugcc

SEQ ID NO: 19439 - RNA, 32 nt, Human
aaagcaugggaccugucgucucagccuguugg

SEQ ID NO: 19440 - RNA, 32 nt, Human
aaagcaugguuuggugccagccccuucaccuc

SEQ ID NO: 19441 - RNA, 31 nt, Human
aaagcauguaguaccaagcacuuguauuucc

SEQ ID NO: 19442 - RNA, 32 nt, Human
aaagcauguagugacuguuuuucaagaagaaa

SEQ ID NO: 19443 - RNA, 32 nt, Human
aaagcaugucuugcacuguucaaccuccugag

SEQ ID NO: 19444 - RNA, 32 nt, Human
aaagcauguuucaggaucagaucaauacaauc

SEQ ID NO: 19445 - RNA, 23 nt, Human
aaagcauuaucaugccccugcug

SEQ ID NO: 19446 - RNA, 32 nt, Human
aaagcauuaugaggcuggagacauagguggga

SEQ ID NO: 19447 - RNA, 32 nt, Human
aaagcauucauucuccccauuugugacauuug

SEQ ID NO: 19448 - RNA, 32 nt, Human
aaagcauucuccccagcaugucucuuccagcu

SEQ ID NO: 19449 - RNA, 32 nt, Human
aaagcauucuugcucaucuccaaauaaaacgu

SEQ ID NO: 19450 - RNA, 32 nt, Human
aaagcauugguggucagagggaagacucuggu

SEQ ID NO: 19451 - RNA, 32 nt, Human
aaagcauuguccagagguaggaacacagucug

SEQ ID NO: 19452 - RNA, 32 nt, Human
aaagcauuucacccucucaaugccucaccuuu

SEQ ID NO: 19453 - RNA, 32 nt, Human
aaagcauuugcuguguuucguuagcaucuggc

SEQ ID NO: 19454 - RNA, 32 nt, Human
aaagccaaaauccccauccaaaggacaguaau

SEQ ID NO: 19455 - RNA, 21 nt, Human
aaagccaaacccaccugugua

SEQ ID NO: 19456 - RNA, 32 nt, Human
aaagccaaagguuugaacaaguuguggauggu

SEQ ID NO: 19457 - RNA, 32 nt, Human
aaagccaaaucaagaggaacaagagcaaaauc

SEQ ID NO: 19458 - RNA, 32 nt, Human
aaagccaacaguaagccccaggaaaggguuuu

SEQ ID NO: 19459 - RNA, 32 nt, Human
aaagccaagagcucugucucccucccaaccca

SEQ ID NO: 19460 - RNA, 32 nt, Human
aaagccaagcuacaaauuaaauccucagccug

SEQ ID NO: 19461 - RNA, 32 nt, Human
aaagccaaggugaaggaugaaucacagagaag

SEQ ID NO: 19462 - RNA, 32 nt, Human
aaagccacaaagucagugccuggagaaggguu

SEQ ID NO: 19463 - RNA, 32 nt, Human
aaagccacaagugccuccaaagccauuacacc

SEQ ID NO: 19464 - RNA, 32 nt, Human
aaagccacacacuacuacaucccuucacaaag

SEQ ID NO: 19465 - RNA, 32 nt, Human
aaagccacagaagacacagagcagggaaggga

SEQ ID NO: 19466 - RNA, 32 nt, Human
aaagccacagaauaauugauagggcagcuguu

SEQ ID NO: 19467 - RNA, 32 nt, Human
aaagccaccagccuggacaggaagagguggca

SEQ ID NO: 19468 - RNA, 22 nt, Human
aaagccacccucuuccugugua

SEQ ID NO: 19469 - RNA, 32 nt, Human
aaagccaccugcuuccuccaccccaccuucca

SEQ ID NO: 19470 - RNA, 32 nt, Human
aaagccacgacaguaacccaugcgaccacuuc

SEQ ID NO: 19471 - RNA, 32 nt, Human
aaagccacuaccucgucugaaggacuggacuu

SEQ ID NO: 19472 - RNA, 32 nt, Human
aaagccacuagagagaaacugaaagaaaacau

SEQ ID NO: 19473 - RNA, 32 nt, Human
aaagccacugaggaggaggcugugcugaguuu

SEQ ID NO: 19474 - RNA, 32 nt, Human
aaagccacugcacucaaacguggggaacaaga

SEQ ID NO: 19475 - RNA, 32 nt, Human
aaagccacuuaggagcagacagcagcguuguu

SEQ ID NO: 19476 - RNA, 32 nt, Human
aaagccagaccagugcaauggauagaaugggc

SEQ ID NO: 19477 - RNA, 32 nt, Human
aaagccagacuacagcugguucuugaagcugc

SEQ ID NO: 19478 - RNA, 32 nt, Human
aaagccagcaaagccuccagcaucuuuuccau

SEQ ID NO: 19479 - RNA, 19 nt, Human
aaagccagcaguaaaggcc

SEQ ID NO: 19480 - RNA, 32 nt, Human
aaagccagcaugcaaggcccuccccuuugugc

SEQ ID NO: 19481 - RNA, 32 nt, Human
aaagccagccaggcagagguuuuaaugucugu

SEQ ID NO: 19482 - RNA, 32 nt, Human
aaagccagccaguucagggcucaggccucacc

SEQ ID NO: 19483 - RNA, 32 nt, Human
aaagccagcccucccuucccuucuuggggcgc

SEQ ID NO: 19484 - RNA, 32 nt, Human
aaagccagccuccaucuuaggccuuugccuca

SEQ ID NO: 19485 - RNA, 32 nt, Human
aaagccagccugagccacauagugagacugag

SEQ ID NO: 19486 - RNA, 32 nt, Human
aaagccagcugucgucauuugagagccagcca

SEQ ID NO: 19487 - RNA, 32 nt, Human
aaagccagcuuagugggacuuccgcgucucuc

SEQ ID NO: 19488 - RNA, 32 nt, Human
aaagccaggaaagauugggaagugggugguca

SEQ ID NO: 19489 - RNA, 32 nt, Human
aaagccaggaacagggaccagcuccccggggg

SEQ ID NO: 19490 - RNA, 32 nt, Human
aaagccaggcagcaguacaguggagaaucugc

SEQ ID NO: 19491 - RNA, 32 nt, Human
aaagccaggcucaguucuuaccucugggaauc

SEQ ID NO: 19492 - RNA, 32 nt, Human
aaagccagggcaggccgggcacaguggcucac

SEQ ID NO: 19493 - RNA, 32 nt, Human
aaagccauauuggaguagcgaggaaucugauu

SEQ ID NO: 19494 - RNA, 32 nt, Human
aaagccaucaugggagacauccagauggcaca

SEQ ID NO: 19495 - RNA, 32 nt, Human
aaagccaucauuuucuccuggauuaaucucuu

SEQ ID NO: 19496 - RNA, 32 nt, Human
aaagccaucucuuccagcaggagagggcucua

SEQ ID NO: 19497 - RNA, 32 nt, Human
aaagccaucugaagccugucucuggugaacaa

SEQ ID NO: 19498 - RNA, 32 nt, Human
aaagccaucugacuucaaucaggaagccagag

SEQ ID NO: 19499 - RNA, 19 nt, Human
aaagccaugccggggugug

SEQ ID NO: 19500 - RNA, 32 nt, Human
aaagccaugccugcuccugccucucucccaac

SEQ ID NO: 19501 - RNA, 32 nt, Human
aaagccauggcagaggguccuagcggcgccac

SEQ ID NO: 19502 - RNA, 32 nt, Human
aaagccauggcccaaacccaggaguugguaaa

SEQ ID NO: 19503 - RNA, 19 nt, Human
aaagccaugucaccugcgu

SEQ ID NO: 19504 - RNA, 32 nt, Human
aaagccauuauuaauuuucauuucuacaccua

SEQ ID NO: 19505 - RNA, 21 nt, Human
aaagccauugaccacccacca

SEQ ID NO: 19506 - RNA, 32 nt, Human
aaagccauugaccacccaccauauuguuugau

SEQ ID NO: 19507 - RNA, 32 nt, Human
aaagcccaacacacacucggguuaagaaauac

SEQ ID NO: 19508 - RNA, 27 nt, Human
aaagcccaaccuucuccagggcugcag

SEQ ID NO: 19509 - RNA, 18 nt, Human
aaagcccaaguauuuuga

SEQ ID NO: 19510 - RNA, 32 nt, Human
aaagcccaaguugaucagcuuaccggaagaaa

SEQ ID NO: 19511 - RNA, 32 nt, Human
aaagcccagacccaugaccaccucuggcucua

SEQ ID NO: 19512 - RNA, 32 nt, Human
aaagcccagagacagcuugaucaaaggcacac

SEQ ID NO: 19513 - RNA, 32 nt, Human
aaagcccagagugcccuuggggacacuuuugg

SEQ ID NO: 19514 - RNA, 23 nt, Human
aaagcccagcacgacccugcugg

SEQ ID NO: 19515 - RNA, 20 nt, Human
aaagcccagcccagcuggag

SEQ ID NO: 19516 - RNA, 32 nt, Human
aaagcccagcccuguccccuuggcuggccggc

SEQ ID NO: 19517 - RNA, 32 nt, Human
aaagcccagcuccaccacauugcucagucuuc

SEQ ID NO: 19518 - RNA, 32 nt, Human
aaagcccaggaauaagaaguauggcuggagac

SEQ ID NO: 19519 - RNA, 32 nt, Human
aaagcccaggagagcaguggguggggcugggc

SEQ ID NO: 19520 - RNA, 22 nt, Human
aaagcccagggccuucacuuua

SEQ ID NO: 19521 - RNA, 24 nt, Human
aaagcccagggucuggggcagcag

SEQ ID NO: 19522 - RNA, 20 nt, Human
aaagcccaggugcuggcugc

SEQ ID NO: 19523 - RNA, 31 nt, Human
aaagcccaguuucagaacauaagcuuuaagc

SEQ ID NO: 19524 - RNA, 32 nt, Human
aaagcccaucacuucuagagggagaaaggcaa

SEQ ID NO: 19525 - RNA, 32 nt, Human
aaagcccauccguacuaccaggagacuggauc

SEQ ID NO: 19526 - RNA, 32 nt, Human
aaagcccaucucuagcacaccuugaccccagg

SEQ ID NO: 19527 - RNA, 18 nt, Human
aaagcccaucuugauuuu

SEQ ID NO: 19528 - RNA, 32 nt, Human
aaagcccaugugugcacauacacacaugcacc

SEQ ID NO: 19529 - RNA, 21 nt, Human
aaagcccauuaaugauucaga

SEQ ID NO: 19530 - RNA, 32 nt, Human
aaagccccagcacuaacguaaauacacaacac

SEQ ID NO: 19531 - RNA, 32 nt, Human
aaagccccagguaaccccggacugguggucac

SEQ ID NO: 19532 - RNA, 20 nt, Human
aaagccccaguuaauuuuga

SEQ ID NO: 19533 - RNA, 32 nt, Human
aaagcccccaaaacaaaacaaaccuuaauuga

SEQ ID NO: 19534 - RNA, 32 nt, Human
aaagcccccucaccuggcgucccgcaaccaug

SEQ ID NO: 19535 - RNA, 32 nt, Human
aaagccccuaaaggaggauuuggccuuucaaa

SEQ ID NO: 19536 - RNA, 32 nt, Human
aaagccccucaacuacagcccagcccaaccca

SEQ ID NO: 19537 - RNA, 32 nt, Human
aaagccccuccaguccagcuuugaggcugggc

SEQ ID NO: 19538 - RNA, 32 nt, Human
aaagccccugccccuccucucccucaucaagg

SEQ ID NO: 19539 - RNA, 32 nt, Human
aaagccccugcucucucugagccuuauuucau

SEQ ID NO: 19540 - RNA, 32 nt, Human
aaagccccuggacauacccacagggaaggcaa

SEQ ID NO: 19541 - RNA, 32 nt, Human
aaagccccugggaacgaggccuacccacuaug

SEQ ID NO: 19542 - RNA, 32 nt, Human
aaagccccuguucacgcugcacuggugcauga

SEQ ID NO: 19543 - RNA, 22 nt, Human
aaagccccuuuuuacacagcug

SEQ ID NO: 19544 - RNA, 32 nt, Human
aaagcccgagggaggaagagagggagggagga

SEQ ID NO: 19545 - RNA, 23 nt, Human
aaagcccggcguccaucaccuua

SEQ ID NO: 19546 - RNA, 32 nt, Human
aaagcccggucucacccccuaaccucauccua

SEQ ID NO: 19547 - RNA, 31 nt, Human
aaagcccucaauaaacauguaugaaggcugg

SEQ ID NO: 19548 - RNA, 32 nt, Human
aaagcccucacugcucucucagucuucuugau

SEQ ID NO: 19549 - RNA, 32 nt, Human
aaagcccucaucuucucuuucucuccucaguu

SEQ ID NO: 19550 - RNA, 20 nt, Human
aaagcccuccucacgcaguu

SEQ ID NO: 19551 - RNA, 32 nt, Human
aaagcccuccucccgggccaagguagaggaag

SEQ ID NO: 19552 - RNA, 32 nt, Human
aaagcccucguaaagcccuccggcuugaggag

SEQ ID NO: 19553 - RNA, 32 nt, Human
aaagcccucuacugcuggauccaaagcuaagg

SEQ ID NO: 19554 - RNA, 21 nt, Human
aaagcccucuucaacccacug

SEQ ID NO: 19555 - RNA, 32 nt, Human
aaagcccucuuuuucacaccucaucaaacagg

SEQ ID NO: 19556 - RNA, 32 nt, Human
aaagcccugaguguggcuaggaagggggugcu

SEQ ID NO: 19557 - RNA, 32 nt, Human
aaagcccugaugaccugguucuucugaggccc

SEQ ID NO: 19558 - RNA, 19 nt, Human
aaagcccugccucugugua

SEQ ID NO: 19559 - RNA, 32 nt, Human
aaagcccugcuugcuuuugcagcugggaggcu

SEQ ID NO: 19560 - RNA, 23 nt, Human
aaagcccugguaaaagggauaca

SEQ ID NO: 19561 - RNA, 21 nt, Human
aaagcccuguaaagauuuuga

SEQ ID NO: 19562 - RNA, 32 nt, Human
aaagcccuucgauccccaucagagaggucaca

SEQ ID NO: 19563 - RNA, 32 nt, Human
aaagcccuugggaggcugagguccugccuucu

SEQ ID NO: 19564 - RNA, 32 nt, Human
aaagccgaaggaguaaggugcugcaaugaugu

SEQ ID NO: 19565 - RNA, 32 nt, Human
aaagccgaccuccaccuccuccuccuccuucu

SEQ ID NO: 19566 - RNA, 32 nt, Human
aaagccgauuucaaauucagaaccugaaugcc

SEQ ID NO: 19567 - RNA, 32 nt, Human
aaagccgggagaaacugcugagacgagguggc

SEQ ID NO: 19568 - RNA, 32 nt, Human
aaagccgggaggcaaguaggacagagagauga

SEQ ID NO: 19569 - RNA, 32 nt, Human
aaagccgggcugggcuuggagcugcucaugga

SEQ ID NO: 19570 - RNA, 32 nt, Human
aaagccggggguaggggccacccuggaauggg

SEQ ID NO: 19571 - RNA, 32 nt, Human
aaagccggucucaaagauaacugcauccuuca

SEQ ID NO: 19572 - RNA, 32 nt, Human
aaagccgucgguuacagaggagacugacagag

SEQ ID NO: 19573 - RNA, 32 nt, Human
aaagccgugcucuccagccuggcugccaggga

SEQ ID NO: 19574 - RNA, 32 nt, Human
aaagccuaaaaauuaaggccaagcugagcuuu

SEQ ID NO: 19575 - RNA, 22 nt, Human
aaagccuaaccaaggcugcugg

SEQ ID NO: 19576 - RNA, 32 nt, Human
aaagccuaagaaaaaggaaauuggacaguuuu

SEQ ID NO: 19577 - RNA, 32 nt, Human
aaagccuaagguccuucuuagcacucuucagc

SEQ ID NO: 19578 - RNA, 32 nt, Human
aaagccucaaagcagccaaaaccaggcuuucc

SEQ ID NO: 19579 - RNA, 32 nt, Human
aaagccucaagugacucagccugguuggagaa

SEQ ID NO: 19580 - RNA, 32 nt, Human
aaagccucacacaccuacuuuuaucaaacaaa

SEQ ID NO: 19581 - RNA, 32 nt, Human
aaagccucagaguuggagugccuggcucucug

SEQ ID NO: 19582 - RNA, 32 nt, Human
aaagccucaguuccacugccuuccucucccuc

SEQ ID NO: 19583 - RNA, 32 nt, Human
aaagccucauuccgugcugucuggcaggaagc

SEQ ID NO: 19584 - RNA, 32 nt, Human
aaagccuccaaccuugaaguccagugaagucu

SEQ ID NO: 19585 - RNA, 32 nt, Human
aaagccucccuggcugguguagagggaucagg

SEQ ID NO: 19586 - RNA, 32 nt, Human
aaagccuccucucucccccacuggucaagauu

SEQ ID NO: 19587 - RNA, 32 nt, Human
aaagccucuaccugcaccucacagugcaaggc

SEQ ID NO: 19588 - RNA, 32 nt, Human
aaagccugacccugggcaggugagugacgggu

SEQ ID NO: 19589 - RNA, 32 nt, Human
aaagccugaccuuccaaagcuugcuuccuucc

SEQ ID NO: 19590 - RNA, 32 nt, Human
aaagccugcauguaagaacaucuacugagaaa

SEQ ID NO: 19591 - RNA, 32 nt, Human
aaagccugcugcauuugcgugaucucaagacc

SEQ ID NO: 19592 - RNA, 32 nt, Human
aaagccugggcaacauggugaaacccugucuc

SEQ ID NO: 19593 - RNA, 32 nt, Human
aaagccuguaucucugugaugauuucugugcu

SEQ ID NO: 19594 - RNA, 32 nt, Human
aaagccuguccacccuugagaauccuuccucu

SEQ ID NO: 19595 - RNA, 32 nt, Human
aaagccugugcccccaucaucucacuccuuug

SEQ ID NO: 19596 - RNA, 32 nt, Human
aaagccuguguggcauuucuggaaaagggaau

SEQ ID NO: 19597 - RNA, 32 nt, Human
aaagccuguucccccgacucaggauuuccaag

SEQ ID NO: 19598 - RNA, 22 nt, Human
aaagccuuagguaucaauucca

SEQ ID NO: 19599 - RNA, 32 nt, Human
aaagccuucagauuuguuuucuagucacuuuu

SEQ ID NO: 19600 - RNA, 32 nt, Human
aaagccuucagggucaguucaagccuuaauag

SEQ ID NO: 19601 - RNA, 32 nt, Human
aaagccuuccacccuccugucugcuuuagaag

SEQ ID NO: 19602 - RNA, 32 nt, Human
aaagccuuccacccuccugucuggcuuuagaa

SEQ ID NO: 19603 - RNA, 32 nt, Human
aaagccuucucccuagcuccuccccuuccucu

SEQ ID NO: 19604 - RNA, 32 nt, Human
aaagccuucuggaaggugggagcagggugagc

SEQ ID NO: 19605 - RNA, 32 nt, Human
aaagccuugcaaucccaggcuggggucagccu

SEQ ID NO: 19606 - RNA, 32 nt, Human
aaagccuuggaagagaaaaguagaauucagua

SEQ ID NO: 19607 - RNA, 18 nt, Human
aaagccuuggugccugug

SEQ ID NO: 19608 - RNA, 32 nt, Human
aaagccuuuaaaacaaaaagccaucguaggua

SEQ ID NO: 19609 - RNA, 32 nt, Human
aaagccuuucagggucugucuauauuuucagu

SEQ ID NO: 19610 - RNA, 23 nt, Human
aaagccuuucugauccaguuuca

SEQ ID NO: 19611 - RNA, 32 nt, Human
aaagccuuuugucacccaggcuggagugccau

SEQ ID NO: 19612 - RNA, 32 nt, Human
aaagccuuuuuauccugcuuucuuugaacaca

SEQ ID NO: 19613 - RNA, 32 nt, Human
aaagcgaaaagagguuuuggaggaauauuuua

SEQ ID NO: 19614 - RNA, 32 nt, Human
aaagcgaagaagagaagagggauguguuccgc

SEQ ID NO: 19615 - RNA, 18 nt, Human
aaagcgaccacugccaag

SEQ ID NO: 19616 - RNA, 32 nt, Human
aaagcgaccacugccaaggagccuaucugaau

SEQ ID NO: 19617 - RNA, 32 nt, Human
aaagcgaccuguggacuaaaucugccacgauu

SEQ ID NO: 19618 - RNA, 32 nt, Human
aaagcgagagggcuaaauggguccaucucuag

SEQ ID NO: 19619 - RNA, 21 nt, Human
aaagcgagccuccaggcccag

SEQ ID NO: 19620 - RNA, 32 nt, Human
aaagcgaggccugcgggcggcggcugggcucc

SEQ ID NO: 19621 - RNA, 32 nt, Human
aaagcgcagcugacacaguugaaggagucacu

SEQ ID NO: 19622 - RNA, 32 nt, Human
aaagcgcaucuucuccacaugggcuucacgug

SEQ ID NO: 19623 - RNA, 32 nt, Human
aaagcgccauugcacuccagucugggugacag

SEQ ID NO: 19624 - RNA, 32 nt, Human
aaagcgccgcagcugccaaaaugucuacaggu

SEQ ID NO: 19625 - RNA, 32 nt, Human
aaagcgccggaggcggaggaagcugacugugg

SEQ ID NO: 19626 - RNA, 32 nt, Human
aaagcgcggguccagaugagggccaggaaggg

SEQ ID NO: 19627 - RNA, 32 nt, Human
aaagcgcucaucuugcccucuaccuccugaua

SEQ ID NO: 19628 - RNA, 32 nt, Human
aaagcgcugccacccacccaccugggccagag

SEQ ID NO: 19629 - RNA, 32 nt, Human
aaagcgcuggauuacaggcaugagccacuaca

SEQ ID NO: 19630 - RNA, 32 nt, Human
aaagcggaaaaagagaaagaaaggagagaagc

SEQ ID NO: 19631 - RNA, 32 nt, Human
aaagcggagaggggagugggugaagcugggaa

SEQ ID NO: 19632 - RNA, 32 nt, Human
aaagcggaggagcuaagccaccugccaaaaug

SEQ ID NO: 19633 - RNA, 32 nt, Human
aaagcggaggcagcgggggaagauggcggcgg

SEQ ID NO: 19634 - RNA, 32 nt, Human
aaagcggcagugagcuaaaaucaagucaccac

SEQ ID NO: 19635 - RNA, 32 nt, Human
aaagcggcaucugcuguggccauguuuugcgg

SEQ ID NO: 19636 - RNA, 20 nt, Human
aaagcggccacacuggggga

SEQ ID NO: 19637 - RNA, 32 nt, Human
aaagcggccaggcaggugggagacugaauuug

SEQ ID NO: 19638 - RNA, 32 nt, Human
aaagcgggaggcacuucccaggggaagaccag

SEQ ID NO: 19639 - RNA, 32 nt, Human
aaagcggggugaggggcggaagggucccggcg

SEQ ID NO: 19640 - RNA, 32 nt, Human
aaagcgggugcuguagaggagcacucagcuca

SEQ ID NO: 19641 - RNA, 23 nt, Human
aaagcggguggguuacuugaggc

SEQ ID NO: 19642 - RNA, 32 nt, Human
aaagcggugagaaaggagggccagccaguugg

SEQ ID NO: 19643 - RNA, 32 nt, Human
aaagcggugggcaagggcuggccgcagcuccu

SEQ ID NO: 19644 - RNA, 32 nt, Human
aaagcgugugcuuuacccaucugcugucuugc

SEQ ID NO: 19645 - RNA, 23 nt, Human
aaagcguuucaaagcgucagcug

SEQ ID NO: 19646 - RNA, 32 nt, Human
aaagcuaaaauggcuuaacaucaugcuacacu

SEQ ID NO: 19647 - RNA, 32 nt, Human
aaagcuaaaguggaaguuauugccaaaggaac

SEQ ID NO: 19648 - RNA, 32 nt, Human
aaagcuaagacaaacaaaacuacaauggaaga

SEQ ID NO: 19649 - RNA, 32 nt, Human
aaagcuaagaugaccaugcgcccuuuccucug

SEQ ID NO: 19650 - RNA, 24 nt, Human
aaagcuaaggaaaacccaccagcc

SEQ ID NO: 19651 - RNA, 32 nt, Human
aaagcuaauuaggaauagacauggacacugau

SEQ ID NO: 19652 - RNA, 32 nt, Human
aaagcuacaguacaggcuguguuagguccucu

SEQ ID NO: 19653 - RNA, 32 nt, Human
aaagcuacuaauugucucaguguaaguuuuaa

SEQ ID NO: 19654 - RNA, 32 nt, Human
aaagcuacugaaacuccuccaccugcuucuaa

SEQ ID NO: 19655 - RNA, 32 nt, Human
aaagcuacuuugcuccuggugagagcuuaaaa

SEQ ID NO: 19656 - RNA, 21 nt, Human
aaagcuagaggcaucaugcua

SEQ ID NO: 19657 - RNA, 32 nt, Human
aaagcuagaggcugggcugagccaggaguccu

SEQ ID NO: 19658 - RNA, 32 nt, Human
aaagcuagagucagagguuccgguugagauca

SEQ ID NO: 19659 - RNA, 32 nt, Human
aaagcuaggacagagcaccugaccucaguugu

SEQ ID NO: 19660 - RNA, 20 nt, Human
aaagcuauacuagcucacau

SEQ ID NO: 19661 - RNA, 24 nt, Human
aaagcuauacuuuuucaucacaua

SEQ ID NO: 19662 - RNA, 31 nt, Human
aaagcuauggccucaaccaccagcaccaaga

SEQ ID NO: 19663 - RNA, 32 nt, Human
aaagcuauuaaugucacuccuuuugcgagcau

SEQ ID NO: 19664 - RNA, 32 nt, Human
aaagcuauugagcguuugcuggaacacauuau

SEQ ID NO: 19665 - RNA, 32 nt, Human
aaagcucaaaauggcuaggugauauuccucaa

SEQ ID NO: 19666 - RNA, 32 nt, Human
aaagcucaacuugaagcuuucuugccugcagu

SEQ ID NO: 19667 - RNA, 32 nt, Human
aaagcucaagagggaaucaucuggccugagcc

SEQ ID NO: 19668 - RNA, 32 nt, Human
aaagcucaagccuuugcgaagcuaaugaccug

SEQ ID NO: 19669 - RNA, 19 nt, Human
aaagcucacagucuaauca

SEQ ID NO: 19670 - RNA, 32 nt, Human
aaagcucacugcugccccagccgggcuucuua

SEQ ID NO: 19671 - RNA, 32 nt, Human
aaagcucagagugggccagagcagggguguga

SEQ ID NO: 19672 - RNA, 32 nt, Human
aaagcucaggagagacacagacuuggggcuuu

SEQ ID NO: 19673 - RNA, 32 nt, Human
aaagcucaggguuuguugaauuagcaugagag

SEQ ID NO: 19674 - RNA, 32 nt, Human
aaagcucauucuucuucuuccucccagcagcu

SEQ ID NO: 19675 - RNA, 32 nt, Human
aaagcucauuggcagagagcauugcuagugag

SEQ ID NO: 19676 - RNA, 32 nt, Human
aaagcucauuggugaaaacaguucucaggggu

SEQ ID NO: 19677 - RNA, 17 nt, Human
aaagcuccccccaauga

SEQ ID NO: 19678 - RNA, 32 nt, Human
aaagcucccugccuucccuugccgcugguccc

SEQ ID NO: 19679 - RNA, 32 nt, Human
aaagcuccggagccccagccccaaggcuuuga

SEQ ID NO: 19680 - RNA, 32 nt, Human
aaagcuccucgagggcagggacuuuggucuau

SEQ ID NO: 19681 - RNA, 32 nt, Human
aaagcuccuggacuugggcuuagcagcugagc

SEQ ID NO: 19682 - RNA, 32 nt, Human
aaagcuccugggccccuccucccuucaaggau

SEQ ID NO: 19683 - RNA, 32 nt, Human
aaagcucgcccagggcugggugcaguggcuca

SEQ ID NO: 19684 - RNA, 32 nt, Human
aaagcucugcuuguauuugugauauuucauuu

SEQ ID NO: 19685 - RNA, 32 nt, Human
aaagcucuggacaaccuugagaagcucaauuu

SEQ ID NO: 19686 - RNA, 32 nt, Human
aaagcucuguaacccacauuguaaagccguga

SEQ ID NO: 19687 - RNA, 32 nt, Human
aaagcucugucucccuaacucaacugcuuugc

SEQ ID NO: 19688 - RNA, 20 nt, Human
aaagcucuuaauucuccaua

SEQ ID NO: 19689 - RNA, 32 nt, Human
aaagcugaaagauuugaugagggauuggaaug

SEQ ID NO: 19690 - RNA, 32 nt, Human
aaagcugaacacugaagucaguucucaacaau

SEQ ID NO: 19691 - RNA, 19 nt, Human
aaagcugacagccugugua

SEQ ID NO: 19692 - RNA, 25 nt, Human
aaagcugaccauggaucccuggggc

SEQ ID NO: 19693 - RNA, 32 nt, Human
aaagcugagaucacaggaacagcaggugacag

SEQ ID NO: 19694 - RNA, 32 nt, Human
aaagcugagcacgggaaggaagacugaucucu

SEQ ID NO: 19695 - RNA, 32 nt, Human
aaagcugaggcaaaaguggccuccagacagga

SEQ ID NO: 19696 - RNA, 32 nt, Human
aaagcugaggcagaaggaucccuugagccuag

SEQ ID NO: 19697 - RNA, 32 nt, Human
aaagcugaggcagguggaucaccugaggucag

SEQ ID NO: 19698 - RNA, 32 nt, Human
aaagcugaggugagccaugauuacuccacugc

SEQ ID NO: 19699 - RNA, 32 nt, Human
aaagcugaguuguagagagaguauguauuuaa

SEQ ID NO: 19700 - RNA, 32 nt, Human
aaagcugaugcaacugauuuauacaaaaugaa

SEQ ID NO: 19701 - RNA, 32 nt, Human
aaagcugauucugguuaucucuuuaaggacaa

SEQ ID NO: 19702 - RNA, 32 nt, Human
aaagcugcaaaagguuuuucacugccugccuc

SEQ ID NO: 19703 - RNA, 32 nt, Human
aaagcugcaacaggcuaggcgcaguggcucau

SEQ ID NO: 19704 - RNA, 32 nt, Human
aaagcugcagagcagaggaaccaaaccagguu

SEQ ID NO: 19705 - RNA, 32 nt, Human
aaagcugcagugagcuacugugaucaugccuc

SEQ ID NO: 19706 - RNA, 32 nt, Human
aaagcugcagugagcuguaauugcaucacugc

SEQ ID NO: 19707 - RNA, 32 nt, Human
aaagcugcagugagucaugauagcaccacugc

SEQ ID NO: 19708 - RNA, 32 nt, Human
aaagcugcaucugucuguaucuuucuuuugua

SEQ ID NO: 19709 - RNA, 32 nt, Human
aaagcugccgaguccuaugauuacacgcgaug

SEQ ID NO: 19710 - RNA, 32 nt, Human
aaagcugccgaguccuaugauuacacgugaug

SEQ ID NO: 19711 - RNA, 32 nt, Human
aaagcugccgcugaagcugccgccguugccuc

SEQ ID NO: 19712 - RNA, 32 nt, Human
aaagcugcucuuuacuguuucuagucaaaaau

SEQ ID NO: 19713 - RNA, 32 nt, Human
aaagcugcugagggauagagccugagccuggu

SEQ ID NO: 19714 - RNA, 32 nt, Human
aaagcugcuuuaauaaauacuucuggucugau

SEQ ID NO: 19715 - RNA, 32 nt, Human
aaagcuggaaggacucugccuugggagauucc

SEQ ID NO: 19716 - RNA, 32 nt, Human
aaagcuggagccaauggugagggcugagaggg

SEQ ID NO: 19717 - RNA, 21 nt, Human
aaagcuggaggcaucacgcua

SEQ ID NO: 19718 - RNA, 21 nt, Human
aaagcuggaggcaucacgcug

SEQ ID NO: 19719 - RNA, 32 nt, Human
aaagcuggagucagaggaagcucuucuucuga

SEQ ID NO: 19720 - RNA, 32 nt, Human
aaagcuggcagaggcccuggaauuccagauca

SEQ ID NO: 19721 - RNA, 32 nt, Human
aaagcuggcagcccuggaagugcaguguuggg

SEQ ID NO: 19722 - RNA, 32 nt, Human
aaagcuggccacugccagcuugcugcgggaac

SEQ ID NO: 19723 - RNA, 32 nt, Human
aaagcuggcccaggcgucuaaggagucaaaag

SEQ ID NO: 19724 - RNA, 32 nt, Human
aaagcuggccugguuuccuuccucccugauug

SEQ ID NO: 19725 - RNA, 32 nt, Human
aaagcuggcucugccuugaauucccaccccuu

SEQ ID NO: 19726 - RNA, 32 nt, Human
aaagcuggcucuuggaaauugagcggagagcg

SEQ ID NO: 19727 - RNA, 32 nt, Human
aaagcugggaaccagcaucucagcgccagcuc

SEQ ID NO: 19728 - RNA, 32 nt, Human
aaagcugggauuacaggcgugagccaccgcgc

SEQ ID NO: 19729 - RNA, 32 nt, Human
aaagcugggauuacagggcccugccaccaagc

SEQ ID NO: 19730 - RNA, 32 nt, Human
aaagcugggauuacuagcaugagccaccaugc

SEQ ID NO: 19731 - RNA, 32 nt, Human
aaagcugggcagguuggugggggccucggugu

SEQ ID NO: 19732 - RNA, 32 nt, Human
aaagcugggccugggagcguuuagcugguggg

SEQ ID NO: 19733 - RNA, 32 nt, Human
aaagcuggggauguuagccuaugacugucauc

SEQ ID NO: 19734 - RNA, 32 nt, Human
aaagcuggguacuaagaaauguuauuugcauc

SEQ ID NO: 19735 - RNA, 32 nt, Human
aaagcugguacggggcgccacccuggacaucg

SEQ ID NO: 19736 - RNA, 32 nt, Human
aaagcugguccagcagcagggguggaggcugg

SEQ ID NO: 19737 - RNA, 32 nt, Human
aaagcuggucucaaacuuguggccucaagcaa

SEQ ID NO: 19738 - RNA, 32 nt, Human
aaagcugguuucgugaugagaaaaugaaagaa

SEQ ID NO: 19739 - RNA, 21 nt, Human
aaagcuguaggcaucacgcua

SEQ ID NO: 19740 - RNA, 32 nt, Human
aaagcuguagugagcugucauugugccacuau

SEQ ID NO: 19741 - RNA, 32 nt, Human
aaagcugucuucuguccacgagcaccacaguc

SEQ ID NO: 19742 - RNA, 32 nt, Human
aaagcugugcaguuaaguacaaaaagauacuu

SEQ ID NO: 19743 - RNA, 32 nt, Human
aaagcugugcucagaggaggugagaggagagg

SEQ ID NO: 19744 - RNA, 32 nt, Human
aaagcuguggcaaaaucuuccacccauccugg

SEQ ID NO: 19745 - RNA, 32 nt, Human
aaagcuguggccaggaaguggccgguauaaag

SEQ ID NO: 19746 - RNA, 32 nt, Human
aaagcugugggaugccuacgcugcauucauua

SEQ ID NO: 19747 - RNA, 32 nt, Human
aaagcuuaaaaaggaaauuacuggaaaauaag

SEQ ID NO: 19748 - RNA, 32 nt, Human
aaagcuuaguccuagcauaugcaccugagcca

SEQ ID NO: 19749 - RNA, 32 nt, Human
aaagcuuauaagauauaaauggagauuuuaaa

SEQ ID NO: 19750 - RNA, 32 nt, Human
aaagcuucaaaccguuuguaagguuaaagaaa

SEQ ID NO: 19751 - RNA, 32 nt, Human
aaagcuucaaacugcaugauucaugccaauua

SEQ ID NO: 19752 - RNA, 32 nt, Human
aaagcuucagagaaaucucaagaagucugugu

SEQ ID NO: 19753 - RNA, 32 nt, Human
aaagcuucauuucucacguucuuaaaagagag

SEQ ID NO: 19754 - RNA, 32 nt, Human
aaagcuuccagcccuccucccuucacccugga

SEQ ID NO: 19755 - RNA, 32 nt, Human
aaagcuuccuggaaguggagaggauccuucug

SEQ ID NO: 19756 - RNA, 32 nt, Human
aaagcuucuaacucuucuuguuguucauuuuu

SEQ ID NO: 19757 - RNA, 32 nt, Human
aaagcuucucccaccagcuuccaugugucccc

SEQ ID NO: 19758 - RNA, 32 nt, Human
aaagcuucuccucugagaaacauuucuguugc

SEQ ID NO: 19759 - RNA, 32 nt, Human
aaagcuucuccucugccucauccacagucauu

SEQ ID NO: 19760 - RNA, 22 nt, Human
aaagcuucuuuuaagauuuuga

SEQ ID NO: 19761 - RNA, 32 nt, Human
aaagcuugaacccaggagguggagguugcagu

SEQ ID NO: 19762 - RNA, 32 nt, Human
aaagcuugagcacaaacagauaccucagcccg

SEQ ID NO: 19763 - RNA, 19 nt, Human
aaagcuugcucccuuggga

SEQ ID NO: 19764 - RNA, 32 nt, Human
aaagcuugcugagugguacagcgccagccugg

SEQ ID NO: 19765 - RNA, 32 nt, Human
aaagcuugcugugcaugaucaugguuaagcca

SEQ ID NO: 19766 - RNA, 32 nt, Human
aaagcuuggaauacaagaagacucucaaaauc

SEQ ID NO: 19767 - RNA, 32 nt, Human
aaagcuugggaaggaaggauggaaagcgcgac

SEQ ID NO: 19768 - RNA, 32 nt, Human
aaagcuugggguucauccuccuucccuggauc

SEQ ID NO: 19769 - RNA, 32 nt, Human
aaagcuuguuuguucuaguuagcaggaaauag

SEQ ID NO: 19770 - RNA, 32 nt, Human
aaagcuuuaaaggagauucuucucccaccccc

SEQ ID NO: 19771 - RNA, 32 nt, Human
aaagcuuuacaauggaaguggccucauggaug

SEQ ID NO: 19772 - RNA, 32 nt, Human
aaagcuuuagaggaggaaugaaaacaaaguga

SEQ ID NO: 19773 - RNA, 32 nt, Human
aaagcuuuagcugcugagauaaaagugauggu

SEQ ID NO: 19774 - RNA, 32 nt, Human
aaagcuuuauuuuaacacucaucugaaucaac

SEQ ID NO: 19775 - RNA, 32 nt, Human
aaagcuuuccuuuaacauuuucaccugcucau

SEQ ID NO: 19776 - RNA, 32 nt, Human
aaagcuuuguguuauugggagucuuauuauuu

SEQ ID NO: 19777 - RNA, 32 nt, Human
aaagcuuuuaaucccuuucauucccugauauc

SEQ ID NO: 19778 - RNA, 22 nt, Human
aaagcuuuuacuuuucccuccu

SEQ ID NO: 19779 - RNA, 32 nt, Human
aaagcuuuuagacaguccagaagccugaauga

SEQ ID NO: 19780 - RNA, 32 nt, Human
aaagcuuuucuugcauacucagcuugcuuuau

SEQ ID NO: 19781 - RNA, 32 nt, Human
aaagcuuuugagucaagacaauggagugcucu

SEQ ID NO: 19782 - RNA, 32 nt, Human
aaagcuuuuguuuccacugaucauuauuuuca

SEQ ID NO: 19783 - RNA, 32 nt, Human
aaaggaaaaagaaaaggaguugcuugauguga

SEQ ID NO: 19784 - RNA, 32 nt, Human
aaaggaaaaaggacaagauggaguuguggggg

SEQ ID NO: 19785 - RNA, 32 nt, Human
aaaggaaaacuggcauauccugccuuccgagu

SEQ ID NO: 19786 - RNA, 32 nt, Human
aaaggaaaagagcccacacaauggaguaaauu

SEQ ID NO: 19787 - RNA, 32 nt, Human
aaaggaaaagugguaaggaagugggaagaaaa

SEQ ID NO: 19788 - RNA, 32 nt, Human
aaaggaaaauaacauuaaaggagacuuaugug

SEQ ID NO: 19789 - RNA, 32 nt, Human
aaaggaaacaaacagacaacaaaaagaagaaa

SEQ ID NO: 19790 - RNA, 32 nt, Human
aaaggaaacaccaggggaucagugaguaagaa

SEQ ID NO: 19791 - RNA, 32 nt, Human
aaaggaaacagccaagagaaucaaagaucuag

SEQ ID NO: 19792 - RNA, 18 nt, Human
aaaggaaacccuauucaa

SEQ ID NO: 19793 - RNA, 32 nt, Human
aaaggaaaccuucguuuucagugagaggauug

SEQ ID NO: 19794 - RNA, 32 nt, Human
aaaggaaacuucuagccccuguccuuagugcu

SEQ ID NO: 19795 - RNA, 32 nt, Human
aaaggaaagaaagaaagaaaagaaaagaaaau

SEQ ID NO: 19796 - RNA, 32 nt, Human
aaaggaaagaaaggaaccagaggcagagagac

SEQ ID NO: 19797 - RNA, 32 nt, Human
aaaggaaagaagaagagagaaagcauagaggg

SEQ ID NO: 19798 - RNA, 32 nt, Human
aaaggaaagaagcagaaugagaaaggaauggu

SEQ ID NO: 19799 - RNA, 31 nt, Human
aaaggaaagagaccuguaucuugguguuuuu

SEQ ID NO: 19800 - RNA, 32 nt, Human
aaaggaaagaggaagggggagcggcgagaggc

SEQ ID NO: 19801 - RNA, 32 nt, Human
aaaggaaagagguuuguccucacuggaauaga

SEQ ID NO: 19802 - RNA, 32 nt, Human
aaaggaaagccuuuuccugucugauccugaga

SEQ ID NO: 19803 - RNA, 32 nt, Human
aaaggaaagcuaaagaagacuaugauaccaua

SEQ ID NO: 19804 - RNA, 32 nt, Human
aaaggaaaggaaggaaggaaaaagcagcuuuc

SEQ ID NO: 19805 - RNA, 32 nt, Human
aaaggaaaggagacagaaugagcuuugguuau

SEQ ID NO: 19806 - RNA, 22 nt, Human
aaaggaaagggggucacgcaca

SEQ ID NO: 19807 - RNA, 32 nt, Human
aaaggaaagugggugggggcaccccacaggug

SEQ ID NO: 19808 - RNA, 32 nt, Human
aaaggaaaucugucuucucuucccuugguuug

SEQ ID NO: 19809 - RNA, 32 nt, Human
aaaggaacaaaauuaucagggauggcucuuug

SEQ ID NO: 19810 - RNA, 32 nt, Human
aaaggaacaaauaacauacaauggagcucuaa

SEQ ID NO: 19811 - RNA, 32 nt, Human
aaaggaacacaaaacaaaacuugcacuuuaac

SEQ ID NO: 19812 - RNA, 32 nt, Human
aaaggaacagaaguuccaacuauugccuggga

SEQ ID NO: 19813 - RNA, 32 nt, Human
aaaggaacauggcucacucagagcuauauggu

SEQ ID NO: 19814 - RNA, 32 nt, Human
aaaggaaccaaauuugggaugguucuccuugc

SEQ ID NO: 19815 - RNA, 32 nt, Human
aaaggaacccuacagauuagcccaguucucuc

SEQ ID NO: 19816 - RNA, 32 nt, Human
aaaggaaccuuaaguaagccucagccaaaggu

SEQ ID NO: 19817 - RNA, 32 nt, Human
aaaggaacuguacaaguguaaugaguguggca

SEQ ID NO: 19818 - RNA, 32 nt, Human
aaaggaacuuccuccaccuucggggcuggagc

SEQ ID NO: 19819 - RNA, 32 nt, Human
aaaggaagaaaauauauugauucuuagaaaau

SEQ ID NO: 19820 - RNA, 32 nt, Human
aaaggaagaagagagagaagauguucuuauga

SEQ ID NO: 19821 - RNA, 32 nt, Human
aaaggaagaaggggauaggaaaagaagaggua

SEQ ID NO: 19822 - RNA, 32 nt, Human
aaaggaagaaugaaggaggaagaaggcaguag

SEQ ID NO: 19823 - RNA, 17 nt, Human
aaaggaagacaguucua

SEQ ID NO: 19824 - RNA, 32 nt, Human
aaaggaagagagaggaagggagaagggagagg

SEQ ID NO: 19825 - RNA, 32 nt, Human
aaaggaagaggaaggaaggaaauauuuugaga

SEQ ID NO: 19826 - RNA, 32 nt, Human
aaaggaagaggcugaacauaagaaaaagaugg

SEQ ID NO: 19827 - RNA, 32 nt, Human
aaaggaagagguggaaacccagagagacagag

SEQ ID NO: 19828 - RNA, 32 nt, Human
aaaggaagagucaacucacuugaagaagaggg

SEQ ID NO: 19829 - RNA, 23 nt, Human
aaaggaagaguggggagauccca

SEQ ID NO: 19830 - RNA, 32 nt, Human
aaaggaagcaaguuuccacgauuucugaagag

SEQ ID NO: 19831 - RNA, 32 nt, Human
aaaggaagcagucuuggccaggcacgguggcu

SEQ ID NO: 19832 - RNA, 32 nt, Human
aaaggaagccacagagagaggccagguaagga

SEQ ID NO: 19833 - RNA, 32 nt, Human
aaaggaagcccuccauccucugguauuaacgc

SEQ ID NO: 19834 - RNA, 30 nt, Human
aaaggaagccucuccagcugguguacugca

SEQ ID NO: 19835 - RNA, 32 nt, Human
aaaggaagcugaaggcagaaagagaugcagag

SEQ ID NO: 19836 - RNA, 32 nt, Human
aaaggaagcugggucaucagcccagccccgcc

SEQ ID NO: 19837 - RNA, 32 nt, Human
aaaggaaggaagagugaccuaagcuagcaugc

SEQ ID NO: 19838 - RNA, 32 nt, Human
aaaggaaggaaggaaagaaggaagggaggacc

SEQ ID NO: 19839 - RNA, 32 nt, Human
aaaggaaggaagugguugagggccaggaaaga

SEQ ID NO: 19840 - RNA, 32 nt, Human
aaaggaagggagggagggagaaaggagaaguu

SEQ ID NO: 19841 - RNA, 32 nt, Human
aaaggaagggcagaggggcaaguaggcacagu

SEQ ID NO: 19842 - RNA, 32 nt, Human
aaaggaaggggagauugucucaggcuggcuga

SEQ ID NO: 19843 - RNA, 32 nt, Human
aaaggaaggguuaucuacaaaugaacugauga

SEQ ID NO: 19844 - RNA, 32 nt, Human
aaaggaagguuucacaguaccacugaguuaga

SEQ ID NO: 19845 - RNA, 32 nt, Human
aaaggaaguaguucagcaucuaucgccagcca

SEQ ID NO: 19846 - RNA, 32 nt, Human
aaaggaagucacagaucaggcaaccaaccaca

SEQ ID NO: 19847 - RNA, 32 nt, Human
aaaggaagugcagaggauuuagaaaaguacau

SEQ ID NO: 19848 - RNA, 32 nt, Human
aaaggaaguggcuuugaggcacacagaggggc

SEQ ID NO: 19849 - RNA, 32 nt, Human
aaaggaaguucagagcuuccagaggaauuauu

SEQ ID NO: 19850 - RNA, 32 nt, Human
aaaggaaguucugcugucagaggcaaaacauc

SEQ ID NO: 19851 - RNA, 32 nt, Human
aaaggaaguugguuccauugcagauucaaggu

SEQ ID NO: 19852 - RNA, 19 nt, Human
aaaggaauauaccacuaga

SEQ ID NO: 19853 - RNA, 32 nt, Human
aaaggaaucaaguauggauuucagaggugcuc

SEQ ID NO: 19854 - RNA, 32 nt, Human
aaaggaaucugaaauuuaauucuauuuugaua

SEQ ID NO: 19855 - RNA, 32 nt, Human
aaaggaaucuguaucuguaucaagaugaucug

SEQ ID NO: 19856 - RNA, 32 nt, Human
aaaggaaugccuaagguuaccuugggguuucu

SEQ ID NO: 19857 - RNA, 32 nt, Human
aaaggaauggggacccagaggcugggucccug

SEQ ID NO: 19858 - RNA, 32 nt, Human
aaaggaauugaguaaugggcccccaggcaagg

SEQ ID NO: 19859 - RNA, 32 nt, Human
aaaggaauugcaggucggugagaggacaagag

SEQ ID NO: 19860 - RNA, 32 nt, Human
aaaggaauuucauccuuucuuuccauucacug

SEQ ID NO: 19861 - RNA, 32 nt, Human
aaaggaauuugcauccagcagcagcacuuaga

SEQ ID NO: 19862 - RNA, 32 nt, Human
aaaggacaaagggacggaggcauuuuaccgga

SEQ ID NO: 19863 - RNA, 32 nt, Human
aaaggacaacaacagacaugucuuaguacuua

SEQ ID NO: 19864 - RNA, 32 nt, Human
aaaggacaaucagauggcgguguuuuccaggg

SEQ ID NO: 19865 - RNA, 32 nt, Human
aaaggacacaaacacacauaugcacucuguag

SEQ ID NO: 19866 - RNA, 32 nt, Human
aaaggacacaagcacacauaagaaugcauucu

SEQ ID NO: 19867 - RNA, 21 nt, Human
aaaggacacaaguguuacaga

SEQ ID NO: 19868 - RNA, 19 nt, Human
aaaggacacacagaacaga

SEQ ID NO: 19869 - RNA, 17 nt, Human
aaaggacacacccuaga

SEQ ID NO: 19870 - RNA, 19 nt, Human
aaaggacacacuuaggaga

SEQ ID NO: 19871 - RNA, 21 nt, Human
aaaggacacuaugaacuuuuu

SEQ ID NO: 19872 - RNA, 32 nt, Human
aaaggacacuccuggcuaucucaguucuguag

SEQ ID NO: 19873 - RNA, 21 nt, Human
aaaggacacuuauccacgaga

SEQ ID NO: 19874 - RNA, 32 nt, Human
aaaggacagagucacugcaagcagagagcagg

SEQ ID NO: 19875 - RNA, 32 nt, Human
aaaggacagcauggucggcacagaggaagggg

SEQ ID NO: 19876 - RNA, 32 nt, Human
aaaggacagggacugggaccguuacuuacaug

SEQ ID NO: 19877 - RNA, 18 nt, Human
aaaggacaucaucauaga

SEQ ID NO: 19878 - RNA, 18 nt, Human
aaaggacauccacacaga

SEQ ID NO: 19879 - RNA, 17 nt, Human
aaaggacaugcccacug

SEQ ID NO: 19880 - RNA, 23 nt, Human
aaaggacauuuguuggaggggug

SEQ ID NO: 19881 - RNA, 32 nt, Human
aaaggaccagugccgucacaucgcugucucug

SEQ ID NO: 19882 - RNA, 32 nt, Human
aaaggaccaugaguugguuguacucugaaaag

SEQ ID NO: 19883 - RNA, 32 nt, Human
aaaggacccaggaacgaggcguucaggaaagc

SEQ ID NO: 19884 - RNA, 32 nt, Human
aaaggacccaggagucugggaccccuccuggg

SEQ ID NO: 19885 - RNA, 32 nt, Human
aaaggaccgaggcgugcagcggacagcagaug

SEQ ID NO: 19886 - RNA, 32 nt, Human
aaaggaccgcuugguagccacuggaacccuuu

SEQ ID NO: 19887 - RNA, 32 nt, Human
aaaggaccucagcugcuucucccacuuggcca

SEQ ID NO: 19888 - RNA, 32 nt, Human
aaaggaccuuagcuuacugaaggaucuaaaga

SEQ ID NO: 19889 - RNA, 32 nt, Human
aaaggaccuucccaagucucccuuucccuguc

SEQ ID NO: 19890 - RNA, 32 nt, Human
aaaggaccuuguagaaccucuuugcagacgac

SEQ ID NO: 19891 - RNA, 32 nt, Human
aaaggacgguagaaaccacugccuuugcuuuu

SEQ ID NO: 19892 - RNA, 24 nt, Human
aaaggacucagcuccacucaacca

SEQ ID NO: 19893 - RNA, 32 nt, Human
aaaggacuccacccauccuaucagccugucuc

SEQ ID NO: 19894 - RNA, 18 nt, Human
aaaggacucugaacucag

SEQ ID NO: 19895 - RNA, 32 nt, Human
aaaggacugacugagaacaggagcaguuuuug

SEQ ID NO: 19896 - RNA, 32 nt, Human
aaaggacugcagcugugccaucgcgccucggu

SEQ ID NO: 19897 - RNA, 32 nt, Human
aaaggacugggcaccugccucugacagacacc

SEQ ID NO: 19898 - RNA, 20 nt, Human
aaaggacuguagacugaggg

SEQ ID NO: 19899 - RNA, 32 nt, Human
aaaggacuucauuucucucugccucaauuccu

SEQ ID NO: 19900 - RNA, 32 nt, Human
aaaggacuuucuucuguuuucuuccaaagugc

SEQ ID NO: 19901 - RNA, 32 nt, Human
aaaggagaaaauaauuaaacagucuucauuuu

SEQ ID NO: 19902 - RNA, 19 nt, Human
aaaggagaaacccgcuaga

SEQ ID NO: 19903 - RNA, 21 nt, Human
aaaggagaaagauaccaaucu

SEQ ID NO: 19904 - RNA, 32 nt, Human
aaaggagaagcacagcuccugccagggugagc

SEQ ID NO: 19905 - RNA, 32 nt, Human
aaaggagaagcagcaacggcugcucugcuucc

SEQ ID NO: 19906 - RNA, 32 nt, Human
aaaggagaaggaggaggaggaagagaguguga

SEQ ID NO: 19907 - RNA, 32 nt, Human
aaaggagaagggaaggaggaugagaaggaacg

SEQ ID NO: 19908 - RNA, 31 nt, Human
aaaggagaauucagagaaaaagaacugucag

SEQ ID NO: 19909 - RNA, 32 nt, Human
aaaggagacagaaaugucagacacugugaugg

SEQ ID NO: 19910 - RNA, 32 nt, Human
aaaggagacaggaacaaggaaaaguugagguu

SEQ ID NO: 19911 - RNA, 32 nt, Human
aaaggagagaacacuggcaucuguugaaauuc

SEQ ID NO: 19912 - RNA, 32 nt, Human
aaaggagagaacacuggcaucuguugaaauuu

SEQ ID NO: 19913 - RNA, 32 nt, Human
aaaggagagaggaggggugauggcaggggagu

SEQ ID NO: 19914 - RNA, 32 nt, Human
aaaggagagaggaggguuggaggugcaugaag

SEQ ID NO: 19915 - RNA, 32 nt, Human
aaaggagaggagaaaggaaaugagaaugaaga

SEQ ID NO: 19916 - RNA, 32 nt, Human
  misc_feature (18)..(18): n is a, c, g or u
aaaggagaggaggaaacnagugaggcagggag

SEQ ID NO: 19917 - RNA, 32 nt, Human
aaaggagaggggugggagcggggugggggcau

SEQ ID NO: 19918 - RNA, 32 nt, Human
aaaggagaucagugagaguacaugaugcugcu

SEQ ID NO: 19919 - RNA, 32 nt, Human
aaaggagaucuguuaaugugcuucacuauagu

SEQ ID NO: 19920 - RNA, 32 nt, Human
aaaggagauggaacuuguucccccuacuuaaa

SEQ ID NO: 19921 - RNA, 18 nt, Human
aaaggagauucuuugaga

SEQ ID NO: 19922 - RNA, 32 nt, Human
aaaggagauuuuggguaaaugagggaacgaua

SEQ ID NO: 19923 - RNA, 32 nt, Human
aaaggagcacacugucgcacuacauugucuaa

SEQ ID NO: 19924 - RNA, 32 nt, Human
aaaggagcaccucccagucacucagauuguga

SEQ ID NO: 19925 - RNA, 18 nt, Human
aaaggagcagcuuugaga

SEQ ID NO: 19926 - RNA, 32 nt, Human
aaaggagcagucauuggacaaugggcacaauc

SEQ ID NO: 19927 - RNA, 32 nt, Human
aaaggagcauuuuuacaccccuuaagggugcu

SEQ ID NO: 19928 - RNA, 24 nt, Human
aaaggagccaagaacuggcgggug

SEQ ID NO: 19929 - RNA, 22 nt, Human
aaaggagccaaggcaaagaggg

SEQ ID NO: 19930 - RNA, 23 nt, Human
aaaggagccaagguguaguggug

SEQ ID NO: 19931 - RNA, 32 nt, Human
aaaggagccacuugaaaaugucugcuccuucg

SEQ ID NO: 19932 - RNA, 32 nt, Human
aaaggagccagccucuccccaguuccugaaau

SEQ ID NO: 19933 - RNA, 32 nt, Human
aaaggagcccggcggaggcagcgguggguuug

SEQ ID NO: 19934 - RNA, 32 nt, Human
aaaggagcgcaggcagaucuggcauuuugcuu

SEQ ID NO: 19935 - RNA, 23 nt, Human
aaaggagcgguuccuagaaggug

SEQ ID NO: 19936 - RNA, 32 nt, Human
aaaggagcugcaggagaagcuaggcaaggagc

SEQ ID NO: 19937 - RNA, 22 nt, Human
aaaggagcuguuuuugaaggug

SEQ ID NO: 19938 - RNA, 32 nt, Human
aaaggagcuugccuccuuugaaugaccuagag

SEQ ID NO: 19939 - RNA, 32 nt, Human
aaaggagcuuucuacacagcuggacuucugag

SEQ ID NO: 19940 - RNA, 31 nt, Human
aaaggagcuuuucagcagccacccugcagca

SEQ ID NO: 19941 - RNA, 32 nt, Human
aaaggaggaaaaagauacauuaccuucaaagg

SEQ ID NO: 19942 - RNA, 18 nt, Human
aaaggaggaaaaguccca

SEQ ID NO: 19943 - RNA, 32 nt, Human
aaaggaggaacucugccucucugcuucuucau

SEQ ID NO: 19944 - RNA, 32 nt, Human
aaaggaggaaggagggagagggaaguaggaaa

SEQ ID NO: 19945 - RNA, 32 nt, Human
aaaggaggaauagucaaagcagcagcggcggc

SEQ ID NO: 19946 - RNA, 32 nt, Human
aaaggaggagcucuauggugacuuugaagacu

SEQ ID NO: 19947 - RNA, 32 nt, Human
aaaggaggaggaagaagaaagagagaaggggg

SEQ ID NO: 19948 - RNA, 32 nt, Human
aaaggaggagugaacgucuaggagaccagccg

SEQ ID NO: 19949 - RNA, 32 nt, Human
aaaggaggagugcaucuuuggccgacaguggu

SEQ ID NO: 19950 - RNA, 32 nt, Human
aaaggaggcgacuccuagauccagggauagcc

SEQ ID NO: 19951 - RNA, 32 nt, Human
aaaggaggcucagcacugucucaggcuggagg

SEQ ID NO: 19952 - RNA, 32 nt, Human
aaaggaggcugacagcaucugggaaaugacag

SEQ ID NO: 19953 - RNA, 32 nt, Human
aaaggagggaauaggaggagggcagggugagu

SEQ ID NO: 19954 - RNA, 32 nt, Human
aaaggagggacaaccugcacuccagggagccc

SEQ ID NO: 19955 - RNA, 32 nt, Human
aaaggagggaccccgccaccccagcagcugag

SEQ ID NO: 19956 - RNA, 32 nt, Human
aaaggagggagagagaggagagagaaggaaau

SEQ ID NO: 19957 - RNA, 32 nt, Human
aaaggagggcagggcuacauccuggcucggug

SEQ ID NO: 19958 - RNA, 32 nt, Human
aaaggagggcucaggaggagaguuuggagaag

SEQ ID NO: 19959 - RNA, 32 nt, Human
aaaggaggggauagagagagaccacuuuucau

SEQ ID NO: 19960 - RNA, 32 nt, Human
aaaggaggggucugaggcagggaggguggcau

SEQ ID NO: 19961 - RNA, 32 nt, Human
aaaggaggguggggcucaggggccucaagcug

SEQ ID NO: 19962 - RNA, 32 nt, Human
aaaggagggugucuuggcugugcuugaaggcg

SEQ ID NO: 19963 - RNA, 32 nt, Human
aaaggagguaguuuaagagucccugacccugg

SEQ ID NO: 19964 - RNA, 32 nt, Human
aaaggagguugaacaugcugugucugaauuca

SEQ ID NO: 19965 - RNA, 32 nt, Human
aaaggagguuugagguaacaacagagacuuuc

SEQ ID NO: 19966 - RNA, 21 nt, Human
aaaggaguaggcuugggggug

SEQ ID NO: 19967 - RNA, 19 nt, Human
aaaggagucgcccacugga

SEQ ID NO: 19968 - RNA, 32 nt, Human
aaaggagugagcuggugagguuaccacccuga

SEQ ID NO: 19969 - RNA, 32 nt, Human
aaaggagugcagaggaccuggccuggcacugg

SEQ ID NO: 19970 - RNA, 32 nt, Human
aaaggaguggaccgaggaaggaaggaaggcaa

SEQ ID NO: 19971 - RNA, 32 nt, Human
aaaggagugguggaacagaguugcuucuuaau

SEQ ID NO: 19972 - RNA, 19 nt, Human
aaaggaguucucccuugag

SEQ ID NO: 19973 - RNA, 32 nt, Human
aaaggauaagguggaggagacaagugaguuag

SEQ ID NO: 19974 - RNA, 32 nt, Human
aaaggauaguuuaugaguaaucuuuaaaacca

SEQ ID NO: 19975 - RNA, 32 nt, Human
aaaggauauaaauacuguguaugcuuuugaau

SEQ ID NO: 19976 - RNA, 32 nt, Human
aaaggauauugcugggauauugaggguugugg

SEQ ID NO: 19977 - RNA, 32 nt, Human
aaaggaucaagaagacuuccuuuucuaccacc

SEQ ID NO: 19978 - RNA, 32 nt, Human
aaaggaucaagcaaucucuugccaccucccag

SEQ ID NO: 19979 - RNA, 19 nt, Human
aaaggaucagaauccaggg

SEQ ID NO: 19980 - RNA, 32 nt, Human
aaaggaucagagaaagggagggcagagggaga

SEQ ID NO: 19981 - RNA, 32 nt, Human
aaaggaucagcuugaggaauaaggcucgucug

SEQ ID NO: 19982 - RNA, 32 nt, Human
aaaggauccucuucacuucuuucuuaaacagc

SEQ ID NO: 19983 - RNA, 32 nt, Human
aaaggaugaguucauguccuuuguagaacaug

SEQ ID NO: 19984 - RNA, 32 nt, Human
aaaggaugcacccaaacuucaaacuucaagca

SEQ ID NO: 19985 - RNA, 31 nt, Human
aaaggaugucuucucccuuguuugagaauga

SEQ ID NO: 19986 - RNA, 32 nt, Human
aaaggauguguuucaaccaugucacaaaaauc

SEQ ID NO: 19987 - RNA, 32 nt, Human
aaaggauguugcagauaucagaaagcaguuuc

SEQ ID NO: 19988 - RNA, 32 nt, Human
aaaggauuaugcuuuaaugcuguuaucuaucu

SEQ ID NO: 19989 - RNA, 32 nt, Human
aaaggauuccuuuaguagcucauguucuuugu

SEQ ID NO: 19990 - RNA, 32 nt, Human
aaaggauucugccucuuuaguccucacuguua

SEQ ID NO: 19991 - RNA, 18 nt, Human
aaaggauuguccuugagg

SEQ ID NO: 19992 - RNA, 32 nt, Human
aaaggauuuucauucaucauguucacaagugc

SEQ ID NO: 19993 - RNA, 32 nt, Human
aaaggcaaagcgcacccccacuuggggaccaa

SEQ ID NO: 19994 - RNA, 32 nt, Human
aaaggcaacauccugucacaggccaugcucug

SEQ ID NO: 19995 - RNA, 32 nt, Human
aaaggcaacguuuugcagcuuccaaauuucug

SEQ ID NO: 19996 - RNA, 18 nt, Human
aaaggcaagaaacugcug

SEQ ID NO: 19997 - RNA, 32 nt, Human
aaaggcaagaccaagaccaccaaaaagcgccc

SEQ ID NO: 19998 - RNA, 32 nt, Human
aaaggcaagaccaagaccaccaaaaagcuccc

SEQ ID NO: 19999 - RNA, 19 nt, Human
aaaggcaagacucucucug

SEQ ID NO: 20000 - RNA, 32 nt, Human
aaaggcacaaacaccaccagccacuuugcuaa

SEQ ID NO: 20001 - RNA, 32 nt, Human
aaaggcacaagaaagaaaauauccagcucucu

SEQ ID NO: 20002 - RNA, 32 nt, Human
aaaggcacuuacugcugcucagaaccucaggc

SEQ ID NO: 20003 - RNA, 32 nt, Human
aaaggcagaaggcagugagagggaggcuaugc

SEQ ID NO: 20004 - RNA, 32 nt, Human
aaaggcagccuccuuaaauguuuucugaagag

SEQ ID NO: 20005 - RNA, 32 nt, Human
aaaggcagccugggcacacggacagacggacu

SEQ ID NO: 20006 - RNA, 32 nt, Human
aaaggcagcguguggagguggagcccagaguu

SEQ ID NO: 20007 - RNA, 32 nt, Human
aaaggcagcuuugucccagcucugccacccuc

SEQ ID NO: 20008 - RNA, 32 nt, Human
aaaggcaggacugggagccggaggggcugaaa

SEQ ID NO: 20009 - RNA, 32 nt, Human
aaaggcaggaggugggugagcggguggggugc

SEQ ID NO: 20010 - RNA, 32 nt, Human
aaaggcaggugcuuuuggcagagaccauaaga

SEQ ID NO: 20011 - RNA, 32 nt, Human
aaaggcagguggaucacuugggucaggaguuc

SEQ ID NO: 20012 - RNA, 31 nt, Human
aaaggcagguucaaaauucuguugaaagaaa

SEQ ID NO: 20013 - RNA, 32 nt, Human
aaaggcaguacagacccaaaaagcgagcagca

SEQ ID NO: 20014 - RNA, 20 nt, Human
aaaggcaguguacccuugag

SEQ ID NO: 20015 - RNA, 31 nt, Human
aaaggcaguuugucuacuacagcagaaggcu

SEQ ID NO: 20016 - RNA, 32 nt, Human
aaaggcauaagaaugaugcaauggacuuuggg

SEQ ID NO: 20017 - RNA, 32 nt, Human
aaaggcauauagaaaauaaaucucaaaaugac

SEQ ID NO: 20018 - RNA, 32 nt, Human
aaaggcaucacugaccaggaauaucugggcuu

SEQ ID NO: 20019 - RNA, 32 nt, Human
aaaggcauccagagaaggugggagcggagagu

SEQ ID NO: 20020 - RNA, 32 nt, Human
aaaggcaucguugucugcuaaauuacuugaau

SEQ ID NO: 20021 - RNA, 32 nt, Human
aaaggcaucuuucugaauuucauucucuugaa

SEQ ID NO: 20022 - RNA, 32 nt, Human
aaaggcaugcaagcccgggcgcccucucagua

SEQ ID NO: 20023 - RNA, 32 nt, Human
aaaggccaacagcauuggccuggccagaccag

SEQ ID NO: 20024 - RNA, 18 nt, Human
aaaggccaagagaaucac

SEQ ID NO: 20025 - RNA, 32 nt, Human
aaaggccaagcuuggucuucagcuggggaaga

SEQ ID NO: 20026 - RNA, 32 nt, Human
aaaggccacaauaugaagucacucucagaugg

SEQ ID NO: 20027 - RNA, 32 nt, Human
aaaggccacagcugagccuggaacugacccuu

SEQ ID NO: 20028 - RNA, 32 nt, Human
aaaggccacagcuggccuggaacugacccuuc

SEQ ID NO: 20029 - RNA, 20 nt, Human
aaaggccaccauggcugcag

SEQ ID NO: 20030 - RNA, 32 nt, Human
aaaggccaccugugcuucaccaugcuccaucc

SEQ ID NO: 20031 - RNA, 32 nt, Human
aaaggccacugaaaggaugacugucccaaaag

SEQ ID NO: 20032 - RNA, 32 nt, Human
aaaggccacugcaccagcccucagcucagggg

SEQ ID NO: 20033 - RNA, 32 nt, Human
aaaggccacugcacuccagccugagugacaga

SEQ ID NO: 20034 - RNA, 32 nt, Human
aaaggccacuggggagaaaccuuauuccugua

SEQ ID NO: 20035 - RNA, 23 nt, Human
aaaggccagacgcaguggcucac

SEQ ID NO: 20036 - RNA, 32 nt, Human
aaaggccagguggaagccauuggggugaacuc

SEQ ID NO: 20037 - RNA, 32 nt, Human
aaaggccagguuguagucccagcucuuaucug

SEQ ID NO: 20038 - RNA, 19 nt, Human
aaaggccauguguggacac

SEQ ID NO: 20039 - RNA, 32 nt, Human
aaaggcccaagagggaagucagagguggcggu

SEQ ID NO: 20040 - RNA, 32 nt, Human
aaaggcccagaacgugcaggucugcggagggg

SEQ ID NO: 20041 - RNA, 32 nt, Human
aaaggcccuggugguuuccacauugcuaccca

SEQ ID NO: 20042 - RNA, 32 nt, Human
aaaggccgacagaggggaaggaauggaccugu

SEQ ID NO: 20043 - RNA, 32 nt, Human
aaaggccgcaugaucuuucuggcuccacucag

SEQ ID NO: 20044 - RNA, 32 nt, Human
aaaggccgccugaugaccugcagccuggaccu

SEQ ID NO: 20045 - RNA, 32 nt, Human
aaaggccguguucacacacucacaagagauau

SEQ ID NO: 20046 - RNA, 32 nt, Human
aaaggccuaagaggagggguuuggggaguuuc

SEQ ID NO: 20047 - RNA, 32 nt, Human
aaaggccuaugcuccagaauucuauuaugaua

SEQ ID NO: 20048 - RNA, 32 nt, Human
aaaggccucagccacccagcugugucccuuuc

SEQ ID NO: 20049 - RNA, 32 nt, Human
aaaggccucgggacuucccaccaccuugcucc

SEQ ID NO: 20050 - RNA, 32 nt, Human
aaaggccugcacccucuuccugcucucccagg

SEQ ID NO: 20051 - RNA, 32 nt, Human
aaaggccuggcuugagaggaaauggagaaaac

SEQ ID NO: 20052 - RNA, 32 nt, Human
aaaggccuggggaggugaaggaagagagacuu

SEQ ID NO: 20053 - RNA, 32 nt, Human
aaaggccugggguggccaaugugaacucauua

SEQ ID NO: 20054 - RNA, 32 nt, Human
aaaggcgaucagcuucaguagauucacggcag

SEQ ID NO: 20055 - RNA, 32 nt, Human
aaaggcgcacacauucgaucucuuucgaagcu

SEQ ID NO: 20056 - RNA, 32 nt, Human
aaaggcgcggccgccccucccccgggcgcccc

SEQ ID NO: 20057 - RNA, 32 nt, Human
aaaggcgcuagggaagggcaaaguauuauugg

SEQ ID NO: 20058 - RNA, 32 nt, Human
aaaggcggaggaaauccaggaggcagaaguga

SEQ ID NO: 20059 - RNA, 21 nt, Human
aaaggcggcacuacuuaugua

SEQ ID NO: 20060 - RNA, 32 nt, Human
aaaggcggcgggaggggagggagggagagugg

SEQ ID NO: 20061 - RNA, 32 nt, Human
aaaggcgggacaacucaaagguggggagaggg

SEQ ID NO: 20062 - RNA, 32 nt, Human
aaaggcgggaggaucacuugaggccaggacuu

SEQ ID NO: 20063 - RNA, 32 nt, Human
aaaggcggugaagagacaggagagggggaucg

SEQ ID NO: 20064 - RNA, 32 nt, Human
aaaggcguaagaauuuugaagcuauguucaaa

SEQ ID NO: 20065 - RNA, 32 nt, Human
aaaggcgugacggagagcuggggcucugagag

SEQ ID NO: 20066 - RNA, 32 nt, Human
aaaggcuaagacuggaggaucgcuugagccaa

SEQ ID NO: 20067 - RNA, 32 nt, Human
aaaggcuaaggcaggaggauugcuugagccca

SEQ ID NO: 20068 - RNA, 32 nt, Human
aaaggcuacgagcaauacuauagcuucacaca

SEQ ID NO: 20069 - RNA, 32 nt, Human
aaaggcucacccuggggagcccuucagccuga

SEQ ID NO: 20070 - RNA, 32 nt, Human
aaaggcuccaucccccgcccccucucucccgc

SEQ ID NO: 20071 - RNA, 32 nt, Human
aaaggcuccuguaacccuccuccaggaugaac

SEQ ID NO: 20072 - RNA, 32 nt, Human
aaaggcucggacgugggcucuguguccugauc

SEQ ID NO: 20073 - RNA, 32 nt, Human
aaaggcucuucugcuugcuuccuggaucccug

SEQ ID NO: 20074 - RNA, 32 nt, Human
aaaggcugaagaccaguucuccccagugaaag

SEQ ID NO: 20075 - RNA, 32 nt, Human
aaaggcugaaggagguggagcuggggaggaag

SEQ ID NO: 20076 - RNA, 32 nt, Human
aaaggcugaaggcagccgggcgcaguggcuca

SEQ ID NO: 20077 - RNA, 32 nt, Human
aaaggcugaccagacuuaacagugcuccaccc

SEQ ID NO: 20078 - RNA, 32 nt, Human
aaaggcugagaggugggcacagcuguggggca

SEQ ID NO: 20079 - RNA, 32 nt, Human
aaaggcugaggcaggagaaucgcuugaaccua

SEQ ID NO: 20080 - RNA, 32 nt, Human
aaaggcugcaacacccagaccuccaggagaga

SEQ ID NO: 20081 - RNA, 32 nt, Human
aaaggcugccugcagaggacagguguguuggg

SEQ ID NO: 20082 - RNA, 32 nt, Human
aaaggcugccuguaccucucaagcuuugcauu

SEQ ID NO: 20083 - RNA, 32 nt, Human
aaaggcugcucacuggcccgucuccucucaug

SEQ ID NO: 20084 - RNA, 32 nt, Human
aaaggcuggaagaagggcugaccuggaggacu

SEQ ID NO: 20085 - RNA, 32 nt, Human
aaaggcugggaaacgggagcagaggaagcaca

SEQ ID NO: 20086 - RNA, 32 nt, Human
aaaggcugggauuacaggcaugagccacugca

SEQ ID NO: 20087 - RNA, 32 nt, Human
aaaggcuggggcaugaguccugcuuggggugg

SEQ ID NO: 20088 - RNA, 32 nt, Human
aaaggcuggggguggaggguggaggagggagc

SEQ ID NO: 20089 - RNA, 18 nt, Human
aaaggcugggucuuggga

SEQ ID NO: 20090 - RNA, 32 nt, Human
aaaggcugguagguacacaaaugcugguccga

SEQ ID NO: 20091 - RNA, 32 nt, Human
aaaggcuguaccaauccucuaauaugaaaugu

SEQ ID NO: 20092 - RNA, 32 nt, Human
aaaggcugugcugcuggggccucccagggccg

SEQ ID NO: 20093 - RNA, 18 nt, Human
aaaggcuguuuuuugagg

SEQ ID NO: 20094 - RNA, 32 nt, Human
aaaggcuuauaaauguuugaaauaucacacaa

SEQ ID NO: 20095 - RNA, 32 nt, Human
aaaggcuucaaggcucugagccccagggcaga

SEQ ID NO: 20096 - RNA, 32 nt, Human
aaaggcuucccucuguguguugcaguccugug

SEQ ID NO: 20097 - RNA, 32 nt, Human
aaaggcuucuccacaaccuccuccuccaguuc

SEQ ID NO: 20098 - RNA, 32 nt, Human
aaaggcuucuuguuugcccaagggccuaucag

SEQ ID NO: 20099 - RNA, 32 nt, Human
aaaggcuugcaauaucccacucccagauugca

SEQ ID NO: 20100 - RNA, 32 nt, Human
aaaggcuuuagccauggacaggaguggcuuug

SEQ ID NO: 20101 - RNA, 32 nt, Human
aaaggcuuucacuucacacccaccuccaucaa

SEQ ID NO: 20102 - RNA, 32 nt, Human
aaaggcuuucgggagugugaggcugcaucugc

SEQ ID NO: 20103 - RNA, 32 nt, Human
aaaggcuuugggccuggugugguggcauaggc

SEQ ID NO: 20104 - RNA, 32 nt, Human
aaagggaaaagaagauguugaagaauagaguu

SEQ ID NO: 20105 - RNA, 32 nt, Human
aaagggaaacaguaccaaggagaccagcccua

SEQ ID NO: 20106 - RNA, 32 nt, Human
aaagggaaagaaaugcuuggaggaggcuccug

SEQ ID NO: 20107 - RNA, 32 nt, Human
aaagggaaagugucugaugaugaccaauuuac

SEQ ID NO: 20108 - RNA, 32 nt, Human
aaagggaaccaaggcagaggcucacagacugu

SEQ ID NO: 20109 - RNA, 32 nt, Human
aaagggaagaaagaagaagaggaggcuguuug

SEQ ID NO: 20110 - RNA, 32 nt, Human
aaagggaagaggagccgacagcagagggggaa

SEQ ID NO: 20111 - RNA, 32 nt, Human
aaagggaagagugauaacaaggcuccacagag

SEQ ID NO: 20112 - RNA, 32 nt, Human
aaagggaagggguuugcccacuuuccucuuuu

SEQ ID NO: 20113 - RNA, 32 nt, Human
aaagggaaguaguuugguucuauuauguggaa

SEQ ID NO: 20114 - RNA, 32 nt, Human
aaagggaagugcugcuuaguccuggacuuuug

SEQ ID NO: 20115 - RNA, 32 nt, Human
aaagggaauaggcugauggagcuguucuguau

SEQ ID NO: 20116 - RNA, 32 nt, Human
aaagggaaugagaggaaggcaagcaggcaggg

SEQ ID NO: 20117 - RNA, 32 nt, Human
aaagggacaagugaggcaggccuagcaguucc

SEQ ID NO: 20118 - RNA, 32 nt, Human
aaagggacaccccuacacacacccaggcccac

SEQ ID NO: 20119 - RNA, 32 nt, Human
aaagggacagagucagcucacacgcugucugu

SEQ ID NO: 20120 - RNA, 32 nt, Human
aaagggacaggaggcaugggauagcaggucug

SEQ ID NO: 20121 - RNA, 32 nt, Human
aaagggaccagagagaaggagucaccugcagu

SEQ ID NO: 20122 - RNA, 32 nt, Human
aaagggaccagcuggaagacuagccucacucu

SEQ ID NO: 20123 - RNA, 32 nt, Human
aaagggaccugggaacgacacuccucugcaua

SEQ ID NO: 20124 - RNA, 32 nt, Human
aaagggacuucuagcaaaccugcaggaagaga

SEQ ID NO: 20125 - RNA, 32 nt, Human
aaagggagaacugccucauucuggcuuuggua

SEQ ID NO: 20126 - RNA, 32 nt, Human
aaagggagaagagggaaaacagaaaaccugau

SEQ ID NO: 20127 - RNA, 32 nt, Human
aaagggagaagagggaaaaggaagcacguccc

SEQ ID NO: 20128 - RNA, 32 nt, Human
aaagggagaagugagagggacaauuggguuca

SEQ ID NO: 20129 - RNA, 32 nt, Human
aaagggagagaaacagagacucagggagaggg

SEQ ID NO: 20130 - RNA, 32 nt, Human
aaagggagagccaccugguacuuguccacccu

SEQ ID NO: 20131 - RNA, 31 nt, Human
aaagggagaggugaaagcaaagacugcuuug

SEQ ID NO: 20132 - RNA, 32 nt, Human
aaagggagauggguagcaucauuuugauuaac

SEQ ID NO: 20133 - RNA, 32 nt, Human
aaagggagcaaugcugugaaugcagcuugcuu

SEQ ID NO: 20134 - RNA, 32 nt, Human
aaagggagcauggguguuggggagacaccugu

SEQ ID NO: 20135 - RNA, 32 nt, Human
aaagggagcccaaacuccacucucacagaacc

SEQ ID NO: 20136 - RNA, 32 nt, Human
aaagggagcccagugguugcaaugaaagacua

SEQ ID NO: 20137 - RNA, 32 nt, Human
aaagggagccugggaggcuggguggaggaggg

SEQ ID NO: 20138 - RNA, 32 nt, Human
aaagggagcugaugcuggcaaugggaucagag

SEQ ID NO: 20139 - RNA, 32 nt, Human
aaagggagcugccccaggcuuuagugcagcug

SEQ ID NO: 20140 - RNA, 32 nt, Human
aaagggaggagaaaggagaaaccaaacuuuga

SEQ ID NO: 20141 - RNA, 32 nt, Human
aaagggaggagagaagcacagugaaagaaaaa

SEQ ID NO: 20142 - RNA, 32 nt, Human
aaagggaggagagagaaggagaaaugagaaaa

SEQ ID NO: 20143 - RNA, 32 nt, Human
aaagggaggaggggcucaugggacugcugaga

SEQ ID NO: 20144 - RNA, 32 nt, Human
aaagggaggcuccgcagccaaaagucccuccu

SEQ ID NO: 20145 - RNA, 32 nt, Human
aaagggaggcugggugagcagagacagaaaag

SEQ ID NO: 20146 - RNA, 32 nt, Human
aaagggagggaaggagaaagaaugggaauaaa

SEQ ID NO: 20147 - RNA, 32 nt, Human
aaagggaggguaggaagagggagaagugucag

SEQ ID NO: 20148 - RNA, 32 nt, Human
aaagggaggugcagagagcucuaagccagugu

SEQ ID NO: 20149 - RNA, 32 nt, Human
aaagggaguaggggagacugagacugaccggu

SEQ ID NO: 20150 - RNA, 20 nt, Human
aaagggagucaaacuuaggg

SEQ ID NO: 20151 - RNA, 32 nt, Human
aaagggagugccugagguaggccuuagaaggg

SEQ ID NO: 20152 - RNA, 32 nt, Human
aaagggaguggcaggacaagauucagacucau

SEQ ID NO: 20153 - RNA, 32 nt, Human
aaagggaguuuccaggccagaagccaucccug

SEQ ID NO: 20154 - RNA, 32 nt, Human
aaagggaucugcaguggggccaaggaugccac

SEQ ID NO: 20155 - RNA, 32 nt, Human
aaagggaugagagaaaggaggugguauggaag

SEQ ID NO: 20156 - RNA, 32 nt, Human
aaagggaugagguugggggaguugcccagagg

SEQ ID NO: 20157 - RNA, 32 nt, Human
aaagggauuaaauugugagaacaacugucaau

SEQ ID NO: 20158 - RNA, 32 nt, Human
aaagggcaaaguacauuccacauguugaagga

SEQ ID NO: 20159 - RNA, 32 nt, Human
aaagggcaacacaugagcugucaaacaguguu

SEQ ID NO: 20160 - RNA, 32 nt, Human
aaagggcaagacgggaguuggggaagggaagg

SEQ ID NO: 20161 - RNA, 32 nt, Human
aaagggcagagacagauaaucucacuuccaga

SEQ ID NO: 20162 - RNA, 32 nt, Human
aaagggcagagcaggccuaaggcuccaacggc

SEQ ID NO: 20163 - RNA, 32 nt, Human
aaagggcagaguuucuggaggaaaccgcagcc

SEQ ID NO: 20164 - RNA, 32 nt, Human
aaagggcagccugugccuguuuauggauccuc

SEQ ID NO: 20165 - RNA, 32 nt, Human
aaagggcaggcucugguuucugcugccucuuc

SEQ ID NO: 20166 - RNA, 32 nt, Human
aaagggcauuuagaggaagaaggcugaaauca

SEQ ID NO: 20167 - RNA, 17 nt, Human
aaagggccaacugcagg

SEQ ID NO: 20168 - RNA, 32 nt, Human
aaagggccagugcccuuauacaaagacuggaa

SEQ ID NO: 20169 - RNA, 32 nt, Human
aaagggccauuuucaccugccucagcauucca

SEQ ID NO: 20170 - RNA, 32 nt, Human
aaagggcccucauuuaaauaaugcuguuauuu

SEQ ID NO: 20171 - RNA, 32 nt, Human
aaagggcccuccacugccaccucucaugggau

SEQ ID NO: 20172 - RNA, 32 nt, Human
aaagggcccuggagagaggggcugguggcugg

SEQ ID NO: 20173 - RNA, 22 nt, Human
aaagggccuauugaacucuggg

SEQ ID NO: 20174 - RNA, 32 nt, Human
aaagggccucugcuggcugcaggugaucaucu

SEQ ID NO: 20175 - RNA, 32 nt, Human
aaagggccugaaccucugcucuggauugaagc

SEQ ID NO: 20176 - RNA, 32 nt, Human
aaagggccugggaaggugaggcaggccagagu

SEQ ID NO: 20177 - RNA, 32 nt, Human
aaagggccugggagguggugggagggagaagg

SEQ ID NO: 20178 - RNA, 32 nt, Human
aaagggcggugacggcacuggguggggccgag

SEQ ID NO: 20179 - RNA, 32 nt, Human
aaagggcgugggaagagcagggcuugcccagc

SEQ ID NO: 20180 - RNA, 32 nt, Human
aaagggcucaaggacagcagcucagcauccug

SEQ ID NO: 20181 - RNA, 32 nt, Human
aaagggcucaaggggcuggagacuggcugcug

SEQ ID NO: 20182 - RNA, 32 nt, Human
aaagggcucagccugugauaggcauucaauaa

SEQ ID NO: 20183 - RNA, 32 nt, Human
aaagggcuccacugcugacaagguuugagaac

SEQ ID NO: 20184 - RNA, 17 nt, Human
aaagggcucgcccaggg

SEQ ID NO: 20185 - RNA, 18 nt, Human
aaagggcucugaagcuca

SEQ ID NO: 20186 - RNA, 32 nt, Human
aaagggcucugccccuuuaacuccucacucuu

SEQ ID NO: 20187 - RNA, 18 nt, Human
aaagggcucuucacucgg

SEQ ID NO: 20188 - RNA, 22 nt, Human
aaagggcucuugagccucuggg

SEQ ID NO: 20189 - RNA, 32 nt, Human
aaagggcuggguuuugaaaauaacacaggcuc

SEQ ID NO: 20190 - RNA, 19 nt, Human
aaagggcuucuuccucagg

SEQ ID NO: 20191 - RNA, 18 nt, Human
aaagggcuuuggauucag

SEQ ID NO: 20192 - RNA, 20 nt, Human
aaagggcuuuggcccaaggg

SEQ ID NO: 20193 - RNA, 32 nt, Human
aaaggggaaaggaagaaagaaggagagcagga

SEQ ID NO: 20194 - RNA, 32 nt, Human
aaaggggaaaggggcagcgggggaagagaauu

SEQ ID NO: 20195 - RNA, 32 nt, Human
aaaggggaaauuuggacacagagagagacaca

SEQ ID NO: 20196 - RNA, 32 nt, Human
aaaggggaagaaagacauaaagaaaagcgaca

SEQ ID NO: 20197 - RNA, 32 nt, Human
aaaggggaaugaaggcugcagauggaaguaaa

SEQ ID NO: 20198 - RNA, 32 nt, Human
aaaggggacagaaauauaacuaaaugcuucca

SEQ ID NO: 20199 - RNA, 32 nt, Human
aaaggggacaugccgggaguugcaguacccuc

SEQ ID NO: 20200 - RNA, 18 nt, Human
aaaggggacccaguucag

SEQ ID NO: 20201 - RNA, 32 nt, Human
aaaggggacuggcugcugugaucuucuaaggg

SEQ ID NO: 20202 - RNA, 32 nt, Human
aaaggggagaagcagagagugggaagacagcu

SEQ ID NO: 20203 - RNA, 32 nt, Human
aaaggggagagaggcuuccaaggggcccauca

SEQ ID NO: 20204 - RNA, 32 nt, Human
aaaggggagagggagauucccaaggagaggcu

SEQ ID NO: 20205 - RNA, 32 nt, Human
aaaggggaggaagauggagggagaagcuagag

SEQ ID NO: 20206 - RNA, 32 nt, Human
aaaggggagggaggggcagggagcugucuacc

SEQ ID NO: 20207 - RNA, 23 nt, Human
aaaggggagugcuaacuggggga

SEQ ID NO: 20208 - RNA, 32 nt, Human
aaaggggaugcagagcccugcccagcaccacc

SEQ ID NO: 20209 - RNA, 32 nt, Human
aaaggggauggagaccugcuccccagcucuuc

SEQ ID NO: 20210 - RNA, 32 nt, Human
aaaggggcaaaagcacuugcucuccucccagc

SEQ ID NO: 20211 - RNA, 32 nt, Human
aaaggggcaagagcugagcggaacaccggccc

SEQ ID NO: 20212 - RNA, 22 nt, Human
aaaggggcacagagugaacaga

SEQ ID NO: 20213 - RNA, 32 nt, Human
aaaggggcacugaccuguagugaaaggccaca

SEQ ID NO: 20214 - RNA, 32 nt, Human
aaaggggcagaacuucaaaugggugaaacucc

SEQ ID NO: 20215 - RNA, 32 nt, Human
aaaggggcaggcggcagugcacagggauuuau

SEQ ID NO: 20216 - RNA, 32 nt, Human
aaaggggccuggcacuuugugauugccacgug

SEQ ID NO: 20217 - RNA, 32 nt, Human
aaaggggcugcaggacacagcaaaaugccagc

SEQ ID NO: 20218 - RNA, 32 nt, Human
aaaggggcugggaagaagggggaccaguuugg

SEQ ID NO: 20219 - RNA, 32 nt, Human
aaaggggcuguugcugaacagucugcaggacc

SEQ ID NO: 20220 - RNA, 32 nt, Human
aaagggggaaaaugcccaggaggaagcaggag

SEQ ID NO: 20221 - RNA, 19 nt, Human
aaagggggaagaacuaggg

SEQ ID NO: 20222 - RNA, 32 nt, Human
aaagggggaggaaaaugauguccccagccuaa

SEQ ID NO: 20223 - RNA, 32 nt, Human
aaagggggaggcauuuugaagauagaaccucu

SEQ ID NO: 20224 - RNA, 20 nt, Human
aaagggggcagcccuuggga

SEQ ID NO: 20225 - RNA, 32 nt, Human
aaagggggccacaugggcagaaacccaaagga

SEQ ID NO: 20226 - RNA, 18 nt, Human
aaagggggccccuugaga

SEQ ID NO: 20227 - RNA, 32 nt, Human
aaagggggcgucuccccuuuaaagacuugcaa

SEQ ID NO: 20228 - RNA, 32 nt, Human
aaagggggcucuucccccagagaaguggcuug

SEQ ID NO: 20229 - RNA, 21 nt, Human
aaaggggggacagguggggga

SEQ ID NO: 20230 - RNA, 32 nt, Human
aaagggggugugaugaguguuaacuugguugu

SEQ ID NO: 20231 - RNA, 32 nt, Human
aaaggggucauccucagucugauaauaccaag

SEQ ID NO: 20232 - RNA, 32 nt, Human
aaaggggucccaacagaggugaagauccaaga

SEQ ID NO: 20233 - RNA, 32 nt, Human
aaagggguguauuuaauuccaucagguccagu

SEQ ID NO: 20234 - RNA, 32 nt, Human
aaagggguugagccaacaaaaggucugccgaa

SEQ ID NO: 20235 - RNA, 32 nt, Human
aacaaaggagagaaaggagggaaaagccaguc

SEQ ID NO: 20236 - RNA, 32 nt, Human
aacaaaggagguuugagagaggcgggaucugg

SEQ ID NO: 20237 - RNA, 32 nt, Human
aacaaaggauccaggauuuaacugggagucag

SEQ ID NO: 20238 - RNA, 32 nt, Human
aacaaaggcaacacauccacaugcacuggaca

SEQ ID NO: 20239 - RNA, 32 nt, Human
aacaaaggcacuggauucugaauggccccugu

SEQ ID NO: 20240 - RNA, 32 nt, Human
aacaaaggcauccucagaggugugccucuuuu

SEQ ID NO: 20241 - RNA, 32 nt, Human
aacaaaggcccagcagccuucugacaagcaag

SEQ ID NO: 20242 - RNA, 32 nt, Human
aacaaaggccuccucaugcuggccuuucuugg

SEQ ID NO: 20243 - RNA, 32 nt, Human
aacaaaggcugaaaaggcugcucacucucauc

SEQ ID NO: 20244 - RNA, 32 nt, Human
aacaaaggcuggggguggaggguggaggaggg

SEQ ID NO: 20245 - RNA, 32 nt, Human
aacaaagggcaaauauccagaaucuacaauga

SEQ ID NO: 20246 - RNA, 32 nt, Human
aacaaagggguucugacacuaagacauuaggg

SEQ ID NO: 20247 - RNA, 32 nt, Human
aacaaaggguaugggaaugagcacauaacacu

SEQ ID NO: 20248 - RNA, 32 nt, Human
aacaaagugauggcuuggaacacugucuuaca

SEQ ID NO: 20249 - RNA, 32 nt, Human
aacaaaguuuauuugagaggaggaauucugga

SEQ ID NO: 20250 - RNA, 32 nt, Human
aacaaauaagacucaaacugcucaaagugacg

SEQ ID NO: 20251 - RNA, 32 nt, Human
aacaaauacauuaucagaaacuggcccaaacc

SEQ ID NO: 20252 - RNA, 32 nt, Human
aacaaauacuccucaguuugacuugacuuagu

SEQ ID NO: 20253 - RNA, 32 nt, Human
aacaaaucacacaccguuucccaaaccaacag

SEQ ID NO: 20254 - RNA, 32 nt, Human
aacaaaucccauauguugggcaacaguucaaa

SEQ ID NO: 20255 - RNA, 32 nt, Human
aacaaaucuauggcuagguaaagggucaacuc

SEQ ID NO: 20256 - RNA, 32 nt, Human
aacaaaucuugcacucugaggaauuuuuaagu

SEQ ID NO: 20257 - RNA, 32 nt, Human
aacaaaugaaggcugaggagguuucuaaaccu

SEQ ID NO: 20258 - RNA, 32 nt, Human
aacaaaugacagacuugggcucugcugcucag

SEQ ID NO: 20259 - RNA, 32 nt, Human
aacaaaugagccacugcgcccggccauaaaug

SEQ ID NO: 20260 - RNA, 32 nt, Human
aacaaaugauaaaggaacucauuuaucaauag

SEQ ID NO: 20261 - RNA, 32 nt, Human
aacaaauggccccuaugcacagagccauagga

SEQ ID NO: 20262 - RNA, 32 nt, Human
aacaaaugggcccugacuguaaauuagugaag

SEQ ID NO: 20263 - RNA, 32 nt, Human
aacaaaugguuuuuauuucacaguuaucaggg

SEQ ID NO: 20264 - RNA, 32 nt, Human
aacaaaugugucugagucuuggaaaacacccc

SEQ ID NO: 20265 - RNA, 32 nt, Human
aacaaauuaaagcucaucuuaaaguccaaaaa

SEQ ID NO: 20266 - RNA, 32 nt, Human
aacaaauuacccucuagcccaguggcuuaaaa

SEQ ID NO: 20267 - RNA, 32 nt, Human
aacaaauuacuuuucaccagcaucuuuacuau

SEQ ID NO: 20268 - RNA, 32 nt, Human
aacaaauuagccuggcacuuuagguaacuuga

SEQ ID NO: 20269 - RNA, 32 nt, Human
aacaaauuuauaaauugauuauuugaaacuuu

SEQ ID NO: 20270 - RNA, 32 nt, Human
aacaacaaaacaccguuauaaacacaucaaag

SEQ ID NO: 20271 - RNA, 32 nt, Human
aacaacaaaagcuugaagcuguggagggccac

SEQ ID NO: 20272 - RNA, 32 nt, Human
aacaacaaagagccaaaagaucaaagaaggga

SEQ ID NO: 20273 - RNA, 32 nt, Human
aacaacaacaaaaacaaaaaugugcuguucaa

SEQ ID NO: 20274 - RNA, 31 nt, Human
aacaacaacaacaaaacagcagaggaauugu

SEQ ID NO: 20275 - RNA, 32 nt, Human
aacaacaacaacaacuuauuuaguuuggggag

SEQ ID NO: 20276 - RNA, 32 nt, Human
aacaacaacaggcugggcgcaguggcucacac

SEQ ID NO: 20277 - RNA, 32 nt, Human
aacaacaacauagccuagucaaacuucucagg

SEQ ID NO: 20278 - RNA, 32 nt, Human
aacaacaagaaagucaaggaagaaaagaacgg

SEQ ID NO: 20279 - RNA, 32 nt, Human
aacaacaagaugaccuuauuucuuaacuguuu

SEQ ID NO: 20280 - RNA, 32 nt, Human
aacaacaaggcugcugggggccuguucuucag

SEQ ID NO: 20281 - RNA, 32 nt, Human
aacaacaaggcuuugggugugaagggacuccc

SEQ ID NO: 20282 - RNA, 32 nt, Human
aacaacacagucucaugaucauacagcugugg

SEQ ID NO: 20283 - RNA, 32 nt, Human
aacaacacaguguguuuuuggaagaugugauu

SEQ ID NO: 20284 - RNA, 32 nt, Human
aacaacaccagccugaccaacauggugaaacc

SEQ ID NO: 20285 - RNA, 32 nt, Human
aacaacacuacccuccucucuucccagaugug

SEQ ID NO: 20286 - RNA, 32 nt, Human
aacaacacucaccacacacacuuccuucaaaa

SEQ ID NO: 20287 - RNA, 32 nt, Human
aacaacacuggagagcagaggcuguggcuugg

SEQ ID NO: 20288 - RNA, 32 nt, Human
aacaacagagggcaagaaaauuugaugcagua

SEQ ID NO: 20289 - RNA, 32 nt, Human
aacaacagcuggugcccugcuuucagauacug

SEQ ID NO: 20290 - RNA, 32 nt, Human
aacaacaggcugggcgcaguggcucacaccug

SEQ ID NO: 20291 - RNA, 24 nt, Human
aacaacaguucgggauauaagaaa

SEQ ID NO: 20292 - RNA, 32 nt, Human
aacaacaguugggcugucaacauucaaagcag

SEQ ID NO: 20293 - RNA, 24 nt, Human
aacaacaguuugcuauaagaaaca

SEQ ID NO: 20294 - RNA, 32 nt, Human
aacaacauacagaaaagugaauaaaacauaaa

SEQ ID NO: 20295 - RNA, 32 nt, Human
aacaacaucaaaaaucaacagacugcacugau

SEQ ID NO: 20296 - RNA, 32 nt, Human
aacaacaucaaauuguauguacgcagagauuu

SEQ ID NO: 20297 - RNA, 32 nt, Human
aacaacauggacggucuuuuucuuuuauuaua

SEQ ID NO: 20298 - RNA, 23 nt, Human
aacaaccaacaaaaugccacuuu

SEQ ID NO: 20299 - RNA, 32 nt, Human
aacaaccaaccaaccaaccaaccaaccacaaa

SEQ ID NO: 20300 - RNA, 32 nt, Human
aacaaccaagaucccuugcaugugcaguucac

SEQ ID NO: 20301 - RNA, 32 nt, Human
aacaaccaauuuaaaauaaggaaagaaagaca

SEQ ID NO: 20302 - RNA, 32 nt, Human
aacaaccaccacuacaccacacaugcuuauaa

SEQ ID NO: 20303 - RNA, 32 nt, Human
aacaaccagaggaggaggaggacagagggaga

SEQ ID NO: 20304 - RNA, 32 nt, Human
aacaaccagaucuuucagggaggcagaaugug

SEQ ID NO: 20305 - RNA, 32 nt, Human
aacaaccauccuagcuuccuagggaagacagu

SEQ ID NO: 20306 - RNA, 32 nt, Human
aacaacccaaauguccauccacagaugaauua

SEQ ID NO: 20307 - RNA, 32 nt, Human
aacaacccaaguuugagccgugugggugcacu

SEQ ID NO: 20308 - RNA, 32 nt, Human
aacaacccaccagaagaagcaccaagaaaacc

SEQ ID NO: 20309 - RNA, 32 nt, Human
aacaaccccaggagaugggaccugaucaugca

SEQ ID NO: 20310 - RNA, 19 nt, Human
aacaacccuauuuccaaag

SEQ ID NO: 20311 - RNA, 31 nt, Human
aacaacccugacagagagacccugucucauu

SEQ ID NO: 20312 - RNA, 32 nt, Human
aacaacccuugaauauuucauuuacuuaacca

SEQ ID NO: 20313 - RNA, 32 nt, Human
aacaaccucccaccccuguccugcugcauggu

SEQ ID NO: 20314 - RNA, 23 nt, Human
aacaaccugacaaacuguggcca

SEQ ID NO: 20315 - RNA, 32 nt, Human
aacaaccugccaccccucccuaacaaaggauu

SEQ ID NO: 20316 - RNA, 32 nt, Human
aacaaccuuagugagguggacaggaggggacc

SEQ ID NO: 20317 - RNA, 22 nt, Human
aacaacgacguugggacuucuc

SEQ ID NO: 20318 - RNA, 32 nt, Human
aacaacguagacugaguuccccaucuagugac

SEQ ID NO: 20319 - RNA, 32 nt, Human
aacaacguauaguauuuacuauaccuggugac

SEQ ID NO: 20320 - RNA, 32 nt, Human
aacaacguccucaaccgggcugaguuccuguc

SEQ ID NO: 20321 - RNA, 32 nt, Human
aacaacgugaucugacaggacagucccagccc

SEQ ID NO: 20322 - RNA, 32 nt, Human
aacaacguugcuauuuccacccauuuguuuuc

SEQ ID NO: 20323 - RNA, 20 nt, Human
aacaacuaaucuuggucccu

SEQ ID NO: 20324 - RNA, 32 nt, Human
aacaacuacaacagauugucucauuuucccag

SEQ ID NO: 20325 - RNA, 32 nt, Human
aacaacuacagucuggccaagugugguggcuc

SEQ ID NO: 20326 - RNA, 32 nt, Human
aacaacuaccaaaagaaauccuaugaaagagu

SEQ ID NO: 20327 - RNA, 32 nt, Human
aacaacuacuuuuggggacuugcccacaucuc

SEQ ID NO: 20328 - RNA, 31 nt, Human
aacaacuaggugaccugaacagcagaaauuu

SEQ ID NO: 20329 - RNA, 32 nt, Human
aacaacucacaaaaccacaaaaagcaacagaa

SEQ ID NO: 20330 - RNA, 32 nt, Human
aacaacucaguuaguauagagaugagguccgc

SEQ ID NO: 20331 - RNA, 32 nt, Human
aacaacuccccaggcuggccgggcaguacacc

SEQ ID NO: 20332 - RNA, 32 nt, Human
aacaacucuaauaucuggugacuuuggguaau

SEQ ID NO: 20333 - RNA, 32 nt, Human
aacaacucugcugccagcaccaaaaagcccuc

SEQ ID NO: 20334 - RNA, 32 nt, Human
aacaacucuggcuuuugagaugacuuauacua

SEQ ID NO: 20335 - RNA, 32 nt, Human
aacaacugaaauucagcuuccuucucaaaguc

SEQ ID NO: 20336 - RNA, 32 nt, Human
aacaacugaccuguuuccuccaccuccacccc

SEQ ID NO: 20337 - RNA, 32 nt, Human
aacaacugaggcuggugggggcuggucggggc

SEQ ID NO: 20338 - RNA, 32 nt, Human
aacaacugcacuccagccuggaugacagaaca

SEQ ID NO: 20339 - RNA, 32 nt, Human
aacaacuggagcaaccuuuagucucuucaaac

SEQ ID NO: 20340 - RNA, 32 nt, Human
aacaacugucuacgugcuucccaugauauguu

SEQ ID NO: 20341 - RNA, 32 nt, Human
aacaacuguggagauuugagggaauguguggu

SEQ ID NO: 20342 - RNA, 32 nt, Human
aacaacuguuaaccuaacccugggugggcauc

SEQ ID NO: 20343 - RNA, 32 nt, Human
aacaacuuaacuuugcauauaacucuauacuu

SEQ ID NO: 20344 - RNA, 32 nt, Human
aacaacuuacucccuccucuggccccaguagc

SEQ ID NO: 20345 - RNA, 32 nt, Human
aacaacuucaaaugcuaaggugauguuuuacc

SEQ ID NO: 20346 - RNA, 32 nt, Human
aacaacuucaugguggaaguaggcagcugaca

SEQ ID NO: 20347 - RNA, 32 nt, Human
aacaacuuccuagauugcaagugcucacguac

SEQ ID NO: 20348 - RNA, 32 nt, Human
aacaacuucuuugcugaagcacugaggagauu

SEQ ID NO: 20349 - RNA, 32 nt, Human
aacaacuuucuccuacucuuccuuccuaauag

SEQ ID NO: 20350 - RNA, 32 nt, Human
aacaacuuucucucacuucugccuccuaucau

SEQ ID NO: 20351 - RNA, 32 nt, Human
aacaacuuuuuaucuucugucuugcuaucauu

SEQ ID NO: 20352 - RNA, 32 nt, Human
aacaagaaaaacaaaaaccaagcaaacuucua

SEQ ID NO: 20353 - RNA, 32 nt, Human
aacaagaaaaacaaaaagaacuuaaccaguuc

SEQ ID NO: 20354 - RNA, 32 nt, Human
aacaagaaauaaaagguguuguggaaacuuaa

SEQ ID NO: 20355 - RNA, 32 nt, Human
aacaagaaccugaggccgcuggagaaaaggaa

SEQ ID NO: 20356 - RNA, 32 nt, Human
aacaagaagauggggaagaggaaguguaaaac

SEQ ID NO: 20357 - RNA, 32 nt, Human
aacaagaaggagauucagaagggcuauauguu

SEQ ID NO: 20358 - RNA, 32 nt, Human
aacaagaaugauuaaaucuauucaucuuacua

SEQ ID NO: 20359 - RNA, 32 nt, Human
aacaagacacuccaauugugauuugaguugag

SEQ ID NO: 20360 - RNA, 32 nt, Human
aacaagacacuggugcuggaugagaccaccac

SEQ ID NO: 20361 - RNA, 32 nt, Human
aacaagacagcacuccagauaggcagccacga

SEQ ID NO: 20362 - RNA, 32 nt, Human
aacaagacaggaguuagaugcagaggagagau

SEQ ID NO: 20363 - RNA, 32 nt, Human
aacaagacagugguuugaauucuggggccuuu

SEQ ID NO: 20364 - RNA, 32 nt, Human
aacaagacaugaaaggucuaccuucauguaau

SEQ ID NO: 20365 - RNA, 32 nt, Human
aacaagaccuaaacaaauugcuuaugggagau

SEQ ID NO: 20366 - RNA, 32 nt, Human
aacaagaccugugcuucuuuacuccaaacucu

SEQ ID NO: 20367 - RNA, 32 nt, Human
aacaagacgcacaaacacgcacccauagaagu

SEQ ID NO: 20368 - RNA, 32 nt, Human
aacaagagacuaauuagacaauggggcuagaa

SEQ ID NO: 20369 - RNA, 32 nt, Human
aacaagagauaagaugcucuccaggggcuagc

SEQ ID NO: 20370 - RNA, 23 nt, Human
aacaagagcaaaacucugucuca

SEQ ID NO: 20371 - RNA, 23 nt, Human
aacaagagcaagacucugucuca

SEQ ID NO: 20372 - RNA, 32 nt, Human
aacaagagcacuaguaugaaaacauuagggac

SEQ ID NO: 20373 - RNA, 32 nt, Human
aacaagagccccuaagucccagccucugcaau

SEQ ID NO: 20374 - RNA, 23 nt, Human
aacaagagcgaaacucugucuca

SEQ ID NO: 20375 - RNA, 32 nt, Human
aacaagaggaagcagaauaugagaagccauau

SEQ ID NO: 20376 - RNA, 32 nt, Human
aacaagaggagaaagcagagauaaaacgcuua

SEQ ID NO: 20377 - RNA, 32 nt, Human
aacaagaggcauuugugcacacacacagggcu

SEQ ID NO: 20378 - RNA, 32 nt, Human
aacaagaggcuaccuccaguuaaccaggacau

SEQ ID NO: 20379 - RNA, 32 nt, Human
aacaagagggagggcgggagagagggaacgga

SEQ ID NO: 20380 - RNA, 32 nt, Human
aacaagagugacgcucacagggcugggcugac

SEQ ID NO: 20381 - RNA, 32 nt, Human
aacaagagugauagcagagaagguuucacaga

SEQ ID NO: 20382 - RNA, 32 nt, Human
aacaagaucacacccuggaacaauuggaggau

SEQ ID NO: 20383 - RNA, 32 nt, Human
aacaagaugccauacaggcaaaacaaagccaa

SEQ ID NO: 20384 - RNA, 32 nt, Human
aacaagauuuccuugugcaaaauauuugacua

SEQ ID NO: 20385 - RNA, 32 nt, Human
aacaagcacacaggagccugucauccccagau

SEQ ID NO: 20386 - RNA, 32 nt, Human
aacaagcacagaaaauauguucccccacacug

SEQ ID NO: 20387 - RNA, 32 nt, Human
aacaagcacccuggaaggcacagggaagcauc

SEQ ID NO: 20388 - RNA, 32 nt, Human
aacaagcaccuuccucuccacagaagcagcug

SEQ ID NO: 20389 - RNA, 32 nt, Human
aacaagcagcugugugcgugagcccaggcuga

SEQ ID NO: 20390 - RNA, 32 nt, Human
aacaagcagcuuucccaaagcgauacacuugc

SEQ ID NO: 20391 - RNA, 32 nt, Human
aacaagcagugcaaaggcccugaggcaggggu

SEQ ID NO: 20392 - RNA, 32 nt, Human
aacaagcauggacauuguuaguucacccaguu

SEQ ID NO: 20393 - RNA, 32 nt, Human
aacaagcauucaauugaacaugagguuaaggc

SEQ ID NO: 20394 - RNA, 32 nt, Human
aacaagcauuccugccuucccuccagaccucu

SEQ ID NO: 20395 - RNA, 32 nt, Human
aacaagccaaaccaaaugaacucuggaaaacc

SEQ ID NO: 20396 - RNA, 32 nt, Human
aacaagccaaauaccagaugugcauuucuuuu

SEQ ID NO: 20397 - RNA, 32 nt, Human
aacaagccaauauuucaacuguucccauugca

SEQ ID NO: 20398 - RNA, 32 nt, Human
aacaagccaccugcucacacaccuuguucaac

SEQ ID NO: 20399 - RNA, 32 nt, Human
aacaagcccagaggcugaagcuucccaguauu

SEQ ID NO: 20400 - RNA, 32 nt, Human
aacaagcccccugcccuccucucccucccacu

SEQ ID NO: 20401 - RNA, 32 nt, Human
aacaagcccugccagccuccuaccucaaaucu

SEQ ID NO: 20402 - RNA, 32 nt, Human
aacaagccuguaugcuggcaggaggcagacuu

SEQ ID NO: 20403 - RNA, 21 nt, Human
aacaagcgaaacucugucuca

SEQ ID NO: 20404 - RNA, 32 nt, Human
aacaagcgccccucagagauucugaugccacu

SEQ ID NO: 20405 - RNA, 32 nt, Human
aacaagcggcucucaaaguccucugccacgcu

SEQ ID NO: 20406 - RNA, 32 nt, Human
aacaagcuauccaaccaaagcaaaguugucga

SEQ ID NO: 20407 - RNA, 32 nt, Human
aacaagcugugaaaauacaguaaauuagaaca

SEQ ID NO: 20408 - RNA, 32 nt, Human
aacaagcuuuucugaagugagaagcuguucuc

SEQ ID NO: 20409 - RNA, 32 nt, Human
aacaaggaaaaauggauguuucgcugcaggau

SEQ ID NO: 20410 - RNA, 32 nt, Human
aacaaggaagaugccuuucaagccucacuggg

SEQ ID NO: 20411 - RNA, 32 nt, Human
aacaaggaaugccugugccaauaaaaguuuuc

SEQ ID NO: 20412 - RNA, 32 nt, Human
aacaaggaauucacaccucugccuccuuugca

SEQ ID NO: 20413 - RNA, 32 nt, Human
aacaaggacacagugguagaacugaaugugaa

SEQ ID NO: 20414 - RNA, 32 nt, Human
aacaaggaccaccuggguucuccagucuugaa

SEQ ID NO: 20415 - RNA, 32 nt, Human
aacaaggacuccuuuccuccacuucuccagua

SEQ ID NO: 20416 - RNA, 32 nt, Human
aacaaggagaguagaucucucuggaucuucug

SEQ ID NO: 20417 - RNA, 32 nt, Human
aacaaggagccccacagcaccuggagcugccc

SEQ ID NO: 20418 - RNA, 32 nt, Human
aacaaggaguccuuccucugaaguggcucuuu

SEQ ID NO: 20419 - RNA, 32 nt, Human
aacaaggauuuccaagcuaagcaagucaucag

SEQ ID NO: 20420 - RNA, 32 nt, Human
aacaaggcagaagggcgacucucaccucucau

SEQ ID NO: 20421 - RNA, 32 nt, Human
aacaaggcaugcuggcagauugcaggguugag

SEQ ID NO: 20422 - RNA, 32 nt, Human
aacaaggcauucagcaguuucugacaauuaac

SEQ ID NO: 20423 - RNA, 32 nt, Human
aacaaggcauugaaggaacauaccugaaaaua

SEQ ID NO: 20424 - RNA, 32 nt, Human
aacaaggccugaaggccaggguagauuggggg

SEQ ID NO: 20425 - RNA, 32 nt, Human
aacaaggcuauuugaaaacagaaggcagguca

SEQ ID NO: 20426 - RNA, 32 nt, Human
aacaagggaagagagagcaggagcuggggcag

SEQ ID NO: 20427 - RNA, 32 nt, Human
aacaagggaggcuuccucaggaucucgaaccu

SEQ ID NO: 20428 - RNA, 23 nt, Human
aacaagggcaaaacucugucuca

SEQ ID NO: 20429 - RNA, 32 nt, Human
aacaagggcaagaaggucugagagggaaggag

SEQ ID NO: 20430 - RNA, 32 nt, Human
aacaagggccaggccagcuguggcugcaaagu

SEQ ID NO: 20431 - RNA, 32 nt, Human
aacaagggcuggagcaguuuauaaacaagguc

SEQ ID NO: 20432 - RNA, 32 nt, Human
aacaaggggaaagugaaauugagcaauucacu

SEQ ID NO: 20433 - RNA, 32 nt, Human
aacaaggggaggaggaagcuauggauacagaa

SEQ ID NO: 20434 - RNA, 32 nt, Human
aacaaggggucugaggaugcauucgagauggc

SEQ ID NO: 20435 - RNA, 32 nt, Human
aacaaggguaacuugaugcccugcgggacauc

SEQ ID NO: 20436 - RNA, 32 nt, Human
aacaagguaggcagagguugcagugagccaag

SEQ ID NO: 20437 - RNA, 32 nt, Human
aacaagguauaucuaguaggggagaaagccac

SEQ ID NO: 20438 - RNA, 32 nt, Human
aacaaguagaaagauaauauuucuccaauugg

SEQ ID NO: 20439 - RNA, 32 nt, Human
aacaagucaagaaauguucaagcccuuggaug

SEQ ID NO: 20440 - RNA, 32 nt, Human
aacaagucaagaaauuuucaagcccuuggaug

SEQ ID NO: 20441 - RNA, 32 nt, Human
aacaagucagaacucagaacacugccugguac

SEQ ID NO: 20442 - RNA, 32 nt, Human
aacaagucuuccugagacccaggcuggugugg

SEQ ID NO: 20443 - RNA, 32 nt, Human
aacaagucuuucuccuccagcccuucucuuca

SEQ ID NO: 20444 - RNA, 32 nt, Human
aacaagugagucucggcuggagugcaguggug

SEQ ID NO: 20445 - RNA, 31 nt, Human
aacaagugccucucacugggcuuugucaaca

SEQ ID NO: 20446 - RNA, 32 nt, Human
aacaagugcucaauaaaugcuugcugauugac

SEQ ID NO: 20447 - RNA, 32 nt, Human
aacaagugcucuuuccaccccaaaggggccuc

SEQ ID NO: 20448 - RNA, 32 nt, Human
aacaaguguuaacuuuaaacaguucgcuacaa

SEQ ID NO: 20449 - RNA, 31 nt, Human
aacaaguugaauagagaaaacacugauugau

SEQ ID NO: 20450 - RNA, 32 nt, Human
aacaaguugccaucugguuugccuuccagcac

SEQ ID NO: 20451 - RNA, 32 nt, Human
aacaaguuuccgugucuucugccuuccucuug

SEQ ID NO: 20452 - RNA, 32 nt, Human
aacaaguuugucaauccaucugaacuucaguu

SEQ ID NO: 20453 - RNA, 32 nt, Human
aacaaguuuuggagaagagagagggagauaaa

SEQ ID NO: 20454 - RNA, 32 nt, Human
aacaauaaaaggauuccuuuaguagcucaugu

SEQ ID NO: 20455 - RNA, 32 nt, Human
aacaauaaagcccacgcucuuugucaggcuca

SEQ ID NO: 20456 - RNA, 32 nt, Human
aacaauaaaguuaauaaagaaguuagaaagaa

SEQ ID NO: 20457 - RNA, 32 nt, Human
aacaauaaaugauguuuuuaugugccuccccu

SEQ ID NO: 20458 - RNA, 32 nt, Human
aacaauaacgaaucucauuuacacuucacaaa

SEQ ID NO: 20459 - RNA, 32 nt, Human
aacaauaagcuccaacgugggcauaguugaac

SEQ ID NO: 20460 - RNA, 32 nt, Human
aacaauaaggcagaagaaggugaacucucuuu

SEQ ID NO: 20461 - RNA, 32 nt, Human
aacaauagacagcacaacacaaacucucucaa

SEQ ID NO: 20462 - RNA, 32 nt, Human
aacaauagccaaugcagaaucuguguguuccu

SEQ ID NO: 20463 - RNA, 32 nt, Human
aacaauagcuuggaauggcuugaaaucacaaa

SEQ ID NO: 20464 - RNA, 32 nt, Human
aacaauauaaacaucugggaauaggggagaug

SEQ ID NO: 20465 - RNA, 32 nt, Human
aacaauaucacagucauucauccaggccacgu

SEQ ID NO: 20466 - RNA, 32 nt, Human
aacaauaucccaauagauuuguugacuugagg

SEQ ID NO: 20467 - RNA, 32 nt, Human
aacaauaucugccucauaggguguuuugugga

SEQ ID NO: 20468 - RNA, 23 nt, Human
aacaauaugcaaauacuucagug

SEQ ID NO: 20469 - RNA, 32 nt, Human
aacaauauucuagagcaacuuugacuacuucc

SEQ ID NO: 20470 - RNA, 32 nt, Human
aacaaucagccccuauagccacauccuccuuu

SEQ ID NO: 20471 - RNA, 32 nt, Human
aacaaucauggagccuaggagcagagagauga

SEQ ID NO: 20472 - RNA, 32 nt, Human
aacaaucuaaauccagaaaauggcaguccuaa

SEQ ID NO: 20473 - RNA, 32 nt, Human
aacaaucucuccccagccucccaaaucaaguc

SEQ ID NO: 20474 - RNA, 32 nt, Human
aacaaucucugccaccaccaagucauugacuu

SEQ ID NO: 20475 - RNA, 32 nt, Human
aacaaucugcccaccgacccccuuucuaagga

SEQ ID NO: 20476 - RNA, 32 nt, Human
aacaaucugugucccuggaaugcuggccucuc

SEQ ID NO: 20477 - RNA, 32 nt, Human
aacaaucuucugacagcaggagcagugauagu

SEQ ID NO: 20478 - RNA, 32 nt, Human
aacaaugaaaugaagaggaacucccucuuucu

SEQ ID NO: 20479 - RNA, 32 nt, Human
aacaaugaacagguuuucucuccaucaccccc

SEQ ID NO: 20480 - RNA, 32 nt, Human
aacaaugaacauguaacuucucucacaagagu

SEQ ID NO: 20481 - RNA, 32 nt, Human
aacaaugaaggaaacucuaaacuccccuuaug

SEQ ID NO: 20482 - RNA, 32 nt, Human
aacaaugaaggccuaguuggcacuuuuauuuc

SEQ ID NO: 20483 - RNA, 32 nt, Human
aacaaugacaacaacauuacuaaccuguggag

SEQ ID NO: 20484 - RNA, 32 nt, Human
aacaaugagauggaaacuccucccucauucag

SEQ ID NO: 20485 - RNA, 32 nt, Human
aacaaugaggaaaauuacugaagaauaaguuu

SEQ ID NO: 20486 - RNA, 31 nt, Human
aacaaugaguaagccaucacacagaagaggg

SEQ ID NO: 20487 - RNA, 32 nt, Human
aacaaugauggccugguuagagcugugguuug

SEQ ID NO: 20488 - RNA, 32 nt, Human
aacaaugauuauacacaaucugcaccaaacag

SEQ ID NO: 20489 - RNA, 32 nt, Human
aacaaugcagaugguucugacaagggcucuau

SEQ ID NO: 20490 - RNA, 32 nt, Human
aacaaugccagcucuguggcuucugcccuggg

SEQ ID NO: 20491 - RNA, 32 nt, Human
aacaaugcccccuugacuuucucaucucacau

SEQ ID NO: 20492 - RNA, 32 nt, Human
aacaaugcugauuuuugaauucaugauuaguu

SEQ ID NO: 20493 - RNA, 32 nt, Human
aacaauggagaugacaaaaauauugguaacag

SEQ ID NO: 20494 - RNA, 32 nt, Human
aacaauggccaaagugaagaaaaugcuaccuu

SEQ ID NO: 20495 - RNA, 31 nt, Human
aacaaugggaaacugacaucagaugucuuga

SEQ ID NO: 20496 - RNA, 32 nt, Human
aacaauggguuauauggcagccaagaaacacc

SEQ ID NO: 20497 - RNA, 32 nt, Human
aacaaugguaaugccauuguguuuguaacacu

SEQ ID NO: 20498 - RNA, 32 nt, Human
aacaauggucaccaagucccggaacagguugu

SEQ ID NO: 20499 - RNA, 32 nt, Human
aacaauggugugugcagaagagaagggacuga

SEQ ID NO: 20500 - RNA, 32 nt, Human
aacaaugguuccuuaguuuugcacugggaaga

SEQ ID NO: 20501 - RNA, 32 nt, Human
aacaauguaacuuuuaaaaggcaucauuccug

SEQ ID NO: 20502 - RNA, 32 nt, Human
aacaauguccagacaagaccuguaccuuugag

SEQ ID NO: 20503 - RNA, 32 nt, Human
aacaaugugcauuugaaggaguuaauuaaaag

SEQ ID NO: 20504 - RNA, 32 nt, Human
aacaaugugcugcugcuucacuuccgcccucc

SEQ ID NO: 20505 - RNA, 19 nt, Human
aacaaugugguaaagccuu

SEQ ID NO: 20506 - RNA, 32 nt, Human
aacaauguuaaggaaacucuuaucucagucau

SEQ ID NO: 20507 - RNA, 32 nt, Human
aacaauguuccaguaagaccuuuguaggcucu

SEQ ID NO: 20508 - RNA, 32 nt, Human
aacaauguucccaaugucuuuacuuuuuaaaa

SEQ ID NO: 20509 - RNA, 32 nt, Human
aacaauuacagaaacauuaaacacuaugacac

SEQ ID NO: 20510 - RNA, 32 nt, Human
aacaauuagggugacaugugugcacugaguaa

SEQ ID NO: 20511 - RNA, 32 nt, Human
aacaauuauaugaccagaagcaucuaaccauu

SEQ ID NO: 20512 - RNA, 32 nt, Human
aacaauuauucaccauggauugcccaacuuuc

SEQ ID NO: 20513 - RNA, 32 nt, Human
aacaauucacuucugucuucugcaaauugacu

SEQ ID NO: 20514 - RNA, 22 nt, Human
aacaauucaguagugucuggaa

SEQ ID NO: 20515 - RNA, 32 nt, Human
aacaauucagucucucaaacauuuuggcacag

SEQ ID NO: 20516 - RNA, 32 nt, Human
aacaauuccccgagcaacuuuaccucacaauc

SEQ ID NO: 20517 - RNA, 32 nt, Human
aacaauuccugccuccuguucccuguucugcc

SEQ ID NO: 20518 - RNA, 32 nt, Human
aacaauucuacaccaaauugucucuucaaaua

SEQ ID NO: 20519 - RNA, 32 nt, Human
aacaauucugcgcgagguagggaggccauggc

SEQ ID NO: 20520 - RNA, 32 nt, Human
aacaauugaagaagaaaggaaaauaagguaag

SEQ ID NO: 20521 - RNA, 32 nt, Human
aacaauugcaauauuuguugagucccuaaaug

SEQ ID NO: 20522 - RNA, 32 nt, Human
aacaauugcauuguccaucaaaaggagacuga

SEQ ID NO: 20523 - RNA, 18 nt, Human
aacaauuguuguguucuu

SEQ ID NO: 20524 - RNA, 20 nt, Human
aacaauuuaacccacaggaa

SEQ ID NO: 20525 - RNA, 32 nt, Human
aacaauuuaagcugcaauauuugugacugaau

SEQ ID NO: 20526 - RNA, 32 nt, Human
aacaauuuggauauuggaaugcagucucauac

SEQ ID NO: 20527 - RNA, 20 nt, Human
aacaauuuggguucugucca

SEQ ID NO: 20528 - RNA, 24 nt, Human
aacaauuugugagcuauauaggaa

SEQ ID NO: 20529 - RNA, 32 nt, Human
aacaauuuguucagaagaacugagcaaacuaa

SEQ ID NO: 20530 - RNA, 23 nt, Human
aacaauuuuaauuuuuugccuca

SEQ ID NO: 20531 - RNA, 20 nt, Human
aacaauuuuagccuuucuca

SEQ ID NO: 20532 - RNA, 22 nt, Human
aacaauuuucuuuauucugucu

SEQ ID NO: 20533 - RNA, 32 nt, Human
aacacaaaaaggcagagagagaaggauuaaau

SEQ ID NO: 20534 - RNA, 32 nt, Human
aacacaaaacauaauaaaacaccaagaacaug

SEQ ID NO: 20535 - RNA, 32 nt, Human
aacacaaaacaucaaguuccacacacgcuaug

SEQ ID NO: 20536 - RNA, 32 nt, Human
aacacaaaaggagugaguuggggucuuuaguc

SEQ ID NO: 20537 - RNA, 32 nt, Human
aacacaaaauuagcugggugugguagugcgug

SEQ ID NO: 20538 - RNA, 32 nt, Human
aacacaaacccccacuccagcuccuucgcuua

SEQ ID NO: 20539 - RNA, 32 nt, Human
aacacaaaggaaugugcauaauggagagaaga

SEQ ID NO: 20540 - RNA, 32 nt, Human
aacacaaagggcaagagguugcuaugguauuu

SEQ ID NO: 20541 - RNA, 32 nt, Human
aacacaaauggacacacauaccuggccacgaa

SEQ ID NO: 20542 - RNA, 32 nt, Human
aacacaaccugccuggccgggcgugguggcgu

SEQ ID NO: 20543 - RNA, 32 nt, Human
aacacaacgcacugcagccucuaccuccuggg

SEQ ID NO: 20544 - RNA, 32 nt, Human
aacacaacuguugccaaagaguuggcuuuguu

SEQ ID NO: 20545 - RNA, 32 nt, Human
aacacaagagggauggaucauucuuccaguuc

SEQ ID NO: 20546 - RNA, 32 nt, Human
aacacaagcagcagcaacaucaacaaugccag

SEQ ID NO: 20547 - RNA, 32 nt, Human
aacacaagccaagaagaguacuuggguggagu

SEQ ID NO: 20548 - RNA, 32 nt, Human
aacacaagcuggagaguuuuagguaagaguca

SEQ ID NO: 20549 - RNA, 32 nt, Human
aacacaaggccuuugccauuggucgcaggaac

SEQ ID NO: 20550 - RNA, 30 nt, Human
aacacaaguuuccaaucagaagacuugaag

SEQ ID NO: 20551 - RNA, 32 nt, Human
aacacaaucaucacuuagugguggugagugac

SEQ ID NO: 20552 - RNA, 32 nt, Human
aacacaaugccacuucacuaauucuuucaaac

SEQ ID NO: 20553 - RNA, 32 nt, Human
aacacaaugcucuuccccuugaccacuucuca

SEQ ID NO: 20554 - RNA, 32 nt, Human
aacacaauuuggggaacagaagggcuuuuguu

SEQ ID NO: 20555 - RNA, 32 nt, Human
aacacacaaacaguuggaacagagcacucuga

SEQ ID NO: 20556 - RNA, 32 nt, Human
aacacacaacauuacacacauauacacacagc

SEQ ID NO: 20557 - RNA, 32 nt, Human
aacacacacaugcuucccuuuccugaguccca

SEQ ID NO: 20558 - RNA, 32 nt, Human
aacacacaccugcugguuaggaacccggcugu

SEQ ID NO: 20559 - RNA, 32 nt, Human
aacacacagaaaccacaccagauauuuucagc

SEQ ID NO: 20560 - RNA, 32 nt, Human
aacacacagaugggaaaucuuaugcauguauu

SEQ ID NO: 20561 - RNA, 32 nt, Human
aacacacagccaugaggagccaugaggagccu

SEQ ID NO: 20562 - RNA, 32 nt, Human
aacacacaggcagcagagaccauggggccccu

SEQ ID NO: 20563 - RNA, 32 nt, Human
aacacacaggccgcuuggaauguugggccauc

SEQ ID NO: 20564 - RNA, 18 nt, Human
aacacacauacaugcaca

SEQ ID NO: 20565 - RNA, 32 nt, Human
aacacacauauaaacaucacacacacagacag

SEQ ID NO: 20566 - RNA, 32 nt, Human
aacacacauaugcacacucacacugacaagca

SEQ ID NO: 20567 - RNA, 32 nt, Human
aacacacauguguagcugcuucuggcugagug

SEQ ID NO: 20568 - RNA, 32 nt, Human
aacacaccaaccagggaagacggccaaggcug

SEQ ID NO: 20569 - RNA, 32 nt, Human
aacacacccccuccuucucugcuuuggguccc

SEQ ID NO: 20570 - RNA, 32 nt, Human
aacacacccuuuccuuaggcguccugcguccc

SEQ ID NO: 20571 - RNA, 32 nt, Human
aacacaccuguauuugauucucagccagggga

SEQ ID NO: 20572 - RNA, 32 nt, Human
aacacaccuuaucuauuagucaccuucuuaaa

SEQ ID NO: 20573 - RNA, 32 nt, Human
aacacacgguagcgaugucauucuucccugcu

SEQ ID NO: 20574 - RNA, 32 nt, Human
aacacacugauggaggagugggcagaguaggc

SEQ ID NO: 20575 - RNA, 32 nt, Human
aacacacugccucgugucuuuguagcugauuc

SEQ ID NO: 20576 - RNA, 32 nt, Human
aacacacuugcccucaugccucccagaauaug

SEQ ID NO: 20577 - RNA, 32 nt, Human
aacacacuuuucucccugugucuggguccaaa

SEQ ID NO: 20578 - RNA, 32 nt, Human
aacacagaaacgcaauaaacacacacaaaaua

SEQ ID NO: 20579 - RNA, 32 nt, Human
aacacagaaauccugaguucuucucauuggug

SEQ ID NO: 20580 - RNA, 32 nt, Human
aacacagaaauugucucucaagaccaggugga

SEQ ID NO: 20581 - RNA, 32 nt, Human
aacacagaacacacaaagcuuucucuuaaaag

SEQ ID NO: 20582 - RNA, 32 nt, Human
aacacagaagguggagguugcagugagccaag

SEQ ID NO: 20583 - RNA, 32 nt, Human
aacacagaccucuuucuugugccuuguucacu

SEQ ID NO: 20584 - RNA, 32 nt, Human
aacacagagacacauugcaucaacuucaagaa

SEQ ID NO: 20585 - RNA, 32 nt, Human
aacacagauucugccugguccaacacagauuc

SEQ ID NO: 20586 - RNA, 32 nt, Human
aacacagcaaaccuucauccggcuggagggca

SEQ ID NO: 20587 - RNA, 32 nt, Human
aacacagcaagaaucugguugucugaacuauu

SEQ ID NO: 20588 - RNA, 32 nt, Human
aacacagcaagggugaugggaaagcauuguaa

SEQ ID NO: 20589 - RNA, 32 nt, Human
aacacagcagcaucucuccacugaaagaagug

SEQ ID NO: 20590 - RNA, 32 nt, Human
aacacagcagcugacuccucuaggcaaggaaa

SEQ ID NO: 20591 - RNA, 32 nt, Human
aacacagcaucauuaugcaauaugaaaccagc

SEQ ID NO: 20592 - RNA, 32 nt, Human
aacacagcaugcaccaggaugcaucagacaga

SEQ ID NO: 20593 - RNA, 32 nt, Human
aacacagccagagaacugugacccugguguuc

SEQ ID NO: 20594 - RNA, 32 nt, Human
aacacagccaguuuccacaaugccuagacugu

SEQ ID NO: 20595 - RNA, 32 nt, Human
aacacagcccacuuauccaucugucaaaaguu

SEQ ID NO: 20596 - RNA, 32 nt, Human
aacacagccgagaaguugcuucuuuguacuuu

SEQ ID NO: 20597 - RNA, 31 nt, Human
aacacagcugugccuggaacagcagacccag

SEQ ID NO: 20598 - RNA, 32 nt, Human
aacacagcuguggcucguuugagggauugggg

SEQ ID NO: 20599 - RNA, 32 nt, Human
aacacaggagaccugcucccuaugugcacacc

SEQ ID NO: 20600 - RNA, 32 nt, Human
aacacaggaggcagagguugcagcgagcugag

SEQ ID NO: 20601 - RNA, 32 nt, Human
aacacaggaggcagagguugcagugagccgag

SEQ ID NO: 20602 - RNA, 32 nt, Human
aacacaggcacacacaugcacacacccauaaa

SEQ ID NO: 20603 - RNA, 32 nt, Human
aacacaggcacagcaggcaccgccugccagau

SEQ ID NO: 20604 - RNA, 32 nt, Human
aacacaggcagcuuucuagaaguuucccuucc

SEQ ID NO: 20605 - RNA, 32 nt, Human
aacacaggcccagugucuguggcuggugagug

SEQ ID NO: 20606 - RNA, 32 nt, Human
aacacaggcuacacagaugagaaaauggggcu

SEQ ID NO: 20607 - RNA, 21 nt, Human
aacacagggacaaaggcaggu

SEQ ID NO: 20608 - RNA, 32 nt, Human
aacacagggcucccagugucccauuuccugug

SEQ ID NO: 20609 - RNA, 32 nt, Human
aacacaggggaggcaggggaagaggcaggagg

SEQ ID NO: 20610 - RNA, 32 nt, Human
aacacaggugcacucagcugcccagggccucu

SEQ ID NO: 20611 - RNA, 32 nt, Human
aacacaggugucaugaaaacuacccccaaaag

SEQ ID NO: 20612 - RNA, 32 nt, Human
aacacagguguuuucugugccaaucugguguu

SEQ ID NO: 20613 - RNA, 32 nt, Human
aacacaguaagcccugcucccuucccugcucu

SEQ ID NO: 20614 - RNA, 32 nt, Human
aacacagucauggagaaggccaguggcagagc

SEQ ID NO: 20615 - RNA, 32 nt, Human
aacacagugagcaaagacacagcaccuacgcc

SEQ ID NO: 20616 - RNA, 32 nt, Human
aacacagugccuggcaaggccucugccccugg

SEQ ID NO: 20617 - RNA, 23 nt, Human
aacacagugccuucuacauugca

SEQ ID NO: 20618 - RNA, 32 nt, Human
aacacagugcucagccuucaguucccuuccac

SEQ ID NO: 20619 - RNA, 32 nt, Human
aacacaguggaaagcagagcugagaaauggac

SEQ ID NO: 20620 - RNA, 32 nt, Human
aacacaguuugaaaaccacugccccagacagc

SEQ ID NO: 20621 - RNA, 22 nt, Human
aacacauaaacaaauaguuuca

SEQ ID NO: 20622 - RNA, 32 nt, Human
aacacauauguaccuacauacauacauaaaua

SEQ ID NO: 20623 - RNA, 32 nt, Human
aacacaucaaugauuuuucacaaguggagcac

SEQ ID NO: 20624 - RNA, 32 nt, Human
aacacaucaccacucccuagggcggggccugu

SEQ ID NO: 20625 - RNA, 20 nt, Human
aacacaucagcucugucuca

SEQ ID NO: 20626 - RNA, 32 nt, Human
aacacaucagcuuucaaaugagaugauaguaa

SEQ ID NO: 20627 - RNA, 21 nt, Human
aacacaucccuccucuucuca

SEQ ID NO: 20628 - RNA, 21 nt, Human
aacacaucccugagcugcaga

SEQ ID NO: 20629 - RNA, 32 nt, Human
aacacauccuuucuccccugggcuuguaagaa

SEQ ID NO: 20630 - RNA, 22 nt, Human
aacacaucuccugcacuucuca

SEQ ID NO: 20631 - RNA, 32 nt, Human
aacacaucugcaggacacauuuugccauguaa

SEQ ID NO: 20632 - RNA, 32 nt, Human
aacacaucuucagccuccuccugggccagcuc

SEQ ID NO: 20633 - RNA, 32 nt, Human
aacacaugacagcauucucagucuugguuucu

SEQ ID NO: 20634 - RNA, 32 nt, Human
aacacaugagcagggugagaggugaggcaagg

SEQ ID NO: 20635 - RNA, 32 nt, Human
aacacaugccugugguccuagcuacuugggag

SEQ ID NO: 20636 - RNA, 32 nt, Human
aacacauggacacacacccaagccacaagaaa

SEQ ID NO: 20637 - RNA, 32 nt, Human
aacacaugucuagcuuucaccuccaggaucua

SEQ ID NO: 20638 - RNA, 32 nt, Human
aacacauguuuauuuugcuuggcugcaguuga

SEQ ID NO: 20639 - RNA, 32 nt, Human
aacacauuauuuuauccguuauuugaaauuuu

SEQ ID NO: 20640 - RNA, 32 nt, Human
aacacauucacuccaacaccuggguauaaagg

SEQ ID NO: 20641 - RNA, 32 nt, Human
aacacauugaaggaaauuggaagaaauggaau

SEQ ID NO: 20642 - RNA, 32 nt, Human
aacacauugguucgugcuucccuuuacuucuu

SEQ ID NO: 20643 - RNA, 32 nt, Human
aacacauuguacugagaaccacuuaagcauug

SEQ ID NO: 20644 - RNA, 32 nt, Human
aacacauuuccaggaauagaagugagaugucu

SEQ ID NO: 20645 - RNA, 32 nt, Human
aacaccaaagcacaggcaacaaaagugaaaau

SEQ ID NO: 20646 - RNA, 32 nt, Human
aacaccaaaggagaccauaugggugaaagcaa

SEQ ID NO: 20647 - RNA, 32 nt, Human
aacaccaaggaaauaucaaagaacacaacgca

SEQ ID NO: 20648 - RNA, 32 nt, Human
aacaccaagguacaauguuaaaggaauauuca

SEQ ID NO: 20649 - RNA, 32 nt, Human
aacaccacacacacauggcaugcauguacgca

SEQ ID NO: 20650 - RNA, 32 nt, Human
aacaccacaggcucgggauugaggugguaagg

SEQ ID NO: 20651 - RNA, 32 nt, Human
aacaccacaggggaacaggacaguuugugacu

SEQ ID NO: 20652 - RNA, 32 nt, Human
aacaccaccaaaacagauacccauguugaggg

SEQ ID NO: 20653 - RNA, 32 nt, Human
aacaccaccauccugugggcccagaagcuuug

SEQ ID NO: 20654 - RNA, 32 nt, Human
aacaccacggcacuucagccugggugacagaa

SEQ ID NO: 20655 - RNA, 32 nt, Human
aacaccacuaaaccacauacggaauaauccac

SEQ ID NO: 20656 - RNA, 32 nt, Human
aacaccacugauaucauuaaagccacuaacag

SEQ ID NO: 20657 - RNA, 32 nt, Human
aacaccacugcacuccaaccugggcaacagag

SEQ ID NO: 20658 - RNA, 32 nt, Human
aacaccacugcacuccaccuguccacuugucc

SEQ ID NO: 20659 - RNA, 32 nt, Human
aacaccacugccugcaggagccugggcugacu

SEQ ID NO: 20660 - RNA, 32 nt, Human
aacaccacuggggcaguacaagucaggaauug

SEQ ID NO: 20661 - RNA, 32 nt, Human
aacaccagauuauuaucuucugauccuggagg

SEQ ID NO: 20662 - RNA, 32 nt, Human
aacaccagccagggagggguggggaaggaggu

SEQ ID NO: 20663 - RNA, 32 nt, Human
aacaccagccucucagcccucucuccauaaag

SEQ ID NO: 20664 - RNA, 32 nt, Human
aacaccagccugggccauauugugagaacacg

SEQ ID NO: 20665 - RNA, 32 nt, Human
aacaccagcuacaaaccaagucuagcacagug

SEQ ID NO: 20666 - RNA, 32 nt, Human
aacaccaggcagcagggcacagagagaggcaa

SEQ ID NO: 20667 - RNA, 32 nt, Human
aacaccagggggcagaggucaggagaaucauc

SEQ ID NO: 20668 - RNA, 32 nt, Human
aacaccagugcuaagguagagcuccccagcag

SEQ ID NO: 20669 - RNA, 32 nt, Human
aacaccagugcucugucagcagccuggccugg

SEQ ID NO: 20670 - RNA, 32 nt, Human
aacaccaguuaggaaaauagcuccagaaaaua

SEQ ID NO: 20671 - RNA, 32 nt, Human
aacaccauuagcuuuugugaucugguuaagaa

SEQ ID NO: 20672 - RNA, 32 nt, Human
aacaccauucugagaacuguugauuuagagag

SEQ ID NO: 20673 - RNA, 23 nt, Human
aacaccauugaugccugccagug

SEQ ID NO: 20674 - RNA, 32 nt, Human
aacaccauugcuuggcguauccuugaggaccu

SEQ ID NO: 20675 - RNA, 32 nt, Human
aacacccaaggucggauucuggggccccugcc

SEQ ID NO: 20676 - RNA, 32 nt, Human
aacacccaccucuccauccaaggcuggucagg

SEQ ID NO: 20677 - RNA, 32 nt, Human
aacacccacgcugguuucugugcaguguuagg

SEQ ID NO: 20678 - RNA, 23 nt, Human
aacacccagaaacucacuucuca

SEQ ID NO: 20679 - RNA, 20 nt, Human
aacacccagcaaccugagca

SEQ ID NO: 20680 - RNA, 22 nt, Human
aacacccagcaggaggcccuca

SEQ ID NO: 20681 - RNA, 32 nt, Human
aacacccagggcgcugccugacuugccgucca

SEQ ID NO: 20682 - RNA, 32 nt, Human
aacacccauccacgcaccaccuccaggacgag

SEQ ID NO: 20683 - RNA, 32 nt, Human
aacaccccaaguguccgggaacaaaggcaagu

SEQ ID NO: 20684 - RNA, 32 nt, Human
aacaccccagaagaauucuagcagugaucucu

SEQ ID NO: 20685 - RNA, 32 nt, Human
aacaccccagcugccaucaccaagccaacucg

SEQ ID NO: 20686 - RNA, 20 nt, Human
aacacccccaggaggccaag

SEQ ID NO: 20687 - RNA, 32 nt, Human
aacacccccaggagucccuucuaggcuugcga

SEQ ID NO: 20688 - RNA, 32 nt, Human
aacaccccucaagcucuacgccagcuucuguu

SEQ ID NO: 20689 - RNA, 32 nt, Human
aacaccccugaugguggugcuguccauuaaca

SEQ ID NO: 20690 - RNA, 32 nt, Human
aacaccccugggaacggacucgcgucuccgca

SEQ ID NO: 20691 - RNA, 21 nt, Human
aacacccgagguuccagggca

SEQ ID NO: 20692 - RNA, 32 nt, Human
aacacccuaaagaucauuuucugucaguauau

SEQ ID NO: 20693 - RNA, 22 nt, Human
aacacccucaaccggcuccauc

SEQ ID NO: 20694 - RNA, 32 nt, Human
aacacccucaaccggcuccaucacauccucag

SEQ ID NO: 20695 - RNA, 32 nt, Human
aacacccucacagacacacucaggaucaaugc

SEQ ID NO: 20696 - RNA, 32 nt, Human
aacacccucccuuuuuccugacaguucuuuca

SEQ ID NO: 20697 - RNA, 32 nt, Human
aacacccuccuggaggaugcuggugagaggca

SEQ ID NO: 20698 - RNA, 32 nt, Human
aacacccucuucacccuccacgccacccccua

SEQ ID NO: 20699 - RNA, 32 nt, Human
aacacccugagugcccugaaaacugcuuuugc

SEQ ID NO: 20700 - RNA, 32 nt, Human
aacacccugcacuccugcuugcgccggcagcu

SEQ ID NO: 20701 - RNA, 32 nt, Human
aacacccugcucucauguccauaagauucagg

SEQ ID NO: 20702 - RNA, 32 nt, Human
aacacccuggcuucucuuuggcacaucagccc

SEQ ID NO: 20703 - RNA, 32 nt, Human
aacacccugggcagcuacaagugcagcuguga

SEQ ID NO: 20704 - RNA, 32 nt, Human
aacacccuugcagcuaaucagguagcccuugu

SEQ ID NO: 20705 - RNA, 32 nt, Human
aacaccgaaauucagauagcucagggacugcu

SEQ ID NO: 20706 - RNA, 18 nt, Human
aacaccgacagcaaccaa

SEQ ID NO: 20707 - RNA, 32 nt, Human
aacaccgagaagacggcaggaggcagaaggcg

SEQ ID NO: 20708 - RNA, 32 nt, Human
aacaccgccccugccugugcucugccucgggc

SEQ ID NO: 20709 - RNA, 32 nt, Human
aacaccgccucccggguucaagcgauucuccu

SEQ ID NO: 20710 - RNA, 32 nt, Human
aacaccgccuuacagucaccucauguugcaga

SEQ ID NO: 20711 - RNA, 32 nt, Human
aacaccggucccuggggagacuugaaaggccc

SEQ ID NO: 20712 - RNA, 32 nt, Human
aacaccuagagcagugccugacauagcagaag

SEQ ID NO: 20713 - RNA, 32 nt, Human
aacaccuagaggagcuguggauucaagugaag

SEQ ID NO: 20714 - RNA, 32 nt, Human
aacaccucaccuuccagcccugccgccccugc

SEQ ID NO: 20715 - RNA, 32 nt, Human
aacaccucagggcaggaaggaggggcuucagg

SEQ ID NO: 20716 - RNA, 32 nt, Human
aacaccuccauugccucugccugcuuagucca

SEQ ID NO: 20717 - RNA, 32 nt, Human
aacaccucccaagaaagauaggggaagaagcc

SEQ ID NO: 20718 - RNA, 19 nt, Human
aacaccucccaggagacag

SEQ ID NO: 20719 - RNA, 32 nt, Human
aacaccucccuggucacauccauggaaucaga

SEQ ID NO: 20720 - RNA, 32 nt, Human
aacaccucuaucucccuugggaauaagcacau

SEQ ID NO: 20721 - RNA, 32 nt, Human
aacaccucucucuccccugcacuagcuguccc

SEQ ID NO: 20722 - RNA, 32 nt, Human
aacaccucugcagugccugcuucuuaccuggc

SEQ ID NO: 20723 - RNA, 32 nt, Human
aacaccucuguaagaaccaaaaagcaagugug

SEQ ID NO: 20724 - RNA, 32 nt, Human
aacaccucuuugucccuucacugucagcuguu

SEQ ID NO: 20725 - RNA, 32 nt, Human
aacaccugagcccaggagguggagguugcacu

SEQ ID NO: 20726 - RNA, 21 nt, Human
aacaccugcacccaugagccc

SEQ ID NO: 20727 - RNA, 32 nt, Human
aacaccugccccagccccaccaugcucauggc

SEQ ID NO: 20728 - RNA, 23 nt, Human
aacaccugccgcgcucugagccc

SEQ ID NO: 20729 - RNA, 32 nt, Human
aacaccugcucacaucuuacucaaaauuguag

SEQ ID NO: 20730 - RNA, 32 nt, Human
aacaccugcucacuggcuggguauucuucgua

SEQ ID NO: 20731 - RNA, 32 nt, Human
aacaccuggagauaaauccugaugauuccauu

SEQ ID NO: 20732 - RNA, 32 nt, Human
aacaccuggagcccuggucugggaguggccug

SEQ ID NO: 20733 - RNA, 17 nt, Human
aacaccuggaugauguu

SEQ ID NO: 20734 - RNA, 32 nt, Human
aacaccuggggguggucagugagggcccccuc

SEQ ID NO: 20735 - RNA, 32 nt, Human
aacaccuguaaucccagcuacuuggaaggcug

SEQ ID NO: 20736 - RNA, 32 nt, Human
aacaccuguagucccagcacucugggaggcgg

SEQ ID NO: 20737 - RNA, 32 nt, Human
aacaccuguagucccagcuuucucuggaagug

SEQ ID NO: 20738 - RNA, 32 nt, Human
aacaccuguguggaggugcaggcccguggccc

SEQ ID NO: 20739 - RNA, 32 nt, Human
aacaccuuaaagacuucugucauuuuaaacau

SEQ ID NO: 20740 - RNA, 32 nt, Human
aacaccuuagggucuuagacucugcugauacu

SEQ ID NO: 20741 - RNA, 21 nt, Human
aacaccuucaccacuggggca

SEQ ID NO: 20742 - RNA, 32 nt, Human
aacacgaaaccugauuugccugugccaugugg

SEQ ID NO: 20743 - RNA, 21 nt, Human
aacacgaacauacagugcaca

SEQ ID NO: 20744 - RNA, 32 nt, Human
aacacgaaggcagaaguuggagugaugagucu

SEQ ID NO: 20745 - RNA, 32 nt, Human
aacacgaccaagcucaagacccuuccccugcc

SEQ ID NO: 20746 - RNA, 32 nt, Human
aacacgacuggguggagggggcggaggggaag

SEQ ID NO: 20747 - RNA, 32 nt, Human
aacacgacuuaaaaguggcuucagaggaaaag

SEQ ID NO: 20748 - RNA, 32 nt, Human
aacacgauguacauuuacaagcggccuuaugu

SEQ ID NO: 20749 - RNA, 32 nt, Human
aacacgcucucuucacagcaguaccuuagggu

SEQ ID NO: 20750 - RNA, 32 nt, Human
aacacggcagaaaggugacaccuggagaccaa

SEQ ID NO: 20751 - RNA, 32 nt, Human
aacacggcucacugcagccucaaccuccugga

SEQ ID NO: 20752 - RNA, 32 nt, Human
aacacggcucacugccgccucaaccucuccug

SEQ ID NO: 20753 - RNA, 32 nt, Human
aacacggcugaucuuucaguguuuccagcaac

SEQ ID NO: 20754 - RNA, 26 nt, Human
aacacgggaggcagagguugcaguga

SEQ ID NO: 20755 - RNA, 32 nt, Human
aacacgggaggcagagguugcagugagcagag

SEQ ID NO: 20756 - RNA, 32 nt, Human
aacacggggugagacagcaggaaggggcccug

SEQ ID NO: 20757 - RNA, 32 nt, Human
aacacggugaaaccugucucuacuaaaaauac

SEQ ID NO: 20758 - RNA, 32 nt, Human
aacacgguucucuccuagccucagcccccagc

SEQ ID NO: 20759 - RNA, 32 nt, Human
aacacgguucugacaguauuucaugacaaugg

SEQ ID NO: 20760 - RNA, 32 nt, Human
aacacgucuccucugcgcacuacguccuguuc

SEQ ID NO: 20761 - RNA, 32 nt, Human
aacacgucugcaagucaagaugucgcacccgu

SEQ ID NO: 20762 - RNA, 32 nt, Human
aacacgugccauccuucaacaccccaacccac

SEQ ID NO: 20763 - RNA, 32 nt, Human
aacacgugcucacccucacacucgccccggcc

SEQ ID NO: 20764 - RNA, 32 nt, Human
aacacguggugcuguuucuacuccaucaccau

SEQ ID NO: 20765 - RNA, 32 nt, Human
aacacgugucugcaguucuuuggcuuguguug

SEQ ID NO: 20766 - RNA, 32 nt, Human
aacacgugugugguuguguaaaccagaccccu

SEQ ID NO: 20767 - RNA, 32 nt, Human
aacacguuuucugccaugaggauuucucuuua

SEQ ID NO: 20768 - RNA, 32 nt, Human
aacacuaaaaagagcaggagcgagagaugaga

SEQ ID NO: 20769 - RNA, 32 nt, Human
aacacuaaaggaaaguuucuucaaagggcucu

SEQ ID NO: 20770 - RNA, 32 nt, Human
aacacuaaauucugucaccuccugucauuuua

SEQ ID NO: 20771 - RNA, 31 nt, Human
aacacuaagcucucugggccuggguuccagg

SEQ ID NO: 20772 - RNA, 32 nt, Human
aacacuaaggugaacuugcuucccuuuucacu

SEQ ID NO: 20773 - RNA, 32 nt, Human
aacacuacucaaagcaaaagugcugcagggcu

SEQ ID NO: 20774 - RNA, 32 nt, Human
aacacuacugcauuccagccugggugacagag

SEQ ID NO: 20775 - RNA, 32 nt, Human
aacacuacuuuagcuucucuccugaagccuua

SEQ ID NO: 20776 - RNA, 32 nt, Human
aacacuagaaauuuuucuguuccuucaaucua

SEQ ID NO: 20777 - RNA, 32 nt, Human
aacacuaucccuugggaguuguagcugcuguc

SEQ ID NO: 20778 - RNA, 32 nt, Human
aacacuaucuucuaccaggaggagguuaaugu

SEQ ID NO: 20779 - RNA, 32 nt, Human
aacacuaugugagaagucagccagcaggcucu

SEQ ID NO: 20780 - RNA, 22 nt, Human
aacacucaaaagcacuaggaca

SEQ ID NO: 20781 - RNA, 32 nt, Human
aacacucaacaaaaccaaucuacauguuuugg

SEQ ID NO: 20782 - RNA, 32 nt, Human
aacacucaacacagagauccagcucagaaaaa

SEQ ID NO: 20783 - RNA, 32 nt, Human
aacacucacaccaacagccagagcaaggcccg

SEQ ID NO: 20784 - RNA, 32 nt, Human
aacacucacugcacugguggcuguucauuuug

SEQ ID NO: 20785 - RNA, 32 nt, Human
aacacucagccaagccacucucagcuuccuga

SEQ ID NO: 20786 - RNA, 32 nt, Human
aacacucauaaauauacaaaacuuuuucagug

SEQ ID NO: 20787 - RNA, 32 nt, Human
aacacucaucaagacacccugccugcagggag

SEQ ID NO: 20788 - RNA, 32 nt, Human
aacacucaucuauugaugagugucaggagauu

SEQ ID NO: 20789 - RNA, 32 nt, Human
aacacucauuuuuaugcuguucccucuugggc

SEQ ID NO: 20790 - RNA, 32 nt, Human
aacacuccuucuuucagccccaccuccccagg

SEQ ID NO: 20791 - RNA, 32 nt, Human
aacacucuacauaugcuccaucuugcagaggc

SEQ ID NO: 20792 - RNA, 32 nt, Human
aacacucuagugagaauuacccugccaauuaa

SEQ ID NO: 20793 - RNA, 32 nt, Human
aacacucugggcaccuuccacugugaauguga

SEQ ID NO: 20794 - RNA, 32 nt, Human
aacacucuuaacuuucucuuuacccuuagcug

SEQ ID NO: 20795 - RNA, 32 nt, Human
aacacucuucagagaaaucugcauucuauuuc

SEQ ID NO: 20796 - RNA, 32 nt, Human
aacacugaagcuguuuugaacuuucaguaaug

SEQ ID NO: 20797 - RNA, 32 nt, Human
aacacugacagcugugccuagccccggaugcc

SEQ ID NO: 20798 - RNA, 25 nt, Human
aacacugaccuugcacuuguacaua

SEQ ID NO: 20799 - RNA, 32 nt, Human
aacacugaccuuggacuggauuugcagggcac

SEQ ID NO: 20800 - RNA, 32 nt, Human
aacacugaccuuuccgucccagaaggagggca

SEQ ID NO: 20801 - RNA, 32 nt, Human
aacacugagacuugggaagauacacaugcaaa

SEQ ID NO: 20802 - RNA, 20 nt, Human
aacacugcacccuccacagg

SEQ ID NO: 20803 - RNA, 32 nt, Human
aacacugcacuccagccugggugacagaguca

SEQ ID NO: 20804 - RNA, 32 nt, Human
aacacugcaggucccagaugucgagccacagu

SEQ ID NO: 20805 - RNA, 32 nt, Human
aacacugcagugagcuaugguggcaccacugc

SEQ ID NO: 20806 - RNA, 32 nt, Human
aacacugccacuccagccugggugacagagca

SEQ ID NO: 20807 - RNA, 32 nt, Human
aacacugccccaggcaauuaaauauuccaaag

SEQ ID NO: 20808 - RNA, 32 nt, Human
aacacugcccuucugugccugccuuaugugug

SEQ ID NO: 20809 - RNA, 32 nt, Human
aacacugccugcagcagucucuggguguguug

SEQ ID NO: 20810 - RNA, 32 nt, Human
aacacugcuaucucccaccucuaacacuggag

SEQ ID NO: 20811 - RNA, 32 nt, Human
aacacugcucacagccuuucugaggacaccag

SEQ ID NO: 20812 - RNA, 32 nt, Human
aacacugcucacugcagccucgaccucccaag

SEQ ID NO: 20813 - RNA, 32 nt, Human
aacacugcucucugcugcccucccauccuccc

SEQ ID NO: 20814 - RNA, 32 nt, Human
aacacugcucuucaugaugcugucuaugauaa

SEQ ID NO: 20815 - RNA, 32 nt, Human
aacacugcucuuccucaccugucacauaaagc

SEQ ID NO: 20816 - RNA, 24 nt, Human
aacacugcugaaaagaacccaaga

SEQ ID NO: 20817 - RNA, 32 nt, Human
aacacugcugcccccuuuccucccagacucug

SEQ ID NO: 20818 - RNA, 32 nt, Human
aacacugcugguuccuuauaagccacugugcu

SEQ ID NO: 20819 - RNA, 32 nt, Human
aacacugcugucgugugaagucacaguggccu

SEQ ID NO: 20820 - RNA, 32 nt, Human
aacacugcugugguggagaaacuggaccccag

SEQ ID NO: 20821 - RNA, 32 nt, Human
aacacuggcucucagcccugagacacaggccu

SEQ ID NO: 20822 - RNA, 32 nt, Human
aacacugggcagccucgccuuguugccaacgu

SEQ ID NO: 20823 - RNA, 32 nt, Human
aacacugggcuaaagacacagacccaggaagc

SEQ ID NO: 20824 - RNA, 32 nt, Human
aacacugggggagggggacggugaaggccaag

SEQ ID NO: 20825 - RNA, 32 nt, Human
aacacugguuacccaagagucaacacuuauua

SEQ ID NO: 20826 - RNA, 32 nt, Human
aacacuguaacuuucaguauuccccaguuagc

SEQ ID NO: 20827 - RNA, 32 nt, Human
aacacuguagaggaauuaccagcuggaaaccg

SEQ ID NO: 20828 - RNA, 32 nt, Human
aacacugucaucagcuugaggguccucagcca

SEQ ID NO: 20829 - RNA, 32 nt, Human
aacacuguccccuggcaguaccacagcaucau

SEQ ID NO: 20830 - RNA, 32 nt, Human
aacacuguuaaagacuccaaggcuccacucug

SEQ ID NO: 20831 - RNA, 32 nt, Human
aacacuguuaggacucucccuguuuaggcugg

SEQ ID NO: 20832 - RNA, 32 nt, Human
aacacuguucauguaacaguaacuccauagau

SEQ ID NO: 20833 - RNA, 32 nt, Human
aacacuguucucugcccuccaagaccuucucc

SEQ ID NO: 20834 - RNA, 32 nt, Human
aacacuguugcccaggcuggagugcagugacg

SEQ ID NO: 20835 - RNA, 32 nt, Human
aacacuguuguugccacaggguagaaucuaau

SEQ ID NO: 20836 - RNA, 22 nt, Human
aacacuuauucaccaucaggca

SEQ ID NO: 20837 - RNA, 32 nt, Human
aacacuucaucauccaccaccuccuggaggga

SEQ ID NO: 20838 - RNA, 32 nt, Human
aacacuucaucauccaccaccuccuggagggg

SEQ ID NO: 20839 - RNA, 32 nt, Human
aacacuucauucuucuuuagcaaguacaguca

SEQ ID NO: 20840 - RNA, 32 nt, Human
aacacuucccagagaggauucuagucugguaa

SEQ ID NO: 20841 - RNA, 32 nt, Human
aacacuuccugucucuggcuucauccuugggc

SEQ ID NO: 20842 - RNA, 32 nt, Human
aacacuucuccugccucagccucccagguagc

SEQ ID NO: 20843 - RNA, 24 nt, Human
aacacuugacuucaucuuaaugua

SEQ ID NO: 20844 - RNA, 32 nt, Human
aacacuugccuccccacugcagccugcggucc

SEQ ID NO: 20845 - RNA, 32 nt, Human
aacacuuggauguuaaggauucaccgaacacu

SEQ ID NO: 20846 - RNA, 24 nt, Human
aacacuugguagaaaucuuaagua

SEQ ID NO: 20847 - RNA, 32 nt, Human
aacacuugucggcugacuggugccucaagcgc

SEQ ID NO: 20848 - RNA, 32 nt, Human
aacacuugugagccaugcucagccuaugucau

SEQ ID NO: 20849 - RNA, 32 nt, Human
aacacuuguuauccaccagauaacagugguua

SEQ ID NO: 20850 - RNA, 32 nt, Human
aacacuuguuucugaaacuuuuuacagcaaac

SEQ ID NO: 20851 - RNA, 32 nt, Human
aacacuuuacaguucuggaggaggagguaaca

SEQ ID NO: 20852 - RNA, 32 nt, Human
aacacuuucugcucauaucauaaccaggucca

SEQ ID NO: 20853 - RNA, 32 nt, Human
aacacuuuguaaaggccaaccaaugcccacug

SEQ ID NO: 20854 - RNA, 32 nt, Human
aacacuuuucaguugcugaaggagaaaggagc

SEQ ID NO: 20855 - RNA, 32 nt, Human
aacacuuuugcugagggagaaaaagaaaacau

SEQ ID NO: 20856 - RNA, 32 nt, Human
aacagaaaauaacauuugaagacuccaaagua

SEQ ID NO: 20857 - RNA, 19 nt, Human
aacagaaaauuuugucuca

SEQ ID NO: 20858 - RNA, 32 nt, Human
aacagaaacauacugaacaugaaccucaccgu

SEQ ID NO: 20859 - RNA, 32 nt, Human
aacagaaacucauucaaaccagcucaggucag

SEQ ID NO: 20860 - RNA, 32 nt, Human
aacagaaagaaaauccuagaaaauacagagua

SEQ ID NO: 20861 - RNA, 32 nt, Human
aacagaaagaagggaaaagguacuaugugaua

SEQ ID NO: 20862 - RNA, 32 nt, Human
aacagaaagacagcaguggccagguggagagc

SEQ ID NO: 20863 - RNA, 32 nt, Human
aacagaaagagcccucaggaggcauccccacc

SEQ ID NO: 20864 - RNA, 32 nt, Human
aacagaaagaggaggaaacuguugccgagaaa

SEQ ID NO: 20865 - RNA, 32 nt, Human
aacagaaaggacacccucucuagguccccagg

SEQ ID NO: 20866 - RNA, 32 nt, Human
aacagaaaggauccccuuucuccaguuugugc

SEQ ID NO: 20867 - RNA, 32 nt, Human
aacagaaauauguauuuuaagcacucaugcaa

SEQ ID NO: 20868 - RNA, 32 nt, Human
aacagaacaaaagcaaaggaaaaugcuuuaga

SEQ ID NO: 20869 - RNA, 21 nt, Human
aacagaacaaggccuccaagg

SEQ ID NO: 20870 - RNA, 32 nt, Human
aacagaacacaaaagagcagagcaccuaagcc

SEQ ID NO: 20871 - RNA, 21 nt, Human
aacagaacagcaagagcagga

SEQ ID NO: 20872 - RNA, 22 nt, Human
aacagaacagcuuucaccaaag

SEQ ID NO: 20873 - RNA, 32 nt, Human
aacagaacaggguggagugaguggaaagcaaa

SEQ ID NO: 20874 - RNA, 32 nt, Human
aacagaacagguaauuuacuccugccugcaga

SEQ ID NO: 20875 - RNA, 32 nt, Human
aacagaacaucauuagaacaaaggacagagua

SEQ ID NO: 20876 - RNA, 32 nt, Human
aacagaaccaauaacauaaguauucaaaguua

SEQ ID NO: 20877 - RNA, 32 nt, Human
aacagaaccaguaucugucauggaacugaaca

SEQ ID NO: 20878 - RNA, 32 nt, Human
aacagaacgcucacaccagcaggaugcuccaa

SEQ ID NO: 20879 - RNA, 32 nt, Human
aacagaacugaacuuagccuucccagggaagg

SEQ ID NO: 20880 - RNA, 32 nt, Human
aacagaacugcaacaugccacacacaccgugg

SEQ ID NO: 20881 - RNA, 21 nt, Human
aacagaacugccaagcccaga

SEQ ID NO: 20882 - RNA, 32 nt, Human
aacagaacuuccaagaccucacagagaaauuc

SEQ ID NO: 20883 - RNA, 32 nt, Human
aacagaacuuccccucucccaugcacccacug

SEQ ID NO: 20884 - RNA, 32 nt, Human
aacagaagaagugguauuugcuggcgaguuaa

SEQ ID NO: 20885 - RNA, 32 nt, Human
aacagaagaccaggagaaaaagucaaaaagaa

SEQ ID NO: 20886 - RNA, 32 nt, Human
aacagaagagucuuguuccaacagaaacuccg

SEQ ID NO: 20887 - RNA, 32 nt, Human
aacagaagagucuuguuccaacagaaacucug

SEQ ID NO: 20888 - RNA, 32 nt, Human
aacagaaggacagauggacccaggagggaggg

SEQ ID NO: 20889 - RNA, 25 nt, Human
aacagaaggagguggugcucucggg

SEQ ID NO: 20890 - RNA, 32 nt, Human
aacagaagugccugggacgcccagauccugcu

SEQ ID NO: 20891 - RNA, 32 nt, Human
aacagaagugcugaggggucgcaggcaggucu

SEQ ID NO: 20892 - RNA, 22 nt, Human
aacagaauaccuucuuccuugc

SEQ ID NO: 20893 - RNA, 32 nt, Human
aacagaauagagaacucagaaauaaguccgug

SEQ ID NO: 20894 - RNA, 32 nt, Human
aacagaauaucaacugcagaaaaugcuucaca

SEQ ID NO: 20895 - RNA, 32 nt, Human
aacagaaucacucacacauacaaguacacuca

SEQ ID NO: 20896 - RNA, 32 nt, Human
aacagaauccaauuuccuuccuucccuccaca

SEQ ID NO: 20897 - RNA, 32 nt, Human
aacagaauccuucugcauuguucuuguaccac

SEQ ID NO: 20898 - RNA, 32 nt, Human
aacagaaucgcguuuggcugugcuggaugugu

SEQ ID NO: 20899 - RNA, 32 nt, Human
aacagaaucuugcucugucucccaggcuggag

SEQ ID NO: 20900 - RNA, 20 nt, Human
aacagaaugccaacccaaag

SEQ ID NO: 20901 - RNA, 32 nt, Human
aacagaauguucagaaacagacuugcacaugu

SEQ ID NO: 20902 - RNA, 32 nt, Human
aacagaauugucccugugaaaucuuuuuaugg

SEQ ID NO: 20903 - RNA, 22 nt, Human
aacagacaaaaacagccucaca

SEQ ID NO: 20904 - RNA, 32 nt, Human
aacagacaaacaagaaaacaaaccacauacuu

SEQ ID NO: 20905 - RNA, 22 nt, Human
aacagacaaacuguuuuccaca

SEQ ID NO: 20906 - RNA, 32 nt, Human
aacagacaagggcaaucuugguauuuaaaucu

SEQ ID NO: 20907 - RNA, 32 nt, Human
aacagacaaugcaggggcagggugugguuugg

SEQ ID NO: 20908 - RNA, 32 nt, Human
aacagacacaaugggaccugggcgggcguuac

SEQ ID NO: 20909 - RNA, 32 nt, Human
aacagacacacagaccaguggaagagaauaca

SEQ ID NO: 20910 - RNA, 32 nt, Human
aacagacacagcaacaaucucaccauuuauau

SEQ ID NO: 20911 - RNA, 32 nt, Human
aacagacacagccgccagcccaaacagcagcg

SEQ ID NO: 20912 - RNA, 32 nt, Human
aacagacauaugccaccaauuguaugauuaau

SEQ ID NO: 20913 - RNA, 32 nt, Human
aacagacauucaggccaggcacggugacucac

SEQ ID NO: 20914 - RNA, 22 nt, Human
aacagacauuucuuccuucaug

SEQ ID NO: 20915 - RNA, 32 nt, Human
aacagacauuuuccacucguguuuccauaguu

SEQ ID NO: 20916 - RNA, 32 nt, Human
aacagaccaacauuuuucucuuccucaagcaa

SEQ ID NO: 20917 - RNA, 32 nt, Human
aacagaccaagaguaccuucauuuaauuuagc

SEQ ID NO: 20918 - RNA, 32 nt, Human
aacagaccaauuaacauacuuauuugcagaag

SEQ ID NO: 20919 - RNA, 32 nt, Human
aacagacccaggugcaaaaccccacaucccaa

SEQ ID NO: 20920 - RNA, 32 nt, Human
aacagacccccucuagaaauuuuucagaugcu

SEQ ID NO: 20921 - RNA, 32 nt, Human
aacagacccuccuggagcuguccaaaggaaag

SEQ ID NO: 20922 - RNA, 32 nt, Human
aacagaccucucuccagcccugagauguccau

SEQ ID NO: 20923 - RNA, 32 nt, Human
aacagaccugagccacuuuucccagccuguuu

SEQ ID NO: 20924 - RNA, 32 nt, Human
aacagacgggcgccaccaaagccaggcccuga

SEQ ID NO: 20925 - RNA, 32 nt, Human
aacagacguacaauuugagagaaggacucgau

SEQ ID NO: 20926 - RNA, 32 nt, Human
aacagacgucugggaguguggugacaccugcg

SEQ ID NO: 20927 - RNA, 32 nt, Human
aacagacgugagccauuuucccagccuguuuu

SEQ ID NO: 20928 - RNA, 32 nt, Human
aacagacuaaaaucuuucucucuagucuuucu

SEQ ID NO: 20929 - RNA, 32 nt, Human
aacagacucaaggagacaaccaccucaacugg

SEQ ID NO: 20930 - RNA, 32 nt, Human
aacagacuccuaaaaggaggguuucuuuccug

SEQ ID NO: 20931 - RNA, 32 nt, Human
aacagacucuuucucacuucugcuccagagcc

SEQ ID NO: 20932 - RNA, 32 nt, Human
aacagacuuauuccuggagacagcauuugagg

SEQ ID NO: 20933 - RNA, 32 nt, Human
aacagacuucacuucccugaaugccuccccca

SEQ ID NO: 20934 - RNA, 32 nt, Human
aacagacuuccaacugggaaacuuuuuggggg

SEQ ID NO: 20935 - RNA, 32 nt, Human
aacagacuucugcugcugaaugugcccugaug

SEQ ID NO: 20936 - RNA, 32 nt, Human
aacagagaaguaacaggaaacaccuaacgcaa

SEQ ID NO: 20937 - RNA, 32 nt, Human
aacagagagaauucgagguugccugaaagcug

SEQ ID NO: 20938 - RNA, 32 nt, Human
aacagagaggauggagguuuggggcgaauguc

SEQ ID NO: 20939 - RNA, 23 nt, Human
aacagagauaguggacuacgcug

SEQ ID NO: 20940 - RNA, 32 nt, Human
aacagagaucgcgccacugaacucgggucugg

SEQ ID NO: 20941 - RNA, 32 nt, Human
aacagagaucuugggacauuuauuuguuuuaa

SEQ ID NO: 20942 - RNA, 22 nt, Human
aacagagcaaaacucugucuca

SEQ ID NO: 20943 - RNA, 19 nt, Human
aacagagcaggcgcaggua

SEQ ID NO: 20944 - RNA, 22 nt, Human
aacagagccagacucugucuca

SEQ ID NO: 20945 - RNA, 32 nt, Human
aacagagccagaucagaacccagguaagcucg

SEQ ID NO: 20946 - RNA, 32 nt, Human
aacagagccauauuucucuucuuucaaaagca

SEQ ID NO: 20947 - RNA, 32 nt, Human
aacagagcccaggagccagggaggaaaagcag

SEQ ID NO: 20948 - RNA, 20 nt, Human
aacagagccucacucuguca

SEQ ID NO: 20949 - RNA, 32 nt, Human
aacagagccugcugccccuggcugucuuccug

SEQ ID NO: 20950 - RNA, 32 nt, Human
aacagagcuccugcugcuucugggugaaccug

SEQ ID NO: 20951 - RNA, 32 nt, Human
aacagaggccaggagccagggaggaaaagcag

SEQ ID NO: 20952 - RNA, 32 nt, Human
aacagaggcccagagagaucagauaauauugc

SEQ ID NO: 20953 - RNA, 32 nt, Human
aacagaggcccaggguggagaccuaagcgggu

SEQ ID NO: 20954 - RNA, 32 nt, Human
aacagaggcuaagaaaggagaauaaacuuguc

SEQ ID NO: 20955 - RNA, 32 nt, Human
aacagaggcuuuuggccuuugaaaauccauga

SEQ ID NO: 20956 - RNA, 32 nt, Human
aacagagggaggcaggugggaauugaggguga

SEQ ID NO: 20957 - RNA, 32 nt, Human
aacagagggcaggcuaauugggugaucaaagg

SEQ ID NO: 20958 - RNA, 32 nt, Human
aacagaggggaagggagcucuuucuuacauuu

SEQ ID NO: 20959 - RNA, 32 nt, Human
aacagaggguccccauucagcagguucaucca

SEQ ID NO: 20960 - RNA, 32 nt, Human
aacagagguuugcggcagaaguggccaauguc

SEQ ID NO: 20961 - RNA, 32 nt, Human
aacagaguacccacugggucacugccuagugg

SEQ ID NO: 20962 - RNA, 32 nt, Human
aacagagugaaaccugucccuguuuuccugcu

SEQ ID NO: 20963 - RNA, 32 nt, Human
aacagagugaugaggcuucaguugaguacuug

SEQ ID NO: 20964 - RNA, 32 nt, Human
aacagauaaucaggccaggcucaguggcucau

SEQ ID NO: 20965 - RNA, 32 nt, Human
aacagauacaaagauaacaaaagcuuuacaag

SEQ ID NO: 20966 - RNA, 32 nt, Human
aacagauaccauuggaccaacagaaaccucaa

SEQ ID NO: 20967 - RNA, 32 nt, Human
aacagauagaggacaggaaagaggagagaaag

SEQ ID NO: 20968 - RNA, 22 nt, Human
aacagauauuuauugaaaauga

SEQ ID NO: 20969 - RNA, 32 nt, Human
aacagaucucugagaaggugcaucagcugcuu

SEQ ID NO: 20970 - RNA, 32 nt, Human
aacagaucuguuuuucacuuauccugauuuaa

SEQ ID NO: 20971 - RNA, 32 nt, Human
aacagaugaagacagaugcaccaacgaggcug

SEQ ID NO: 20972 - RNA, 32 nt, Human
aacagaugaauaugcaccuucuccagaguuau

SEQ ID NO: 20973 - RNA, 21 nt, Human
aacagaugcuacucaggggcu

SEQ ID NO: 20974 - RNA, 32 nt, Human
aacagauggcacuuugaaggggccucaccgag

SEQ ID NO: 20975 - RNA, 32 nt, Human
aacagaugggcugggcugggcugugguggggu

SEQ ID NO: 20976 - RNA, 32 nt, Human
aacagauggugcuuccucaucaaauuguguga

SEQ ID NO: 20977 - RNA, 23 nt, Human
aacagauguaaagacuucaguga

SEQ ID NO: 20978 - RNA, 32 nt, Human
aacagauguacugucuuucauguggccucaca

SEQ ID NO: 20979 - RNA, 32 nt, Human
aacagaugugagaagcccaguacuggagcuaa

SEQ ID NO: 20980 - RNA, 32 nt, Human
aacagaugugagagcccagauucgucugcaau

SEQ ID NO: 20981 - RNA, 32 nt, Human
aacagaugugagccacuuuucucagccuguuu

SEQ ID NO: 20982 - RNA, 22 nt, Human
aacagauguuauguaagaaugu

SEQ ID NO: 20983 - RNA, 32 nt, Human
aacagauguuuaggagauuuccuguauagcag

SEQ ID NO: 20984 - RNA, 32 nt, Human
aacagauuaaacugauugaagugcaaagcaac

SEQ ID NO: 20985 - RNA, 32 nt, Human
aacagauucaauuuccugagguggugaggaga

SEQ ID NO: 20986 - RNA, 32 nt, Human
aacagauucaugggugauuuagccuaucuguc

SEQ ID NO: 20987 - RNA, 32 nt, Human
aacagauuccagacgccgggaacucacgccuc

SEQ ID NO: 20988 - RNA, 32 nt, Human
aacagauucuacauauuuuuccuuccaaugca

SEQ ID NO: 20989 - RNA, 32 nt, Human
aacagauugcagccuucuucgcugagucucug

SEQ ID NO: 20990 - RNA, 32 nt, Human
aacagauuguucuacagaugaaucuguaagcc

SEQ ID NO: 20991 - RNA, 32 nt, Human
aacagauuuacacucagagccuggucgccccc

SEQ ID NO: 20992 - RNA, 32 nt, Human
aacagauuuuaacucugaaaagccauuuccag

SEQ ID NO: 20993 - RNA, 32 nt, Human
aacagauuuugccuccccgaucagugugugcc

SEQ ID NO: 20994 - RNA, 32 nt, Human
aacagcaaaggccauaaccuuuugggauuuuu

SEQ ID NO: 20995 - RNA, 32 nt, Human
aacagcaaaggugguggccugccccucucucu

SEQ ID NO: 20996 - RNA, 32 nt, Human
aacagcaaagucagcauuugcuguauagagcu

SEQ ID NO: 20997 - RNA, 32 nt, Human
aacagcaaauauccccagcccuugaagucacc

SEQ ID NO: 20998 - RNA, 32 nt, Human
aacagcaaaugagaaaaguggacuggggaaug

SEQ ID NO: 20999 - RNA, 32 nt, Human
aacagcaacaacaaagacagacuuuccguagc

SEQ ID NO: 21000 - RNA, 32 nt, Human
aacagcaacucucagcuugcuucaagaaccag

SEQ ID NO: 21001 - RNA, 32 nt, Human
aacagcaagcagagucaugguccuaaacucug

SEQ ID NO: 21002 - RNA, 32 nt, Human
aacagcaaucagugagaaagaugggauucuuu

SEQ ID NO: 21003 - RNA, 32 nt, Human
aacagcaaucuaaguacagaaaagcucuuugu

SEQ ID NO: 21004 - RNA, 32 nt, Human
aacagcaaucuaaguacagaaaagcuuuuugu

SEQ ID NO: 21005 - RNA, 32 nt, Human
aacagcaauuccaggcucaguauugugaccgc

SEQ ID NO: 21006 - RNA, 32 nt, Human
aacagcacaagaaagaccugcccccauaauuc

SEQ ID NO: 21007 - RNA, 32 nt, Human
aacagcaccaagccauucaugggggaaucugc

SEQ ID NO: 21008 - RNA, 32 nt, Human
aacagcaccacauaacgcacacaaagauacuc

SEQ ID NO: 21009 - RNA, 32 nt, Human
aacagcacccuugagcaaugcacacuuauccc

SEQ ID NO: 21010 - RNA, 21 nt, Human
aacagcaccucccaccaacca

SEQ ID NO: 21011 - RNA, 32 nt, Human
aacagcaccugccacacacagugacugugcag

SEQ ID NO: 21012 - RNA, 32 nt, Human
aacagcaccuugccugaacaugacuuuaaaga

SEQ ID NO: 21013 - RNA, 23 nt, Human
aacagcacguccccggccgugug

SEQ ID NO: 21014 - RNA, 32 nt, Human
aacagcacucccaggaugcaguuugugucaac

SEQ ID NO: 21015 - RNA, 22 nt, Human
aacagcagaaucggcuuugcag

SEQ ID NO: 21016 - RNA, 32 nt, Human
aacagcagacugaggcccccacccugaaaaag

SEQ ID NO: 21017 - RNA, 32 nt, Human
aacagcagagagauuuguccccuggcuugggc

SEQ ID NO: 21018 - RNA, 32 nt, Human
aacagcagagguggaggcaagcagugacuccu

SEQ ID NO: 21019 - RNA, 32 nt, Human
aacagcagauuaaucauagaaaauguugcuuc

SEQ ID NO: 21020 - RNA, 32 nt, Human
aacagcagcacugagcucccacccgcagagcc

SEQ ID NO: 21021 - RNA, 32 nt, Human
aacagcagcagagggaggugggggagagggaa

SEQ ID NO: 21022 - RNA, 18 nt, Human
aacagcagcagcagcugc

SEQ ID NO: 21023 - RNA, 32 nt, Human
aacagcagcagcccugucagccuggaugcagc

SEQ ID NO: 21024 - RNA, 32 nt, Human
aacagcagcaggacagggcacggagggagcga

SEQ ID NO: 21025 - RNA, 32 nt, Human
aacagcagcagugccauagccaggcucucugc

SEQ ID NO: 21026 - RNA, 22 nt, Human
aacagcagcaguuaggagagga

SEQ ID NO: 21027 - RNA, 32 nt, Human
aacagcagcaugagccucaggugcuuugggga

SEQ ID NO: 21028 - RNA, 32 nt, Human
aacagcagccucagcuucugaagugcaugaaa

SEQ ID NO: 21029 - RNA, 32 nt, Human
aacagcagcgcaaccucugcucccugccucgc

SEQ ID NO: 21030 - RNA, 32 nt, Human
aacagcagcucuuuaaguguuugcauuuucua

SEQ ID NO: 21031 - RNA, 32 nt, Human
aacagcagcugcagcaguugaaguggcuucua

SEQ ID NO: 21032 - RNA, 32 nt, Human
aacagcagcuguucccagcgccagaggacccc

SEQ ID NO: 21033 - RNA, 32 nt, Human
aacagcaggaaucacgagaaaguuguguuuug

SEQ ID NO: 21034 - RNA, 32 nt, Human
aacagcaggaauuggagguuucgauaugaacu

SEQ ID NO: 21035 - RNA, 32 nt, Human
aacagcaggaccuaacacuggagcucagaagg

SEQ ID NO: 21036 - RNA, 32 nt, Human
aacagcaggccuggccagcccaaaggacucuc

SEQ ID NO: 21037 - RNA, 32 nt, Human
aacagcagguauaagagguugggguggcugua

SEQ ID NO: 21038 - RNA, 32 nt, Human
aacagcagucauacccaaaucauuugcacuuu

SEQ ID NO: 21039 - RNA, 32 nt, Human
aacagcagugagccagaggagcacaggcgggc

SEQ ID NO: 21040 - RNA, 32 nt, Human
aacagcagugccucugcaggcaccaagagagc

SEQ ID NO: 21041 - RNA, 32 nt, Human
aacagcagugccugcgucccgcuccacggagu

SEQ ID NO: 21042 - RNA, 32 nt, Human
aacagcaguggacgauguugugcaauauccau

SEQ ID NO: 21043 - RNA, 32 nt, Human
aacagcaguucagaaaccucaaagagaaaugu

SEQ ID NO: 21044 - RNA, 32 nt, Human
aacagcaucuuucuuuccccaucuuucuauuu

SEQ ID NO: 21045 - RNA, 32 nt, Human
aacagcaugcugcugcucaaaaugccacagcc

SEQ ID NO: 21046 - RNA, 31 nt, Human
aacagcauggaggagaaugaccccaagccug

SEQ ID NO: 21047 - RNA, 32 nt, Human
aacagcauggaggcagauguggggcugagcug

SEQ ID NO: 21048 - RNA, 32 nt, Human
aacagcauugccugugcucuccucucaggggc

SEQ ID NO: 21049 - RNA, 32 nt, Human
aacagcauuguaauccauucucuugcaccuuc

SEQ ID NO: 21050 - RNA, 31 nt, Human
aacagccaaauaaaaacuagacaacuuucaa

SEQ ID NO: 21051 - RNA, 19 nt, Human
aacagccaagagagcaggg

SEQ ID NO: 21052 - RNA, 32 nt, Human
aacagccaagggaggacuagucuggagcacgc

SEQ ID NO: 21053 - RNA, 32 nt, Human
aacagccaauacuagauagcacugccugugug

SEQ ID NO: 21054 - RNA, 32 nt, Human
aacagccaauuagucuggcauggugguuugcg

SEQ ID NO: 21055 - RNA, 32 nt, Human
aacagccacaccccuccuccaguccuucuccu

SEQ ID NO: 21056 - RNA, 32 nt, Human
aacagccacucccuuuuuggccuccaacuggg

SEQ ID NO: 21057 - RNA, 32 nt, Human
aacagccacugagauccuccagccuggacaug

SEQ ID NO: 21058 - RNA, 32 nt, Human
aacagccagauccugaauguucuauguucacc

SEQ ID NO: 21059 - RNA, 32 nt, Human
aacagccagcacucuucuccuagccgcucacu

SEQ ID NO: 21060 - RNA, 32 nt, Human
aacagccagccuggccaccaguuguaccuuac

SEQ ID NO: 21061 - RNA, 32 nt, Human
aacagccagggaggacaagcagggcugggccu

SEQ ID NO: 21062 - RNA, 32 nt, Human
aacagccaggugaaagcuaaaucuugugugag

SEQ ID NO: 21063 - RNA, 32 nt, Human
aacagccaguguccucagauggugcuggaucu

SEQ ID NO: 21064 - RNA, 32 nt, Human
aacagccaguguguguuucccaucucuuguag

SEQ ID NO: 21065 - RNA, 25 nt, Human
aacagccaucagagaauacuauaaa

SEQ ID NO: 21066 - RNA, 32 nt, Human
aacagccaucauccaacauuauugagauuguc

SEQ ID NO: 21067 - RNA, 32 nt, Human
aacagccaugaucuucuguccucugggucccc

SEQ ID NO: 21068 - RNA, 32 nt, Human
aacagccauguaacacaugagcaccugaguug

SEQ ID NO: 21069 - RNA, 32 nt, Human
aacagccauuacuaaucucugcacuggucauu

SEQ ID NO: 21070 - RNA, 32 nt, Human
aacagccauugcacuccagccugggcaacaga

SEQ ID NO: 21071 - RNA, 32 nt, Human
aacagcccagagccccaggugccuggccuggc

SEQ ID NO: 21072 - RNA, 32 nt, Human
aacagcccaucuccugucuaugaagaaagacc

SEQ ID NO: 21073 - RNA, 32 nt, Human
aacagccccacugcaagccugggauauccaga

SEQ ID NO: 21074 - RNA, 32 nt, Human
aacagccccagagccugggcucugcuggacuu

SEQ ID NO: 21075 - RNA, 32 nt, Human
aacagcccccacuccuccuccugaguuccagg

SEQ ID NO: 21076 - RNA, 32 nt, Human
aacagcccuccucugcacucccaccugacaca

SEQ ID NO: 21077 - RNA, 32 nt, Human
aacagccuagaugacucagugggauuggggca

SEQ ID NO: 21078 - RNA, 24 nt, Human
aacagccucaccuuggcugauaga

SEQ ID NO: 21079 - RNA, 23 nt, Human
aacagccuccaauaccacaaccu

SEQ ID NO: 21080 - RNA, 22 nt, Human
aacagccucccaaaaggacaga

SEQ ID NO: 21081 - RNA, 21 nt, Human
aacagccuccggccagcagcc

SEQ ID NO: 21082 - RNA, 32 nt, Human
aacagccuccuuacuccagccuggcagggaag

SEQ ID NO: 21083 - RNA, 32 nt, Human
aacagccucugaaaagcacuuucuccauacau

SEQ ID NO: 21084 - RNA, 32 nt, Human
aacagccucugcgguguaaacagccucugcgg

SEQ ID NO: 21085 - RNA, 32 nt, Human
aacagccugcagcucacuccaugccacacggg

SEQ ID NO: 21086 - RNA, 32 nt, Human
aacagccuggacauggcaucagagauccacau

SEQ ID NO: 21087 - RNA, 32 nt, Human
aacagccuggccugcagaagagcccagaucca

SEQ ID NO: 21088 - RNA, 32 nt, Human
aacagccuggcuuuggaaaggaauuucauccu

SEQ ID NO: 21089 - RNA, 32 nt, Human
aacagccugucucagcuguacucucaugauac

SEQ ID NO: 21090 - RNA, 32 nt, Human
aacagccugugcaaaagcccagaggcugggaa

SEQ ID NO: 21091 - RNA, 20 nt, Human
aacagccuucacagcacacc

SEQ ID NO: 21092 - RNA, 32 nt, Human
aacagccuuuaagagcuggaagaugaaagcuc

SEQ ID NO: 21093 - RNA, 23 nt, Human
aacagccuuuagggaucacagcc

SEQ ID NO: 21094 - RNA, 32 nt, Human
aacagccuuucuggauuucucagaguccuaug

SEQ ID NO: 21095 - RNA, 32 nt, Human
aacagcgauugaccaguaacugugagaucaga

SEQ ID NO: 21096 - RNA, 32 nt, Human
aacagcgccugggaaucagcccuucucccuac

SEQ ID NO: 21097 - RNA, 32 nt, Human
aacagcgcucccaacaaugccaccuccaagac

SEQ ID NO: 21098 - RNA, 32 nt, Human
aacagcggcaaugccucuaucucugggaugca

SEQ ID NO: 21099 - RNA, 25 nt, Human
aacagcggcggcgacagcagcagga

SEQ ID NO: 21100 - RNA, 32 nt, Human
aacagcgggcuggggcagccacugcuuacacu

SEQ ID NO: 21101 - RNA, 31 nt, Human
aacagcggucccacaggcaggagggaucugg

SEQ ID NO: 21102 - RNA, 32 nt, Human
aacagcgguggcagggcaggggguggugggcc

SEQ ID NO: 21103 - RNA, 32 nt, Human
aacagcgucagagagaaagaacugacugaaac

SEQ ID NO: 21104 - RNA, 32 nt, Human
aacagcgucucuuccuggccaagagaagccug

SEQ ID NO: 21105 - RNA, 32 nt, Human
aacagcgucuuaccccagaagguucccuuggg

SEQ ID NO: 21106 - RNA, 18 nt, Human
aacagcuacaacgggaaa

SEQ ID NO: 21107 - RNA, 32 nt, Human
aacagcuagaaauuuuccucugugauauuuua

SEQ ID NO: 21108 - RNA, 32 nt, Human
aacagcuagauauccuggauauuguuugcacc

SEQ ID NO: 21109 - RNA, 22 nt, Human
aacagcuaguaagugguggagc

SEQ ID NO: 21110 - RNA, 32 nt, Human
aacagcuauauacauuuuguuccauuuuucug

SEQ ID NO: 21111 - RNA, 32 nt, Human
aacagcuaucugucugaauuacuucaggccuu

SEQ ID NO: 21112 - RNA, 32 nt, Human
aacagcucaaauguccaucaauagcagaaaga

SEQ ID NO: 21113 - RNA, 32 nt, Human
aacagcucaaucucuuaaaacacuuuucaaaa

SEQ ID NO: 21114 - RNA, 32 nt, Human
aacagcucacugcagucuugaacuccugggcu

SEQ ID NO: 21115 - RNA, 32 nt, Human
aacagcucaguucugucauccaggacauggcc

SEQ ID NO: 21116 - RNA, 32 nt, Human
aacagcucccuggcaggcaggcugugggcugg

SEQ ID NO: 21117 - RNA, 32 nt, Human
aacagcuccuaggaaaauguagacuuuugcuu

SEQ ID NO: 21118 - RNA, 32 nt, Human
aacagcucuggugacuaucauauccuuuucuu

SEQ ID NO: 21119 - RNA, 32 nt, Human
aacagcugacauuuuaaauuuugaugaaaucc

SEQ ID NO: 21120 - RNA, 32 nt, Human
aacagcugagucaagcuuggaggucccugaac

SEQ ID NO: 21121 - RNA, 31 nt, Human
aacagcugcauggcacauaccaaagcugcug

SEQ ID NO: 21122 - RNA, 32 nt, Human
aacagcugccuggucuucucucccagucugcc

SEQ ID NO: 21123 - RNA, 32 nt, Human
aacagcugcugcugcuucuccugcugcuggga

SEQ ID NO: 21124 - RNA, 20 nt, Human
aacagcugcuguuguguuuu

SEQ ID NO: 21125 - RNA, 32 nt, Human
aacagcugcuuugccauagacccaauacccau

SEQ ID NO: 21126 - RNA, 32 nt, Human
aacagcuggaacccggcagugaugugggaccu

SEQ ID NO: 21127 - RNA, 25 nt, Human
aacagcuggcagccaggaggcagga

SEQ ID NO: 21128 - RNA, 32 nt, Human
aacagcugggauuacaggcgugagccaccgcg

SEQ ID NO: 21129 - RNA, 32 nt, Human
aacagcugggcugcuggagucacagaggaaau

SEQ ID NO: 21130 - RNA, 32 nt, Human
aacagcugucauauguucauggucagauguca

SEQ ID NO: 21131 - RNA, 32 nt, Human
aacagcugugcuggacagucagacccggagcc

SEQ ID NO: 21132 - RNA, 32 nt, Human
aacagcugugugacccuagacgaguuccgcag

SEQ ID NO: 21133 - RNA, 32 nt, Human
aacagcuguugaagcucagagcuggaggugag

SEQ ID NO: 21134 - RNA, 32 nt, Human
aacagcuguugacucuaguacugugaauccag

SEQ ID NO: 21135 - RNA, 32 nt, Human
aacagcuuaaagauuugcaugugcagugugca

SEQ ID NO: 21136 - RNA, 32 nt, Human
aacagcuucagcuucagaaucggagcgaaaau

SEQ ID NO: 21137 - RNA, 32 nt, Human
aacagcuucugccucacuccuaagcucugacc

SEQ ID NO: 21138 - RNA, 32 nt, Human
aacagcuugggcccugcaaacacaaccaucua

SEQ ID NO: 21139 - RNA, 32 nt, Human
aacagcuuuggagauggcgguggagaaguuaa

SEQ ID NO: 21140 - RNA, 32 nt, Human
aacaggaaaagcaggauaaaugcuugauuuca

SEQ ID NO: 21141 - RNA, 32 nt, Human
aacaggaaacaugcuuuauuuuucaaaaccuu

SEQ ID NO: 21142 - RNA, 32 nt, Human
aacaggaaaccagccuaagacacuucagguug

SEQ ID NO: 21143 - RNA, 32 nt, Human
aacaggaaagagaguuacaccuugugggugug

SEQ ID NO: 21144 - RNA, 24 nt, Human
aacaggaaagcacccaucagcaaa

SEQ ID NO: 21145 - RNA, 32 nt, Human
aacaggaaaguuuccagauagguauuguauca

SEQ ID NO: 21146 - RNA, 32 nt, Human
aacaggaaauauuggcuuaucucuguaggaag

SEQ ID NO: 21147 - RNA, 23 nt, Human
aacaggaaauuaaacacugcaaa

SEQ ID NO: 21148 - RNA, 32 nt, Human
aacaggaaauuccucucagcucugccucagau

SEQ ID NO: 21149 - RNA, 32 nt, Human
aacaggaagaugcgggacaggugaggagcugg

SEQ ID NO: 21150 - RNA, 32 nt, Human
aacaggacacaggggucugauuugaagccccu

SEQ ID NO: 21151 - RNA, 32 nt, Human
aacaggacagagcacaucacacguauaggcag

SEQ ID NO: 21152 - RNA, 32 nt, Human
aacaggacaggaguuagaugcagagaagagau

SEQ ID NO: 21153 - RNA, 32 nt, Human
aacaggacauauguggccuugaagggaagaca

SEQ ID NO: 21154 - RNA, 32 nt, Human
aacaggacaucggggagaagccagcagccaug

SEQ ID NO: 21155 - RNA, 21 nt, Human
aacaggacauggggcuccugg

SEQ ID NO: 21156 - RNA, 32 nt, Human
aacaggaccagaaacaccucccuucuccaaca

SEQ ID NO: 21157 - RNA, 32 nt, Human
aacaggaccagaggaggacugaggggcacugg

SEQ ID NO: 21158 - RNA, 32 nt, Human
aacaggacccacugcugaugauggcuccaccu

SEQ ID NO: 21159 - RNA, 32 nt, Human
aacaggaccuaggcccugugcaauggcucaca

SEQ ID NO: 21160 - RNA, 32 nt, Human
aacaggacgagaugacgguguuauuccaaggg

SEQ ID NO: 21161 - RNA, 32 nt, Human
aacaggagaaggagggagagagccaaaugucu

SEQ ID NO: 21162 - RNA, 32 nt, Human
aacaggagagacaugccuguaguuacauccag

SEQ ID NO: 21163 - RNA, 18 nt, Human
aacaggagagaggcugcc

SEQ ID NO: 21164 - RNA, 32 nt, Human
aacaggagaggaagaggaggccuggacucucc

SEQ ID NO: 21165 - RNA, 32 nt, Human
aacaggagaggcggcaggaggagcaggagagg

SEQ ID NO: 21166 - RNA, 32 nt, Human
aacaggagaggcugcuggacaagggguaggag

SEQ ID NO: 21167 - RNA, 20 nt, Human
aacaggagaucaccacugcc

SEQ ID NO: 21168 - RNA, 32 nt, Human
aacaggagcaagagagaggcagcugggggcag

SEQ ID NO: 21169 - RNA, 32 nt, Human
aacaggagccagacaugacagggacuuggccc

SEQ ID NO: 21170 - RNA, 32 nt, Human
aacaggagccgaugccaaauggucuagaggca

SEQ ID NO: 21171 - RNA, 32 nt, Human
aacaggagccugaaggcugagcugcagaagcu

SEQ ID NO: 21172 - RNA, 32 nt, Human
aacaggagcugaguuuucugacuugaguuaac

SEQ ID NO: 21173 - RNA, 32 nt, Human
aacaggaggagaagaugcggaggcaggaggag

SEQ ID NO: 21174 - RNA, 32 nt, Human
aacaggagguggagguugcagugagccgagau

SEQ ID NO: 21175 - RNA, 32 nt, Human
aacaggauaaaaagauacccauugccuguguc

SEQ ID NO: 21176 - RNA, 32 nt, Human
aacaggauaaagccauuccuccuuccaccuag

SEQ ID NO: 21177 - RNA, 32 nt, Human
aacaggauaucugccaaagggugucugaugug

SEQ ID NO: 21178 - RNA, 32 nt, Human
aacaggaucuaugccuggaauccuggcaggga

SEQ ID NO: 21179 - RNA, 32 nt, Human
aacaggauuagggaaggacauaauguauuuaa

SEQ ID NO: 21180 - RNA, 32 nt, Human
aacaggauuucugcuccucuugagugggucuc

SEQ ID NO: 21181 - RNA, 32 nt, Human
aacaggcaaaccaaacagcacacuguagcuau

SEQ ID NO: 21182 - RNA, 32 nt, Human
aacaggcaacagcagccagcccucgcugucca

SEQ ID NO: 21183 - RNA, 18 nt, Human
aacaggcaacguguucuu

SEQ ID NO: 21184 - RNA, 32 nt, Human
aacaggcacagcccucccaucuucccaaugag

SEQ ID NO: 21185 - RNA, 19 nt, Human
aacaggcacauuagccuug

SEQ ID NO: 21186 - RNA, 32 nt, Human
aacaggcacccacugacuccagccucauggaa

SEQ ID NO: 21187 - RNA, 22 nt, Human
aacaggcaccuggccagaguga

SEQ ID NO: 21188 - RNA, 32 nt, Human
aacaggcaccuuugcagagagcaaagaaacgu

SEQ ID NO: 21189 - RNA, 32 nt, Human
aacaggcacggcuggcccaaugccuggucugg

SEQ ID NO: 21190 - RNA, 32 nt, Human
aacaggcacggcugguggugugcagugaacag

SEQ ID NO: 21191 - RNA, 32 nt, Human
aacaggcacucaauaaauauuuuugcuguaga

SEQ ID NO: 21192 - RNA, 23 nt, Human
aacaggcacuccaggcuuaguga

SEQ ID NO: 21193 - RNA, 24 nt, Human
aacaggcacuuggcagccuuguga

SEQ ID NO: 21194 - RNA, 32 nt, Human
aacaggcagaagaaaaggcagcuguggugugu

SEQ ID NO: 21195 - RNA, 32 nt, Human
aacaggcagacaagauuauggaagagaaaugu

SEQ ID NO: 21196 - RNA, 32 nt, Human
aacaggcaggagccagguugugcagugcugug

SEQ ID NO: 21197 - RNA, 20 nt, Human
aacaggcagggaguggagcu

SEQ ID NO: 21198 - RNA, 32 nt, Human
aacaggcagggugggcaguugggguucaggga

SEQ ID NO: 21199 - RNA, 21 nt, Human
aacaggcaguagaacuuaagu

SEQ ID NO: 21200 - RNA, 32 nt, Human
aacaggcaguggaagcaguuucagagaacuuu

SEQ ID NO: 21201 - RNA, 32 nt, Human
aacaggcaugacagaccagggugaggguugug

SEQ ID NO: 21202 - RNA, 32 nt, Human
aacaggcaugagccaccgcgccuggcuuuaaa

SEQ ID NO: 21203 - RNA, 32 nt, Human
aacaggcaugagccaccgugccuggcccucuc

SEQ ID NO: 21204 - RNA, 32 nt, Human
aacaggcaugagccacugugcccagccagagg

SEQ ID NO: 21205 - RNA, 32 nt, Human
aacaggcaugggaaaauggaaggguugaggau

SEQ ID NO: 21206 - RNA, 32 nt, Human
aacaggcauugcacuccgguugggggucccca

SEQ ID NO: 21207 - RNA, 32 nt, Human
aacaggccaccugagccucacacccagguuca

SEQ ID NO: 21208 - RNA, 32 nt, Human
aacaggccagccaggaggucaggaggccccag

SEQ ID NO: 21209 - RNA, 32 nt, Human
aacaggccaggacuugucucugugcugaaagc

SEQ ID NO: 21210 - RNA, 32 nt, Human
aacaggcccagucaagucaggggcaagcacau

SEQ ID NO: 21211 - RNA, 23 nt, Human
aacaggcccauucagggcugccu

SEQ ID NO: 21212 - RNA, 32 nt, Human
aacaggcccugaggugugguggcucaugccug

SEQ ID NO: 21213 - RNA, 32 nt, Human
aacaggccucagggcuccuugugggccugggc

SEQ ID NO: 21214 - RNA, 32 nt, Human
aacaggccuccccucccucucucggcaccagu

SEQ ID NO: 21215 - RNA, 21 nt, Human
aacaggccuccuaucuuuagu

SEQ ID NO: 21216 - RNA, 21 nt, Human
aacaggccugcagacucaagu

SEQ ID NO: 21217 - RNA, 32 nt, Human
aacaggcgugaagucaggagaauuugagcuuu

SEQ ID NO: 21218 - RNA, 32 nt, Human
aacaggcuacccaauguuacuacuuauuuuuc

SEQ ID NO: 21219 - RNA, 31 nt, Human
aacaggcucaauauuccugaaugaaauauca

SEQ ID NO: 21220 - RNA, 32 nt, Human
aacaggcuccuucgcccucuggcuccugguca

SEQ ID NO: 21221 - RNA, 32 nt, Human
aacaggcugagagaagaaaaaugacugcucca

SEQ ID NO: 21222 - RNA, 32 nt, Human
aacaggcugaggagguuccgaggcucaaagga

SEQ ID NO: 21223 - RNA, 32 nt, Human
aacaggcugcugcugccuccagcugcccacca

SEQ ID NO: 21224 - RNA, 32 nt, Human
aacaggcuggcgugguggcucacaccuguaau

SEQ ID NO: 21225 - RNA, 32 nt, Human
aacaggcugguguacagggagcaacaccggag

SEQ ID NO: 21226 - RNA, 32 nt, Human
aacaggcugucuagucagaugcagcuugaucu

SEQ ID NO: 21227 - RNA, 32 nt, Human
aacaggcuguucaccaccaucuccagcugauc

SEQ ID NO: 21228 - RNA, 32 nt, Human
aacaggcuucucuuggcaacagacucaugaca

SEQ ID NO: 21229 - RNA, 32 nt, Human
aacaggcuugaaucaaagaacuucuccuacug

SEQ ID NO: 21230 - RNA, 32 nt, Human
aacagggaaaagaaaaacacacacuaccugaa

SEQ ID NO: 21231 - RNA, 32 nt, Human
aacagggaacagcaaaccaaugcuauugugau

SEQ ID NO: 21232 - RNA, 32 nt, Human
aacagggaagcagagguugcggugaaccggga

SEQ ID NO: 21233 - RNA, 32 nt, Human
aacagggaagcaucuaggcugcuuguggaagu

SEQ ID NO: 21234 - RNA, 32 nt, Human
aacagggaccaggcugccccacggucccugaa

SEQ ID NO: 21235 - RNA, 32 nt, Human
aacagggacgaugauagcaccucccucagcgg

SEQ ID NO: 21236 - RNA, 32 nt, Human
aacagggagagggcuuucuggggcagggggag

SEQ ID NO: 21237 - RNA, 32 nt, Human
aacagggaggcagagguugcagugagccgaga

SEQ ID NO: 21238 - RNA, 32 nt, Human
aacagggaggggccucgcaggagcagcagcgg

SEQ ID NO: 21239 - RNA, 32 nt, Human
aacagggaucucacacccauguuacuugccau

SEQ ID NO: 21240 - RNA, 20 nt, Human
aacagggaugaggcucuugg

SEQ ID NO: 21241 - RNA, 22 nt, Human
aacagggcaagacucugucuca

SEQ ID NO: 21242 - RNA, 32 nt, Human
aacagggcagcaucgaccugcccacgcccuac

SEQ ID NO: 21243 - RNA, 32 nt, Human
aacagggcaggcagguaguaggcccagcuggg

SEQ ID NO: 21244 - RNA, 24 nt, Human
aacagggcaggggaaaaucuuagg

SEQ ID NO: 21245 - RNA, 32 nt, Human
aacagggccaauaucacucacuucacagguug

SEQ ID NO: 21246 - RNA, 32 nt, Human
aacagggccacagggauauaaaagcagcccug

SEQ ID NO: 21247 - RNA, 32 nt, Human
aacagggccaguggcacacaaggggccaguga

SEQ ID NO: 21248 - RNA, 32 nt, Human
aacagggcccucugcagcccagccuuuccuuc

SEQ ID NO: 21249 - RNA, 32 nt, Human
aacagggcugcugguuuccgcagccacugcuc

SEQ ID NO: 21250 - RNA, 32 nt, Human
aacagggcuggccuuggaaaaaccccaaaaca

SEQ ID NO: 21251 - RNA, 32 nt, Human
aacaggggagauggagguugcagugagcugag

SEQ ID NO: 21252 - RNA, 32 nt, Human
aacaggggaggcagagccagagggaggagaga

SEQ ID NO: 21253 - RNA, 32 nt, Human
aacaggggcuuagaggaaaguugaagauuaua

SEQ ID NO: 21254 - RNA, 32 nt, Human
aacagggggaagaaaaggaaaagggagcgcag

SEQ ID NO: 21255 - RNA, 32 nt, Human
aacagggggccuaauacuugccaagcccugug

SEQ ID NO: 21256 - RNA, 32 nt, Human
aacaggggugagugcucggaaaggaagggcgg

SEQ ID NO: 21257 - RNA, 32 nt, Human
aacagggguuacuggggaggcggcgucuggga

SEQ ID NO: 21258 - RNA, 32 nt, Human
aacagggguuugaggggaacauggggacuggg

SEQ ID NO: 21259 - RNA, 32 nt, Human
aacaggguaggcagaauauaaccaaauaccuc

SEQ ID NO: 21260 - RNA, 32 nt, Human
aacagggucaccaagcagacagggagcccgcg

SEQ ID NO: 21261 - RNA, 32 nt, Human
aacaggguuaacaucuguguuaggggagguca

SEQ ID NO: 21262 - RNA, 23 nt, Human
aacaggguuacaaauguguagua

SEQ ID NO: 21263 - RNA, 32 nt, Human
aacaggguuagucagcaaaauaaaaucaaccu

SEQ ID NO: 21264 - RNA, 32 nt, Human
aacagguaaguucggggagacuucaggccagg

SEQ ID NO: 21265 - RNA, 32 nt, Human
aacagguacggaauggcccuggaacauuucua

SEQ ID NO: 21266 - RNA, 32 nt, Human
aacagguaugaaccaccgcgcccagccuuuuu

SEQ ID NO: 21267 - RNA, 32 nt, Human
aacaggucagcccucagaucaccuggcccggg

SEQ ID NO: 21268 - RNA, 32 nt, Human
aacaggucauuucuacucuccccauauuccac

SEQ ID NO: 21269 - RNA, 32 nt, Human
aacagguccaggaguagauuccaugccuucag

SEQ ID NO: 21270 - RNA, 32 nt, Human
aacaggugaggaaagaaauaaauaagugauuc

SEQ ID NO: 21271 - RNA, 32 nt, Human
aacaggugauguccuaggugcugcagugaaca

SEQ ID NO: 21272 - RNA, 32 nt, Human
aacaggugcaggacugccagggaucggagugc

SEQ ID NO: 21273 - RNA, 32 nt, Human
aacaggugccagccaccaugcccagcuaauuu

SEQ ID NO: 21274 - RNA, 32 nt, Human
aacagguggcccaggacaugcuccugcauacu

SEQ ID NO: 21275 - RNA, 32 nt, Human
aacagguggcugcuguguggugccaucgaguc

SEQ ID NO: 21276 - RNA, 32 nt, Human
aacaggugggacuugccggccaugaagaggac

SEQ ID NO: 21277 - RNA, 32 nt, Human
aacaggugggcacuauccucugugcccucauu

SEQ ID NO: 21278 - RNA, 32 nt, Human
aacagguggucuucuaugcugcagagaaacua

SEQ ID NO: 21279 - RNA, 32 nt, Human
aacaggugguuugaguggaugucuccugcagg

SEQ ID NO: 21280 - RNA, 32 nt, Human
aacaggugugaacgaccaugcccacuuaauuu

SEQ ID NO: 21281 - RNA, 32 nt, Human
aacaggugugaccugauccugccccuuccuuc

SEQ ID NO: 21282 - RNA, 32 nt, Human
aacaggugugagccaccgcacccugccaaguu

SEQ ID NO: 21283 - RNA, 32 nt, Human
aacaggugugcaccaccaugcccugcuaauuu

SEQ ID NO: 21284 - RNA, 32 nt, Human
aacagguguggaccgcaggaucucagcacucu

SEQ ID NO: 21285 - RNA, 32 nt, Human
aacagguguggggacacagcagugaguaauca

SEQ ID NO: 21286 - RNA, 32 nt, Human
aacaggugugugugaacugggcacagauugaa

SEQ ID NO: 21287 - RNA, 32 nt, Human
aacagguuaaaacucagagaacuccaauaaua

SEQ ID NO: 21288 - RNA, 32 nt, Human
aacagguugccuaauuagcagcuuuuggguga

SEQ ID NO: 21289 - RNA, 32 nt, Human
aacagguugggaagaaaauuguggcuguugga

SEQ ID NO: 21290 - RNA, 21 nt, Human
aacagguuggguuaggagcag

SEQ ID NO: 21291 - RNA, 32 nt, Human
aacagguuugggcaguggugggggagggggcc

SEQ ID NO: 21292 - RNA, 32 nt, Human
aacagguuuuucuuuuccuuuuuaauuuuucu

SEQ ID NO: 21293 - RNA, 32 nt, Human
aacaguaaaccaguauuucacacugagauugu

SEQ ID NO: 21294 - RNA, 32 nt, Human
aacaguaaaggccaugugaagagaauuauuac

SEQ ID NO: 21295 - RNA, 32 nt, Human
aacaguaaccuagaguuacagcacuugcuccu

SEQ ID NO: 21296 - RNA, 32 nt, Human
aacaguaagcggcuccaggccuccucugggcc

SEQ ID NO: 21297 - RNA, 22 nt, Human
aacaguaauggaagugcggcca

SEQ ID NO: 21298 - RNA, 32 nt, Human
aacaguaauggaguacaugagcacuggaagug

SEQ ID NO: 21299 - RNA, 32 nt, Human
aacaguacaaugcuuguuaaugguuaauauag

SEQ ID NO: 21300 - RNA, 31 nt, Human
aacaguacaggugcacucacagcaugauggc

SEQ ID NO: 21301 - RNA, 32 nt, Human
aacaguaccaauaucaugaaguuucaaguauc

SEQ ID NO: 21302 - RNA, 32 nt, Human
aacaguacccugguuguguguccccuugcagc

SEQ ID NO: 21303 - RNA, 32 nt, Human
aacaguaccugggaaggacucccaccucacca

SEQ ID NO: 21304 - RNA, 32 nt, Human
aacaguacuacaaugauucugaagcacagugu

SEQ ID NO: 21305 - RNA, 32 nt, Human
aacaguacuucuaagaacguugccugucaucg

SEQ ID NO: 21306 - RNA, 32 nt, Human
aacaguagcaaauucacuaaacuuuuguguuc

SEQ ID NO: 21307 - RNA, 32 nt, Human
aacaguaggagagaggucuggggauaagugaa

SEQ ID NO: 21308 - RNA, 32 nt, Human
aacaguagguccaggcuggaugcugguaugau

SEQ ID NO: 21309 - RNA, 32 nt, Human
aacaguagucuagauguugcugugaagguauu

SEQ ID NO: 21310 - RNA, 32 nt, Human
aacaguauaugauccagcugcagagagcagac

SEQ ID NO: 21311 - RNA, 20 nt, Human
aacaguaugccauguguucu

SEQ ID NO: 21312 - RNA, 32 nt, Human
aacaguaugugccuugggggaggagggaaaga

SEQ ID NO: 21313 - RNA, 32 nt, Human
aacagucaacacacccugccacuuucaccauc

SEQ ID NO: 21314 - RNA, 32 nt, Human
aacagucacaggcagugggaugagugaaguua

SEQ ID NO: 21315 - RNA, 32 nt, Human
aacagucacauagcaggcuacugcuucaacau

SEQ ID NO: 21316 - RNA, 21 nt, Human
aacagucaccauuuacuacca

SEQ ID NO: 21317 - RNA, 32 nt, Human
aacagucacugcagaagaauuugcugcacgga

SEQ ID NO: 21318 - RNA, 32 nt, Human
aacagucauaugcugaaucuucuaucugugaa

SEQ ID NO: 21319 - RNA, 32 nt, Human
aacagucauucuuccucuuuguuaaugugcca

SEQ ID NO: 21320 - RNA, 32 nt, Human
aacaguccagguucaaggaggcugcuuuuauu

SEQ ID NO: 21321 - RNA, 32 nt, Human
aacagucccacuguuaaccuggugcuacuggg

SEQ ID NO: 21322 - RNA, 32 nt, Human
aacagucgggccggauccccggugucugggga

SEQ ID NO: 21323 - RNA, 32 nt, Human
aacagucuccccucauccugauuccugacaac

SEQ ID NO: 21324 - RNA, 32 nt, Human
aacagucuccgguguccaugcguugacugcca

SEQ ID NO: 21325 - RNA, 32 nt, Human
aacagucuccuuccacaaaaccauggcgucgc

SEQ ID NO: 21326 - RNA, 32 nt, Human
aacagucugcuccccucuucccuuccuucuuu

SEQ ID NO: 21327 - RNA, 32 nt, Human
aacagucuggguggaauggggcugaaaccaug

SEQ ID NO: 21328 - RNA, 32 nt, Human
aacagucuucccuguuguccagauucuguaua

SEQ ID NO: 21329 - RNA, 32 nt, Human
aacagucuucuccccucccucgccuuccauuu

SEQ ID NO: 21330 - RNA, 32 nt, Human
aacagucuucugcccaugucugggaacacacg

SEQ ID NO: 21331 - RNA, 31 nt, Human
aacagugaaaagagagaagggagacucuauu

SEQ ID NO: 21332 - RNA, 32 nt, Human
aacagugaaaugucacauggcucaaacccagg

SEQ ID NO: 21333 - RNA, 32 nt, Human
aacagugaagaaaaggagggugagagggcggc

SEQ ID NO: 21334 - RNA, 32 nt, Human
aacagugacuuuuccagggaggaagaggcagc

SEQ ID NO: 21335 - RNA, 32 nt, Human
aacagugagcccagugagcagccccagccagc

SEQ ID NO: 21336 - RNA, 32 nt, Human
aacagugaggugguagcaagacuucuuuuuag

SEQ ID NO: 21337 - RNA, 32 nt, Human
aacagugaucagacauauuacagggaaauagc

SEQ ID NO: 21338 - RNA, 32 nt, Human
aacagugcacacacaugaacauucauugcaug

SEQ ID NO: 21339 - RNA, 22 nt, Human
aacagugccaaaugcuggggca

SEQ ID NO: 21340 - RNA, 32 nt, Human
aacagugccuggaagccugaggcugcauuucc

SEQ ID NO: 21341 - RNA, 32 nt, Human
aacagugcuuggcaccuggaaguagguggcag

SEQ ID NO: 21342 - RNA, 32 nt, Human
aacaguggaagcaagagguuggggugaugugg

SEQ ID NO: 21343 - RNA, 32 nt, Human
aacaguggagaggaagagggagugaggcccug

SEQ ID NO: 21344 - RNA, 32 nt, Human
aacaguggcgacuggaaucugguuuauauuca

SEQ ID NO: 21345 - RNA, 32 nt, Human
aacaguggcuuaugccuguaaucccagcacuc

SEQ ID NO: 21346 - RNA, 32 nt, Human
aacagugggcacaggcaugcuguucccaccau

SEQ ID NO: 21347 - RNA, 32 nt, Human
aacaguguaagccgguuucagucacuccacag

SEQ ID NO: 21348 - RNA, 32 nt, Human
aacaguguccuagucccucccuucccucuccu

SEQ ID NO: 21349 - RNA, 32 nt, Human
aacaguguuaauuuagaugcacuaaagcaaag

SEQ ID NO: 21350 - RNA, 32 nt, Human
aacaguguuccuuuucuugguuuuaauuucug

SEQ ID NO: 21351 - RNA, 32 nt, Human
aacaguguuuuagaugagagaucauuaaugca

SEQ ID NO: 21352 - RNA, 32 nt, Human
aacaguuaagagucacugggaaauuauuguau

SEQ ID NO: 21353 - RNA, 21 nt, Human
aacaguuagugaggaacagcu

SEQ ID NO: 21354 - RNA, 32 nt, Human
aacaguucaguaaacucugccuugaccagcaa

SEQ ID NO: 21355 - RNA, 32 nt, Human
aacaguucauucuacuuaauaaugcaauaaug

SEQ ID NO: 21356 - RNA, 32 nt, Human
aacaguuccagaccagccugggcaauacagcg

SEQ ID NO: 21357 - RNA, 32 nt, Human
aacaguucccaucaccaccaccaccaccacca

SEQ ID NO: 21358 - RNA, 32 nt, Human
aacaguuccccuacuacuaucucccacucuag

SEQ ID NO: 21359 - RNA, 32 nt, Human
aacaguuccuucagcuuccauuucgccccuca

SEQ ID NO: 21360 - RNA, 24 nt, Human
aacaguuccuuuaaauguguagua

SEQ ID NO: 21361 - RNA, 24 nt, Human
aacaguuccuuuacauguguagua

SEQ ID NO: 21362 - RNA, 32 nt, Human
aacaguuccuuucaaaggagaaugaaucauga

SEQ ID NO: 21363 - RNA, 32 nt, Human
aacaguucgacuucgguuacugccuucucccu

SEQ ID NO: 21364 - RNA, 32 nt, Human
aacaguucggccaagcagaacugcuguaccuc

SEQ ID NO: 21365 - RNA, 32 nt, Human
aacaguucucagaaaugucaugauugccgggg

SEQ ID NO: 21366 - RNA, 32 nt, Human
aacaguucugcaguagugugguggugacuugg

SEQ ID NO: 21367 - RNA, 32 nt, Human
aacaguucugucuugcugggguuccagguacc

SEQ ID NO: 21368 - RNA, 32 nt, Human
aacaguucuugcucuguucagcuccccacauu

SEQ ID NO: 21369 - RNA, 32 nt, Human
aacaguugcaaucuuggcagcuugaaaauggu

SEQ ID NO: 21370 - RNA, 32 nt, Human
aacaguugcugcuaguauuaggguuccacauc

SEQ ID NO: 21371 - RNA, 31 nt, Human
aacaguugggagagagacaagaccugucggg

SEQ ID NO: 21372 - RNA, 32 nt, Human
aacaguuguccaggaugcuggcugguggaaca

SEQ ID NO: 21373 - RNA, 32 nt, Human
aacaguuguucuguucacugcuuucauugaga

SEQ ID NO: 21374 - RNA, 32 nt, Human
aacaguuuaugcagugcugcuuugccaaauaa

SEQ ID NO: 21375 - RNA, 32 nt, Human
aacaguuugaacacaaaggcucuauggaagaa

SEQ ID NO: 21376 - RNA, 19 nt, Human
aacaguuugaugaguuuuu

SEQ ID NO: 21377 - RNA, 19 nt, Human
aacaguuugccagugguuc

SEQ ID NO: 21378 - RNA, 32 nt, Human
aacaguuugccucccucccagccucaaccaca

SEQ ID NO: 21379 - RNA, 17 nt, Human
aacaguuugguggucuu

SEQ ID NO: 21380 - RNA, 32 nt, Human
aacaguuuguagguuaucaggugacuugaccc

SEQ ID NO: 21381 - RNA, 32 nt, Human
aacaguuuguauaguuggaauauuugucuuug

SEQ ID NO: 21382 - RNA, 18 nt, Human
aacaguuuguuaauucuu

SEQ ID NO: 21383 - RNA, 21 nt, Human
aacaguuuucaacuuguucuu

SEQ ID NO: 21384 - RNA, 32 nt, Human
aacaguuuuggcuucuuaaacuucauauuugg

SEQ ID NO: 21385 - RNA, 32 nt, Human
aacaguuuuugcuaauuuuuaggcugaaagau

SEQ ID NO: 21386 - RNA, 32 nt, Human
aacauaaaacacagcaagaaucugguugucug

SEQ ID NO: 21387 - RNA, 32 nt, Human
aacauaaaacauccuuacuuuuauuucacaca

SEQ ID NO: 21388 - RNA, 32 nt, Human
aacauaaaaguggagagacugaggcuaagguu

SEQ ID NO: 21389 - RNA, 32 nt, Human
aacauaaaauggcuugguaaaaguaauaaaau

SEQ ID NO: 21390 - RNA, 32 nt, Human
aacauaaaccccaacauccacccaugaagcca

SEQ ID NO: 21391 - RNA, 32 nt, Human
aacauaaaucugccuacugaacucuaggauau

SEQ ID NO: 21392 - RNA, 32 nt, Human
aacauaacaacaagcauaggucuuaucaucca

SEQ ID NO: 21393 - RNA, 32 nt, Human
aacauaacccagcauuccaagugucuguguug

SEQ ID NO: 21394 - RNA, 32 nt, Human
aacauaacuaacuccauuuuuguuuaaggggc

SEQ ID NO: 21395 - RNA, 32 nt, Human
aacauaacucacaccccugcccccaccccaug

SEQ ID NO: 21396 - RNA, 32 nt, Human
aacauaaguaaucacuaaugcucaacaauuua

SEQ ID NO: 21397 - RNA, 32 nt, Human
aacauaagucucaggagauuugggagguggcc

SEQ ID NO: 21398 - RNA, 32 nt, Human
aacauaauuucaguuaucagaagccauuccau

SEQ ID NO: 21399 - RNA, 32 nt, Human
aacauacacaaugugucuuucuuuuuggacau

SEQ ID NO: 21400 - RNA, 32 nt, Human
aacauacacaggggguuggugaauggugccga

SEQ ID NO: 21401 - RNA, 32 nt, Human
aacauacacaugcauguaucuuuauaaaagaa

SEQ ID NO: 21402 - RNA, 29 nt, Human
aacauacaguguaccucaaaaggggcccu

SEQ ID NO: 21403 - RNA, 32 nt, Human
aacauacaucacuuucugagucauacuuuaug

SEQ ID NO: 21404 - RNA, 32 nt, Human
aacauacaugaauggaccugcuacacagaagg

SEQ ID NO: 21405 - RNA, 32 nt, Human
aacauacaugcaugcacacauacauacauaug

SEQ ID NO: 21406 - RNA, 32 nt, Human
aacauacauucaucugaucagcauuaauuugg

SEQ ID NO: 21407 - RNA, 32 nt, Human
aacauaccucaauccugucccaggccggaucc

SEQ ID NO: 21408 - RNA, 32 nt, Human
aacauacgccuuuguucugucauuuuaaagag

SEQ ID NO: 21409 - RNA, 23 nt, Human
aacauacuaaugggggucuuucu

SEQ ID NO: 21410 - RNA, 32 nt, Human
aacauacuccaucaucccaggacacugaaacu

SEQ ID NO: 21411 - RNA, 32 nt, Human
aacauacucuuguggauuccaucaggagcugg

SEQ ID NO: 21412 - RNA, 32 nt, Human
aacauacugauagagguuagaagauuauuuua

SEQ ID NO: 21413 - RNA, 32 nt, Human
aacauacuggccuggacuguuuucucucggcu

SEQ ID NO: 21414 - RNA, 32 nt, Human
aacauagaaguuaagaagagaucuggcuggga

SEQ ID NO: 21415 - RNA, 32 nt, Human
aacauagaccaacuugcugcaugguaaggugg

SEQ ID NO: 21416 - RNA, 32 nt, Human
aacauagcaagacucugucucuguaaaguaau

SEQ ID NO: 21417 - RNA, 32 nt, Human
aacauagcacacuugugcacugagaggaggga

SEQ ID NO: 21418 - RNA, 32 nt, Human
aacauagccaucaaaauuaauauuauguaaug

SEQ ID NO: 21419 - RNA, 32 nt, Human
aacauagcucacugcagccuugaacuccugga

SEQ ID NO: 21420 - RNA, 32 nt, Human
aacauaggaggcacuucuuuucauaaagagaa

SEQ ID NO: 21421 - RNA, 32 nt, Human
aacauaggcccaggcuauccaggcugcagugg

SEQ ID NO: 21422 - RNA, 32 nt, Human
aacauaggcuuagaugacugguuuuccuuuag

SEQ ID NO: 21423 - RNA, 32 nt, Human
aacauagggcauuccaggucuguaacccugca

SEQ ID NO: 21424 - RNA, 32 nt, Human
aacauagguccuccccucaccccaacucuagg

SEQ ID NO: 21425 - RNA, 32 nt, Human
aacauaguauaaacagagaagacuucauuuuu

SEQ ID NO: 21426 - RNA, 32 nt, Human
aacauagugagcucucugccucuucggaacga

SEQ ID NO: 21427 - RNA, 32 nt, Human
aacauauauuggagagaagcccuguuaugguc

SEQ ID NO: 21428 - RNA, 32 nt, Human
aacauaucccuuagaacagauccaauagacaa

SEQ ID NO: 21429 - RNA, 32 nt, Human
aacauaucuggaauuugaaaugagaucuguuu

SEQ ID NO: 21430 - RNA, 32 nt, Human
aacauaugaaguaaaguguucuauccaggauu

SEQ ID NO: 21431 - RNA, 32 nt, Human
aacauaugguagggauuacagugggggcauuu

SEQ ID NO: 21432 - RNA, 32 nt, Human
aacauauucacacccaugcacgcacacacaua

SEQ ID NO: 21433 - RNA, 32 nt, Human
aacauauucauucucucuucuccaucacccau

SEQ ID NO: 21434 - RNA, 32 nt, Human
aacauauuccaaugcucuccucuuucucuggc

SEQ ID NO: 21435 - RNA, 32 nt, Human
aacaucaaaaacaaaaacaauuagcugggcau

SEQ ID NO: 21436 - RNA, 32 nt, Human
aacaucaacgucuuuuguccagccucuuuuuc

SEQ ID NO: 21437 - RNA, 32 nt, Human
aacaucaauaccuaggccugagaaauaacccc

SEQ ID NO: 21438 - RNA, 32 nt, Human
aacaucaaugaaggagagaagagccagccaga

SEQ ID NO: 21439 - RNA, 32 nt, Human
aacaucacaauuaaaagaacuagaaaagcaag

SEQ ID NO: 21440 - RNA, 32 nt, Human
aacaucacaccauugcacuccagccugggcaa

SEQ ID NO: 21441 - RNA, 32 nt, Human
aacaucaccgauuuuaaaaucugucacaacag

SEQ ID NO: 21442 - RNA, 32 nt, Human
aacaucacuccucccuggucagcugggagagc

SEQ ID NO: 21443 - RNA, 32 nt, Human
aacaucacugaagcucugaagcuuugagcagc

SEQ ID NO: 21444 - RNA, 32 nt, Human
aacaucacugauaccauuaaagccacuaacag

SEQ ID NO: 21445 - RNA, 32 nt, Human
aacaucacuguggaugacuacuuucacgaggg

SEQ ID NO: 21446 - RNA, 32 nt, Human
aacaucacugugggugaacagagauuuccagg

SEQ ID NO: 21447 - RNA, 25 nt, Human
aacaucagaaggaacaaacucuaga

SEQ ID NO: 21448 - RNA, 32 nt, Human
aacaucagaaugggggucagaggcagaaggac

SEQ ID NO: 21449 - RNA, 32 nt, Human
aacaucagagcugaacuucuuaagaaaagcac

SEQ ID NO: 21450 - RNA, 32 nt, Human
aacaucagauacaaaugaaaagguuucaaauu

SEQ ID NO: 21451 - RNA, 32 nt, Human
aacaucagcagaggggcccugccccuccgccu

SEQ ID NO: 21452 - RNA, 32 nt, Human
aacaucagcaguaggguccauuccaagauugu

SEQ ID NO: 21453 - RNA, 32 nt, Human
aacaucagccuccacucucccagcuugcuuua

SEQ ID NO: 21454 - RNA, 32 nt, Human
aacaucagccugggcaacauagcaggacccca

SEQ ID NO: 21455 - RNA, 32 nt, Human
aacaucagcuuccucgaugaggaagucucuac

SEQ ID NO: 21456 - RNA, 32 nt, Human
aacaucaggagaagaaagagagagggggauuu

SEQ ID NO: 21457 - RNA, 32 nt, Human
aacaucagugggaggcaggggaggcagauauu

SEQ ID NO: 21458 - RNA, 32 nt, Human
aacaucaguuucuggggaggccucagggagcu

SEQ ID NO: 21459 - RNA, 31 nt, Human
aacaucaugguggcuuucaaaggggucugga

SEQ ID NO: 21460 - RNA, 32 nt, Human
aacaucauuacagcuaagagaaguucuccuau

SEQ ID NO: 21461 - RNA, 32 nt, Human
aacaucauugauggguucugcagcccagggcc

SEQ ID NO: 21462 - RNA, 32 nt, Human
aacaucauuugcaaagggagagaggggcaagc

SEQ ID NO: 21463 - RNA, 32 nt, Human
aacauccacagaacuaguccaacucuuaaaag

SEQ ID NO: 21464 - RNA, 32 nt, Human
aacauccacaguuaagguugggccagcuaccu

SEQ ID NO: 21465 - RNA, 32 nt, Human
aacauccagaaaacuuuaacauucuucaaaga

SEQ ID NO: 21466 - RNA, 32 nt, Human
aacauccaguaauggggaccuggaaccugggc

SEQ ID NO: 21467 - RNA, 32 nt, Human
aacauccauacagcacugcuggaggaagagga

SEQ ID NO: 21468 - RNA, 28 nt, Human
aacaucccaaguguaugucucuucccug

SEQ ID NO: 21469 - RNA, 32 nt, Human
aacaucccaucucuucccuuucaccucugcca

SEQ ID NO: 21470 - RNA, 32 nt, Human
aacauccccacugucaugugucucagcagugg

SEQ ID NO: 21471 - RNA, 32 nt, Human
aacauccccuccauacucagcucuuuaacuuu

SEQ ID NO: 21472 - RNA, 32 nt, Human
aacauccccuugacaguugcagccucuugacc

SEQ ID NO: 21473 - RNA, 32 nt, Human
aacaucccucaccacucucccccagcaccccc

SEQ ID NO: 21474 - RNA, 32 nt, Human
aacaucccucauugagccacugggaagcuaug

SEQ ID NO: 21475 - RNA, 32 nt, Human
aacaucccugguacuccagcuuugagguccua

SEQ ID NO: 21476 - RNA, 32 nt, Human
aacaucccuucucugcuccacaggagugucuu

SEQ ID NO: 21477 - RNA, 32 nt, Human
aacauccggcgccacugggguuugacuucucc

SEQ ID NO: 21478 - RNA, 32 nt, Human
aacauccuaacaguaaucacaucucacccucc

SEQ ID NO: 21479 - RNA, 32 nt, Human
aacauccucauugauccucuucaguuggaguc

SEQ ID NO: 21480 - RNA, 32 nt, Human
aacauccuccacugacuuccucccacugucug

SEQ ID NO: 21481 - RNA, 32 nt, Human
aacauccugcuuguaucaggaaacucagaagc

SEQ ID NO: 21482 - RNA, 32 nt, Human
aacauccuucaagaacucugggcugcuaccca

SEQ ID NO: 21483 - RNA, 32 nt, Human
aacauccuuggucauugcccagaaaguaccug

SEQ ID NO: 21484 - RNA, 32 nt, Human
aacauccuugucugggucuaccaggaacgcuu

SEQ ID NO: 21485 - RNA, 32 nt, Human
aacaucuaaaguguauuaacagugcaugcuuu

SEQ ID NO: 21486 - RNA, 32 nt, Human
aacaucuacagccuuuggguguuuuaguaaga

SEQ ID NO: 21487 - RNA, 32 nt, Human
aacaucuagcucgauucaggugcauugagaag

SEQ ID NO: 21488 - RNA, 20 nt, Human
aacaucuaucucugcugcca

SEQ ID NO: 21489 - RNA, 19 nt, Human
aacaucuaugguugugaca

SEQ ID NO: 21490 - RNA, 31 nt, Human
aacaucucaauaaaaccauuuuaguugaaaa

SEQ ID NO: 21491 - RNA, 32 nt, Human
aacaucucaguuaccucauucugcaauaaguu

SEQ ID NO: 21492 - RNA, 32 nt, Human
aacaucucccugucauccuuuuucacccauaa

SEQ ID NO: 21493 - RNA, 32 nt, Human
aacaucucuagugcccuugcaagagccuuuaa

SEQ ID NO: 21494 - RNA, 32 nt, Human
aacaucucucucccucuccaucacuccccaug

SEQ ID NO: 21495 - RNA, 32 nt, Human
aacaucucugacuucucuaccuccucugugcu

SEQ ID NO: 21496 - RNA, 32 nt, Human
aacaucucuggcccagaaagccucucucuccc

SEQ ID NO: 21497 - RNA, 32 nt, Human
aacaucugaauguagaccaugaucucaaguuc

SEQ ID NO: 21498 - RNA, 32 nt, Human
aacaucugacccuuuucaagaggaaggaugaa

SEQ ID NO: 21499 - RNA, 32 nt, Human
aacaucugaggcuguagacaucucugcaucuu

SEQ ID NO: 21500 - RNA, 32 nt, Human
aacaucugcaguguucugugaauagcaguggc

SEQ ID NO: 21501 - RNA, 32 nt, Human
aacaucugcucacuggacugucugauccaaug

SEQ ID NO: 21502 - RNA, 32 nt, Human
aacaucugcugucaaaggccagccugucguua

SEQ ID NO: 21503 - RNA, 32 nt, Human
aacaucuggcacauaggauuuguacuccguaa

SEQ ID NO: 21504 - RNA, 32 nt, Human
aacaucuggcacauaggauuuguacucgguaa

SEQ ID NO: 21505 - RNA, 32 nt, Human
aacaucugggcugccuuguagagaugcagccu

SEQ ID NO: 21506 - RNA, 19 nt, Human
aacaucugugacugugaca

SEQ ID NO: 21507 - RNA, 32 nt, Human
aacaucuguggacaccucaugcucuguucaag

SEQ ID NO: 21508 - RNA, 32 nt, Human
aacaucuuauuguugguaauagugcuuuauau

SEQ ID NO: 21509 - RNA, 32 nt, Human
aacaucuucagacuggccugaccugggccuug

SEQ ID NO: 21510 - RNA, 32 nt, Human
aacaucuuccacccucccucucccccucugcc

SEQ ID NO: 21511 - RNA, 32 nt, Human
aacaucuuccagcauguguccuggggugaugg

SEQ ID NO: 21512 - RNA, 32 nt, Human
aacaucuucucccaacacugcuuuaauggaag

SEQ ID NO: 21513 - RNA, 32 nt, Human
aacaucuuggcauccccaccccaggaagugcg

SEQ ID NO: 21514 - RNA, 32 nt, Human
aacaucuuuacucuuauugucuggaccuucaa

SEQ ID NO: 21515 - RNA, 32 nt, Human
aacaucuuugauaguaacgugccuucaaacaa

SEQ ID NO: 21516 - RNA, 18 nt, Human
aacaucuuugauguucaa

SEQ ID NO: 21517 - RNA, 32 nt, Human
aacaucuuuuacucugacuugcuuuuaucuua

SEQ ID NO: 21518 - RNA, 32 nt, Human
aacaugaaagagaucuuugugaauaaauucaa

SEQ ID NO: 21519 - RNA, 28 nt, Human
aacaugaaagccucugcagcacuucugu

SEQ ID NO: 21520 - RNA, 32 nt, Human
aacaugaagccagugcacgccagccugggcga

SEQ ID NO: 21521 - RNA, 32 nt, Human
aacaugaauguugaugaacaaauguaaaauua

SEQ ID NO: 21522 - RNA, 32 nt, Human
aacaugaauugcacuucacugcagcuuuagag

SEQ ID NO: 21523 - RNA, 26 nt, Human
aacaugaccaaaaaccaaaagugcau

SEQ ID NO: 21524 - RNA, 28 nt, Human
aacaugaccagccuggugcaccucacuc

SEQ ID NO: 21525 - RNA, 32 nt, Human
aacaugagagccccucacccccaacucuccac

SEQ ID NO: 21526 - RNA, 32 nt, Human
aacaugagcccuuuuuaaaugugauuucccgu

SEQ ID NO: 21527 - RNA, 32 nt, Human
aacaugagcuucaacuccaccuccagcucuga

SEQ ID NO: 21528 - RNA, 32 nt, Human
aacaugaggaucagagagggaaagucacuugc

SEQ ID NO: 21529 - RNA, 32 nt, Human
aacaugaguauaguuuagaacuuuaugagaau

SEQ ID NO: 21530 - RNA, 32 nt, Human
aacaugaucaauguauuucucugccuugacau

SEQ ID NO: 21531 - RNA, 32 nt, Human
aacaugaucccagcuacacggacugccaugga

SEQ ID NO: 21532 - RNA, 32 nt, Human
aacaugaugccaucauuuaggaaauccaugga

SEQ ID NO: 21533 - RNA, 32 nt, Human
aacaugcaacccacugagaccucaagucagug

SEQ ID NO: 21534 - RNA, 32 nt, Human
aacaugcacguguacacauaccacagacacgc

SEQ ID NO: 21535 - RNA, 32 nt, Human
aacaugcagcagcucugugaccuugggccuca

SEQ ID NO: 21536 - RNA, 32 nt, Human
aacaugcagguuuguuacauagguauacaugu

SEQ ID NO: 21537 - RNA, 32 nt, Human
aacaugcagucuccugucucaugguuugaagu

SEQ ID NO: 21538 - RNA, 32 nt, Human
aacaugcauguuuacagucuugcagugugcug

SEQ ID NO: 21539 - RNA, 32 nt, Human
aacaugccacacacaccgugguuuuaggggcc

SEQ ID NO: 21540 - RNA, 32 nt, Human
aacaugccacagugaacacacucguguacaua

SEQ ID NO: 21541 - RNA, 32 nt, Human
aacaugcccagcaaaaacuugcuuuauggguc

SEQ ID NO: 21542 - RNA, 32 nt, Human
aacaugcccugccuguuuccccucguuggucc

SEQ ID NO: 21543 - RNA, 24 nt, Human
aacaugccuaaucccagcuucauc

SEQ ID NO: 21544 - RNA, 32 nt, Human
aacaugccugauuuuaaaagguugacucaagu

SEQ ID NO: 21545 - RNA, 32 nt, Human
aacaugcuaaaauccccucucuacuaaaaaua

SEQ ID NO: 21546 - RNA, 32 nt, Human
aacaugcuaggaacugcuuuuggcacugggag

SEQ ID NO: 21547 - RNA, 32 nt, Human
aacaugcuccaaaaucugaaacucuuugagcc

SEQ ID NO: 21548 - RNA, 32 nt, Human
aacaugcugccuuugcagaugccugaaaauug

SEQ ID NO: 21549 - RNA, 32 nt, Human
aacaugcugcgggacagaugcagagaggccac

SEQ ID NO: 21550 - RNA, 32 nt, Human
aacaugcugcuuagcuucucugugccaaacuu

SEQ ID NO: 21551 - RNA, 32 nt, Human
aacaugcuguuggguuuuaauucucuaauuau

SEQ ID NO: 21552 - RNA, 32 nt, Human
aacaugcuucgugccaucaugauccuugccuu

SEQ ID NO: 21553 - RNA, 32 nt, Human
aacaugcuuuuauuccagcacugugguuauca

SEQ ID NO: 21554 - RNA, 32 nt, Human
aacauggaaaaccaucucaaugcugaaacuuc

SEQ ID NO: 21555 - RNA, 23 nt, Human
aacauggaaagucagagccuucu

SEQ ID NO: 21556 - RNA, 24 nt, Human
aacauggaacaguguggcucuucu

SEQ ID NO: 21557 - RNA, 32 nt, Human
aacauggaauuugcaaguaaccaaugaccguc

SEQ ID NO: 21558 - RNA, 22 nt, Human
aacauggacaaggagccucucu

SEQ ID NO: 21559 - RNA, 32 nt, Human
aacauggagaaaugccaucucuacuaaaaaua

SEQ ID NO: 21560 - RNA, 20 nt, Human
aacauggagagucagucuuu

SEQ ID NO: 21561 - RNA, 32 nt, Human
aacauggagccuugccuggccugggcuagggg

SEQ ID NO: 21562 - RNA, 28 nt, Human
aacauggaggcagauauaaucacaaauc

SEQ ID NO: 21563 - RNA, 28 nt, Human
aacauggaggcuggcucagugguucgag

SEQ ID NO: 21564 - RNA, 32 nt, Human
aacauggaucuagcucaggucauuccucuacc

SEQ ID NO: 21565 - RNA, 32 nt, Human
aacauggauggaaacugaccaccuacuuuguc

SEQ ID NO: 21566 - RNA, 28 nt, Human
aacauggcaaaaaucuccagcccuacag

SEQ ID NO: 21567 - RNA, 32 nt, Human
aacauggcaaagccuuuaacaagcccucaauu

SEQ ID NO: 21568 - RNA, 32 nt, Human
aacauggcaagauccccucucuaccaaacaaa

SEQ ID NO: 21569 - RNA, 32 nt, Human
aacauggcaaggaacaccacaccacugcuuuu

SEQ ID NO: 21570 - RNA, 32 nt, Human
aacauggcagaaaggugacaccuggagaccaa

SEQ ID NO: 21571 - RNA, 32 nt, Human
aacauggcaggcaggagguccucagaaggugu

SEQ ID NO: 21572 - RNA, 32 nt, Human
aacauggccaacagcauugccaaccugagacu

SEQ ID NO: 21573 - RNA, 32 nt, Human
aacauggcuagauccaucagaaacugaagccg

SEQ ID NO: 21574 - RNA, 32 nt, Human
aacauggcucacugcagccucaaccucccagg

SEQ ID NO: 21575 - RNA, 32 nt, Human
aacauggcucacugcagccucgaccuccuggg

SEQ ID NO: 21576 - RNA, 32 nt, Human
aacauggcucagaggagagggaggaaggaucu

SEQ ID NO: 21577 - RNA, 28 nt, Human
aacauggcuccaguggagcacguugugg

SEQ ID NO: 21578 - RNA, 32 nt, Human
aacaugggaaaucguuuucauuagauguacau

SEQ ID NO: 21579 - RNA, 32 nt, Human
aacaugggacaugccuuucuuuuccgaucagu

SEQ ID NO: 21580 - RNA, 23 nt, Human
aacaugggaggcggagguugcag

SEQ ID NO: 21581 - RNA, 26 nt, Human
aacaugggaggcggagguugcaguga

SEQ ID NO: 21582 - RNA, 32 nt, Human
aacaugggaggcggagguugcagugagccgag

SEQ ID NO: 21583 - RNA, 32 nt, Human
aacaugggaggcguagcuugcagugagcugag

SEQ ID NO: 21584 - RNA, 26 nt, Human
aacaugggagguggaggcugcaguga

SEQ ID NO: 21585 - RNA, 32 nt, Human
aacaugggcuuaguagcucaguuuuccaucau

SEQ ID NO: 21586 - RNA, 32 nt, Human
aacauggggaaacugaggcucggcucggaaag

SEQ ID NO: 21587 - RNA, 32 nt, Human
aacaugguagacagagguugcagugagccaaa

SEQ ID NO: 21588 - RNA, 18 nt, Human
aacauggugaaaccccgu

SEQ ID NO: 21589 - RNA, 32 nt, Human
aacauggugaaaggaagcaccaccagcauggc

SEQ ID NO: 21590 - RNA, 32 nt, Human
aacauggugacacucaccuucugugacuacuu

SEQ ID NO: 21591 - RNA, 32 nt, Human
aacauggugagacucugccucuacaaaagaaa

SEQ ID NO: 21592 - RNA, 32 nt, Human
aacauggugaugggcucccuccccuaaccuug

SEQ ID NO: 21593 - RNA, 32 nt, Human
aacauggugccggcaccugcucagcuuuugga

SEQ ID NO: 21594 - RNA, 32 nt, Human
aacaugguuucaaauugaggaggagagucuug

SEQ ID NO: 21595 - RNA, 32 nt, Human
aacauguaacuugcaguguuugccagcuuuca

SEQ ID NO: 21596 - RNA, 32 nt, Human
aacauguagagaaguuguagauucaagauaua

SEQ ID NO: 21597 - RNA, 32 nt, Human
aacauguaggguggggaguaugagcaccaaca

SEQ ID NO: 21598 - RNA, 32 nt, Human
aacauguccaccucaacuucugagccagcccc

SEQ ID NO: 21599 - RNA, 32 nt, Human
aacaugucgcuucaaauauaacuaauauccug

SEQ ID NO: 21600 - RNA, 23 nt, Human
aacaugucucggccccugucccc

SEQ ID NO: 21601 - RNA, 32 nt, Human
aacaugucuguuaccccucuccaucuuaccaa

SEQ ID NO: 21602 - RNA, 32 nt, Human
aacaugucuguuuccuccucagacacaaaggg

SEQ ID NO: 21603 - RNA, 32 nt, Human
aacaugugagcauggucacaagcacaaagcuc

SEQ ID NO: 21604 - RNA, 32 nt, Human
aacaugugauuccgucuuaaaaguuuuccauu

SEQ ID NO: 21605 - RNA, 32 nt, Human
aacaugugccaaugggcgaucuugccuggaau

SEQ ID NO: 21606 - RNA, 32 nt, Human
aacaugugcuuccuauugaucccaggucuuca

SEQ ID NO: 21607 - RNA, 32 nt, Human
aacauguucagaagccauggggccaagcacau

SEQ ID NO: 21608 - RNA, 32 nt, Human
aacauguucuagcugacaggccagcuucucca

SEQ ID NO: 21609 - RNA, 32 nt, Human
aacauguugagugagcaugcuggagaaugaga

SEQ ID NO: 21610 - RNA, 22 nt, Human
aacauguuggcuuuucucuuga

SEQ ID NO: 21611 - RNA, 32 nt, Human
aacauguuuaaacuuuguucauggucaaauuc

SEQ ID NO: 21612 - RNA, 32 nt, Human
aacauguuuacugagcaucuguuaaguguugg

SEQ ID NO: 21613 - RNA, 32 nt, Human
aacauguuucuccaaugcaaucaagcccuaga

SEQ ID NO: 21614 - RNA, 32 nt, Human
aacauguuugugaauguaugcacuuguacuaa

SEQ ID NO: 21615 - RNA, 32 nt, Human
aacauuaaaacaguaacugacauccaguuaaa

SEQ ID NO: 21616 - RNA, 20 nt, Human
aacauuaaaaugcuggggca

SEQ ID NO: 21617 - RNA, 32 nt, Human
aacauuaaccaccccucucuagucuuacuggu

SEQ ID NO: 21618 - RNA, 32 nt, Human
aacauuaacccugagcuuucuucauggaacca

SEQ ID NO: 21619 - RNA, 32 nt, Human
aacauuaagcuuucugggccacuggaacaaag

SEQ ID NO: 21620 - RNA, 32 nt, Human
aacauuacuggggugaaggaggcauuguucuu

SEQ ID NO: 21621 - RNA, 32 nt, Human
aacauuagagcaaauacucaggggauuuuuca

SEQ ID NO: 21622 - RNA, 32 nt, Human
aacauuagcugucacaggcuguauccuuaaag

SEQ ID NO: 21623 - RNA, 32 nt, Human
aacauucaauuccagagaaccaaaaaucccac

SEQ ID NO: 21624 - RNA, 32 nt, Human
aacauucaucguaguuuugcugucacaucuca

SEQ ID NO: 21625 - RNA, 32 nt, Human
aacauucauucaacaaacacuuacugaggcca

SEQ ID NO: 21626 - RNA, 32 nt, Human
aacauuccaaauuacugucaauaaaauauaua

SEQ ID NO: 21627 - RNA, 32 nt, Human
aacauuccagccccacccucaggcuggagggc

SEQ ID NO: 21628 - RNA, 32 nt, Human
aacauuccauagagugaagugguucaaauuuc

SEQ ID NO: 21629 - RNA, 32 nt, Human
aacauuccccuggaugaugcugugcaguucaa

SEQ ID NO: 21630 - RNA, 32 nt, Human
aacauuccucaaaaauacauacacucauacuu

SEQ ID NO: 21631 - RNA, 32 nt, Human
aacauuccucaagucuagccucaggagaccug

SEQ ID NO: 21632 - RNA, 32 nt, Human
aacauuccuuaaaucuucuccucuccagauau

SEQ ID NO: 21633 - RNA, 32 nt, Human
aacauuccuugcagaccccgcauugccuuugg

SEQ ID NO: 21634 - RNA, 32 nt, Human
aacauucgcuucucucaccaggaacauuuaug

SEQ ID NO: 21635 - RNA, 32 nt, Human
aacauucucaacaagaugaauugauggcggau

SEQ ID NO: 21636 - RNA, 32 nt, Human
aacauucucugcaagugucuguuauuagagaa

SEQ ID NO: 21637 - RNA, 32 nt, Human
aacauucugauuuuacauguaaaacaagaaaa

SEQ ID NO: 21638 - RNA, 32 nt, Human
aacauucugguuuccuccuuccuugaaguccc

SEQ ID NO: 21639 - RNA, 32 nt, Human
aacauucuugcuauaacugucucuccaagacc

SEQ ID NO: 21640 - RNA, 32 nt, Human
aacauucuuuccugccagaguucuaagaaucu

SEQ ID NO: 21641 - RNA, 32 nt, Human
aacauugaacccaggaggcggagcuugcagug

SEQ ID NO: 21642 - RNA, 32 nt, Human
aacauugaguccuguuuuccauuggcuucagg

SEQ ID NO: 21643 - RNA, 32 nt, Human
aacauugaugaacauccgaaacuacaacgugg

SEQ ID NO: 21644 - RNA, 32 nt, Human
aacauugcagagcuaagcagucgugguauggg

SEQ ID NO: 21645 - RNA, 26 nt, Human
aacauugccuaagcccuugccugcug

SEQ ID NO: 21646 - RNA, 32 nt, Human
aacauugcgguauccaugauuuggccuugugg

SEQ ID NO: 21647 - RNA, 20 nt, Human
aacauugcucaccugggccc

SEQ ID NO: 21648 - RNA, 32 nt, Human
aacauugcucagcuccagccugauauggaggc

SEQ ID NO: 21649 - RNA, 32 nt, Human
aacauuggcacugaggccagauggccuugggu

SEQ ID NO: 21650 - RNA, 32 nt, Human
aacauuggcaggaguccagaccacuuuuuguc

SEQ ID NO: 21651 - RNA, 32 nt, Human
aacauugggaaucaugguuuguuugcauuagu

SEQ ID NO: 21652 - RNA, 32 nt, Human
aacauuggggccuucuuaacaaaagucuuuga

SEQ ID NO: 21653 - RNA, 32 nt, Human
aacauugguauauuuccauucaugccaaagca

SEQ ID NO: 21654 - RNA, 32 nt, Human
aacauuguaaggacuaugaguccuccauuuuu

SEQ ID NO: 21655 - RNA, 32 nt, Human
aacauugucaugacaugagaagagacucugcu

SEQ ID NO: 21656 - RNA, 32 nt, Human
aacauugugauaauccuucacagcaagaaacc

SEQ ID NO: 21657 - RNA, 32 nt, Human
aacauuguucuuuuucugccuuccgacucaaa

SEQ ID NO: 21658 - RNA, 32 nt, Human
aacauuuaaaaagggauugggguugaaaauca

SEQ ID NO: 21659 - RNA, 32 nt, Human
aacauuuacauacaguuuugcucuucuauaca

SEQ ID NO: 21660 - RNA, 32 nt, Human
aacauuuacccacuuugugaaugggcugccug

SEQ ID NO: 21661 - RNA, 32 nt, Human
aacauuuagauguuuaguccaacugaaauuug

SEQ ID NO: 21662 - RNA, 32 nt, Human
aacauuuaguuuaaacccaagaaggacacuaa

SEQ ID NO: 21663 - RNA, 32 nt, Human
aacauuuauuaaaaauauaagagcauagagca

SEQ ID NO: 21664 - RNA, 32 nt, Human
aacauuucaguaggguucaagguggucccaaa

SEQ ID NO: 21665 - RNA, 32 nt, Human
aacauuucauccguguguauguguaugugugu

SEQ ID NO: 21666 - RNA, 32 nt, Human
aacauuucaucuauuaucucugccucauuucu

SEQ ID NO: 21667 - RNA, 32 nt, Human
aacauuucauucuucagccuguggaccugcuu

SEQ ID NO: 21668 - RNA, 32 nt, Human
aacauuucauuucccacccacacucgccagcu

SEQ ID NO: 21669 - RNA, 32 nt, Human
aacauuucuaaggugucccaagcccuggaaau

SEQ ID NO: 21670 - RNA, 32 nt, Human
aacauuucucagacaauguugaugcuacugau

SEQ ID NO: 21671 - RNA, 32 nt, Human
aacauuucuccccucacucccuugcugguguc

SEQ ID NO: 21672 - RNA, 21 nt, Human
aacauuugagggagccuuggg

SEQ ID NO: 21673 - RNA, 26 nt, Human
aacauuugcagccacacauguacaua

SEQ ID NO: 21674 - RNA, 32 nt, Human
aacauuugccugaauacuauggcuaagcauca

SEQ ID NO: 21675 - RNA, 32 nt, Human
aacauuugccuuuaggcuguucuuugagguau

SEQ ID NO: 21676 - RNA, 32 nt, Human
aacauuugcuuugcuuucugcugaaucccuaa

SEQ ID NO: 21677 - RNA, 32 nt, Human
aacauuuggcccugagccagcagaucaagcaa

SEQ ID NO: 21678 - RNA, 32 nt, Human
aacauuuggguugaugaggcagaggggauuca

SEQ ID NO: 21679 - RNA, 32 nt, Human
aacauuuguccacccugagagaacucugagca

SEQ ID NO: 21680 - RNA, 32 nt, Human
aacauuugugcagaaauuugaaugacaagauu

SEQ ID NO: 21681 - RNA, 32 nt, Human
aacauuuguuuagcuugcuuggcuuuaauuau

SEQ ID NO: 21682 - RNA, 32 nt, Human
aacauuuuacugaugugaacauucuagaugac

SEQ ID NO: 21683 - RNA, 32 nt, Human
aacauuuuaucugagaaggaaggaaggucaga

SEQ ID NO: 21684 - RNA, 32 nt, Human
aacauuuucagaagcaagugcauaaccuucuc

SEQ ID NO: 21685 - RNA, 32 nt, Human
aacauuuucagagauacagcuucuuauaguaa

SEQ ID NO: 21686 - RNA, 32 nt, Human
aacauuuuccaaauuguuuauuacuauugcuu

SEQ ID NO: 21687 - RNA, 32 nt, Human
aacauuuuccuuccaccucuuugaccuucccu

SEQ ID NO: 21688 - RNA, 32 nt, Human
aacauuuucuguaaagggccagauaguaaaua

SEQ ID NO: 21689 - RNA, 32 nt, Human
aacauuuucuguguguacauguacaugcauuu

SEQ ID NO: 21690 - RNA, 32 nt, Human
aacauuuucuucuucucucucuuaacuucaca

SEQ ID NO: 21691 - RNA, 32 nt, Human
aacauuuucuuuuauuguuacuugcuuuuuaa

SEQ ID NO: 21692 - RNA, 32 nt, Human
aacauuuugaccaaaaauccacacuauaugua

SEQ ID NO: 21693 - RNA, 32 nt, Human
aacauuuuggaggugcaucugcuaugugacau

SEQ ID NO: 21694 - RNA, 32 nt, Human
aacauuuugucuuugaccacugucuuuugaau

SEQ ID NO: 21695 - RNA, 32 nt, Human
aacauuuuucagggcaaggcuuuugcuacugg

SEQ ID NO: 21696 - RNA, 32 nt, Human
aacauuuuugguggucuuuaaugugauggaca

SEQ ID NO: 21697 - RNA, 32 nt, Human
aaccaaaaaggaacccagcaauucccaagugu

SEQ ID NO: 21698 - RNA, 22 nt, Human
aaccaaaacaaaauuaaugaaa

SEQ ID NO: 21699 - RNA, 32 nt, Human
aaccaaaacccaaaggcucuuuucagagccaa

SEQ ID NO: 21700 - RNA, 32 nt, Human
aaccaaaagagcuuucccucccucacuuuuuc

SEQ ID NO: 21701 - RNA, 32 nt, Human
aaccaaaauuggccuuuuucucccucuuaaua

SEQ ID NO: 21702 - RNA, 32 nt, Human
aaccaaacagcaguucauauaccugccugaga

SEQ ID NO: 21703 - RNA, 32 nt, Human
aaccaaaccaauucaccaacacaguugggacc

SEQ ID NO: 21704 - RNA, 23 nt, Human
aaccaaacucugugucagcaucu

SEQ ID NO: 21705 - RNA, 32 nt, Human
aaccaaagacacuguccccacagcaggugccu

SEQ ID NO: 21706 - RNA, 32 nt, Human
aaccaaagcaagaaaggauccugcaugaguca

SEQ ID NO: 21707 - RNA, 32 nt, Human
aaccaaagcggugcauggcaaugugauagggg

SEQ ID NO: 21708 - RNA, 32 nt, Human
aaccaaaggacuaggagucaggagaacaaguc

SEQ ID NO: 21709 - RNA, 32 nt, Human
aaccaaaggcugccacugcaugcagcuguccc

SEQ ID NO: 21710 - RNA, 32 nt, Human
aaccaaagucaagaaaggcugaauaagaaaaa

SEQ ID NO: 21711 - RNA, 32 nt, Human
aaccaaaguguugucaggccaacugaaugaug

SEQ ID NO: 21712 - RNA, 25 nt, Human
aaccaaauccuguugucagcaaucu

SEQ ID NO: 21713 - RNA, 32 nt, Human
aaccaaaucuuagaaucacuucauuuaaaaua

SEQ ID NO: 21714 - RNA, 32 nt, Human
aaccaaauguuacugcucaacugaaauaugag

SEQ ID NO: 21715 - RNA, 32 nt, Human
aaccaaauugcuugcagcuaggaggaccuuga

SEQ ID NO: 21716 - RNA, 32 nt, Human
aaccaaauuggucuuaaaaaugauguuaaccc

SEQ ID NO: 21717 - RNA, 32 nt, Human
aaccaaauuuuaucuuuuacauggccccuuug

SEQ ID NO: 21718 - RNA, 32 nt, Human
aaccaacacugcuuuuaauccucuuuuaaugu

SEQ ID NO: 21719 - RNA, 32 nt, Human
aaccaacaucucuaucaucccaaaaaguucuc

SEQ ID NO: 21720 - RNA, 32 nt, Human
aaccaacauggugaaaccccgucucuacaaaa

SEQ ID NO: 21721 - RNA, 32 nt, Human
aaccaacauggugaaaccccgucucuccuaaa

SEQ ID NO: 21722 - RNA, 32 nt, Human
aaccaacauggugaaaccucgugucuacuaaa

SEQ ID NO: 21723 - RNA, 32 nt, Human
aaccaacauucaaauucugccucaucuggagg

SEQ ID NO: 21724 - RNA, 32 nt, Human
aaccaaccaaccaaccaacaaacaaacacaga

SEQ ID NO: 21725 - RNA, 32 nt, Human
aaccaaccaaccaaccaaccaaacuucccucu

SEQ ID NO: 21726 - RNA, 32 nt, Human
aaccaaccaaccaaccaaccaacaaacaaaca

SEQ ID NO: 21727 - RNA, 32 nt, Human
aaccaaccaaccaaccaaccaaccaacaaaca

SEQ ID NO: 21728 - RNA, 32 nt, Human
aaccaaccaaccaaccaaccaaccacaaacca

SEQ ID NO: 21729 - RNA, 32 nt, Human
aaccaaccaagaggaggagaaagaugacccag

SEQ ID NO: 21730 - RNA, 32 nt, Human
aaccaaccaucccauuuuagcauugagagcau

SEQ ID NO: 21731 - RNA, 32 nt, Human
aaccaaccccuaaaaucauuuucuuauuguac

SEQ ID NO: 21732 - RNA, 32 nt, Human
aaccaaccgaaaaagacuagagggauuaguac

SEQ ID NO: 21733 - RNA, 32 nt, Human
aaccaaccuccaccuccuccuuccauuuugac

SEQ ID NO: 21734 - RNA, 32 nt, Human
aaccaaccugccuggcagaggugcagaaauuu

SEQ ID NO: 21735 - RNA, 32 nt, Human
aaccaaccuugggagcugugugccaguuccag

SEQ ID NO: 21736 - RNA, 32 nt, Human
aaccaacuccaccaaccucuggcucuuaaaua

SEQ ID NO: 21737 - RNA, 32 nt, Human
aaccaacuccaccaaccucuggcucuuacaua

SEQ ID NO: 21738 - RNA, 32 nt, Human
aaccaacucuuaggccugcucuuuacuaggga

SEQ ID NO: 21739 - RNA, 32 nt, Human
aaccaagagcucaggucacacagaccuuggag

SEQ ID NO: 21740 - RNA, 32 nt, Human
aaccaagaucaugccacugaacuccagccugg

SEQ ID NO: 21741 - RNA, 32 nt, Human
aaccaagauuaccugaguccaaguuuuaauaa

SEQ ID NO: 21742 - RNA, 32 nt, Human
aaccaagauucucugcuuuugcacugaaauua

SEQ ID NO: 21743 - RNA, 32 nt, Human
aaccaagcaccuucuagguccuaggauaggug

SEQ ID NO: 21744 - RNA, 32 nt, Human
aaccaagcacuuugacauuugcaccuuaggag

SEQ ID NO: 21745 - RNA, 32 nt, Human
aaccaagcaguugugcugagaauggcaccugg

SEQ ID NO: 21746 - RNA, 32 nt, Human
aaccaagcauuuucagucuuacaaagaaaucu

SEQ ID NO: 21747 - RNA, 32 nt, Human
aaccaagcuauuccuuucccuuccucuucggc

SEQ ID NO: 21748 - RNA, 32 nt, Human
aaccaagcugcagugggagcagccugggaccc

SEQ ID NO: 21749 - RNA, 32 nt, Human
aaccaaggagagaggaagggagcagguucaca

SEQ ID NO: 21750 - RNA, 32 nt, Human
aaccaaggaggcagagguuguaguaagcugac

SEQ ID NO: 21751 - RNA, 32 nt, Human
aaccaaggagguggagguugcagugagccggg

SEQ ID NO: 21752 - RNA, 32 nt, Human
aaccaaggaggugguuggacagcuggaggaug

SEQ ID NO: 21753 - RNA, 32 nt, Human
aaccaaggcacuccagccugggugacagagug

SEQ ID NO: 21754 - RNA, 32 nt, Human
aaccaaggccauguacagcugcagugaaggcu

SEQ ID NO: 21755 - RNA, 32 nt, Human
aaccaaggcccagcuggcagugcugaucgauc

SEQ ID NO: 21756 - RNA, 32 nt, Human
aaccaaggcuccaaaggcugaggucuccccag

SEQ ID NO: 21757 - RNA, 32 nt, Human
aaccaaggcuccccgugcuucuucccauugcu

SEQ ID NO: 21758 - RNA, 32 nt, Human
aaccaaggcucuaaaagaugauuucccuucug

SEQ ID NO: 21759 - RNA, 32 nt, Human
aaccaaggcugcagccgguugaaggccucacu

SEQ ID NO: 21760 - RNA, 32 nt, Human
aaccaagggaagcuccucugauucaccuagaa

SEQ ID NO: 21761 - RNA, 32 nt, Human
aaccaagggauuugugcucuucaucugugggu

SEQ ID NO: 21762 - RNA, 32 nt, Human
aaccaagggcaccuugcuuugcacugacgcaa

SEQ ID NO: 21763 - RNA, 32 nt, Human
aaccaagguggcagagguugcaguaagccaag

SEQ ID NO: 21764 - RNA, 32 nt, Human
aaccaaguacucugucuacaccagagggugcu

SEQ ID NO: 21765 - RNA, 32 nt, Human
aaccaagucauaaauugcuguaaucuuuccug

SEQ ID NO: 21766 - RNA, 32 nt, Human
aaccaagucaugugcauuuccacgucaacaga

SEQ ID NO: 21767 - RNA, 32 nt, Human
aaccaagucucuagguuccucuuaucagauau

SEQ ID NO: 21768 - RNA, 32 nt, Human
aaccaagugccuugagcugccugcucugcagc

SEQ ID NO: 21769 - RNA, 32 nt, Human
aaccaaguuuaagcccaccaaugcacugcuga

SEQ ID NO: 21770 - RNA, 32 nt, Human
aaccaaguuuuuaaaaagaugauucucugaua

SEQ ID NO: 21771 - RNA, 32 nt, Human
aaccaauaaacaguaaccuccaucaaaugcua

SEQ ID NO: 21772 - RNA, 32 nt, Human
aaccaauccccgggaaccucaggcccgcggau

SEQ ID NO: 21773 - RNA, 32 nt, Human
aaccaaucccuucacacucucucccccauccc

SEQ ID NO: 21774 - RNA, 32 nt, Human
aaccaaugaauggcuaauacugacauauucag

SEQ ID NO: 21775 - RNA, 32 nt, Human
aaccaaugcucacaccuuauugcacaggaaag

SEQ ID NO: 21776 - RNA, 32 nt, Human
aaccaaugcucugccucagggugcaaaugcca

SEQ ID NO: 21777 - RNA, 32 nt, Human
aaccaaugucauaacaggcauugccaaccuca

SEQ ID NO: 21778 - RNA, 32 nt, Human
aaccaaugugaggaggcuugagacaggguuau

SEQ ID NO: 21779 - RNA, 32 nt, Human
aaccaauguucucucuucuccaccucccacaa

SEQ ID NO: 21780 - RNA, 32 nt, Human
aaccaauuacucguccccgccauuccagggau

SEQ ID NO: 21781 - RNA, 32 nt, Human
aaccaauuucaccucugucuccaguaucacca

SEQ ID NO: 21782 - RNA, 32 nt, Human
aaccaauuuugucccauuucaccaggaugacu

SEQ ID NO: 21783 - RNA, 32 nt, Human
aaccacaaaacucaucuggaguucucaaagac

SEQ ID NO: 21784 - RNA, 18 nt, Human
aaccacaaacuuguuuua

SEQ ID NO: 21785 - RNA, 32 nt, Human
aaccacaagguggcagaagaacuccauucuug

SEQ ID NO: 21786 - RNA, 32 nt, Human
aaccacacacagucuccaacuucuaaacuaac

SEQ ID NO: 21787 - RNA, 32 nt, Human
aaccacaccacaucuaagccugaaggggcguc

SEQ ID NO: 21788 - RNA, 32 nt, Human
aaccacacugccugucauugugcuuuauguca

SEQ ID NO: 21789 - RNA, 32 nt, Human
aaccacagaccagaacugguugcauguuacuu

SEQ ID NO: 21790 - RNA, 32 nt, Human
aaccacagagcacuggcccuucauggcugagc

SEQ ID NO: 21791 - RNA, 32 nt, Human
aaccacagagccaggaggaaugucugagcaga

SEQ ID NO: 21792 - RNA, 32 nt, Human
aaccacagagccgccuugacagaagccagggc

SEQ ID NO: 21793 - RNA, 32 nt, Human
aaccacagaggaaggaugaggugggaugugga

SEQ ID NO: 21794 - RNA, 32 nt, Human
aaccacagaggaccugugacagcucugcagaa

SEQ ID NO: 21795 - RNA, 32 nt, Human
aaccacagccuauccucugcuccauuucacuc

SEQ ID NO: 21796 - RNA, 32 nt, Human
aaccacagccuauggggaacugcccuugacuc

SEQ ID NO: 21797 - RNA, 32 nt, Human
aaccacagugccaccaagcucacaccuguccu

SEQ ID NO: 21798 - RNA, 32 nt, Human
aaccacaguuauguaagcagguucugagaaaa

SEQ ID NO: 21799 - RNA, 32 nt, Human
aaccacauccccaggcauaacaccaccuuccc

SEQ ID NO: 21800 - RNA, 32 nt, Human
aaccacaucucccauaacugccccagcacauc

SEQ ID NO: 21801 - RNA, 32 nt, Human
aaccacaucugggucuaguagguggaucccau

SEQ ID NO: 21802 - RNA, 32 nt, Human
aaccacaucuucuucagggaucgauauggagu

SEQ ID NO: 21803 - RNA, 24 nt, Human
aaccaccaaaauugucuccagaca

SEQ ID NO: 21804 - RNA, 32 nt, Human
aaccaccaccaccacaauaaacaaguugcuga

SEQ ID NO: 21805 - RNA, 32 nt, Human
aaccaccaccaccaccaccaccccuacuaccc

SEQ ID NO: 21806 - RNA, 32 nt, Human
aaccaccaccaccaccaccgccgccaccacca

SEQ ID NO: 21807 - RNA, 32 nt, Human
aaccaccaccaccacccccacacccaccacuc

SEQ ID NO: 21808 - RNA, 32 nt, Human
aaccaccacgcccagcugguuccugaggaagu

SEQ ID NO: 21809 - RNA, 32 nt, Human
aaccaccaggcgcguccccgccggcuuggguc

SEQ ID NO: 21810 - RNA, 32 nt, Human
aaccaccaguaccaccaccacuacccacauca

SEQ ID NO: 21811 - RNA, 32 nt, Human
aaccaccaguccaagaaucuguuuaaguucag

SEQ ID NO: 21812 - RNA, 32 nt, Human
aaccaccagugaaauguguguguauacaauaa

SEQ ID NO: 21813 - RNA, 32 nt, Human
aaccaccaugggcaaggcagucucucucccag

SEQ ID NO: 21814 - RNA, 32 nt, Human
aaccacccaaguauuggugaugccaggccuca

SEQ ID NO: 21815 - RNA, 32 nt, Human
aaccacccagaacccagaaaaugcagauucac

SEQ ID NO: 21816 - RNA, 32 nt, Human
aaccacccagcccagaaguuccagggaaggaa

SEQ ID NO: 21817 - RNA, 32 nt, Human
aaccacccauccuccugccucccaccaccacc

SEQ ID NO: 21818 - RNA, 32 nt, Human
aaccacccccacucugcacucucccccucuau

SEQ ID NO: 21819 - RNA, 32 nt, Human
aaccaccccuccaccucuggaggucccaccag

SEQ ID NO: 21820 - RNA, 32 nt, Human
aaccacccuugagagaagaggcagcagcagcg

SEQ ID NO: 21821 - RNA, 32 nt, Human
aaccacccuuggaacuugccucuuguccugcu

SEQ ID NO: 21822 - RNA, 32 nt, Human
aaccaccgccaccaccaccaacaccgccacac

SEQ ID NO: 21823 - RNA, 32 nt, Human
aaccaccgcugccucuccuuccuccgcaugag

SEQ ID NO: 21824 - RNA, 32 nt, Human
aaccaccggaaguggcugucucagggauacug

SEQ ID NO: 21825 - RNA, 32 nt, Human
aaccaccgugccuggccaaagauguaauuuaa

SEQ ID NO: 21826 - RNA, 32 nt, Human
aaccaccuaggaaccugcuguugcucuaaggc

SEQ ID NO: 21827 - RNA, 32 nt, Human
aaccaccucccaaaggcugucauuucauugca

SEQ ID NO: 21828 - RNA, 32 nt, Human
aaccaccuccuggcuggacacagggcaaguug

SEQ ID NO: 21829 - RNA, 32 nt, Human
aaccaccucucugucuuuuuccuuccugagaa

SEQ ID NO: 21830 - RNA, 32 nt, Human
aaccaccugaucuccccuuggacuguacccuu

SEQ ID NO: 21831 - RNA, 32 nt, Human
aaccaccugcaggacccucacccauggugucc

SEQ ID NO: 21832 - RNA, 32 nt, Human
aaccaccuggggacucacguagcuggagagca

SEQ ID NO: 21833 - RNA, 32 nt, Human
aaccaccugucaucaaaacauggacagcaggg

SEQ ID NO: 21834 - RNA, 32 nt, Human
aaccaccuuuccagagagcaucagcccuccag

SEQ ID NO: 21835 - RNA, 32 nt, Human
aaccaccuuuccagccauagagauuuuaauua

SEQ ID NO: 21836 - RNA, 32 nt, Human
aaccacgaaacgcccagguggagggaguaagg

SEQ ID NO: 21837 - RNA, 32 nt, Human
aaccacgaccaccaccaccaccaccacucacc

SEQ ID NO: 21838 - RNA, 32 nt, Human
aaccacgcccagcuaauuuuuguauuuucggu

SEQ ID NO: 21839 - RNA, 32 nt, Human
aaccacgcccagcuaauuuuuguauuuuuagu

SEQ ID NO: 21840 - RNA, 32 nt, Human
aaccacgggcuggccuuacugcccuugagauc

SEQ ID NO: 21841 - RNA, 32 nt, Human
aaccacgggucugacacgucugagaugagcug

SEQ ID NO: 21842 - RNA, 32 nt, Human
aaccacguugggacagggaggugugaggcagg

SEQ ID NO: 21843 - RNA, 32 nt, Human
aaccacuagcacuuaaguacuccugauucuua

SEQ ID NO: 21844 - RNA, 32 nt, Human
aaccacuaggguaaacaaagcagcuauggcuu

SEQ ID NO: 21845 - RNA, 32 nt, Human
aaccacuaugugaagggugauuggagaaggac

SEQ ID NO: 21846 - RNA, 32 nt, Human
aaccacucacucuguguaaaggccaacagauu

SEQ ID NO: 21847 - RNA, 32 nt, Human
aaccacucacucuguguaaaggccaacggauu

SEQ ID NO: 21848 - RNA, 32 nt, Human
aaccacuccucauguaaucuuugccucucucu

SEQ ID NO: 21849 - RNA, 32 nt, Human
aaccacuccucuccucccaguggagugggguu

SEQ ID NO: 21850 - RNA, 32 nt, Human
aaccacucuaaaauuguuugguaaugucacuu

SEQ ID NO: 21851 - RNA, 32 nt, Human
aaccacucuccccagauccuggagaguggguu

SEQ ID NO: 21852 - RNA, 32 nt, Human
aaccacugacauuccuccauguccucacggcu

SEQ ID NO: 21853 - RNA, 32 nt, Human
aaccacugacccuuucugggccuguuuccuua

SEQ ID NO: 21854 - RNA, 32 nt, Human
aaccacugaguaugauguuggcucuaaguauu

SEQ ID NO: 21855 - RNA, 32 nt, Human
aaccacugcaauccagccugggcaacgagcaa

SEQ ID NO: 21856 - RNA, 32 nt, Human
aaccacugcacuccaaccugggcaacauggca

SEQ ID NO: 21857 - RNA, 32 nt, Human
aaccacugccaaggagugcggggguggcaaug

SEQ ID NO: 21858 - RNA, 32 nt, Human
aaccacugccgaguuucugccuggagcagggc

SEQ ID NO: 21859 - RNA, 19 nt, Human
aaccacugguauccagaga

SEQ ID NO: 21860 - RNA, 32 nt, Human
aaccacuggucuagcuagaccugcacugucca

SEQ ID NO: 21861 - RNA, 32 nt, Human
aaccacuguaguccagccugagugacagagug

SEQ ID NO: 21862 - RNA, 32 nt, Human
aaccacuguucccaaauugggaaaugucccag

SEQ ID NO: 21863 - RNA, 32 nt, Human
aaccacuuaccccuauugcucuucuuccuaaa

SEQ ID NO: 21864 - RNA, 32 nt, Human
aaccacuucuuagcuucauuuguucucauaac

SEQ ID NO: 21865 - RNA, 32 nt, Human
aaccacuugaaaagcuggaccaauagcaaggu

SEQ ID NO: 21866 - RNA, 32 nt, Human
aaccacuuugugaauacauauguguauauaag

SEQ ID NO: 21867 - RNA, 32 nt, Human
aaccacuuuucugaugucuucaaacaaacagc

SEQ ID NO: 21868 - RNA, 32 nt, Human
aaccagaaaaugugggaacucauucauucuug

SEQ ID NO: 21869 - RNA, 19 nt, Human
aaccagaaaugcaacaguu

SEQ ID NO: 21870 - RNA, 32 nt, Human
aaccagaaaugucuuaucucuaaaaauuuuua

SEQ ID NO: 21871 - RNA, 20 nt, Human
aaccagaaccugcaccacac

SEQ ID NO: 21872 - RNA, 20 nt, Human
aaccagaacucugcgcccca

SEQ ID NO: 21873 - RNA, 32 nt, Human
aaccagaagguggagguggcagugagccgaga

SEQ ID NO: 21874 - RNA, 32 nt, Human
aaccagaaguagcugggcauuggagucauggg

SEQ ID NO: 21875 - RNA, 32 nt, Human
aaccagaaguccugcaccugauuucccaucac

SEQ ID NO: 21876 - RNA, 32 nt, Human
aaccagaaguuagcaagagugcugcugguucc

SEQ ID NO: 21877 - RNA, 32 nt, Human
aaccagaauauauaaggaguucaaccaacucc

SEQ ID NO: 21878 - RNA, 32 nt, Human
aaccagaaucuuaauccuggagucuaggaauc

SEQ ID NO: 21879 - RNA, 32 nt, Human
aaccagaauucuccagcaacaugaggaggaaa

SEQ ID NO: 21880 - RNA, 32 nt, Human
aaccagacaaguguccuaggagagugaacagg

SEQ ID NO: 21881 - RNA, 32 nt, Human
aaccagacacaguaggacaaauauuguauagu

SEQ ID NO: 21882 - RNA, 32 nt, Human
aaccagacagcagccuugggugcaggcguggu

SEQ ID NO: 21883 - RNA, 32 nt, Human
aaccagacagcucgguuuuugccaccauuuau

SEQ ID NO: 21884 - RNA, 32 nt, Human
aaccagacccuccucagccucagccuucgaga

SEQ ID NO: 21885 - RNA, 32 nt, Human
aaccagaccucuacauuccauuuuggaagaag

SEQ ID NO: 21886 - RNA, 32 nt, Human
aaccagacucugugucuccucccaggugcuga

SEQ ID NO: 21887 - RNA, 32 nt, Human
aaccagacucuugccuguuucccaggcccacu

SEQ ID NO: 21888 - RNA, 32 nt, Human
aaccagacugcagaauggaggggugggaacuu

SEQ ID NO: 21889 - RNA, 32 nt, Human
aaccagacugccuuuuguccaguggcugucag

SEQ ID NO: 21890 - RNA, 32 nt, Human
aaccagacuuaucuugcaauaugagaaugcug

SEQ ID NO: 21891 - RNA, 32 nt, Human
aaccagagaaaaguuugaggcauuaaaagaag

SEQ ID NO: 21892 - RNA, 32 nt, Human
aaccagagagguggagguugcagugaaccgag

SEQ ID NO: 21893 - RNA, 32 nt, Human
aaccagagaucuguaaucaucucuauuggccu

SEQ ID NO: 21894 - RNA, 32 nt, Human
aaccagagaugacugaaaccacucugaaauaa

SEQ ID NO: 21895 - RNA, 32 nt, Human
aaccagagcagcugcauuuuuaucccauucau

SEQ ID NO: 21896 - RNA, 32 nt, Human
aaccagagccaaauacuuuugaagaguuuccc

SEQ ID NO: 21897 - RNA, 32 nt, Human
aaccagagcccccuaugggcucagugggcucc

SEQ ID NO: 21898 - RNA, 32 nt, Human
aaccagagcgcucagccagccugcuggacugg

SEQ ID NO: 21899 - RNA, 32 nt, Human
aaccagagcucauuggcuaucucuuccauguu

SEQ ID NO: 21900 - RNA, 32 nt, Human
aaccagaggaggaggaggacagagggagagaa

SEQ ID NO: 21901 - RNA, 32 nt, Human
aaccagaggucugguaucuacacuccuggugc

SEQ ID NO: 21902 - RNA, 32 nt, Human
aaccagagguggaggaagaacgguaggaaggc

SEQ ID NO: 21903 - RNA, 32 nt, Human
aaccagagucauaugcugcuaguagaauuuuu

SEQ ID NO: 21904 - RNA, 32 nt, Human
aaccagagugagagggcagauaggcaggauuc

SEQ ID NO: 21905 - RNA, 32 nt, Human
aaccagagugggcagaagcaucgagagcguga

SEQ ID NO: 21906 - RNA, 32 nt, Human
aaccagaugcagagggaacagccuggccuaga

SEQ ID NO: 21907 - RNA, 32 nt, Human
aaccagaugcccagagccggcaggagcaggac

SEQ ID NO: 21908 - RNA, 32 nt, Human
aaccagaugcccaggacaggugcucuagccau

SEQ ID NO: 21909 - RNA, 32 nt, Human
aaccagauguuacuggggccaagcuaggaugg

SEQ ID NO: 21910 - RNA, 32 nt, Human
aaccagcaacccagacuuccacuggcaacucu

SEQ ID NO: 21911 - RNA, 31 nt, Human
aaccagcaacuuuucucauguguuuggaguu

SEQ ID NO: 21912 - RNA, 32 nt, Human
aaccagcaagaacacuuggaaugaacgaauga

SEQ ID NO: 21913 - RNA, 32 nt, Human
aaccagcaauggaggagcagccccagaugcaa

SEQ ID NO: 21914 - RNA, 32 nt, Human
aaccagcacagauguucugaacugaauggugu

SEQ ID NO: 21915 - RNA, 32 nt, Human
aaccagcacuccaucacugagagcccgacuuc

SEQ ID NO: 21916 - RNA, 32 nt, Human
aaccagcacugcccuggcgcuucauagguucu

SEQ ID NO: 21917 - RNA, 32 nt, Human
aaccagcagcagagccagggcccagggaccag

SEQ ID NO: 21918 - RNA, 32 nt, Human
aaccagcagcuguuccucagguugugacucac

SEQ ID NO: 21919 - RNA, 31 nt, Human
aaccagcagugcuaguaacuaccucacagag

SEQ ID NO: 21920 - RNA, 32 nt, Human
aaccagcaucccaguucucaggagacauggau

SEQ ID NO: 21921 - RNA, 32 nt, Human
aaccagcauggaaaacagauuagguuagaugu

SEQ ID NO: 21922 - RNA, 32 nt, Human
aaccagcauucaacaacaaauuuuggaaccua

SEQ ID NO: 21923 - RNA, 32 nt, Human
aaccagcauucucuuauuaauucuuuaaacug

SEQ ID NO: 21924 - RNA, 32 nt, Human
aaccagccaccuacugcugaagucucuuguaa

SEQ ID NO: 21925 - RNA, 32 nt, Human
aaccagccacugcagcccuccagcucuggccc

SEQ ID NO: 21926 - RNA, 32 nt, Human
aaccagcccaauagaaguacagagccagcuga

SEQ ID NO: 21927 - RNA, 32 nt, Human
aaccagcccacugucaccccuaauuuacagac

SEQ ID NO: 21928 - RNA, 32 nt, Human
aaccagcccagccgcugccucuugccgcuccg

SEQ ID NO: 21929 - RNA, 32 nt, Human
aaccagccccucccccugccccaccuccuccc

SEQ ID NO: 21930 - RNA, 32 nt, Human
aaccagccucacaagaacaucaacaucaccuu

SEQ ID NO: 21931 - RNA, 32 nt, Human
aaccagccucagaucagggcccugccacccag

SEQ ID NO: 21932 - RNA, 32 nt, Human
aaccagccucuucagccucacacccauucccc

SEQ ID NO: 21933 - RNA, 32 nt, Human
aaccagccugggagggagaagccucgguuacc

SEQ ID NO: 21934 - RNA, 32 nt, Human
aaccagccugggagucagggaggacucuucag

SEQ ID NO: 21935 - RNA, 32 nt, Human
aaccagccuggggccuuccuggcuuugggagu

SEQ ID NO: 21936 - RNA, 25 nt, Human
aaccagccugggugacagagggaga

SEQ ID NO: 21937 - RNA, 32 nt, Human
aaccagccugggugcccggugcaguggcucau

SEQ ID NO: 21938 - RNA, 32 nt, Human
aaccagccugguccacugggaacucaaaagcc

SEQ ID NO: 21939 - RNA, 32 nt, Human
aaccagccuuugcuguagcacacacauauauc

SEQ ID NO: 21940 - RNA, 31 nt, Human
aaccagccuuuucagcaucucacccauuagc

SEQ ID NO: 21941 - RNA, 32 nt, Human
aaccagcgggugggcaucuuccccagcaacua

SEQ ID NO: 21942 - RNA, 32 nt, Human
aaccagcuaucccucuggaaugcagcugacca

SEQ ID NO: 21943 - RNA, 32 nt, Human
aaccagcucacauggagaaucagagaauggga

SEQ ID NO: 21944 - RNA, 32 nt, Human
aaccagcucacugcagccuugaccuccugggc

SEQ ID NO: 21945 - RNA, 23 nt, Human
aaccagcugagacagggcgccac

SEQ ID NO: 21946 - RNA, 32 nt, Human
aaccagcugcacagcaggagaguuacugugga

SEQ ID NO: 21947 - RNA, 19 nt, Human
aaccagcuucacccaggag

SEQ ID NO: 21948 - RNA, 32 nt, Human
aaccagcuucgaguuacuuucccuucaagggg

SEQ ID NO: 21949 - RNA, 18 nt, Human
aaccagcuuugcucgagu

SEQ ID NO: 21950 - RNA, 32 nt, Human
aaccaggaaaacuuccuugucuuauuacuuua

SEQ ID NO: 21951 - RNA, 32 nt, Human
aaccaggaaauccugccaucuccgccuuuauu

SEQ ID NO: 21952 - RNA, 32 nt, Human
aaccaggaaaugggucagggaggagaaacaaa

SEQ ID NO: 21953 - RNA, 32 nt, Human
aaccaggaagcauugcuuuuggacaaggaaga

SEQ ID NO: 21954 - RNA, 23 nt, Human
aaccaggaaggcagagauugcag

SEQ ID NO: 21955 - RNA, 32 nt, Human
aaccaggaaggcagagauugcagugagcugag

SEQ ID NO: 21956 - RNA, 32 nt, Human
aaccaggaaggcagagguugcacugagcugag

SEQ ID NO: 21957 - RNA, 32 nt, Human
aaccaggacagaggcugcagcacccagggagg

SEQ ID NO: 21958 - RNA, 32 nt, Human
aaccaggacagcugugugugcagaccucaugu

SEQ ID NO: 21959 - RNA, 32 nt, Human
aaccaggacaugacccucccccacccugcucg

SEQ ID NO: 21960 - RNA, 32 nt, Human
aaccaggagacggagguugcagugagcugaaa

SEQ ID NO: 21961 - RNA, 32 nt, Human
aaccaggagauccugcaucgaugaaucccaga

SEQ ID NO: 21962 - RNA, 32 nt, Human
aaccaggagccucaagugacagccaggaagag

SEQ ID NO: 21963 - RNA, 32 nt, Human
aaccaggagcugcucacuaccuccucagggau

SEQ ID NO: 21964 - RNA, 32 nt, Human
aaccaggaggagguggcugcugugccccaacc

SEQ ID NO: 21965 - RNA, 25 nt, Human
aaccaggaggcggaggcugcaguga

SEQ ID NO: 21966 - RNA, 32 nt, Human
aaccaggaggcugaggcaggagaaucacuuga

SEQ ID NO: 21967 - RNA, 32 nt, Human
aaccaggagguggacguugcagugaucccaga

SEQ ID NO: 21968 - RNA, 32 nt, Human
aaccaggagguuugggguuaagagauacucaa

SEQ ID NO: 21969 - RNA, 32 nt, Human
aaccaggaucugucagcgcagccccagugcug

SEQ ID NO: 21970 - RNA, 32 nt, Human
aaccaggaugauaagacacauggagcagagcc

SEQ ID NO: 21971 - RNA, 32 nt, Human
aaccaggauggaaacuucuucccugccuuacc

SEQ ID NO: 21972 - RNA, 32 nt, Human
aaccaggauggggagguugcagugagccgaga

SEQ ID NO: 21973 - RNA, 32 nt, Human
aaccaggauuccuuacuauugacagauuugcu

SEQ ID NO: 21974 - RNA, 32 nt, Human
aaccaggcacucucccuuucugucuuucuagu

SEQ ID NO: 21975 - RNA, 32 nt, Human
aaccaggcagguccugaaagcauuuuccauaa

SEQ ID NO: 21976 - RNA, 32 nt, Human
aaccaggccacauuccuuccaucgugcccuga

SEQ ID NO: 21977 - RNA, 32 nt, Human
aaccaggcccgcgccgccaccauguuucgaaa

SEQ ID NO: 21978 - RNA, 32 nt, Human
aaccaggccugggcuaggcugcagccugccuc

SEQ ID NO: 21979 - RNA, 32 nt, Human
aaccaggcuggcaaagccccacccucauggag

SEQ ID NO: 21980 - RNA, 32 nt, Human
aaccaggcugggucaggcucuuaauuucacua

SEQ ID NO: 21981 - RNA, 32 nt, Human
aaccagggaagcggagguugcagugagccgag

SEQ ID NO: 21982 - RNA, 32 nt, Human
aaccagggagaugagacauaccagggcugggc

SEQ ID NO: 21983 - RNA, 32 nt, Human
aaccagggagcuaucuggcaccuuuugugcuc

SEQ ID NO: 21984 - RNA, 32 nt, Human
aaccagggagcuuguuagaaauguagaaucug

SEQ ID NO: 21985 - RNA, 32 nt, Human
aaccagggaggaaagaagggagagggagguuc

SEQ ID NO: 21986 - RNA, 32 nt, Human
aaccagggaggaggagcuugcagugagccgag

SEQ ID NO: 21987 - RNA, 32 nt, Human
aaccagggaggcagagauugcagugagccgag

SEQ ID NO: 21988 - RNA, 32 nt, Human
aaccagggaggcagaggcugcggugagccgag

SEQ ID NO: 21989 - RNA, 32 nt, Human
aaccagggaggcagagguugcagugagcccag

SEQ ID NO: 21990 - RNA, 32 nt, Human
aaccagggaggcagagguugcagugagccgag

SEQ ID NO: 21991 - RNA, 32 nt, Human
aaccagggaggcagagguuguggugagccgag

SEQ ID NO: 21992 - RNA, 32 nt, Human
aaccagggaggcagaguuugcagugaauggag

SEQ ID NO: 21993 - RNA, 32 nt, Human
aaccagggaggcggagguugcagcaagccaag

SEQ ID NO: 21994 - RNA, 32 nt, Human
aaccagggaggcggagguugcagugagccgag

SEQ ID NO: 21995 - RNA, 32 nt, Human
aaccagggaggcggcgguuguggugagcugug

SEQ ID NO: 21996 - RNA, 32 nt, Human
aaccagggagguagagguugcagugagcugag

SEQ ID NO: 21997 - RNA, 26 nt, Human
aaccagggagguggagguugcaguga

SEQ ID NO: 21998 - RNA, 32 nt, Human
aaccagggagguggagguugcagugagccaag

SEQ ID NO: 21999 - RNA, 32 nt, Human
aaccagggagguggagguugcagugagccgag

SEQ ID NO: 22000 - RNA, 32 nt, Human
aaccagggagguggagguugcagugagcugag

SEQ ID NO: 22001 - RNA, 32 nt, Human
aaccagggagucagagguuucagugagccaag

SEQ ID NO: 22002 - RNA, 32 nt, Human
aaccagggagucggagauugcagugagcugag

SEQ ID NO: 22003 - RNA, 32 nt, Human
aaccagggaugcugagguugcacgagcugaga

SEQ ID NO: 22004 - RNA, 32 nt, Human
aaccagggcacaauaaauggugugauuggcuc

SEQ ID NO: 22005 - RNA, 32 nt, Human
aaccagggcagaaaggagggaggauucguccc

SEQ ID NO: 22006 - RNA, 32 nt, Human
aaccagggcugaguucagcccagcucugucca

SEQ ID NO: 22007 - RNA, 32 nt, Human
aaccagggcuugucuccuccugaacuugggcc

SEQ ID NO: 22008 - RNA, 32 nt, Human
aaccaggggcccugaucaggggacugagccgu

SEQ ID NO: 22009 - RNA, 32 nt, Human
aaccaggggcuucauuuucgcuuuucccugga

SEQ ID NO: 22010 - RNA, 32 nt, Human
aaccaggguauucuuuuuccaucccuagccau

SEQ ID NO: 22011 - RNA, 32 nt, Human
aaccaggguauucuuuuuccauccuuagccau

SEQ ID NO: 22012 - RNA, 32 nt, Human
aaccaggguggaagcgccaggagcagcugcag

SEQ ID NO: 22013 - RNA, 32 nt, Human
aaccaggucacauggaccacagugccagaucc

SEQ ID NO: 22014 - RNA, 32 nt, Human
aaccaggucaucuccccguugccaaguggguu

SEQ ID NO: 22015 - RNA, 32 nt, Human
aaccaggucauuugugcacagcccggaaggca

SEQ ID NO: 22016 - RNA, 32 nt, Human
aaccaggucccaagcuccauuggagaugacca

SEQ ID NO: 22017 - RNA, 32 nt, Human
aaccagguccugauuauggcaagcugccccac

SEQ ID NO: 22018 - RNA, 32 nt, Human
aaccagguuccaguccucucuggcagaagagc

SEQ ID NO: 22019 - RNA, 32 nt, Human
aaccagguuuaaauaggcucuacccuuaccuu

SEQ ID NO: 22020 - RNA, 32 nt, Human
aaccaguaaggagacuugaaauucagaaaauc

SEQ ID NO: 22021 - RNA, 32 nt, Human
aaccaguauccuucuagcucuccagucaggac

SEQ ID NO: 22022 - RNA, 25 nt, Human
aaccaguauuucauacaaacuugua

SEQ ID NO: 22023 - RNA, 32 nt, Human
aaccagucaccuuucuccuagguaaugaguag

SEQ ID NO: 22024 - RNA, 32 nt, Human
aaccagucagcccucuguggagucauugugcc

SEQ ID NO: 22025 - RNA, 32 nt, Human
aaccaguccagcuggggaaacugaggcucugg

SEQ ID NO: 22026 - RNA, 32 nt, Human
aaccagucugaaauaggauaaaagccaccaaa

SEQ ID NO: 22027 - RNA, 31 nt, Human
aaccagugacuucucugggccugggucuggg

SEQ ID NO: 22028 - RNA, 32 nt, Human
aaccaguggaccuggaauuggccaagggcuca

SEQ ID NO: 22029 - RNA, 32 nt, Human
aaccaguggcccaggggauguuacgguggaca

SEQ ID NO: 22030 - RNA, 32 nt, Human
aaccagugggacaaacugccuccuggagguuu

SEQ ID NO: 22031 - RNA, 32 nt, Human
aaccaguggggaaaaucccacagaaaucagua

SEQ ID NO: 22032 - RNA, 32 nt, Human
aaccaguggucugcaagaaggcuuguucuucc

SEQ ID NO: 22033 - RNA, 32 nt, Human
aaccagugucgaguuccaugcuggccccggca

SEQ ID NO: 22034 - RNA, 32 nt, Human
aaccagugucuucugccccucucccagcuguu

SEQ ID NO: 22035 - RNA, 32 nt, Human
aaccaguguggccgagguugcagugaguguag

SEQ ID NO: 22036 - RNA, 32 nt, Human
aaccaguucccuaccagugucuugucagcucu

SEQ ID NO: 22037 - RNA, 32 nt, Human
aaccaguugcugcugucauaccccuggcaggg

SEQ ID NO: 22038 - RNA, 32 nt, Human
aaccaguuucuaucccuuaccugcuuuucucu

SEQ ID NO: 22039 - RNA, 32 nt, Human
aaccaguuuucaucuuugaaagugccauuucu

SEQ ID NO: 22040 - RNA, 32 nt, Human
aaccauaaaauggacaacugagaauucuccca

SEQ ID NO: 22041 - RNA, 32 nt, Human
aaccauaacauacugugauucaucaaacagca

SEQ ID NO: 22042 - RNA, 32 nt, Human
aaccauaacauacugugauucaucaagcagca

SEQ ID NO: 22043 - RNA, 32 nt, Human
aaccauaagacaccuauccugcucuguuauuu

SEQ ID NO: 22044 - RNA, 22 nt, Human
aaccauaaugaaaaucaugaaa

SEQ ID NO: 22045 - RNA, 32 nt, Human
aaccauacauuuuccaagacucagggaacaca

SEQ ID NO: 22046 - RNA, 32 nt, Human
aaccauacucacaaccaucacagcagagguga

SEQ ID NO: 22047 - RNA, 32 nt, Human
aaccauagaagagaggaagaaaacaaagggca

SEQ ID NO: 22048 - RNA, 32 nt, Human
aaccauaggaagcuaauaugugcuccaucguu

SEQ ID NO: 22049 - RNA, 32 nt, Human
aaccauaucccuucuggcaauuuccuucucag

SEQ ID NO: 22050 - RNA, 32 nt, Human
aaccauaugaauguaaugaaugugggaaagcu

SEQ ID NO: 22051 - RNA, 32 nt, Human
aaccauauuuaguuguacaguaagagaaauuu

SEQ ID NO: 22052 - RNA, 32 nt, Human
aaccaucaacaucucugguguuuuaagauguu

SEQ ID NO: 22053 - RNA, 32 nt, Human
aaccaucacuagcucugguuucccaagauccu

SEQ ID NO: 22054 - RNA, 32 nt, Human
aaccaucagagcaguggcuggggcacuggaag

SEQ ID NO: 22055 - RNA, 32 nt, Human
aaccaucagccaugugcugcuauuucuagggc

SEQ ID NO: 22056 - RNA, 32 nt, Human
aaccaucaugcugugaggaagcccaagcuaac

SEQ ID NO: 22057 - RNA, 32 nt, Human
aaccaucauucugcguggaaaaaccuacagga

SEQ ID NO: 22058 - RNA, 32 nt, Human
aaccauccaccugacaccagcacaucaggccu

SEQ ID NO: 22059 - RNA, 32 nt, Human
aaccaucccuaggggagcagauuaaccuacca

SEQ ID NO: 22060 - RNA, 32 nt, Human
aaccauccuugccuucaguucucuccaauauu

SEQ ID NO: 22061 - RNA, 27 nt, Human
aaccaucucaauaaacacauuuuggac

SEQ ID NO: 22062 - RNA, 27 nt, Human
aaccaucucaauaaacacauuuuggau

SEQ ID NO: 22063 - RNA, 31 nt, Human
aaccaucucaauaaacacauuuuggauuaaa

SEQ ID NO: 22064 - RNA, 32 nt, Human
aaccaucuccaccauccaucuccagaaugacu

SEQ ID NO: 22065 - RNA, 32 nt, Human
aaccaucuccaccugccccagcuccugcaggg

SEQ ID NO: 22066 - RNA, 32 nt, Human
aaccaucucuauagguuccugacagggaagca

SEQ ID NO: 22067 - RNA, 32 nt, Human
aaccaucugcauguuuggauucugagcaaaga

SEQ ID NO: 22068 - RNA, 32 nt, Human
aaccaucugccuggaagaccugggcuucucag

SEQ ID NO: 22069 - RNA, 32 nt, Human
aaccaucuggggacugcugggaaaugcuguga

SEQ ID NO: 22070 - RNA, 32 nt, Human
aaccaucugugcugagccucuuugcaguccuc

SEQ ID NO: 22071 - RNA, 32 nt, Human
aaccaucuuugagguugcaaagcugcuguacu

SEQ ID NO: 22072 - RNA, 32 nt, Human
aaccaucuuuuccuugcugucucccuucuuuc

SEQ ID NO: 22073 - RNA, 32 nt, Human
aaccaugaaagagagccagagagcuuuuugca

SEQ ID NO: 22074 - RNA, 32 nt, Human
aaccaugaaugagagaugaagcuaaagaauag

SEQ ID NO: 22075 - RNA, 32 nt, Human
aaccaugacugaggcaggcauggaguugggcg

SEQ ID NO: 22076 - RNA, 21 nt, Human
aaccaugagaaauaaauuucu

SEQ ID NO: 22077 - RNA, 32 nt, Human
aaccaugagcugugaugaaauccaggcaacug

SEQ ID NO: 22078 - RNA, 32 nt, Human
aaccaugagcuucaccgucugucucuuccuuc

SEQ ID NO: 22079 - RNA, 32 nt, Human
aaccaugauugcacuccaaccugggcgacaga

SEQ ID NO: 22080 - RNA, 32 nt, Human
aaccaugauuguaccacuguauuccagccugg

SEQ ID NO: 22081 - RNA, 32 nt, Human
aaccaugcaagcccucccaccucccagggcuc

SEQ ID NO: 22082 - RNA, 32 nt, Human
aaccaugcagccaccaaccccagccaguguca

SEQ ID NO: 22083 - RNA, 32 nt, Human
aaccaugcaguuccuggugagggucagaaggg

SEQ ID NO: 22084 - RNA, 32 nt, Human
aaccaugcccgaguaauuuuuguauuuauuuu

SEQ ID NO: 22085 - RNA, 32 nt, Human
aaccaugcguagccugaguggcuggguagacg

SEQ ID NO: 22086 - RNA, 32 nt, Human
aaccaugcucagcuaauuuuucuauuuuuagu

SEQ ID NO: 22087 - RNA, 32 nt, Human
aaccaugcuggugauuggcaccgucauaaauc

SEQ ID NO: 22088 - RNA, 32 nt, Human
aaccaugcuuguuuaaccugcugguaaaauuc

SEQ ID NO: 22089 - RNA, 32 nt, Human
aaccauggagagugaagcagcacuuuuuggug

SEQ ID NO: 22090 - RNA, 32 nt, Human
aaccauggagugauguggagcuaggauuguga

SEQ ID NO: 22091 - RNA, 32 nt, Human
aaccauggaugagaaagaaaggagucaggggc

SEQ ID NO: 22092 - RNA, 32 nt, Human
aaccauggauucugccuuuggaccccucucua

SEQ ID NO: 22093 - RNA, 32 nt, Human
aaccauggccuacaggggccugguuuucuccc

SEQ ID NO: 22094 - RNA, 32 nt, Human
aaccauggccuuuccucaguguuguaaggccu

SEQ ID NO: 22095 - RNA, 32 nt, Human
aaccauggcucuucccagccuaggggaagccu

SEQ ID NO: 22096 - RNA, 32 nt, Human
aaccaugggcugcugcugucacucccucucca

SEQ ID NO: 22097 - RNA, 29 nt, Human
aaccauggggacugugcacgcccggaguu

SEQ ID NO: 22098 - RNA, 32 nt, Human
aaccauggguuaacaggaaaggcuaccuaacu

SEQ ID NO: 22099 - RNA, 32 nt, Human
aaccauggucaaaagaccauucuguccuaucc

SEQ ID NO: 22100 - RNA, 32 nt, Human
aaccauguaaagaacauaaauaacaaaucuca

SEQ ID NO: 22101 - RNA, 32 nt, Human
aaccauguauuuaaaaacuuuuuagugauuau

SEQ ID NO: 22102 - RNA, 32 nt, Human
aaccaugucaggaccaccuuccucuagagcuc

SEQ ID NO: 22103 - RNA, 32 nt, Human
aaccaugugaaccuggccagggcggugcgacg

SEQ ID NO: 22104 - RNA, 32 nt, Human
aaccaugugagcccggccggcccagccaggcc

SEQ ID NO: 22105 - RNA, 32 nt, Human
aaccaugugcaagucugugucuugucagucca

SEQ ID NO: 22106 - RNA, 32 nt, Human
aaccaugugcagcuaauuuuuguauuuuuagu

SEQ ID NO: 22107 - RNA, 32 nt, Human
aaccauguggagagaagguuugggagaacuuu

SEQ ID NO: 22108 - RNA, 21 nt, Human
aaccauguuuuuaacuugugg

SEQ ID NO: 22109 - RNA, 32 nt, Human
aaccauuaaagauguggagaaagaccaugguu

SEQ ID NO: 22110 - RNA, 32 nt, Human
aaccauuaacacagcacccuuucaagccaugc

SEQ ID NO: 22111 - RNA, 32 nt, Human
aaccauuaagccccaauagcuacaaggagggu

SEQ ID NO: 22112 - RNA, 32 nt, Human
aaccauuaaugaaaacuuuuucacaguugagu

SEQ ID NO: 22113 - RNA, 32 nt, Human
aaccauuagaguccagccugauugcacaaaug

SEQ ID NO: 22114 - RNA, 32 nt, Human
aaccauuaguaaaacauuuccuaaauagugcc

SEQ ID NO: 22115 - RNA, 32 nt, Human
aaccauucaaaaacucaggguguucgggauaa

SEQ ID NO: 22116 - RNA, 32 nt, Human
aaccauucacagacaccaaaucucuaggagaa

SEQ ID NO: 22117 - RNA, 32 nt, Human
aaccauuccauucgaaaagcacuuugaaaaau

SEQ ID NO: 22118 - RNA, 32 nt, Human
aaccauuccugcaucuuggggcucccugacuc

SEQ ID NO: 22119 - RNA, 32 nt, Human
aaccauuccuuucauagggauggcagugauuc

SEQ ID NO: 22120 - RNA, 32 nt, Human
aaccauucuacugugucaccuuugccauugag

SEQ ID NO: 22121 - RNA, 26 nt, Human
aaccauucuccugccucagccuccca

SEQ ID NO: 22122 - RNA, 32 nt, Human
aaccauucuccugccucagccucccagguagc

SEQ ID NO: 22123 - RNA, 26 nt, Human
aaccauucuccugccucagccucuca

SEQ ID NO: 22124 - RNA, 32 nt, Human
aaccauucugcuugguuccacaaucaucuauu

SEQ ID NO: 22125 - RNA, 32 nt, Human
aaccauugaggcucauacaauuuucaagcaac

SEQ ID NO: 22126 - RNA, 32 nt, Human
aaccauugauaccuccuggcugggugaggcgg

SEQ ID NO: 22127 - RNA, 32 nt, Human
aaccauuguacuccagccugggugacagagca

SEQ ID NO: 22128 - RNA, 32 nt, Human
aaccauuuauucagaaccauuaaaccaaugau

SEQ ID NO: 22129 - RNA, 32 nt, Human
aaccauuucaaucuucugccuccuggauaucu

SEQ ID NO: 22130 - RNA, 32 nt, Human
aaccauuugcauuucuuugucucagcuauauu

SEQ ID NO: 22131 - RNA, 32 nt, Human
aaccauuuucccccucacccuaacucucuuau

SEQ ID NO: 22132 - RNA, 32 nt, Human
aaccauuuuuccuucuaagccuccuggccugu

SEQ ID NO: 22133 - RNA, 32 nt, Human
aacccaaaaggcagacauugcagugagccaag

SEQ ID NO: 22134 - RNA, 32 nt, Human
aacccaaaaggcggagguugcagugagccaag

SEQ ID NO: 22135 - RNA, 32 nt, Human
aacccaaaccaccacaggugcuccuccugggg

SEQ ID NO: 22136 - RNA, 32 nt, Human
aacccaaacugccuuugccucagcuuuauggu

SEQ ID NO: 22137 - RNA, 32 nt, Human
aacccaaagccagcuguuccaggcuccagggg

SEQ ID NO: 22138 - RNA, 32 nt, Human
aacccaacaugccaccauguugacauaaguuc

SEQ ID NO: 22139 - RNA, 32 nt, Human
aacccaacccaaccuagcccagucccagccgc

SEQ ID NO: 22140 - RNA, 32 nt, Human
aacccaagaaguggagguugcagugagccaag

SEQ ID NO: 22141 - RNA, 32 nt, Human
aacccaagacaagccacauaaaagcaaccuaa

SEQ ID NO: 22142 - RNA, 32 nt, Human
aacccaagaggcagaggaugcaaugagccaag

SEQ ID NO: 22143 - RNA, 32 nt, Human
aacccaagaggcagagguugaguaagcugaga

SEQ ID NO: 22144 - RNA, 32 nt, Human
aacccaagaggcagagguugcagugaacugag

SEQ ID NO: 22145 - RNA, 32 nt, Human
aacccaagaggcagaguuugcagugagcugag

SEQ ID NO: 22146 - RNA, 32 nt, Human
aacccaagaggcggagguugagcuggaagagg

SEQ ID NO: 22147 - RNA, 32 nt, Human
aacccaagaggcggagguugaguaagcugaga

SEQ ID NO: 22148 - RNA, 32 nt, Human
aacccaagaggcggagguugcagugagccaag

SEQ ID NO: 22149 - RNA, 32 nt, Human
aacccaagaggcggagguuguggugagccgag

SEQ ID NO: 22150 - RNA, 32 nt, Human
aacccaagagguccaaggcugcagugagccau

SEQ ID NO: 22151 - RNA, 32 nt, Human
aacccaagaggucgaggcugcagugagccaag

SEQ ID NO: 22152 - RNA, 32 nt, Human
aacccaagagguggaggcugaagugagccaag

SEQ ID NO: 22153 - RNA, 32 nt, Human
aacccaagagguggagguugcggugagccaag

SEQ ID NO: 22154 - RNA, 32 nt, Human
aacccaagauggccaggaacugcucugagugc

SEQ ID NO: 22155 - RNA, 32 nt, Human
aacccaagcaugauucacaaaggggcuggcaa

SEQ ID NO: 22156 - RNA, 32 nt, Human
aacccaaggugcugugcuccaucaucgccggu

SEQ ID NO: 22157 - RNA, 32 nt, Human
aacccaagucuccugacuccuggccuucuaug

SEQ ID NO: 22158 - RNA, 23 nt, Human
aacccaagugcugcacaaaagca

SEQ ID NO: 22159 - RNA, 32 nt, Human
aacccaaucuucuccccugacaccaguagaga

SEQ ID NO: 22160 - RNA, 32 nt, Human
aacccaaugagguugagauauaggcuacucuu

SEQ ID NO: 22161 - RNA, 32 nt, Human
aacccaaugccucccuuugcuccuggaugccc

SEQ ID NO: 22162 - RNA, 32 nt, Human
aacccacaaucaggaggcaacccuggccugca

SEQ ID NO: 22163 - RNA, 23 nt, Human
aacccacaccccacaucccccug

SEQ ID NO: 22164 - RNA, 32 nt, Human
aacccacaccccacaucccccugccggcagcc

SEQ ID NO: 22165 - RNA, 32 nt, Human
aacccacagaccucacaccugggggacagagg

SEQ ID NO: 22166 - RNA, 32 nt, Human
aacccacagagggaggggaggggcugagcugu

SEQ ID NO: 22167 - RNA, 32 nt, Human
aacccacagcagucgcagaaugagcaccuggc

SEQ ID NO: 22168 - RNA, 32 nt, Human
aacccacagccugucucuucucuuguuuaguu

SEQ ID NO: 22169 - RNA, 22 nt, Human
aacccacaggcggagguugcgg

SEQ ID NO: 22170 - RNA, 32 nt, Human
aacccacaggcggagguugcggugggcugggg

SEQ ID NO: 22171 - RNA, 32 nt, Human
aacccacagggcagaggucacagugagccaag

SEQ ID NO: 22172 - RNA, 32 nt, Human
aacccacagugccaggcaacccuucagaaagg

SEQ ID NO: 22173 - RNA, 32 nt, Human
aacccaccaagugccugugugcagccuccugu

SEQ ID NO: 22174 - RNA, 32 nt, Human
aacccaccacaggccuggcacauuguguaugu

SEQ ID NO: 22175 - RNA, 32 nt, Human
aacccaccaggccaacugggaauuagaauuga

SEQ ID NO: 22176 - RNA, 32 nt, Human
aacccaccauggugcugucuccugccgacaag

SEQ ID NO: 22177 - RNA, 32 nt, Human
aacccacccagacugcaguucccuccccaccc

SEQ ID NO: 22178 - RNA, 32 nt, Human
aacccacccaggaaguggccuccagccucccu

SEQ ID NO: 22179 - RNA, 32 nt, Human
aacccacccucuuuaccaaccccuuucuccuc

SEQ ID NO: 22180 - RNA, 32 nt, Human
aacccaccuccuacuccuggcucagaccuuug

SEQ ID NO: 22181 - RNA, 32 nt, Human
aacccaccucucucaccccacauucauauccc

SEQ ID NO: 22182 - RNA, 32 nt, Human
aacccaccucucuuuucugucauucuccaacu

SEQ ID NO: 22183 - RNA, 23 nt, Human
aacccaccuggagacgcaguuca

SEQ ID NO: 22184 - RNA, 32 nt, Human
aacccaccugggacggcagugaggaugagcac

SEQ ID NO: 22185 - RNA, 32 nt, Human
aacccacgcagucaccccagagggcagggcua

SEQ ID NO: 22186 - RNA, 32 nt, Human
aacccacucacaccaauccagugaccgugugu

SEQ ID NO: 22187 - RNA, 32 nt, Human
aacccacucacacccacccucaguggcuucuu

SEQ ID NO: 22188 - RNA, 32 nt, Human
aacccacugaacacuaauuaugagcccugucu

SEQ ID NO: 22189 - RNA, 32 nt, Human
aacccacugguuucaaccaguucaggaaugag

SEQ ID NO: 22190 - RNA, 32 nt, Human
aacccacugucaccccuccgacucaccggcaa

SEQ ID NO: 22191 - RNA, 32 nt, Human
aacccacugugggcagcaucuaagccaugucc

SEQ ID NO: 22192 - RNA, 32 nt, Human
aacccagaaagcggagguugcagugaccuggg

SEQ ID NO: 22193 - RNA, 32 nt, Human
aacccagaaaugcugagucaggguggccaaga

SEQ ID NO: 22194 - RNA, 32 nt, Human
aacccagaaccagacacucaggcuccagccac

SEQ ID NO: 22195 - RNA, 32 nt, Human
aacccagaagcggagguugcagugagcugaga

SEQ ID NO: 22196 - RNA, 32 nt, Human
aacccagaaggcagagguugcagugagcugag

SEQ ID NO: 22197 - RNA, 32 nt, Human
aacccagaaggcagggguugcagugagccaag

SEQ ID NO: 22198 - RNA, 32 nt, Human
aacccagaaggcggaaguugcagugagccgag

SEQ ID NO: 22199 - RNA, 32 nt, Human
aacccagaaggcggaaguugcagugagcugag

SEQ ID NO: 22200 - RNA, 32 nt, Human
aacccagaaggugcagguugcagugagcugag

SEQ ID NO: 22201 - RNA, 32 nt, Human
aacccagaagguggagguagcagugagccgag

SEQ ID NO: 22202 - RNA, 32 nt, Human
aacccagaagguggagguugcagugagccgag

SEQ ID NO: 22203 - RNA, 32 nt, Human
aacccagaagucagaacacaucuaccuccugg

SEQ ID NO: 22204 - RNA, 32 nt, Human
aacccagaaugacugauuaagugccuugcgaa

SEQ ID NO: 22205 - RNA, 32 nt, Human
aacccagagaaaugacaauguugcaucaauua

SEQ ID NO: 22206 - RNA, 32 nt, Human
aacccagagcagcuccacgugagagcauuaaa

SEQ ID NO: 22207 - RNA, 32 nt, Human
aacccagagcuggugugcgcgugcgcugucug

SEQ ID NO: 22208 - RNA, 32 nt, Human
aacccagaggcccgcgcucugaaggugacccc

SEQ ID NO: 22209 - RNA, 25 nt, Human
aacccagaggcggagguuguaguga

SEQ ID NO: 22210 - RNA, 32 nt, Human
aacccagaggcggagguuguagugagccgaaa

SEQ ID NO: 22211 - RNA, 32 nt, Human
aacccagauagcagagguugcagugagcugag

SEQ ID NO: 22212 - RNA, 32 nt, Human
aacccagaugaggcucaucaggaacagaucuu

SEQ ID NO: 22213 - RNA, 23 nt, Human
aacccagauuauccaaagagaga

SEQ ID NO: 22214 - RNA, 32 nt, Human
aacccagcaagucaaggccaggaggaccaggg

SEQ ID NO: 22215 - RNA, 32 nt, Human
aacccagcagauggagguugcagugagccaag

SEQ ID NO: 22216 - RNA, 32 nt, Human
aacccagcaggcagagguugcagugagccaag

SEQ ID NO: 22217 - RNA, 26 nt, Human
aacccagcaggcggagguugcgguga

SEQ ID NO: 22218 - RNA, 32 nt, Human
aacccagcaggcggagguugcggugagucgag

SEQ ID NO: 22219 - RNA, 32 nt, Human
aacccagcaucauguggcucagucucugauug

SEQ ID NO: 22220 - RNA, 32 nt, Human
aacccagcauuuucggcaaccgcugcuggcag

SEQ ID NO: 22221 - RNA, 32 nt, Human
aacccagccagccucauacucggagcccggcc

SEQ ID NO: 22222 - RNA, 32 nt, Human
aacccagccugaccccugagagcugccccgug

SEQ ID NO: 22223 - RNA, 32 nt, Human
aacccagcgagaaaggaggggaagccccuucu

SEQ ID NO: 22224 - RNA, 32 nt, Human
aacccagcgggaagagguugcagugagccaag

SEQ ID NO: 22225 - RNA, 32 nt, Human
aacccagcuacucaggagguuggggcagaauu

SEQ ID NO: 22226 - RNA, 31 nt, Human
aacccagcuacucgggagguugaggcaggag

SEQ ID NO: 22227 - RNA, 32 nt, Human
aacccagcugcaccccuuccugggcacacgcu

SEQ ID NO: 22228 - RNA, 32 nt, Human
aacccagcuguggucccagagaucagggggug

SEQ ID NO: 22229 - RNA, 32 nt, Human
aacccagcuugggaagagaagccccagcgugg

SEQ ID NO: 22230 - RNA, 32 nt, Human
aacccaggaagaggagguugcagugagccgag

SEQ ID NO: 22231 - RNA, 32 nt, Human
aacccaggaagaguggccucaccagaaacuga

SEQ ID NO: 22232 - RNA, 32 nt, Human
aacccaggaagcagagguugcaguaagcugag

SEQ ID NO: 22233 - RNA, 32 nt, Human
aacccaggaagcagagguugcagugagcagag

SEQ ID NO: 22234 - RNA, 32 nt, Human
aacccaggaagcagagguugcagugagcugag

SEQ ID NO: 22235 - RNA, 32 nt, Human
aacccaggaagcggagguugcaaucagcugag

SEQ ID NO: 22236 - RNA, 32 nt, Human
aacccaggaagcggagguugcagugagccgag

SEQ ID NO: 22237 - RNA, 26 nt, Human
aacccaggaagcggagguugugguga

SEQ ID NO: 22238 - RNA, 32 nt, Human
aacccaggaagcggagguuguggugagccaag

SEQ ID NO: 22239 - RNA, 32 nt, Human
aacccaggaagcgggguugcagugagccaaag

SEQ ID NO: 22240 - RNA, 32 nt, Human
aacccaggaagguguggcguccccgcuucgcg

SEQ ID NO: 22241 - RNA, 32 nt, Human
aacccaggaaguagagguugcagugagccgag

SEQ ID NO: 22242 - RNA, 32 nt, Human
aacccaggaaguggagacugcagugagccgau

SEQ ID NO: 22243 - RNA, 32 nt, Human
aacccaggaaguggagguugcagugagccgag

SEQ ID NO: 22244 - RNA, 32 nt, Human
aacccaggaaguggagguugcagugagcuaag

SEQ ID NO: 22245 - RNA, 32 nt, Human
aacccaggaaguggagguugcagugagcugag

SEQ ID NO: 22246 - RNA, 32 nt, Human
aacccaggaaguggcaguugcagugagccgag

SEQ ID NO: 22247 - RNA, 32 nt, Human
aacccaggacacggagauugcagugagccaag

SEQ ID NO: 22248 - RNA, 32 nt, Human
aacccaggacgcagagguugcggugagccaag

SEQ ID NO: 22249 - RNA, 32 nt, Human
aacccaggacuccacacacaaaacuccuggga

SEQ ID NO: 22250 - RNA, 32 nt, Human
aacccaggagacagagguugcagugagccaag

SEQ ID NO: 22251 - RNA, 32 nt, Human
aacccaggagacagagguuguagugagcugag

SEQ ID NO: 22252 - RNA, 32 nt, Human
aacccaggagacagagguugugguggggcaag

SEQ ID NO: 22253 - RNA, 32 nt, Human
aacccaggagacagggguugcagugagccaag

SEQ ID NO: 22254 - RNA, 32 nt, Human
aacccaggagacauggguugcagugagccgag

SEQ ID NO: 22255 - RNA, 32 nt, Human
aacccaggagacgagguugcagugagccgaga

SEQ ID NO: 22256 - RNA, 32 nt, Human
aacccaggagacggaaguugcagugagcugag

SEQ ID NO: 22257 - RNA, 32 nt, Human
aacccaggagacggagcuugcagugagccgag

SEQ ID NO: 22258 - RNA, 32 nt, Human
aacccaggagacggagguugcagugagccgag

SEQ ID NO: 22259 - RNA, 26 nt, Human
aacccaggagacggagguugcgguga

SEQ ID NO: 22260 - RNA, 32 nt, Human
aacccaggagacggagguugcggugaguugag

SEQ ID NO: 22261 - RNA, 32 nt, Human
aacccaggagacggugguugcagugagccaag

SEQ ID NO: 22262 - RNA, 32 nt, Human
aacccaggagacggugguugcagugagcgaag

SEQ ID NO: 22263 - RNA, 32 nt, Human
aacccaggagaggaagaaagaaaggagagagg

SEQ ID NO: 22264 - RNA, 32 nt, Human
aacccaggagaggaagguugcaguaagcugag

SEQ ID NO: 22265 - RNA, 32 nt, Human
aacccaggagauagagguugcaaugagccaag

SEQ ID NO: 22266 - RNA, 32 nt, Human
aacccaggagauggaaguugcagugagcugau

SEQ ID NO: 22267 - RNA, 32 nt, Human
aacccaggagauggagguugcagugagccaag

SEQ ID NO: 22268 - RNA, 32 nt, Human
aacccaggagauggagguugcagugagcugag

SEQ ID NO: 22269 - RNA, 26 nt, Human
aacccaggagauggagguugcgguga

SEQ ID NO: 22270 - RNA, 32 nt, Human
aacccaggagauggagguugcggugagcugag

SEQ ID NO: 22271 - RNA, 32 nt, Human
aacccaggagccagaggaaccagggcaagagg

SEQ ID NO: 22272 - RNA, 32 nt, Human
aacccaggagccccgagaaccugcuuuccuca

SEQ ID NO: 22273 - RNA, 26 nt, Human
aacccaggagccggagguugugguga

SEQ ID NO: 22274 - RNA, 32 nt, Human
aacccaggaggaagagguugcagugagccaag

SEQ ID NO: 22275 - RNA, 32 nt, Human
aacccaggaggaggagcuugcagugagccgag

SEQ ID NO: 22276 - RNA, 32 nt, Human
aacccaggaggcaaaggcugcagugagccaag

SEQ ID NO: 22277 - RNA, 32 nt, Human
aacccaggaggcaaagguugcagugagccacg

SEQ ID NO: 22278 - RNA, 32 nt, Human
aacccaggaggcacagauugcagugagccaag

SEQ ID NO: 22279 - RNA, 32 nt, Human
aacccaggaggcacagcuugcagugagcgaag

SEQ ID NO: 22280 - RNA, 32 nt, Human
aacccaggaggcacagguugcagugagccagg

SEQ ID NO: 22281 - RNA, 32 nt, Human
aacccaggaggcagaaguugcaagguugagcc

SEQ ID NO: 22282 - RNA, 32 nt, Human
aacccaggaggcagaaguugcagugagcagag

SEQ ID NO: 22283 - RNA, 32 nt, Human
aacccaggaggcagaaguugcagugagccgaa

SEQ ID NO: 22284 - RNA, 32 nt, Human
aacccaggaggcagaaguugcagugagcugag

SEQ ID NO: 22285 - RNA, 32 nt, Human
aacccaggaggcagacguugcagcgagccaaa

SEQ ID NO: 22286 - RNA, 32 nt, Human
aacccaggaggcagagaucgcagugaguugag

SEQ ID NO: 22287 - RNA, 32 nt, Human
aacccaggaggcagagauugcagugagccaag

SEQ ID NO: 22288 - RNA, 32 nt, Human
aacccaggaggcagagauugcagugagcugag

SEQ ID NO: 22289 - RNA, 32 nt, Human
aacccaggaggcagagauugcggugagccaag

SEQ ID NO: 22290 - RNA, 32 nt, Human
aacccaggaggcagagauugcggugagccggg

SEQ ID NO: 22291 - RNA, 23 nt, Human
aacccaggaggcagagcuugcag

SEQ ID NO: 22292 - RNA, 32 nt, Human
aacccaggaggcagagcuugcagugagccaag

SEQ ID NO: 22293 - RNA, 32 nt, Human
aacccaggaggcagagcuugcagugagccgag

SEQ ID NO: 22294 - RNA, 32 nt, Human
aacccaggaggcagagcuugcagugagccuag

SEQ ID NO: 22295 - RNA, 32 nt, Human
aacccaggaggcagagcuugcagugagcugag

SEQ ID NO: 22296 - RNA, 32 nt, Human
aacccaggaggcagagcuuguagugagccuag

SEQ ID NO: 22297 - RNA, 23 nt, Human
aacccaggaggcagaggcuacag

SEQ ID NO: 22298 - RNA, 32 nt, Human
aacccaggaggcagaggcuacagugagcugag

SEQ ID NO: 22299 - RNA, 32 nt, Human
aacccaggaggcagaggguugcagugagccga

SEQ ID NO: 22300 - RNA, 32 nt, Human
aacccaggaggcagaggucgcagugagucgag

SEQ ID NO: 22301 - RNA, 32 nt, Human
aacccaggaggcagagguuacagugagcagag

SEQ ID NO: 22302 - RNA, 32 nt, Human
aacccaggaggcagagguugcaaugagccaag

SEQ ID NO: 22303 - RNA, 32 nt, Human
aacccaggaggcagagguugcagcgagcugag

SEQ ID NO: 22304 - RNA, 32 nt, Human
aacccaggaggcagagguugcaguaagccaag

SEQ ID NO: 22305 - RNA, 32 nt, Human
aacccaggaggcagagguugcaguaagccuag

SEQ ID NO: 22306 - RNA, 32 nt, Human
aacccaggaggcagagguugcagucagccaag

SEQ ID NO: 22307 - RNA, 26 nt, Human
aacccaggaggcagagguugcaguga

SEQ ID NO: 22308 - RNA, 32 nt, Human
aacccaggaggcagagguugcagugagccaag

SEQ ID NO: 22309 - RNA, 32 nt, Human
aacccaggaggcagagguugcagugagccgag

SEQ ID NO: 22310 - RNA, 32 nt, Human
aacccaggaggcagagguugcagugagcuaag

SEQ ID NO: 22311 - RNA, 32 nt, Human
aacccaggaggcagagguugcagugagcugag

SEQ ID NO: 22312 - RNA, 32 nt, Human
aacccaggaggcagagguugcagugagcugug

SEQ ID NO: 22313 - RNA, 32 nt, Human
aacccaggaggcagagguugcagugagucaag

SEQ ID NO: 22314 - RNA, 32 nt, Human
aacccaggaggcagagguugcagugagugaag

SEQ ID NO: 22315 - RNA, 32 nt, Human
aacccaggaggcagagguugcagugcaccaag

SEQ ID NO: 22316 - RNA, 32 nt, Human
aacccaggaggcagagguugcagugcgcugag

SEQ ID NO: 22317 - RNA, 26 nt, Human
aacccaggaggcagagguugcagugg

SEQ ID NO: 22318 - RNA, 32 nt, Human
aacccaggaggcagagguugcagugggccaag

SEQ ID NO: 22319 - RNA, 26 nt, Human
aacccaggaggcagagguugcgguga

SEQ ID NO: 22320 - RNA, 32 nt, Human
aacccaggaggcagagguugcggugagccgag

SEQ ID NO: 22321 - RNA, 32 nt, Human
aacccaggaggcagagguugcggugagucgag

SEQ ID NO: 22322 - RNA, 32 nt, Human
aacccaggaggcagagguugcguugagccaag

SEQ ID NO: 22323 - RNA, 32 nt, Human
aacccaggaggcagagguuggggugagcugag

SEQ ID NO: 22324 - RNA, 32 nt, Human
aacccaggaggcagagguuguagugagccaag

SEQ ID NO: 22325 - RNA, 32 nt, Human
aacccaggaggcagaguuugcagucagccaag

SEQ ID NO: 22326 - RNA, 32 nt, Human
aacccaggaggcagaguuugcagugagccaag

SEQ ID NO: 22327 - RNA, 32 nt, Human
aacccaggaggcagaguuugcagugagcugag

SEQ ID NO: 22328 - RNA, 32 nt, Human
aacccaggaggcagcuguugcagugagccaag

SEQ ID NO: 22329 - RNA, 32 nt, Human
aacccaggaggcagugauugcagugagcugag

SEQ ID NO: 22330 - RNA, 32 nt, Human
aacccaggaggcagugguugcaaugagccgag

SEQ ID NO: 22331 - RNA, 32 nt, Human
aacccaggaggccgagguugcagugagccaag

SEQ ID NO: 22332 - RNA, 26 nt, Human
aacccaggaggcggaaguugcaguga

SEQ ID NO: 22333 - RNA, 32 nt, Human
aacccaggaggcggaaguugcagugagcugag

SEQ ID NO: 22334 - RNA, 32 nt, Human
aacccaggaggcggaccuuguagugagccgag

SEQ ID NO: 22335 - RNA, 26 nt, Human
aacccaggaggcggagauugcaguga

SEQ ID NO: 22336 - RNA, 32 nt, Human
aacccaggaggcggagauugcagugagccgag

SEQ ID NO: 22337 - RNA, 32 nt, Human
aacccaggaggcggagauugcagugagcugag

SEQ ID NO: 22338 - RNA, 32 nt, Human
aacccaggaggcggagcuggcagugagcugag

SEQ ID NO: 22339 - RNA, 23 nt, Human
aacccaggaggcggagcuugcag

SEQ ID NO: 22340 - RNA, 26 nt, Human
aacccaggaggcggagcuugcaguga

SEQ ID NO: 22341 - RNA, 32 nt, Human
aacccaggaggcggagcuugcagugagcagag

SEQ ID NO: 22342 - RNA, 32 nt, Human
aacccaggaggcggagcuugcagugagccaag

SEQ ID NO: 22343 - RNA, 32 nt, Human
aacccaggaggcggagcuugcagugagccaug

SEQ ID NO: 22344 - RNA, 32 nt, Human
aacccaggaggcggagcuugcagugagccgag

SEQ ID NO: 22345 - RNA, 32 nt, Human
aacccaggaggcggagcuugcagugagcugag

SEQ ID NO: 22346 - RNA, 32 nt, Human
aacccaggaggcggaggcagaggcugcaguga

SEQ ID NO: 22347 - RNA, 26 nt, Human
aacccaggaggcggaggcugcaguga

SEQ ID NO: 22348 - RNA, 32 nt, Human
aacccaggaggcggaggcugcagugagcccag

SEQ ID NO: 22349 - RNA, 32 nt, Human
aacccaggaggcggaggcugcagugagcugag

SEQ ID NO: 22350 - RNA, 26 nt, Human
aacccaggaggcggagguagcaguga

SEQ ID NO: 22351 - RNA, 32 nt, Human
aacccaggaggcggagguagcagugagccaag

SEQ ID NO: 22352 - RNA, 26 nt, Human
aacccaggaggcggagguagugguga

SEQ ID NO: 22353 - RNA, 32 nt, Human
aacccaggaggcggagguaguggugagcaaag

SEQ ID NO: 22354 - RNA, 26 nt, Human
aacccaggaggcggagguuacaguga

SEQ ID NO: 22355 - RNA, 32 nt, Human
aacccaggaggcggagguuacagugagccaag

SEQ ID NO: 22356 - RNA, 26 nt, Human
aacccaggaggcggagguuccaguga

SEQ ID NO: 22357 - RNA, 26 nt, Human
aacccaggaggcggagguugcacuga

SEQ ID NO: 22358 - RNA, 32 nt, Human
aacccaggaggcggagguugcacugagccgag

SEQ ID NO: 22359 - RNA, 23 nt, Human
aacccaggaggcggagguugcag

SEQ ID NO: 22360 - RNA, 26 nt, Human
aacccaggaggcggagguugcaggga

SEQ ID NO: 22361 - RNA, 32 nt, Human
aacccaggaggcggagguugcagggagggaga

SEQ ID NO: 22362 - RNA, 24 nt, Human
aacccaggaggcggagguugcagu

SEQ ID NO: 22363 - RNA, 32 nt, Human
aacccaggaggcggagguugcaguaagccaag

SEQ ID NO: 22364 - RNA, 26 nt, Human
aacccaggaggcggagguugcaguga

SEQ ID NO: 22365 - RNA, 32 nt, Human
aacccaggaggcggagguugcagugaaccgag

SEQ ID NO: 22366 - RNA, 32 nt, Human
aacccaggaggcggagguugcagugacccgag

SEQ ID NO: 22367 - RNA, 32 nt, Human
aacccaggaggcggagguugcagugagacgag

SEQ ID NO: 22368 - RNA, 32 nt, Human
aacccaggaggcggagguugcagugagcagag

SEQ ID NO: 22369 - RNA, 32 nt, Human
aacccaggaggcggagguugcagugagccaag

SEQ ID NO: 22370 - RNA, 32 nt, Human
aacccaggaggcggagguugcagugagccagg

SEQ ID NO: 22371 - RNA, 32 nt, Human
aacccaggaggcggagguugcagugagccgag

SEQ ID NO: 22372 - RNA, 32 nt, Human
aacccaggaggcggagguugcagugagcucag

SEQ ID NO: 22373 - RNA, 32 nt, Human
aacccaggaggcggagguugcagugagcugag

SEQ ID NO: 22374 - RNA, 32 nt, Human
aacccaggaggcggagguugcagugaguugag

SEQ ID NO: 22375 - RNA, 32 nt, Human
aacccaggaggcggagguugcagugauccaag

SEQ ID NO: 22376 - RNA, 26 nt, Human
aacccaggaggcggagguugccguga

SEQ ID NO: 22377 - RNA, 32 nt, Human
aacccaggaggcggagguugccgugagccaag

SEQ ID NO: 22378 - RNA, 26 nt, Human
aacccaggaggcggagguugcgguga

SEQ ID NO: 22379 - RNA, 32 nt, Human
aacccaggaggcggagguugcggugagccaag

SEQ ID NO: 22380 - RNA, 32 nt, Human
aacccaggaggcggagguugcggugagccgag

SEQ ID NO: 22381 - RNA, 32 nt, Human
aacccaggaggcggagguugcggugagcugag

SEQ ID NO: 22382 - RNA, 32 nt, Human
aacccaggaggcggagguugcggugaguugag

SEQ ID NO: 22383 - RNA, 26 nt, Human
aacccaggaggcggagguuguaguga

SEQ ID NO: 22384 - RNA, 32 nt, Human
aacccaggaggcggagguuguagugagccaag

SEQ ID NO: 22385 - RNA, 32 nt, Human
aacccaggaggcggagguuguauaggcugaga

SEQ ID NO: 22386 - RNA, 26 nt, Human
aacccaggaggcggagguugugguga

SEQ ID NO: 22387 - RNA, 32 nt, Human
aacccaggaggcggagguuguggugagccaag

SEQ ID NO: 22388 - RNA, 32 nt, Human
aacccaggaggcggaguuugcagugagcugag

SEQ ID NO: 22389 - RNA, 32 nt, Human
aacccaggaggcggcgguugcagugagccaag

SEQ ID NO: 22390 - RNA, 32 nt, Human
aacccaggaggcggggguugcagugagucgag

SEQ ID NO: 22391 - RNA, 32 nt, Human
aacccaggaggcggugcuugcagggagccgag

SEQ ID NO: 22392 - RNA, 32 nt, Human
aacccaggaggcggugguuguaggaagcugug

SEQ ID NO: 22393 - RNA, 32 nt, Human
aacccaggaggcguagcuagcagugagccaag

SEQ ID NO: 22394 - RNA, 26 nt, Human
aacccaggaggcugagguugcaguga

SEQ ID NO: 22395 - RNA, 32 nt, Human
aacccaggaggcugagguugcagugagccagg

SEQ ID NO: 22396 - RNA, 32 nt, Human
aacccaggaggcugagguugcagugagcccag

SEQ ID NO: 22397 - RNA, 32 nt, Human
aacccaggagguagaagcugcagugagcaggg

SEQ ID NO: 22398 - RNA, 32 nt, Human
aacccaggagguagaaguugcagugagccgag

SEQ ID NO: 22399 - RNA, 32 nt, Human
aacccaggagguagaggcugcagugagcaggg

SEQ ID NO: 22400 - RNA, 32 nt, Human
aacccaggagguagaggcugcagugagccggg

SEQ ID NO: 22401 - RNA, 32 nt, Human
aacccaggagguagaggcugcagugagcuggg

SEQ ID NO: 22402 - RNA, 32 nt, Human
aacccaggagguagagguugcagugagccaag

SEQ ID NO: 22403 - RNA, 32 nt, Human
aacccaggagguagagguugcagugagccgag

SEQ ID NO: 22404 - RNA, 26 nt, Human
aacccaggaggugaagguugcaguga

SEQ ID NO: 22405 - RNA, 32 nt, Human
aacccaggaggugaagguugcagugaccggag

SEQ ID NO: 22406 - RNA, 26 nt, Human
aacccaggaggugcagguugcaguga

SEQ ID NO: 22407 - RNA, 32 nt, Human
aacccaggaggugcagguugcagugagccgag

SEQ ID NO: 22408 - RNA, 32 nt, Human
aacccaggagguggaaguugcuuugagccgag

SEQ ID NO: 22409 - RNA, 32 nt, Human
aacccaggagguggacauuacagugagcccag

SEQ ID NO: 22410 - RNA, 32 nt, Human
aacccaggagguggagacugcagugagccaag

SEQ ID NO: 22411 - RNA, 26 nt, Human
aacccaggagguggagauugcaguga

SEQ ID NO: 22412 - RNA, 32 nt, Human
aacccaggagguggagauugcagugagcugag

SEQ ID NO: 22413 - RNA, 32 nt, Human
aacccaggagguggagcuugcaaugagccgag

SEQ ID NO: 22414 - RNA, 32 nt, Human
aacccaggagguggagcuugcagugagccgag

SEQ ID NO: 22415 - RNA, 26 nt, Human
aacccaggagguggaggaugcaguga

SEQ ID NO: 22416 - RNA, 32 nt, Human
aacccaggagguggaggaugcagugaacugag

SEQ ID NO: 22417 - RNA, 26 nt, Human
aacccaggagguggaggcugcaguga

SEQ ID NO: 22418 - RNA, 32 nt, Human
aacccaggagguggaggcugcagugagcugag

SEQ ID NO: 22419 - RNA, 26 nt, Human
aacccaggagguggaggcugcgguga

SEQ ID NO: 22420 - RNA, 32 nt, Human
aacccaggagguggaggcugcggugagccgag

SEQ ID NO: 22421 - RNA, 26 nt, Human
aacccaggagguggagguagcaguga

SEQ ID NO: 22422 - RNA, 32 nt, Human
aacccaggagguggagguagcagugagccgag

SEQ ID NO: 22423 - RNA, 26 nt, Human
aacccaggagguggagguuacaguga

SEQ ID NO: 22424 - RNA, 32 nt, Human
aacccaggagguggagguuacagugagccaag

SEQ ID NO: 22425 - RNA, 32 nt, Human
aacccaggagguggagguuacagugagcugag

SEQ ID NO: 22426 - RNA, 32 nt, Human
aacccaggagguggagguuccagugagccaaa

SEQ ID NO: 22427 - RNA, 20 nt, Human
aacccaggagguggagguug

SEQ ID NO: 22428 - RNA, 32 nt, Human
aacccaggagguggagguugaaaugagcugag

SEQ ID NO: 22429 - RNA, 32 nt, Human
aacccaggagguggagguugcaagugagcuga

SEQ ID NO: 22430 - RNA, 26 nt, Human
aacccaggagguggagguugcaauga

SEQ ID NO: 22431 - RNA, 23 nt, Human
aacccaggagguggagguugcag

SEQ ID NO: 22432 - RNA, 32 nt, Human
aacccaggagguggagguugcagcaagcagag

SEQ ID NO: 22433 - RNA, 26 nt, Human
aacccaggagguggagguugcagcga

SEQ ID NO: 22434 - RNA, 24 nt, Human
aacccaggagguggagguugcagu

SEQ ID NO: 22435 - RNA, 32 nt, Human
aacccaggagguggagguugcaguaagccaag

SEQ ID NO: 22436 - RNA, 32 nt, Human
aacccaggagguggagguugcaguaagcugag

SEQ ID NO: 22437 - RNA, 26 nt, Human
aacccaggagguggagguugcaguga

SEQ ID NO: 22438 - RNA, 32 nt, Human
aacccaggagguggagguugcagugaacugag

SEQ ID NO: 22439 - RNA, 32 nt, Human
aacccaggagguggagguugcagugagcagag

SEQ ID NO: 22440 - RNA, 32 nt, Human
aacccaggagguggagguugcagugagccaag

SEQ ID NO: 22441 - RNA, 32 nt, Human
aacccaggagguggagguugcagugagccaga

SEQ ID NO: 22442 - RNA, 32 nt, Human
aacccaggagguggagguugcagugagccgag

SEQ ID NO: 22443 - RNA, 32 nt, Human
aacccaggagguggagguugcagugagcugag

SEQ ID NO: 22444 - RNA, 32 nt, Human
aacccaggagguggagguugcagugagcuggg

SEQ ID NO: 22445 - RNA, 32 nt, Human
aacccaggagguggagguugcagugaggcaag

SEQ ID NO: 22446 - RNA, 32 nt, Human
aacccaggagguggagguugcagugagucaag

SEQ ID NO: 22447 - RNA, 32 nt, Human
aacccaggagguggagguugcagugagucgag

SEQ ID NO: 22448 - RNA, 32 nt, Human
aacccaggagguggagguugcagugggccgag

SEQ ID NO: 22449 - RNA, 32 nt, Human
aacccaggagguggagguugcaguuagcugag

SEQ ID NO: 22450 - RNA, 23 nt, Human
aacccaggagguggagguugcgg

SEQ ID NO: 22451 - RNA, 32 nt, Human
aacccaggagguggagguugcggugagcugag

SEQ ID NO: 22452 - RNA, 26 nt, Human
aacccaggagguggagguugcuguga

SEQ ID NO: 22453 - RNA, 32 nt, Human
aacccaggagguggagguugcugugagccaag

SEQ ID NO: 22454 - RNA, 23 nt, Human
aacccaggagguggagguuguag

SEQ ID NO: 22455 - RNA, 26 nt, Human
aacccaggagguggagguuguaguga

SEQ ID NO: 22456 - RNA, 32 nt, Human
aacccaggagguggagguuguagugagacaag

SEQ ID NO: 22457 - RNA, 26 nt, Human
aacccaggagguggagguugugguga

SEQ ID NO: 22458 - RNA, 32 nt, Human
aacccaggagguggagguuguggugagccaag

SEQ ID NO: 22459 - RNA, 32 nt, Human
aacccaggagguggagguuguggugagccgag

SEQ ID NO: 22460 - RNA, 32 nt, Human
aacccaggagguggagguuguggugagcugag

SEQ ID NO: 22461 - RNA, 32 nt, Human
aacccaggagguggaguuugcagugagcugag

SEQ ID NO: 22462 - RNA, 26 nt, Human
aacccaggagguggauguugcaguga

SEQ ID NO: 22463 - RNA, 32 nt, Human
aacccaggaggugggcauugcagugagccgag

SEQ ID NO: 22464 - RNA, 26 nt, Human
aacccaggagguggugguugcaguga

SEQ ID NO: 22465 - RNA, 32 nt, Human
aacccaggagguggugguugcagugagccuag

SEQ ID NO: 22466 - RNA, 32 nt, Human
aacccaggagguugaggcugcagugagucaug

SEQ ID NO: 22467 - RNA, 32 nt, Human
aacccaggagucaaaagcugcagugagcuacu

SEQ ID NO: 22468 - RNA, 32 nt, Human
aacccaggagucagagguuucagugagccgag

SEQ ID NO: 22469 - RNA, 32 nt, Human
aacccaggagucggagguugcagugaguugag

SEQ ID NO: 22470 - RNA, 32 nt, Human
aacccaggaguucaagucugcagugagcuaug

SEQ ID NO: 22471 - RNA, 32 nt, Human
aacccaggaguuggagcuugcagugagccgag

SEQ ID NO: 22472 - RNA, 32 nt, Human
aacccaggaugcggagguugcagugagccgag

SEQ ID NO: 22473 - RNA, 32 nt, Human
aacccaggcagcuggcaggaguggggugguua

SEQ ID NO: 22474 - RNA, 32 nt, Human
aacccaggcaguggagguugcagugagccaag

SEQ ID NO: 22475 - RNA, 32 nt, Human
aacccaggccgauggcugggcacgguggcuca

SEQ ID NO: 22476 - RNA, 18 nt, Human
aacccaggccuuccugga

SEQ ID NO: 22477 - RNA, 23 nt, Human
aacccaggcggcagagguugcag

SEQ ID NO: 22478 - RNA, 32 nt, Human
aacccaggcggcagagguugcagugagccaag

SEQ ID NO: 22479 - RNA, 32 nt, Human
aacccaggcggcagagguugcagugagucgag

SEQ ID NO: 22480 - RNA, 32 nt, Human
aacccagggaauagcccuccucuccccaggaa

SEQ ID NO: 22481 - RNA, 32 nt, Human
aacccagggacacccaaggauaugucuucuga

SEQ ID NO: 22482 - RNA, 32 nt, Human
aacccagggccagcaguggaagccucaagcaa

SEQ ID NO: 22483 - RNA, 26 nt, Human
aacccagggggcagagguugcaguga

SEQ ID NO: 22484 - RNA, 32 nt, Human
aacccagggggcagagguugcagugagccgag

SEQ ID NO: 22485 - RNA, 26 nt, Human
aacccagggggcggagguugcaguga

SEQ ID NO: 22486 - RNA, 32 nt, Human
aacccaggggguggagguugcacugagccgag

SEQ ID NO: 22487 - RNA, 32 nt, Human
aacccaggguuuuguacuuggagaggaaagau

SEQ ID NO: 22488 - RNA, 32 nt, Human
aacccagguccacgugguuccagccuggcuuc

SEQ ID NO: 22489 - RNA, 32 nt, Human
aacccaggucuuggauuucaggucccuccacc

SEQ ID NO: 22490 - RNA, 23 nt, Human
aacccagguggcggagguugcag

SEQ ID NO: 22491 - RNA, 32 nt, Human
aacccagguggcggagguugcagugagccgac

SEQ ID NO: 22492 - RNA, 32 nt, Human
aacccagguuguggagguuguagugagccgag

SEQ ID NO: 22493 - RNA, 32 nt, Human
aacccaguagaggaagguugcaguaagcugag

SEQ ID NO: 22494 - RNA, 32 nt, Human
aacccaguaggcggaaguugcagugagcugaa

SEQ ID NO: 22495 - RNA, 32 nt, Human
aacccagucagacaaauucaccuucacuuagg

SEQ ID NO: 22496 - RNA, 32 nt, Human
aacccagugccguuuauuucagaagcuuccug

SEQ ID NO: 22497 - RNA, 32 nt, Human
aacccagugccuccucaacuccugggugggug

SEQ ID NO: 22498 - RNA, 32 nt, Human
aacccaguggcggaggcugcagugagccgaga

SEQ ID NO: 22499 - RNA, 32 nt, Human
aacccagugugauauaucaaaauacagucuac

SEQ ID NO: 22500 - RNA, 32 nt, Human
aacccagugugcugagaaacaggagagugacu

SEQ ID NO: 22501 - RNA, 32 nt, Human
aacccaguguuugcacacacacaaaaucuuga

SEQ ID NO: 22502 - RNA, 32 nt, Human
aacccaguucagguguaggaggcugcuguggg

SEQ ID NO: 22503 - RNA, 32 nt, Human
aacccaguuccaacuaugaucugacuucaucc

SEQ ID NO: 22504 - RNA, 32 nt, Human
aacccaguuggaggggcauggcuuccaauuua

SEQ ID NO: 22505 - RNA, 32 nt, Human
aacccauaaggcagagguugcagugagcugag

SEQ ID NO: 22506 - RNA, 32 nt, Human
aacccaucaccaggaacugucacuggggacga

SEQ ID NO: 22507 - RNA, 32 nt, Human
aacccaucuaugagagaaaguucagucacuuu

SEQ ID NO: 22508 - RNA, 32 nt, Human
aacccaucucaccacacugcuuuacagucuuc

SEQ ID NO: 22509 - RNA, 32 nt, Human
aacccaucucucuuggagaauccacacuucgu

SEQ ID NO: 22510 - RNA, 32 nt, Human
aacccaucugcaauuugccugugggagaagca

SEQ ID NO: 22511 - RNA, 32 nt, Human
aacccaucuucauuccuuuuuauggggcucca

SEQ ID NO: 22512 - RNA, 32 nt, Human
aacccaucuuugcaaagaagcuugccuauaga

SEQ ID NO: 22513 - RNA, 32 nt, Human
aacccaugacacagcacaacucuacagacagu

SEQ ID NO: 22514 - RNA, 32 nt, Human
aacccaugacuguauucucucccuuggacacc

SEQ ID NO: 22515 - RNA, 32 nt, Human
aacccaugaggcggagguugcagugagccgag

SEQ ID NO: 22516 - RNA, 32 nt, Human
aacccaugagguggagguugcggugagccaag

SEQ ID NO: 22517 - RNA, 32 nt, Human
aacccaugccgaccccuccuagagccacugga

SEQ ID NO: 22518 - RNA, 32 nt, Human
aacccaugccucccccuagccauuuuuacugu

SEQ ID NO: 22519 - RNA, 30 nt, Human
aacccauggagaccagaccaacagcucuga

SEQ ID NO: 22520 - RNA, 32 nt, Human
aacccauguccucacuucaagguuaucaaucu

SEQ ID NO: 22521 - RNA, 32 nt, Human
aacccaugugccauccuacuuguauuacuggu

SEQ ID NO: 22522 - RNA, 30 nt, Human
aacccauguuugcaaucaaagaugauaaaa

SEQ ID NO: 22523 - RNA, 32 nt, Human
aacccauugcccacaaccccuccacccucggu

SEQ ID NO: 22524 - RNA, 32 nt, Human
aacccauugucaccccuccgacucaccggcaa

SEQ ID NO: 22525 - RNA, 32 nt, Human
aaccccaaaagaugccgcgucaguucgagcca

SEQ ID NO: 22526 - RNA, 32 nt, Human
aaccccaaacagccuggaacauguuacucuga

SEQ ID NO: 22527 - RNA, 32 nt, Human
aaccccaaacuguugauuauuagccagguaau

SEQ ID NO: 22528 - RNA, 32 nt, Human
aaccccaaagagagcacuguccaaggaugucg

SEQ ID NO: 22529 - RNA, 32 nt, Human
aaccccaaagcccaugcuccgacagguggccc

SEQ ID NO: 22530 - RNA, 32 nt, Human
aaccccaaagugucccccuuguggaaccaaau

SEQ ID NO: 22531 - RNA, 32 nt, Human
aaccccaaauguccaaaagcccuuuucuggug

SEQ ID NO: 22532 - RNA, 24 nt, Human
aaccccaacaaccugccaccccuc

SEQ ID NO: 22533 - RNA, 32 nt, Human
aaccccaaccucuacacagacagaaaggagca

SEQ ID NO: 22534 - RNA, 19 nt, Human
aaccccaacguccccgaga

SEQ ID NO: 22535 - RNA, 32 nt, Human
aaccccaagccggggcagcuccaccuccccag

SEQ ID NO: 22536 - RNA, 32 nt, Human
aaccccaagggcccuggagcgcucccugauac

SEQ ID NO: 22537 - RNA, 32 nt, Human
aaccccaauucagccauggugacuccuuugau

SEQ ID NO: 22538 - RNA, 32 nt, Human
aaccccacaagugucuucacuguggaaaaccu

SEQ ID NO: 22539 - RNA, 32 nt, Human
aaccccacaauuggaauucacuuuaaaaaucc

SEQ ID NO: 22540 - RNA, 32 nt, Human
aaccccacagcuccugagaauucucucgccug

SEQ ID NO: 22541 - RNA, 32 nt, Human
aaccccaccccagcccuacacagcagucuggc

SEQ ID NO: 22542 - RNA, 32 nt, Human
aaccccaccuagaccacccuccaugucaggua

SEQ ID NO: 22543 - RNA, 32 nt, Human
aaccccacuuccuacuguaauagaucagcauc

SEQ ID NO: 22544 - RNA, 32 nt, Human
aaccccacuuccucggcaggaccccagucuca

SEQ ID NO: 22545 - RNA, 32 nt, Human
aaccccacuuucucccuccuccuuuuccugug

SEQ ID NO: 22546 - RNA, 32 nt, Human
aaccccagaaguuugaguccagcccaggcaac

SEQ ID NO: 22547 - RNA, 32 nt, Human
aaccccagaccagggcaggggacaggucucaa

SEQ ID NO: 22548 - RNA, 32 nt, Human
aaccccagacccagggggaggaaggguggagg

SEQ ID NO: 22549 - RNA, 32 nt, Human
aaccccagaccugcccuuacaguaguguagcg

SEQ ID NO: 22550 - RNA, 32 nt, Human
aaccccagagagagcuuccccgacagcugcag

SEQ ID NO: 22551 - RNA, 32 nt, Human
aaccccagagcuucacuugcuccuucacuucc

SEQ ID NO: 22552 - RNA, 32 nt, Human
aaccccagaggaugagauaaaugggaacugga

SEQ ID NO: 22553 - RNA, 32 nt, Human
aaccccagaggcagaggcugaagugagccaag

SEQ ID NO: 22554 - RNA, 32 nt, Human
aaccccagaggcagagguugcagugagcugag

SEQ ID NO: 22555 - RNA, 32 nt, Human
aaccccagaggcagagguugcggugagccgag

SEQ ID NO: 22556 - RNA, 32 nt, Human
aaccccagaggcaguggcaagaggagguggcg

SEQ ID NO: 22557 - RNA, 32 nt, Human
aaccccagaggcggagguugcagugagccgag

SEQ ID NO: 22558 - RNA, 32 nt, Human
aaccccagagguggagguugcagugagccgag

SEQ ID NO: 22559 - RNA, 32 nt, Human
aaccccagcaaaacauuccucccuguaaaugg

SEQ ID NO: 22560 - RNA, 32 nt, Human
aaccccagcaaucccuuccuuucacuaccuuc

SEQ ID NO: 22561 - RNA, 32 nt, Human
aaccccagccagccugucaccaugcugacagc

SEQ ID NO: 22562 - RNA, 32 nt, Human
aaccccagccauggaccgucaguggcuggagg

SEQ ID NO: 22563 - RNA, 32 nt, Human
aaccccagccuccugagggcuccaugcugaag

SEQ ID NO: 22564 - RNA, 32 nt, Human
aaccccagcuacuagggaggcugaggcaggag

SEQ ID NO: 22565 - RNA, 32 nt, Human
aaccccagcuacucaggaggccgaggcgggag

SEQ ID NO: 22566 - RNA, 32 nt, Human
aaccccagcuacucaggagguugaggcaggag

SEQ ID NO: 22567 - RNA, 32 nt, Human
aaccccagcuacucgggaagcugagguaggag

SEQ ID NO: 22568 - RNA, 32 nt, Human
aaccccagcuacucgggaggcugaggcaggaa

SEQ ID NO: 22569 - RNA, 32 nt, Human
aaccccagcuacuugggaggcugaggagggau

SEQ ID NO: 22570 - RNA, 32 nt, Human
aaccccagcuacuugggaggcugaggcacuag

SEQ ID NO: 22571 - RNA, 32 nt, Human
aaccccagcuccacuccagccuggcguccagg

SEQ ID NO: 22572 - RNA, 32 nt, Human
aaccccagcucugccucacaggcaggcaggcc

SEQ ID NO: 22573 - RNA, 32 nt, Human
aaccccagcuggaugugccucccaggccugcu

SEQ ID NO: 22574 - RNA, 32 nt, Human
aaccccaggacacccacccacccaaagagcca

SEQ ID NO: 22575 - RNA, 32 nt, Human
aaccccaggagguggggguuguugugagccaa

SEQ ID NO: 22576 - RNA, 32 nt, Human
aaccccaggaugagaagggagcagggagaguu

SEQ ID NO: 22577 - RNA, 32 nt, Human
aaccccaggcuggagugcaguggcucaaugca

SEQ ID NO: 22578 - RNA, 32 nt, Human
aaccccagggcuccagcacuaccaaguuggaa

SEQ ID NO: 22579 - RNA, 32 nt, Human
aaccccaguauugccuuucguuucccuauuca

SEQ ID NO: 22580 - RNA, 32 nt, Human
aaccccagugcagcugcaucucccaggcggga

SEQ ID NO: 22581 - RNA, 32 nt, Human
aaccccaucaccaagaggagguucagggaagc

SEQ ID NO: 22582 - RNA, 32 nt, Human
aaccccauccuuguugggcagcucccugcuuu

SEQ ID NO: 22583 - RNA, 32 nt, Human
aaccccaucucugcuaaaaauaccaaaauuac

SEQ ID NO: 22584 - RNA, 32 nt, Human
aaccccaucuuucuacacacaaaaagauacag

SEQ ID NO: 22585 - RNA, 32 nt, Human
aaccccaugggaggaggaggaagaagaggagg

SEQ ID NO: 22586 - RNA, 31 nt, Human
aaccccaugggggaccucgacaacagcgccu

SEQ ID NO: 22587 - RNA, 32 nt, Human
aaccccauuugaagacucauggucccauguca

SEQ ID NO: 22588 - RNA, 32 nt, Human
aaccccauuugcuuucuuuucucccauauugg

SEQ ID NO: 22589 - RNA, 32 nt, Human
aacccccaacaguaugacagaaaauggccuua

SEQ ID NO: 22590 - RNA, 32 nt, Human
aacccccaacccaguggccaucuucacaacug

SEQ ID NO: 22591 - RNA, 18 nt, Human
aacccccaaccccugccc

SEQ ID NO: 22592 - RNA, 32 nt, Human
aacccccaaggcggagcuugcagugagccgag

SEQ ID NO: 22593 - RNA, 32 nt, Human
aacccccagcacuuugggaggccgagguggga

SEQ ID NO: 22594 - RNA, 32 nt, Human
aacccccagccagcacagacuuccugccuucc

SEQ ID NO: 22595 - RNA, 32 nt, Human
aacccccaguagcuuugccugcuuuuauaaag

SEQ ID NO: 22596 - RNA, 32 nt, Human
aacccccaucccagcaccccauccuguuguuc

SEQ ID NO: 22597 - RNA, 32 nt, Human
aacccccauuauacauuaugaucuuaagccag

SEQ ID NO: 22598 - RNA, 32 nt, Human
aacccccgaugccaccacagccaucgccacug

SEQ ID NO: 22599 - RNA, 32 nt, Human
aacccccgcuucgcagcucaggagccugaggu

SEQ ID NO: 22600 - RNA, 32 nt, Human
aacccccggaguagcuggaacuacagccuccu

SEQ ID NO: 22601 - RNA, 32 nt, Human
aacccccggcaucugcuccuaguagaggccag

SEQ ID NO: 22602 - RNA, 32 nt, Human
aacccccguuccccugcacuccucuucuccca

SEQ ID NO: 22603 - RNA, 32 nt, Human
aacccccuaaauugaaguuuagcaauaugaca

SEQ ID NO: 22604 - RNA, 32 nt, Human
aacccccuaccuuggccagcuggcugcagguc

SEQ ID NO: 22605 - RNA, 32 nt, Human
aacccccuccccucgcugcugggccccaucuc

SEQ ID NO: 22606 - RNA, 32 nt, Human
aacccccucccucugcuggaguuuccuagccc

SEQ ID NO: 22607 - RNA, 32 nt, Human
aacccccugaaauguauccucaguuugccaga

SEQ ID NO: 22608 - RNA, 32 nt, Human
aacccccugcagcucucuuguggaccccugcc

SEQ ID NO: 22609 - RNA, 32 nt, Human
aacccccugcgugguccucuguggcagccuuc

SEQ ID NO: 22610 - RNA, 32 nt, Human
aacccccuuccacaauggucucagccuaggcc

SEQ ID NO: 22611 - RNA, 20 nt, Human
aacccccuuuacccccauga

SEQ ID NO: 22612 - RNA, 32 nt, Human
aacccccuuugguuagagaagggaaagugacu

SEQ ID NO: 22613 - RNA, 32 nt, Human
aaccccgagcugcaaaaccagcagguuuuuau

SEQ ID NO: 22614 - RNA, 32 nt, Human
aaccccgccucuuccuccuccugugggacugc

SEQ ID NO: 22615 - RNA, 20 nt, Human
aaccccgccuggccacccca

SEQ ID NO: 22616 - RNA, 22 nt, Human
aaccccggaccucaggugaucc

SEQ ID NO: 22617 - RNA, 32 nt, Human
aaccccggagauggagguugcagugagccaag

SEQ ID NO: 22618 - RNA, 32 nt, Human
aaccccggaggcagagguuucagugagccgag

SEQ ID NO: 22619 - RNA, 32 nt, Human
aaccccggaggcggagcuugcagugagccgag

SEQ ID NO: 22620 - RNA, 32 nt, Human
aaccccggaggcggagguugcagugagcugag

SEQ ID NO: 22621 - RNA, 32 nt, Human
aaccccggagguagagguugcagugagccgag

SEQ ID NO: 22622 - RNA, 32 nt, Human
aaccccggcggagcugaggagcagggccgggc

SEQ ID NO: 22623 - RNA, 32 nt, Human
aaccccgggguagugaugcacaccuguagucu

SEQ ID NO: 22624 - RNA, 32 nt, Human
aaccccgucucuacuaaaaauuagcugagugc

SEQ ID NO: 22625 - RNA, 32 nt, Human
aaccccgugggcagggacuacagggaaggcuc

SEQ ID NO: 22626 - RNA, 32 nt, Human
aaccccuacugaccuggcuggugacagaacau

SEQ ID NO: 22627 - RNA, 32 nt, Human
aaccccuagcacuccggcucugggcuuucggc

SEQ ID NO: 22628 - RNA, 32 nt, Human
aaccccucacaggagcuuacuggcaaacauga

SEQ ID NO: 22629 - RNA, 32 nt, Human
aaccccucagcugccacugcaacagugggcuu

SEQ ID NO: 22630 - RNA, 32 nt, Human
aaccccucaugugaagaacgugucagaaucuu

SEQ ID NO: 22631 - RNA, 32 nt, Human
aaccccuccagcccaucagacgccaggcugcc

SEQ ID NO: 22632 - RNA, 32 nt, Human
aaccccuccgccacccuccaccuccgaaccgc

SEQ ID NO: 22633 - RNA, 32 nt, Human
aaccccuccucccucagacucagagguccaag

SEQ ID NO: 22634 - RNA, 32 nt, Human
aaccccuccuccugcucccagauacgggagaa

SEQ ID NO: 22635 - RNA, 32 nt, Human
aaccccucucagggcugcagcuuacagguggg

SEQ ID NO: 22636 - RNA, 32 nt, Human
aaccccucucucugaaaaugacaugcccucgc

SEQ ID NO: 22637 - RNA, 32 nt, Human
aaccccucugcaggagcuucuccugccgccag

SEQ ID NO: 22638 - RNA, 32 nt, Human
aaccccucuguauguuuuccauguagcgugua

SEQ ID NO: 22639 - RNA, 32 nt, Human
aaccccugaaacccacacagcacucuccaucu

SEQ ID NO: 22640 - RNA, 32 nt, Human
aaccccugaccccacacacucucugccaugca

SEQ ID NO: 22641 - RNA, 32 nt, Human
aaccccugaccccacacacucugccaugcaca

SEQ ID NO: 22642 - RNA, 20 nt, Human
aaccccugaccuaaacuacu

SEQ ID NO: 22643 - RNA, 23 nt, Human
aaccccugaccucaagugaucca

SEQ ID NO: 22644 - RNA, 22 nt, Human
aaccccugaccucaggcaaucu

SEQ ID NO: 22645 - RNA, 23 nt, Human
aaccccugagcucaggugaucca

SEQ ID NO: 22646 - RNA, 32 nt, Human
aaccccugcugcagcauuucaggugcaguaug

SEQ ID NO: 22647 - RNA, 32 nt, Human
aaccccuggaaccugguugggcaguaggggag

SEQ ID NO: 22648 - RNA, 32 nt, Human
aaccccuggacaacugaccacacccacaaggc

SEQ ID NO: 22649 - RNA, 32 nt, Human
aaccccuggcagcugcugccaguccuggaggc

SEQ ID NO: 22650 - RNA, 32 nt, Human
aaccccuggcugaacagugcucugccucuaac

SEQ ID NO: 22651 - RNA, 20 nt, Human
aaccccugggcucaagugau

SEQ ID NO: 22652 - RNA, 24 nt, Human
aaccccugggcucaagugauccuc

SEQ ID NO: 22653 - RNA, 32 nt, Human
aaccccugggcugaggcccuggcccugccccc

SEQ ID NO: 22654 - RNA, 32 nt, Human
aaccccugggggcagagacugaggagggagga

SEQ ID NO: 22655 - RNA, 32 nt, Human
aaccccugucccccaccucucacuuucaccua

SEQ ID NO: 22656 - RNA, 32 nt, Human
aaccccugucggccaaaacccccacacccgga

SEQ ID NO: 22657 - RNA, 32 nt, Human
aaccccugugccccuccccuccaggcuaccuc

SEQ ID NO: 22658 - RNA, 32 nt, Human
aaccccuguggacugcagccucgcucuuucca

SEQ ID NO: 22659 - RNA, 32 nt, Human
aaccccugugucagaaggaugggugaggcuca

SEQ ID NO: 22660 - RNA, 32 nt, Human
aaccccuucacacccaccccucugaccccugc

SEQ ID NO: 22661 - RNA, 19 nt, Human
aaccccuucugggacuuca

SEQ ID NO: 22662 - RNA, 32 nt, Human
aaccccuugccuggccucaccuggccagcuca

SEQ ID NO: 22663 - RNA, 32 nt, Human
aaccccuuuccuccccuccaccaggggucaca

SEQ ID NO: 22664 - RNA, 32 nt, Human
aaccccuuuuucuguguggccccuggggcugc

SEQ ID NO: 22665 - RNA, 32 nt, Human
aacccgaagaggaggcggaccaggagaagagc

SEQ ID NO: 22666 - RNA, 32 nt, Human
aacccgacaggcaccagugcccugccaggccu

SEQ ID NO: 22667 - RNA, 32 nt, Human
aacccgaccaaaguaggcuggugaggaagucc

SEQ ID NO: 22668 - RNA, 32 nt, Human
aacccgagagacggagguugcagugagcugau

SEQ ID NO: 22669 - RNA, 32 nt, Human
aacccgagaggcggaaguugcagugagccgag

SEQ ID NO: 22670 - RNA, 32 nt, Human
aacccgagaggcggagcuugcagugagccaag

SEQ ID NO: 22671 - RNA, 32 nt, Human
aacccgagaggcggagcuugcagugagcugag

SEQ ID NO: 22672 - RNA, 26 nt, Human
aacccgagaggcggagguugcaguga

SEQ ID NO: 22673 - RNA, 32 nt, Human
aacccgagaggcggagguugcagugagcccag

SEQ ID NO: 22674 - RNA, 32 nt, Human
aacccgagaggcggagguugcagugagccgag

SEQ ID NO: 22675 - RNA, 32 nt, Human
aacccgagagguggagguugaagugagccaag

SEQ ID NO: 22676 - RNA, 32 nt, Human
aacccgagagguggagguugcagugaaccaag

SEQ ID NO: 22677 - RNA, 32 nt, Human
aacccgagagguggagguugcagugagccaaa

SEQ ID NO: 22678 - RNA, 32 nt, Human
aacccgaggaagaugcucaucugagccagcac

SEQ ID NO: 22679 - RNA, 32 nt, Human
aacccgagucgaagcgggaagauggcugcaga

SEQ ID NO: 22680 - RNA, 32 nt, Human
aacccgcagagggaggggaggggcugagcugu

SEQ ID NO: 22681 - RNA, 32 nt, Human
aacccgcauuggauaucagagcugggagggcc

SEQ ID NO: 22682 - RNA, 32 nt, Human
aacccgcauuuuccaaagagaggaaucacagg

SEQ ID NO: 22683 - RNA, 32 nt, Human
aacccgcgaggcggagacugcagugagccgag

SEQ ID NO: 22684 - RNA, 32 nt, Human
aacccgcuggcgaccgcugccuccgggaaguu

SEQ ID NO: 22685 - RNA, 32 nt, Human
aacccgcugucgcgcaagcugcauaagauccu

SEQ ID NO: 22686 - RNA, 32 nt, Human
aacccggaagcgaagguugcagugagccaagg

SEQ ID NO: 22687 - RNA, 32 nt, Human
aacccggaaggcagagcuugcagugagccgag

SEQ ID NO: 22688 - RNA, 32 nt, Human
aacccggaaggcagagguugcagugagccgag

SEQ ID NO: 22689 - RNA, 32 nt, Human
aacccggaaggcggagcuugcagugagccgag

SEQ ID NO: 22690 - RNA, 32 nt, Human
aacccggaaggcggagguugcagugagccaag

SEQ ID NO: 22691 - RNA, 32 nt, Human
aacccggaagguggagguugcagugagccgag

SEQ ID NO: 22692 - RNA, 32 nt, Human
aacccggaagguggagguuguugcggugagcu

SEQ ID NO: 22693 - RNA, 32 nt, Human
aacccggaagguggaguuugcagugagccgag

SEQ ID NO: 22694 - RNA, 32 nt, Human
aacccggaggcagagguugcagugagccgaga

SEQ ID NO: 22695 - RNA, 32 nt, Human
aacccggaggcggagguugcgguaagccgaga

SEQ ID NO: 22696 - RNA, 32 nt, Human
aacccggaggugggcuacugcagggaccugag

SEQ ID NO: 22697 - RNA, 32 nt, Human
aacccggcaauguugguggcucuugcauuccu

SEQ ID NO: 22698 - RNA, 32 nt, Human
aacccggcaggaagagguugcauugagcugag

SEQ ID NO: 22699 - RNA, 32 nt, Human
aacccggcaggcagagcuugcagugagccgag

SEQ ID NO: 22700 - RNA, 32 nt, Human
aacccggcaggcagagguugcagugagccgag

SEQ ID NO: 22701 - RNA, 32 nt, Human
aacccggcaggcggagguugcagugagcggag

SEQ ID NO: 22702 - RNA, 32 nt, Human
aacccggcgcauccuggugaagccacacccag

SEQ ID NO: 22703 - RNA, 32 nt, Human
aacccggcgggaagagguugcagugagccaag

SEQ ID NO: 22704 - RNA, 32 nt, Human
aacuggaggcacggcagaggaggcagggccga

SEQ ID NO: 22705 - RNA, 32 nt, Human
aacuggagugugaaggaccgagacaagaugaa

SEQ ID NO: 22706 - RNA, 32 nt, Human
aacuggaucccuuccuuacaccuuaacaaaaa

SEQ ID NO: 22707 - RNA, 32 nt, Human
aacuggaucugaggaggcaggaaaggacccaa

SEQ ID NO: 22708 - RNA, 32 nt, Human
aacuggaugcagcugcucauacucaaucccau

SEQ ID NO: 22709 - RNA, 32 nt, Human
aacuggaugggacauuccgaagagcucccagc

SEQ ID NO: 22710 - RNA, 32 nt, Human
aacuggauguaggccaggcauggugagucaca

SEQ ID NO: 22711 - RNA, 32 nt, Human
aacuggauuuguuaggugagggugaggccaag

SEQ ID NO: 22712 - RNA, 32 nt, Human
aacuggcaacaagcaaacaggucuucagcaaa

SEQ ID NO: 22713 - RNA, 32 nt, Human
aacuggcacccaugggcccacccaugagugau

SEQ ID NO: 22714 - RNA, 32 nt, Human
aacuggcagacaggccagggauguauguugcu

SEQ ID NO: 22715 - RNA, 32 nt, Human
aacuggcauacugcaaaguccccagcccugcc

SEQ ID NO: 22716 - RNA, 32 nt, Human
aacuggcauccuggugggcccaaggguuuuca

SEQ ID NO: 22717 - RNA, 32 nt, Human
aacuggcauuacaggcgccugccaccaccccu

SEQ ID NO: 22718 - RNA, 32 nt, Human
aacuggccacugcugaucugcgccuagaagac

SEQ ID NO: 22719 - RNA, 32 nt, Human
aacuggccagaagaggagcagcugcaguccug

SEQ ID NO: 22720 - RNA, 32 nt, Human
aacuggccagagaucaccccagaagagaguac

SEQ ID NO: 22721 - RNA, 32 nt, Human
aacuggcccaggcacuggaguggaauagaaug

SEQ ID NO: 22722 - RNA, 32 nt, Human
aacuggcccaguaggcugagagauaugaugac

SEQ ID NO: 22723 - RNA, 21 nt, Human
aacuggccggcagccugguga

SEQ ID NO: 22724 - RNA, 32 nt, Human
aacuggccuccagggggcauuguuggaauaug

SEQ ID NO: 22725 - RNA, 32 nt, Human
aacuggccugggagcugagguuggcacuagug

SEQ ID NO: 22726 - RNA, 32 nt, Human
aacuggccuuucucuuaccuugccuuaggccu

SEQ ID NO: 22727 - RNA, 32 nt, Human
aacuggcggguauucuggucauugaggagaca

SEQ ID NO: 22728 - RNA, 32 nt, Human
aacuggcuacugagucaugauccuugcugaua

SEQ ID NO: 22729 - RNA, 32 nt, Human
aacuggcucauggagaaaacaaauuugacuug

SEQ ID NO: 22730 - RNA, 32 nt, Human
aacuggcugccucacauugcucugguuugugu

SEQ ID NO: 22731 - RNA, 32 nt, Human
aacuggcuguuccugaagucugugccccacuu

SEQ ID NO: 22732 - RNA, 32 nt, Human
aacuggcuuaaacaagaacagggcucucucac

SEQ ID NO: 22733 - RNA, 32 nt, Human
aacugggaaaacagugaaucuuaugguggaag

SEQ ID NO: 22734 - RNA, 32 nt, Human
aacugggaaagccaaagucagucuugagcaga

SEQ ID NO: 22735 - RNA, 32 nt, Human
aacugggaagagaaggaggggaacuuaaaccu

SEQ ID NO: 22736 - RNA, 32 nt, Human
aacugggacaacaggcgcccgucaccacgccc

SEQ ID NO: 22737 - RNA, 32 nt, Human
aacugggacaacauguccaugccaccaugcuc

SEQ ID NO: 22738 - RNA, 22 nt, Human
aacugggacagcuuuccccuca

SEQ ID NO: 22739 - RNA, 32 nt, Human
aacugggaccucaagggccuucugucagccuu

SEQ ID NO: 22740 - RNA, 32 nt, Human
aacugggacuaaaggcacacaccaccacaccu

SEQ ID NO: 22741 - RNA, 32 nt, Human
aacugggacuacacacgcaugccacuacaccc

SEQ ID NO: 22742 - RNA, 32 nt, Human
aacugggacuacagaugcgugccaccacaccu

SEQ ID NO: 22743 - RNA, 32 nt, Human
aacugggacuacaggcacagcucacuaugccc

SEQ ID NO: 22744 - RNA, 32 nt, Human
aacugggacuacaggcaugcaccaccaugccu

SEQ ID NO: 22745 - RNA, 32 nt, Human
aacugggacuacaggcgcgugccaccaugccu

SEQ ID NO: 22746 - RNA, 32 nt, Human
aacugggacuacaggugcccgccaccacaccc

SEQ ID NO: 22747 - RNA, 32 nt, Human
aacugggacugcaggcacaugccaccacaucc

SEQ ID NO: 22748 - RNA, 23 nt, Human
aacugggagaaauaaacuucugu

SEQ ID NO: 22749 - RNA, 32 nt, Human
aacugggagaggaagagagcaggacaaggcag

SEQ ID NO: 22750 - RNA, 32 nt, Human
aacugggagagggaggaagggagaaagugaga

SEQ ID NO: 22751 - RNA, 32 nt, Human
aacugggagaggggcaugcuccccagcugugu

SEQ ID NO: 22752 - RNA, 32 nt, Human
aacugggagcagagcacacagagccguggagc

SEQ ID NO: 22753 - RNA, 32 nt, Human
aacugggaggcagggguuggagugagccagga

SEQ ID NO: 22754 - RNA, 32 nt, Human
aacugggaggcggagcuugcagugagccgaga

SEQ ID NO: 22755 - RNA, 32 nt, Human
aacugggaggcugaggcaggaggaucacuuga

SEQ ID NO: 22756 - RNA, 22 nt, Human
aacugggagguggagguugcag

SEQ ID NO: 22757 - RNA, 25 nt, Human
aacugggagguggagguugcaguga

SEQ ID NO: 22758 - RNA, 32 nt, Human
aacugggagguggagguugcagugagccaaga

SEQ ID NO: 22759 - RNA, 32 nt, Human
aacugggaugggugaguccacucuggcuaggg

SEQ ID NO: 22760 - RNA, 32 nt, Human
aacugggaugugugaaagcaggaagcaaagcu

SEQ ID NO: 22761 - RNA, 32 nt, Human
aacugggauuacaggcacccgccaccaugcca

SEQ ID NO: 22762 - RNA, 32 nt, Human
aacugggauuacaggcaugaggcaccgugccu

SEQ ID NO: 22763 - RNA, 32 nt, Human
aacugggauuacaggcaugcaccaccacgccc

SEQ ID NO: 22764 - RNA, 32 nt, Human
aacugggauuacaggcaugcaccaccaugccu

SEQ ID NO: 22765 - RNA, 32 nt, Human
aacugggauuacaggcaugcgccaccauaccc

SEQ ID NO: 22766 - RNA, 32 nt, Human
aacugggauuacaggcaugcgccaccaugccc

SEQ ID NO: 22767 - RNA, 32 nt, Human
aacugggauuacaggcaugcgccacuaaggga

SEQ ID NO: 22768 - RNA, 32 nt, Human
aacugggauuacaggcaugugccaucacgcuc

SEQ ID NO: 22769 - RNA, 32 nt, Human
aacugggauuacaggcaugugucaccaugccc

SEQ ID NO: 22770 - RNA, 32 nt, Human
aacugggauuacaggugcccaccaccaugccc

SEQ ID NO: 22771 - RNA, 32 nt, Human
aacugggauuacaggugugugccaccacaccc

SEQ ID NO: 22772 - RNA, 32 nt, Human
aacugggauuacagucgugugccaccacgcuc

SEQ ID NO: 22773 - RNA, 32 nt, Human
aacugggauuauaggcaugcaccaccacgccc

SEQ ID NO: 22774 - RNA, 32 nt, Human
aacugggauugcaggcgugagccaccgcgccc

SEQ ID NO: 22775 - RNA, 32 nt, Human
aacugggauuuuaucucaucucuuuaaaagag

SEQ ID NO: 22776 - RNA, 32 nt, Human
aacugggcaaaaguugugaagcagcaauucug

SEQ ID NO: 22777 - RNA, 32 nt, Human
aacugggcacuucccucuggaaaucacagugu

SEQ ID NO: 22778 - RNA, 32 nt, Human
aacugggcagaggccacagucaccuccccaca

SEQ ID NO: 22779 - RNA, 32 nt, Human
aacugggcauuucacgaacuguucacacugca

SEQ ID NO: 22780 - RNA, 32 nt, Human
aacugggccucccucccuccccuuggucaugg

SEQ ID NO: 22781 - RNA, 32 nt, Human
aacugggcggagguggaggugcagggucaacu

SEQ ID NO: 22782 - RNA, 32 nt, Human
aacugggcucaagcgauccucccacuuuggcc

SEQ ID NO: 22783 - RNA, 32 nt, Human
aacugggcucacugcagccuagaccugcuggg

SEQ ID NO: 22784 - RNA, 32 nt, Human
aacugggcugugaacccgcaggggcagggacc

SEQ ID NO: 22785 - RNA, 32 nt, Human
aacugggcuuugccucacguauuccugcugcc

SEQ ID NO: 22786 - RNA, 31 nt, Human
aacuggggaaagaaguugugaucuguugccu

SEQ ID NO: 22787 - RNA, 32 nt, Human
aacuggggaagcagagguuguagugagccgag

SEQ ID NO: 22788 - RNA, 32 nt, Human
aacuggggaccaauagaacccugcugaagcag

SEQ ID NO: 22789 - RNA, 32 nt, Human
aacuggggagagaagagauacagagcuaccau

SEQ ID NO: 22790 - RNA, 32 nt, Human
aacuggggaggagaagguugcagugagccgag

SEQ ID NO: 22791 - RNA, 32 nt, Human
aacuggggaggcagagguugcagugagacaag

SEQ ID NO: 22792 - RNA, 32 nt, Human
aacuggggaggcagagguugcaguggcccgag

SEQ ID NO: 22793 - RNA, 26 nt, Human
aacuggggaggcagagguugcgguga

SEQ ID NO: 22794 - RNA, 32 nt, Human
aacuggggaggcagagguugcggugagcccag

SEQ ID NO: 22795 - RNA, 32 nt, Human
aacuggggagguagagguuacagcgagccaag

SEQ ID NO: 22796 - RNA, 32 nt, Human
aacuggggagguggagguaggaagauugcuug

SEQ ID NO: 22797 - RNA, 32 nt, Human
aacugggggacaggucugcgcugcagugggau

SEQ ID NO: 22798 - RNA, 32 nt, Human
aacugggggaggcagggcacagggagaugcuc

SEQ ID NO: 22799 - RNA, 32 nt, Human
aacugggggugucgcuggcaaguucccacaag

SEQ ID NO: 22800 - RNA, 32 nt, Human
aacugggguacagccugggcucagggaauagc

SEQ ID NO: 22801 - RNA, 32 nt, Human
aacuggggugggggaagggaaaaaggaaagua

SEQ ID NO: 22802 - RNA, 32 nt, Human
aacuggguccccuaucacaaggcuacuggcua

SEQ ID NO: 22803 - RNA, 32 nt, Human
aacugggucucucagcccuggggaucagaaag

SEQ ID NO: 22804 - RNA, 32 nt, Human
aacugggugaagccacacacacccaaugaaca

SEQ ID NO: 22805 - RNA, 32 nt, Human
aacuggguggccagggcguccgugcacgaccc

SEQ ID NO: 22806 - RNA, 32 nt, Human
aacugggugucuuuuucuuuucaucuggcaac

SEQ ID NO: 22807 - RNA, 32 nt, Human
aacuggguuaaucaagucucgguaaguccuuu

SEQ ID NO: 22808 - RNA, 26 nt, Human
aacuggguuggacccagcugggccau

SEQ ID NO: 22809 - RNA, 32 nt, Human
aacuggguuuggguucugugguuccaguggaa

SEQ ID NO: 22810 - RNA, 32 nt, Human
aacugguaacaggcugggugcaauggcucaca

SEQ ID NO: 22811 - RNA, 32 nt, Human
aacugguagcagaagcagcagugaagaugaug

SEQ ID NO: 22812 - RNA, 32 nt, Human
aacugguagcauuugccacuucccauggugua

SEQ ID NO: 22813 - RNA, 32 nt, Human
aacugguccugccucuuuaccacacagaacca

SEQ ID NO: 22814 - RNA, 32 nt, Human
aacuggucucaaacuccuggccucaagcaauu

SEQ ID NO: 22815 - RNA, 32 nt, Human
aacuggucucgaacuccugaccucgggaucca

SEQ ID NO: 22816 - RNA, 32 nt, Human
aacuggucuucuucaagagagcuaaguauaca

SEQ ID NO: 22817 - RNA, 32 nt, Human
aacuggucuuugacagauuugacuguccauau

SEQ ID NO: 22818 - RNA, 32 nt, Human
aacuggugaagugagaaaaacagaaugcagcu

SEQ ID NO: 22819 - RNA, 32 nt, Human
aacuggugagauuacaggcaugagccaccaca

SEQ ID NO: 22820 - RNA, 32 nt, Human
aacuggugcucacaccuuacucaacauuagaa

SEQ ID NO: 22821 - RNA, 32 nt, Human
aacugguguuucuauuaauaaguaucuaaguu

SEQ ID NO: 22822 - RNA, 32 nt, Human
aacugguucaauuccccgcuccugggcuuccu

SEQ ID NO: 22823 - RNA, 32 nt, Human
aacugguuccgugaggaaaggcagaagccguu

SEQ ID NO: 22824 - RNA, 32 nt, Human
aacugguucucuguguuccaagcacaauauua

SEQ ID NO: 22825 - RNA, 32 nt, Human
aacugguuuucacuuccaguuacugcaacagc

SEQ ID NO: 22826 - RNA, 32 nt, Human
aacuguaaccgauuguaugacugcugcacuua

SEQ ID NO: 22827 - RNA, 23 nt, Human
aacuguaagaaauaaaucucugu

SEQ ID NO: 22828 - RNA, 21 nt, Human
aacuguacaagacacuacggg

SEQ ID NO: 22829 - RNA, 32 nt, Human
aacuguacaucucacauguugggaaacgcugg

SEQ ID NO: 22830 - RNA, 32 nt, Human
aacuguaccacugggccaagugcaguggauca

SEQ ID NO: 22831 - RNA, 32 nt, Human
aacuguaccauccagagcccaccagaagcuau

SEQ ID NO: 22832 - RNA, 32 nt, Human
aacuguacgcagugacgugcacuggccugggg

SEQ ID NO: 22833 - RNA, 32 nt, Human
aacuguagaaacccuccagaaauuuccacugc

SEQ ID NO: 22834 - RNA, 32 nt, Human
aacuguagaagagaaucaagaagaaaaauaaa

SEQ ID NO: 22835 - RNA, 32 nt, Human
aacuguagcuuauauucuuuauuugugcauac

SEQ ID NO: 22836 - RNA, 32 nt, Human
aacuguagggcaggcuaggacauaucaucuuu

SEQ ID NO: 22837 - RNA, 32 nt, Human
aacuguagucaucuuaaaggcuucucauccac

SEQ ID NO: 22838 - RNA, 32 nt, Human
aacuguaucucuuccggcugaggacagagaag

SEQ ID NO: 22839 - RNA, 32 nt, Human
aacuguaucugccacucauuuccccaguuggu

SEQ ID NO: 22840 - RNA, 32 nt, Human
aacuguaucuuucuguuugucagaaguucucc

SEQ ID NO: 22841 - RNA, 32 nt, Human
aacuguaugcugagggagguggugacggauac

SEQ ID NO: 22842 - RNA, 32 nt, Human
aacuguauuaccugcuuugcaagguggcuuua

SEQ ID NO: 22843 - RNA, 32 nt, Human
aacugucacugagacacagaagccacagagac

SEQ ID NO: 22844 - RNA, 32 nt, Human
aacugucacugcaccaagcucugcuggaggag

SEQ ID NO: 22845 - RNA, 32 nt, Human
aacugucagcauuuuucugccugccugccucc

SEQ ID NO: 22846 - RNA, 32 nt, Human
aacugucaggcugaaaacaauggaguauucuc

SEQ ID NO: 22847 - RNA, 32 nt, Human
aacugucaguggugguuucccaugaccacgcc

SEQ ID NO: 22848 - RNA, 32 nt, Human
aacugucaucagagcagaaaucaagcccaguc

SEQ ID NO: 22849 - RNA, 32 nt, Human
aacugucauggcagguacagggaccaauggcu

SEQ ID NO: 22850 - RNA, 32 nt, Human
aacugucauuaaggagcacagacuuacugaag

SEQ ID NO: 22851 - RNA, 32 nt, Human
aacuguccaaucaaaagacagauuggcaaaau

SEQ ID NO: 22852 - RNA, 32 nt, Human
aacuguccaucuuuucggugcucccuaaucca

SEQ ID NO: 22853 - RNA, 32 nt, Human
aacugucccgggcuggagagccggcaacugcc

SEQ ID NO: 22854 - RNA, 32 nt, Human
aacuguccucuccuuauuaucucccauuuccc

SEQ ID NO: 22855 - RNA, 32 nt, Human
aacuguccuggucacagagcaggcuucucucg

SEQ ID NO: 22856 - RNA, 32 nt, Human
aacuguccuguaccaaagcuugagugucaggu

SEQ ID NO: 22857 - RNA, 28 nt, Human
aacugucgacgugcugccacgucuguug

SEQ ID NO: 22858 - RNA, 32 nt, Human
aacugucgagagcaucuugucuuccacacagu

SEQ ID NO: 22859 - RNA, 32 nt, Human
aacugucuauauuagacacccccagccaguuu

SEQ ID NO: 22860 - RNA, 32 nt, Human
aacugucuauucugccucgcaccuacaaagag

SEQ ID NO: 22861 - RNA, 32 nt, Human
aacugucuccuaccucugcucuuggaggagau

SEQ ID NO: 22862 - RNA, 24 nt, Human
aacugugaaaaaugaccugccugu

SEQ ID NO: 22863 - RNA, 32 nt, Human
aacugugaaagagagguuccagggguaucucc

SEQ ID NO: 22864 - RNA, 21 nt, Human
aacugugaauuuuauuucugu

SEQ ID NO: 22865 - RNA, 24 nt, Human
aacugugacacaacacauuucugu

SEQ ID NO: 22866 - RNA, 23 nt, Human
aacugugagaaaauaaauguuug

SEQ ID NO: 22867 - RNA, 23 nt, Human
aacugugagaaaauaaauuucug

SEQ ID NO: 22868 - RNA, 24 nt, Human
aacugugagaaaauaaauuucugu

SEQ ID NO: 22869 - RNA, 21 nt, Human
aacugugagaaagaaaucucu

SEQ ID NO: 22870 - RNA, 23 nt, Human
aacugugagaaauaaaugucugu

SEQ ID NO: 22871 - RNA, 23 nt, Human
aacugugagaaauaaauuucugu

SEQ ID NO: 22872 - RNA, 23 nt, Human
aacugugagacaauaaacucuca

SEQ ID NO: 22873 - RNA, 23 nt, Human
aacugugagagauaaauuucugu

SEQ ID NO: 22874 - RNA, 32 nt, Human
aacugugagaggaggagaggccaggaagggag

SEQ ID NO: 22875 - RNA, 24 nt, Human
aacugugagauguuacauuucugu

SEQ ID NO: 22876 - RNA, 23 nt, Human
aacugugagccaaauaaacuucu

SEQ ID NO: 22877 - RNA, 32 nt, Human
aacugugagccaauuaaacugcuuuauaaauu

SEQ ID NO: 22878 - RNA, 22 nt, Human
aacugugaggcaauaaauuucu

SEQ ID NO: 22879 - RNA, 24 nt, Human
aacugugaggcaauacauuucugu

SEQ ID NO: 22880 - RNA, 32 nt, Human
aacugugcaaggccugguguuucuugauacau

SEQ ID NO: 22881 - RNA, 32 nt, Human
aacugugcagaacaugccgggagugaucaguc

SEQ ID NO: 22882 - RNA, 32 nt, Human
aacugugcauuguacccugaaaccagcuuuau

SEQ ID NO: 22883 - RNA, 32 nt, Human
aacugugccauuugaacagucacuuccaagcu

SEQ ID NO: 22884 - RNA, 20 nt, Human
aacugugcccaggcccaaag

SEQ ID NO: 22885 - RNA, 32 nt, Human
aacugugcccaucuuaguuuucaugaguuuuc

SEQ ID NO: 22886 - RNA, 32 nt, Human
aacugugccucccucugucuguuuucacuuga

SEQ ID NO: 22887 - RNA, 32 nt, Human
aacugugccuggaagguugaaggguuuguucc

SEQ ID NO: 22888 - RNA, 32 nt, Human
aacuguggaaaaaguaggagaggcagauuccc

SEQ ID NO: 22889 - RNA, 32 nt, Human
aacuguggacacacaaggugaagaggacuccg

SEQ ID NO: 22890 - RNA, 32 nt, Human
aacuguggauucuuuuucucucguggucucac

SEQ ID NO: 22891 - RNA, 21 nt, Human
aacuguggccaaaggaggcag

SEQ ID NO: 22892 - RNA, 32 nt, Human
aacuguggcuacugugcauuccuugaauaauc

SEQ ID NO: 22893 - RNA, 32 nt, Human
aacuguggcucagccacaucccaaagggggca

SEQ ID NO: 22894 - RNA, 32 nt, Human
aacuguggcugagacgugggcucuccagggag

SEQ ID NO: 22895 - RNA, 32 nt, Human
aacuguggcuguguugacaauccaggcuggau

SEQ ID NO: 22896 - RNA, 23 nt, Human
aacugugggcaauaaaugucugu

SEQ ID NO: 22897 - RNA, 32 nt, Human
aacugugggucugacccaggagaacggaaagc

SEQ ID NO: 22898 - RNA, 32 nt, Human
aacugugguccaucuccagacucuaccacuua

SEQ ID NO: 22899 - RNA, 32 nt, Human
aacuguguaacugucuucaucuuuacagagga

SEQ ID NO: 22900 - RNA, 32 nt, Human
aacuguguaguaccuuagacuuggcauuuauu

SEQ ID NO: 22901 - RNA, 32 nt, Human
aacugugucaacaacaggaaacuauuuguauu

SEQ ID NO: 22902 - RNA, 32 nt, Human
aacugugucauccuggagccauauccaugagu

SEQ ID NO: 22903 - RNA, 32 nt, Human
aacuguguccaguuucucugugguguuuauga

SEQ ID NO: 22904 - RNA, 32 nt, Human
aacugugucccaguagagggucccggcugcac

SEQ ID NO: 22905 - RNA, 32 nt, Human
aacugugucuuugugguguccucuggcuuaag

SEQ ID NO: 22906 - RNA, 31 nt, Human
aacugugugagucucccuugaggagcacuca

SEQ ID NO: 22907 - RNA, 23 nt, Human
aacuguguggcaagagagccuca

SEQ ID NO: 22908 - RNA, 21 nt, Human
aacugugugucacccacagag

SEQ ID NO: 22909 - RNA, 32 nt, Human
aacugugugugauccaguaggccucaggccca

SEQ ID NO: 22910 - RNA, 32 nt, Human
aacuguguucuuccucuucugaagacaucagu

SEQ ID NO: 22911 - RNA, 32 nt, Human
aacuguguugcaaaaucacuccccuaccguca

SEQ ID NO: 22912 - RNA, 32 nt, Human
aacuguuacaaaaccaguugguggugacaaga

SEQ ID NO: 22913 - RNA, 32 nt, Human
aacuguuaccugccugucaucaugaaagccug

SEQ ID NO: 22914 - RNA, 25 nt, Human
aacuguuauccauugaguccagaca

SEQ ID NO: 22915 - RNA, 19 nt, Human
aacuguucacaacagcaaa

SEQ ID NO: 22916 - RNA, 32 nt, Human
aacuguuccccagcuacugaggggcacuguca

SEQ ID NO: 22917 - RNA, 20 nt, Human
aacuguucggcuacuggaca

SEQ ID NO: 22918 - RNA, 32 nt, Human
aacuguugaacacaugacugugaugcacaaau

SEQ ID NO: 22919 - RNA, 32 nt, Human
aacuguugagcaugacaucaggaagccuguac

SEQ ID NO: 22920 - RNA, 32 nt, Human
aacuguugcaguaugauucagaucauuuaaaa

SEQ ID NO: 22921 - RNA, 32 nt, Human
aacuguuguaaauacugagaaacauuuugaau

SEQ ID NO: 22922 - RNA, 32 nt, Human
aacuguugugugugugcaugccuugggcacaa

SEQ ID NO: 22923 - RNA, 32 nt, Human
aacuguuuaaccggaucccauuguacccagag

SEQ ID NO: 22924 - RNA, 32 nt, Human
aacuguuuagaccuuuugaagaacaaagacaa

SEQ ID NO: 22925 - RNA, 32 nt, Human
aacuguuuauagucuuuucacacugcagcuuu

SEQ ID NO: 22926 - RNA, 22 nt, Human
aacuguuuccugcauucauuca

SEQ ID NO: 22927 - RNA, 32 nt, Human
aacuguuugcagcacaauauaacuuuacauuc

SEQ ID NO: 22928 - RNA, 32 nt, Human
aacuguuuucauuuucacggcugucucacugg

SEQ ID NO: 22929 - RNA, 32 nt, Human
aacuguuuuccaggaacaaagggcucaaguaa

SEQ ID NO: 22930 - RNA, 32 nt, Human
aacuguuuuccccaaagcuaaacaaguuaaaa

SEQ ID NO: 22931 - RNA, 32 nt, Human
aacuguuuucuuucccuuaauuuccuuuccua

SEQ ID NO: 22932 - RNA, 32 nt, Human
aacuuaaaaauauaugaauacaugcgcaauac

SEQ ID NO: 22933 - RNA, 32 nt, Human
aacuuaaaaugcaaagaggauauuuuucucuu

SEQ ID NO: 22934 - RNA, 32 nt, Human
aacuuaaacauauucuguucacuugaguguaa

SEQ ID NO: 22935 - RNA, 32 nt, Human
aacuuaaacguuaauuuuugugcaaaaacaaa

SEQ ID NO: 22936 - RNA, 32 nt, Human
aacuuaaagaucuuugucugugaagaagaaaa

SEQ ID NO: 22937 - RNA, 32 nt, Human
aacuuaaaugaacacagcucuuuaacaugguu

SEQ ID NO: 22938 - RNA, 32 nt, Human
aacuuaaauugcuuauuuuguuguguaauguc

SEQ ID NO: 22939 - RNA, 32 nt, Human
aacuuaaccacuguuaagugaucugugaucaa

SEQ ID NO: 22940 - RNA, 32 nt, Human
aacuuaaccagcuccaucuuguuucuaaccuc

SEQ ID NO: 22941 - RNA, 32 nt, Human
aacuuaacuuucuguaaaggcacuuugugguu

SEQ ID NO: 22942 - RNA, 32 nt, Human
aacuuaagaggaaauaaggaaaaggagagaaa

SEQ ID NO: 22943 - RNA, 32 nt, Human
aacuuaagcccaagaagagagcucagaagugu

SEQ ID NO: 22944 - RNA, 32 nt, Human
aacuuaagggacaccagaaaauuuguacugaa

SEQ ID NO: 22945 - RNA, 32 nt, Human
aacuuaaggugaggagaaagagcgcuagcuuc

SEQ ID NO: 22946 - RNA, 32 nt, Human
aacuuaaguggagaguuuucucagggauaaga

SEQ ID NO: 22947 - RNA, 32 nt, Human
aacuuaaguggaguuuaccggcagcaucaaau

SEQ ID NO: 22948 - RNA, 32 nt, Human
aacuuaauauccaucugucagucaucaacuuu

SEQ ID NO: 22949 - RNA, 32 nt, Human
aacuuaaugggggacggaagggggaggagugc

SEQ ID NO: 22950 - RNA, 32 nt, Human
aacuuaauugaauguuaccucuuggagggagu

SEQ ID NO: 22951 - RNA, 32 nt, Human
aacuuacacauacuagcagcauuaucauggga

SEQ ID NO: 22952 - RNA, 32 nt, Human
aacuuacauaugcacauuuuguuacaucauuu

SEQ ID NO: 22953 - RNA, 32 nt, Human
aacuuacggggugggggcgggggugaggguag

SEQ ID NO: 22954 - RNA, 32 nt, Human
aacuuacuaggcagcagagaauucauacugga

SEQ ID NO: 22955 - RNA, 32 nt, Human
aacuuacucauguaacaaaccugugcauguac

SEQ ID NO: 22956 - RNA, 32 nt, Human
aacuuacugagccugugacuuguauuuagcug

SEQ ID NO: 22957 - RNA, 32 nt, Human
aacuuacugccauuuuucauaaucugaguggc

SEQ ID NO: 22958 - RNA, 32 nt, Human
aacuuacuuugguaucaaaaucacacaacucc

SEQ ID NO: 22959 - RNA, 32 nt, Human
aacuuacuuuucucccuggcuuuugguucacu

SEQ ID NO: 22960 - RNA, 32 nt, Human
aacuuagaugugaaaaucuacacacugggaga

SEQ ID NO: 22961 - RNA, 32 nt, Human
aacuuagcaacgaucuagcugugcaaaggcau

SEQ ID NO: 22962 - RNA, 18 nt, Human
aacuuagcauguguugaa

SEQ ID NO: 22963 - RNA, 32 nt, Human
aacuuagccaacuugaccccucucaucccacu

SEQ ID NO: 22964 - RNA, 32 nt, Human
aacuuagccagccacuacuguuucauuguguu

SEQ ID NO: 22965 - RNA, 32 nt, Human
aacuuagccuuaggaagcaugguaagacucug

SEQ ID NO: 22966 - RNA, 32 nt, Human
aacuuagcucaccgcaaccuccaccucccggg

SEQ ID NO: 22967 - RNA, 32 nt, Human
aacuuagcuucucagggguaaagacagacaga

SEQ ID NO: 22968 - RNA, 32 nt, Human
aacuuaggagagaagcacggaggagcccccgg

SEQ ID NO: 22969 - RNA, 32 nt, Human
aacuuaggcuuuuggcucagaagauuauugaa

SEQ ID NO: 22970 - RNA, 24 nt, Human
aacuuaggugauucuccugccuca

SEQ ID NO: 22971 - RNA, 31 nt, Human
aacuuagucaauaaaaccuugaaauaaagau

SEQ ID NO: 22972 - RNA, 32 nt, Human
aacuuaguccuaaucccagcacuuugggaggc

SEQ ID NO: 22973 - RNA, 32 nt, Human
aacuuaguucuuuggaaauacacaaguaaaac

SEQ ID NO: 22974 - RNA, 32 nt, Human
aacuuaguuuucugaauggggguggggaguug

SEQ ID NO: 22975 - RNA, 32 nt, Human
aacuuauaaugaaugggcauuguguuaagaaa

SEQ ID NO: 22976 - RNA, 32 nt, Human
aacuuaucauauggcccagccauuucacuacu

SEQ ID NO: 22977 - RNA, 32 nt, Human
aacuuaucaucacacaacucagccuggcugau

SEQ ID NO: 22978 - RNA, 32 nt, Human
aacuuauccaugguuugugucauuaggagucc

SEQ ID NO: 22979 - RNA, 32 nt, Human
aacuuaucucacuccugugaacuuucaggcug

SEQ ID NO: 22980 - RNA, 32 nt, Human
aacuuaugccuggagcuguauccugccccgca

SEQ ID NO: 22981 - RNA, 32 nt, Human
aacuuauggaaagcccauuuguguacacaguc

SEQ ID NO: 22982 - RNA, 32 nt, Human
aacuuauucuacauucugaaagcacaauuuuc

SEQ ID NO: 22983 - RNA, 32 nt, Human
aacuucaaggggaauuucagcuccguuugcgu

SEQ ID NO: 22984 - RNA, 32 nt, Human
aacuucaaguagcggcaacaaggguccgugga

SEQ ID NO: 22985 - RNA, 31 nt, Human
aacuucaaguuucagcaacuaccuacaaaag

SEQ ID NO: 22986 - RNA, 32 nt, Human
aacuucacagcaggccagcugcagugacuugu

SEQ ID NO: 22987 - RNA, 32 nt, Human
aacuucacagcccgcgugcagcgcggcucucg

SEQ ID NO: 22988 - RNA, 32 nt, Human
aacuucacauccguccuccugucucagggcug

SEQ ID NO: 22989 - RNA, 32 nt, Human
aacuucacgagcguuggcugggccucggcuuc

SEQ ID NO: 22990 - RNA, 32 nt, Human
aacuucacugcaauucuguuucccucauuuga

SEQ ID NO: 22991 - RNA, 32 nt, Human
aacuucagacccuggguagggaagagaagggg

SEQ ID NO: 22992 - RNA, 32 nt, Human
aacuucagacuuccuguccugcugguaucaug

SEQ ID NO: 22993 - RNA, 31 nt, Human
aacuucagagaagucaguuggagaaaaauga

SEQ ID NO: 22994 - RNA, 31 nt, Human
aacuucagagaagucaguuggagaaaaugaa

SEQ ID NO: 22995 - RNA, 32 nt, Human
aacuucagagccugucaccaggaaagguaagc

SEQ ID NO: 22996 - RNA, 32 nt, Human
aacuucagcaacugggaaucacagaauaccua

SEQ ID NO: 22997 - RNA, 32 nt, Human
aacuucagcuccugccuccugcccaugcagcc

SEQ ID NO: 22998 - RNA, 32 nt, Human
aacuucagucaguuggagggauggauuugaga

SEQ ID NO: 22999 - RNA, 32 nt, Human
aacuucaguccgggcuggaggccgugcacaac

SEQ ID NO: 23000 - RNA, 32 nt, Human
aacuucaguuuauaauuggaagagaaauuuuu

SEQ ID NO: 23001 - RNA, 32 nt, Human
aacuucaugcugauuucucugccucuugauuu

SEQ ID NO: 23002 - RNA, 22 nt, Human
aacuucaugggacucuucaaag

SEQ ID NO: 23003 - RNA, 32 nt, Human
aacuucauggucuccaaggucuccgcuccccu

SEQ ID NO: 23004 - RNA, 18 nt, Human
aacuucauguucccugca

SEQ ID NO: 23005 - RNA, 32 nt, Human
aacuucauguuugggcagaagcugaaugucug

SEQ ID NO: 23006 - RNA, 32 nt, Human
aacuucauuagcuucugugaugacucaagauu

SEQ ID NO: 23007 - RNA, 32 nt, Human
aacuuccaagccuccggcaucuuuuccuggug

SEQ ID NO: 23008 - RNA, 21 nt, Human
aacuuccagagaccuaucuca

SEQ ID NO: 23009 - RNA, 32 nt, Human
aacuuccauauggucaguaguagauguucucu

SEQ ID NO: 23010 - RNA, 32 nt, Human
aacuuccaugagccaccaugcccggccccuua

SEQ ID NO: 23011 - RNA, 32 nt, Human
aacuuccaugaucauccaaagucugaaacaaa

SEQ ID NO: 23012 - RNA, 32 nt, Human
aacuucccacaguggcugagacugaaugaaag

SEQ ID NO: 23013 - RNA, 32 nt, Human
aacuucccagccuccagaacugugagaaagaa

SEQ ID NO: 23014 - RNA, 32 nt, Human
aacuucccaggcacccuccuuucugccccaga

SEQ ID NO: 23015 - RNA, 32 nt, Human
aacuucccaguucugacauucacagcaugacc

SEQ ID NO: 23016 - RNA, 32 nt, Human
aacuuccccucccacucugggcucaggcuguc

SEQ ID NO: 23017 - RNA, 32 nt, Human
aacuuccccucuaacuggacagccucuucugu

SEQ ID NO: 23018 - RNA, 32 nt, Human
aacuuccccuuuccucugguuuccuuguccua

SEQ ID NO: 23019 - RNA, 32 nt, Human
aacuucccgggaagcagcggcacuuuucuccc

SEQ ID NO: 23020 - RNA, 32 nt, Human
aacuucccucauuccaucaucaccaucucuuu

SEQ ID NO: 23021 - RNA, 32 nt, Human
aacuucccucuuaguacugcuuuugcuguauu

SEQ ID NO: 23022 - RNA, 32 nt, Human
aacuucccugugcaaggcaaguuuacaucaca

SEQ ID NO: 23023 - RNA, 32 nt, Human
aacuuccguugccucccagcccucuguaucca

SEQ ID NO: 23024 - RNA, 32 nt, Human
aacuuccuacccacacccucuucccaaggccc

SEQ ID NO: 23025 - RNA, 32 nt, Human
aacuuccuccaggucauuucccagugugagca

SEQ ID NO: 23026 - RNA, 32 nt, Human
aacuuccucccaccccagacauuuuuccuggu

SEQ ID NO: 23027 - RNA, 32 nt, Human
aacuuccucuuccucauuuucuugagauggau

SEQ ID NO: 23028 - RNA, 32 nt, Human
aacuuccugaguagcugggauuacaggcgccc

SEQ ID NO: 23029 - RNA, 32 nt, Human
aacuuccugcacacacuggcagagaggggcgc

SEQ ID NO: 23030 - RNA, 32 nt, Human
aacuuccugcauagccaacuucccagggucau

SEQ ID NO: 23031 - RNA, 32 nt, Human
aacuuccugcucucacacacaccagaggggaa

SEQ ID NO: 23032 - RNA, 32 nt, Human
aacuuccuguucugugggucuggggucaccag

SEQ ID NO: 23033 - RNA, 22 nt, Human
aacuuccuuacucuuucucuca

SEQ ID NO: 23034 - RNA, 32 nt, Human
aacuuccuuauucaagauaaaauaagacauac

SEQ ID NO: 23035 - RNA, 32 nt, Human
aacuuccuucagguuuggcaagugaucaaagc

SEQ ID NO: 23036 - RNA, 32 nt, Human
aacuuccuuucaaccaagugacggccuccugg

SEQ ID NO: 23037 - RNA, 32 nt, Human
aacuuccuuuugcuaaaugcauucuuucugcu

SEQ ID NO: 23038 - RNA, 32 nt, Human
aacuucgaguucuuuugaaauucagagucugu

SEQ ID NO: 23039 - RNA, 32 nt, Human
aacuucgccccuuuaggaaauucaaagcaggg

SEQ ID NO: 23040 - RNA, 32 nt, Human
aacuucgcugcaggaagcagguuuguuucuuu

SEQ ID NO: 23041 - RNA, 32 nt, Human
aacuucgggcaucuacccugcaauucccgcuu

SEQ ID NO: 23042 - RNA, 32 nt, Human
aacuucggggucgucugccagagcagggucug

SEQ ID NO: 23043 - RNA, 32 nt, Human
aacuucguguggccugcaggacaggccugggc

SEQ ID NO: 23044 - RNA, 32 nt, Human
aacuucuaaggggaaagaacagcuggaguuuc

SEQ ID NO: 23045 - RNA, 32 nt, Human
aacuucuaauggugaugacagccucuucuuca

SEQ ID NO: 23046 - RNA, 32 nt, Human
aacuucuacaaaccaagcucagggccccaacc

SEQ ID NO: 23047 - RNA, 32 nt, Human
aacuucuacaauaugguuuacaauaauuccuu

SEQ ID NO: 23048 - RNA, 32 nt, Human
aacuucuacagaagcagguugcagugagccga

SEQ ID NO: 23049 - RNA, 32 nt, Human
aacuucuagcgucagugcuggagggagaagcu

SEQ ID NO: 23050 - RNA, 31 nt, Human
aacuucucaguuuuggagguugggaggucca

SEQ ID NO: 23051 - RNA, 23 nt, Human
aacuucuccuucccuuccccuca

SEQ ID NO: 23052 - RNA, 32 nt, Human
aacuucucgccugggcaggaggcggucguggg

SEQ ID NO: 23053 - RNA, 32 nt, Human
aacuucucuauugacacuuuuaccucaccgag

SEQ ID NO: 23054 - RNA, 32 nt, Human
aacuucucucucccugcucuugcccagggagc

SEQ ID NO: 23055 - RNA, 22 nt, Human
aacuucucugaagccuuucucc

SEQ ID NO: 23056 - RNA, 32 nt, Human
aacuucucugcaagcaccugugcacagcaaug

SEQ ID NO: 23057 - RNA, 32 nt, Human
aacuucucuggacuggaccagaaguuucuagc

SEQ ID NO: 23058 - RNA, 32 nt, Human
aacuucucuuucuccuccuuucccucuuauuc

SEQ ID NO: 23059 - RNA, 32 nt, Human
aacuucucuuuggcuuuucuucaucuguaaaa

SEQ ID NO: 23060 - RNA, 32 nt, Human
aacuucugaacugccuucgucuucaguuauau

SEQ ID NO: 23061 - RNA, 28 nt, Human
aacuucugaagugcugucuuuuuacauu

SEQ ID NO: 23062 - RNA, 32 nt, Human
aacuucugacccacagaaccauaagaugguaa

SEQ ID NO: 23063 - RNA, 32 nt, Human
aacuucugaccucaaaugauugccugccucag

SEQ ID NO: 23064 - RNA, 23 nt, Human
aacuucugaccucaggugaucca

SEQ ID NO: 23065 - RNA, 32 nt, Human
aacuucugaccuugugaucugccugccuuggc

SEQ ID NO: 23066 - RNA, 32 nt, Human
aacuucugaguguggauuugcacauucuaaac

SEQ ID NO: 23067 - RNA, 32 nt, Human
aacuucugcucagaccgagcgugugccacugg

SEQ ID NO: 23068 - RNA, 19 nt, Human
aacuucugcuuguguugga

SEQ ID NO: 23069 - RNA, 22 nt, Human
aacuucuggccucaagugaucc

SEQ ID NO: 23070 - RNA, 23 nt, Human
aacuucuggccucaagugaucca

SEQ ID NO: 23071 - RNA, 18 nt, Human
aacuucugggcccaggag

SEQ ID NO: 23072 - RNA, 32 nt, Human
aacuucugggcucaagugcuucucccaccuca

SEQ ID NO: 23073 - RNA, 32 nt, Human
aacuucugggcugugguuguaaacugugagca

SEQ ID NO: 23074 - RNA, 32 nt, Human
aacuucugugcuguuccugugaaucuccaaau

SEQ ID NO: 23075 - RNA, 32 nt, Human
aacuucuguggaaguuccaguguucucucuua

SEQ ID NO: 23076 - RNA, 21 nt, Human
aacuucuugauuccucagaua

SEQ ID NO: 23077 - RNA, 32 nt, Human
aacuucuuggugcugaagagaggaucaugcaa

SEQ ID NO: 23078 - RNA, 32 nt, Human
aacuucuuucugucaaauuagauuuaaugaga

SEQ ID NO: 23079 - RNA, 32 nt, Human
aacuugaacccgcuuccaccuccgucucccuc

SEQ ID NO: 23080 - RNA, 23 nt, Human
aacuugaagcaagcuuucucuca

SEQ ID NO: 23081 - RNA, 32 nt, Human
aacuugaaguuugaaacccccagcuugcugag

SEQ ID NO: 23082 - RNA, 32 nt, Human
aacuugaaugaacacugcucaaacuuucugcu

SEQ ID NO: 23083 - RNA, 32 nt, Human
aacuugaaugauucuuuccuuuauacuggcaa

SEQ ID NO: 23084 - RNA, 32 nt, Human
aacuugacaauauuuuugcucucuucaaaagu

SEQ ID NO: 23085 - RNA, 32 nt, Human
aacuugaccacugccacaccagcccugggguc

SEQ ID NO: 23086 - RNA, 32 nt, Human
aacuugaccauccuggaacacccuggaagaaa

SEQ ID NO: 23087 - RNA, 32 nt, Human
aacuugaccugggauaacuacuuuaaagaaau

SEQ ID NO: 23088 - RNA, 32 nt, Human
aacuugacuacaggccuccaucuuguuucagg

SEQ ID NO: 23089 - RNA, 32 nt, Human
aacuugagagaaggggaucagcugcucaguac

SEQ ID NO: 23090 - RNA, 32 nt, Human
aacuugagcaacaggcaccuuuacagagggca

SEQ ID NO: 23091 - RNA, 32 nt, Human
aacuugagcaggagagaaaacucccucaaagu

SEQ ID NO: 23092 - RNA, 32 nt, Human
aacuugagcugugacggguucugcaaggggug

SEQ ID NO: 23093 - RNA, 32 nt, Human
aacuugaggaagcccugguucuauuucaccug

SEQ ID NO: 23094 - RNA, 32 nt, Human
aacuugaggaagucuuuugucuuccagcugcu

SEQ ID NO: 23095 - RNA, 32 nt, Human
aacuugaguagcauuggagaaaucucauuucu

SEQ ID NO: 23096 - RNA, 32 nt, Human
aacuugagucucugcuggcuccuuccaagguu

SEQ ID NO: 23097 - RNA, 32 nt, Human
aacuugauacauccaaugcagaaaagucuuga

SEQ ID NO: 23098 - RNA, 32 nt, Human
aacuugauuuaccaagacaagcugugggcugu

SEQ ID NO: 23099 - RNA, 23 nt, Human
aacuugcaagguggagguuacag

SEQ ID NO: 23100 - RNA, 32 nt, Human
aacuugcaagguggagguuacagugagcugaa

SEQ ID NO: 23101 - RNA, 32 nt, Human
aacuugcagaauugggugugugggagagcaaa

SEQ ID NO: 23102 - RNA, 32 nt, Human
aacuugcagaggaccguagcucuccuggccug

SEQ ID NO: 23103 - RNA, 32 nt, Human
aacuugcagcugcccaccucacccucagcucu

SEQ ID NO: 23104 - RNA, 32 nt, Human
aacuugcccuauuugcaaaagcacuuuuguag

SEQ ID NO: 23105 - RNA, 32 nt, Human
aacuugcccugacagccucuggcucccgcucu

SEQ ID NO: 23106 - RNA, 32 nt, Human
aacuugccuuaaacacucaccuucuagucuug

SEQ ID NO: 23107 - RNA, 32 nt, Human
aacuugcggugagccgagaucgcaccacugca

SEQ ID NO: 23108 - RNA, 32 nt, Human
aacuugcugagagcuuacuaugcgucaggugc

SEQ ID NO: 23109 - RNA, 23 nt, Human
aacuugcuggcacccccgcuccc

SEQ ID NO: 23110 - RNA, 22 nt, Human
aacuugcugggcucaaauccca

SEQ ID NO: 23111 - RNA, 32 nt, Human
aacuugcuguuuccucaucuuugccuuuuggg

SEQ ID NO: 23112 - RNA, 32 nt, Human
aacuugcuucauguaacguguugcauaugagu

SEQ ID NO: 23113 - RNA, 32 nt, Human
aacuugcuuuccccacccuguuucugggggca

SEQ ID NO: 23114 - RNA, 32 nt, Human
aacuugcuuuuuagcugaucuuccauccucaa

SEQ ID NO: 23115 - RNA, 32 nt, Human
aacuuggagagcagggaagugggcacccuuga

SEQ ID NO: 23116 - RNA, 32 nt, Human
aacuuggagagggggccggacccccgucagcu

SEQ ID NO: 23117 - RNA, 32 nt, Human
aacuuggagccaaguccccacagcuggaucag

SEQ ID NO: 23118 - RNA, 32 nt, Human
aacuuggagccccagugccaagcacagugccu

SEQ ID NO: 23119 - RNA, 32 nt, Human
aacuuggcaaaugacaugcagguucuucaagg

SEQ ID NO: 23120 - RNA, 32 nt, Human
aacuuggcacuccugugcccucugccuggaca

SEQ ID NO: 23121 - RNA, 31 nt, Human
aacuuggcacuuuuucguguggaucuugcca

SEQ ID NO: 23122 - RNA, 32 nt, Human
aacuuggcagcagggcuucaguucuccagaag

SEQ ID NO: 23123 - RNA, 32 nt, Human
aacuuggccugagaacauuuucugggaagagg

SEQ ID NO: 23124 - RNA, 32 nt, Human
aacuuggcucacugcaaccucugcccccuggg

SEQ ID NO: 23125 - RNA, 32 nt, Human
aacuugggaaacacugucaucagcuugagggu

SEQ ID NO: 23126 - RNA, 32 nt, Human
aacuugggaaugaagagguagcaggagggugg

SEQ ID NO: 23127 - RNA, 32 nt, Human
aacuugggacagacuauugauggccaagccca

SEQ ID NO: 23128 - RNA, 32 nt, Human
aacuugggagccucuugagaguguacagcauc

SEQ ID NO: 23129 - RNA, 32 nt, Human
aacuugggaggcagagguuguggugagccgag

SEQ ID NO: 23130 - RNA, 32 nt, Human
aacuugggaggcagagguuucagugagccgag

SEQ ID NO: 23131 - RNA, 32 nt, Human
aacuugggaggcggagcuugcggugagccaag

SEQ ID NO: 23132 - RNA, 26 nt, Human
aacuugggaggcggagguugcaguga

SEQ ID NO: 23133 - RNA, 32 nt, Human
aacuugggaggcggagguugcagugagcuaag

SEQ ID NO: 23134 - RNA, 32 nt, Human
aacuugggagggagagguugcagugagcccag

SEQ ID NO: 23135 - RNA, 32 nt, Human
aacuugggagggguagguugcagugagcugag

SEQ ID NO: 23136 - RNA, 32 nt, Human
aacuugggagguagagguuacagggagccaag

SEQ ID NO: 23137 - RNA, 32 nt, Human
aacuugggagguggagcuuacagugagccgag

SEQ ID NO: 23138 - RNA, 26 nt, Human
aacuugggagguggagguugcaguga

SEQ ID NO: 23139 - RNA, 32 nt, Human
aacuugggagguggagguugcagugagccagg

SEQ ID NO: 23140 - RNA, 26 nt, Human
aacuugggagguggagguugcagugg

SEQ ID NO: 23141 - RNA, 32 nt, Human
aacuugggagguggagguugcagugggccgag

SEQ ID NO: 23142 - RNA, 32 nt, Human
aacuugggcaaaacaauuaagcacacaacuuc

SEQ ID NO: 23143 - RNA, 32 nt, Human
aacuugggccauccuaucaucuggagcccuag

SEQ ID NO: 23144 - RNA, 32 nt, Human
aacuugggcuguaaagcaaacuggggcugugu

SEQ ID NO: 23145 - RNA, 32 nt, Human
aacuuggggguuucacugcucucccccaugau

SEQ ID NO: 23146 - RNA, 32 nt, Human
aacuugguacuuguuuuucuucauuuggaggc

SEQ ID NO: 23147 - RNA, 32 nt, Human
aacuuggugaagaacaagauagagacucaucu

SEQ ID NO: 23148 - RNA, 32 nt, Human
aacuuggugcagcacugggguauuguuggcuu

SEQ ID NO: 23149 - RNA, 32 nt, Human
aacuugguggggucagggaggaaaggcagaag

SEQ ID NO: 23150 - RNA, 32 nt, Human
aacuugguuacuucuuucucucuuccuccauc

SEQ ID NO: 23151 - RNA, 32 nt, Human
aacuugguuccucccuuucuuaagcccuuauu

SEQ ID NO: 23152 - RNA, 32 nt, Human
aacuugguucgcagccugccuugccccuggag

SEQ ID NO: 23153 - RNA, 32 nt, Human
aacuuguaucaucaaccugaacacugagcuua

SEQ ID NO: 23154 - RNA, 32 nt, Human
aacuuguccaagaucacaaagcuggugaacau

SEQ ID NO: 23155 - RNA, 32 nt, Human
aacuuguccuuuuucucccuccagagcagcag

SEQ ID NO: 23156 - RNA, 32 nt, Human
aacuugucucauuccaccucuucucagagcaa

SEQ ID NO: 23157 - RNA, 32 nt, Human
aacuugucucucccucuccuuguuagucuguu

SEQ ID NO: 23158 - RNA, 32 nt, Human
aacuugucugagacugacuuuaucaauaaucu

SEQ ID NO: 23159 - RNA, 32 nt, Human
aacuugucuuaaaucaacaaccuucuacucau

SEQ ID NO: 23160 - RNA, 32 nt, Human
aacuugugcagaggacucuccaggugaaggcu

SEQ ID NO: 23161 - RNA, 32 nt, Human
aacuugugccugggagugugugguguuagggu

SEQ ID NO: 23162 - RNA, 32 nt, Human
aacuugugccuguaauuccagcugcucuggaa

SEQ ID NO: 23163 - RNA, 32 nt, Human
aacuuguggcugcuuuugcugcugcugcuccu

SEQ ID NO: 23164 - RNA, 32 nt, Human
aacuugugggaguggggagagaggaggaaagc

SEQ ID NO: 23165 - RNA, 32 nt, Human
aacuugugggguggagguugcagugagcugag

SEQ ID NO: 23166 - RNA, 32 nt, Human
aacuugugugugcagaggaugggcuggaggac

SEQ ID NO: 23167 - RNA, 32 nt, Human
aacuuguguuagggcugugagcuguuccucga

SEQ ID NO: 23168 - RNA, 32 nt, Human
aacuuguucaaaacagggaaagacugaugaaa

SEQ ID NO: 23169 - RNA, 32 nt, Human
aacuuguucaaauuauuaccagugaaucuuug

SEQ ID NO: 23170 - RNA, 32 nt, Human
aacuuguucacuggggacuuugcuuaccguuc

SEQ ID NO: 23171 - RNA, 32 nt, Human
aacuuguucucccaguugucccccucuucucu

SEQ ID NO: 23172 - RNA, 32 nt, Human
aacuuguuggcauuagacaaaucaagcuggug

SEQ ID NO: 23173 - RNA, 32 nt, Human
aacuuguuucagauuugcucuguuacacuuuu

SEQ ID NO: 23174 - RNA, 32 nt, Human
aacuuguuugauuaagaauaaaggaggaggaa

SEQ ID NO: 23175 - RNA, 32 nt, Human
aacuuguuugcuuaaaguuaaugacuuaauga

SEQ ID NO: 23176 - RNA, 32 nt, Human
aacuuguuuucaguuucccuguuuaugacagu

SEQ ID NO: 23177 - RNA, 32 nt, Human
aacuuuaaauagauucucaguuugaaaucauc

SEQ ID NO: 23178 - RNA, 32 nt, Human
aacuuuaauauguauuuuauguauguuuacac

SEQ ID NO: 23179 - RNA, 32 nt, Human
aacuuuaaucuugggaguuauuguuuacuggg

SEQ ID NO: 23180 - RNA, 32 nt, Human
aacuuuacaaaccugaaugaugugacaauaau

SEQ ID NO: 23181 - RNA, 32 nt, Human
aacuuuacagguuuggcuccagcagcugcugu

SEQ ID NO: 23182 - RNA, 32 nt, Human
aacuuuaccauccacagucacugaaucacuua

SEQ ID NO: 23183 - RNA, 32 nt, Human
aacuuuaccguacaguaccucagucuagcugu

SEQ ID NO: 23184 - RNA, 32 nt, Human
aacuuuacgacaaaaugucucuggacaaagag

SEQ ID NO: 23185 - RNA, 32 nt, Human
aacuuuacuaguagcugagauuuaaugggcac

SEQ ID NO: 23186 - RNA, 32 nt, Human
aacuuuacucagcuuggcugugccucaguuua

SEQ ID NO: 23187 - RNA, 32 nt, Human
aacuuuacucgacacccaucucuuaucaaauu

SEQ ID NO: 23188 - RNA, 32 nt, Human
aacuuuagcugguuucuccacccacaguuccu

SEQ ID NO: 23189 - RNA, 32 nt, Human
aacuuuaggcccugccccagauuuacuaaauc

SEQ ID NO: 23190 - RNA, 32 nt, Human
aacuuuauaugcuaauuaucuucaagggucuu

SEQ ID NO: 23191 - RNA, 32 nt, Human
aacuuuaucaaucuuuuccuuuaagauuugca

SEQ ID NO: 23192 - RNA, 32 nt, Human
aacuuuaucacuucugauggcauuaggacaca

SEQ ID NO: 23193 - RNA, 31 nt, Human
aacuuuaucaguaugcuuuguugaaagcaga

SEQ ID NO: 23194 - RNA, 32 nt, Human
aacuuuaucuguguuccucaaaugccuuagac

SEQ ID NO: 23195 - RNA, 32 nt, Human
aacuuuauucacagaguccagcuuugggacua

SEQ ID NO: 23196 - RNA, 32 nt, Human
aacuuuauuuuuaguuguaacugcuugaggua

SEQ ID NO: 23197 - RNA, 32 nt, Human
aacuuucaaagaaaacccccaaacuuuuaagu

SEQ ID NO: 23198 - RNA, 32 nt, Human
aacuuucaaucuaaggcaucacagaagugaaa

SEQ ID NO: 23199 - RNA, 32 nt, Human
aacuuucacaugcaaccaauguauaucugagu

SEQ ID NO: 23200 - RNA, 32 nt, Human
aacuuucagagacagcagagcacacaagcuuc

SEQ ID NO: 23201 - RNA, 32 nt, Human
aacuuucagugaaugauaaaaugugacaucuu

SEQ ID NO: 23202 - RNA, 32 nt, Human
aacuuucaguguagccacagccauggacucca

SEQ ID NO: 23203 - RNA, 32 nt, Human
aacuuuccagcauccuccucuguucuaaccac

SEQ ID NO: 23204 - RNA, 32 nt, Human
aacuuuccagcucccccucaucaugccuccuc

SEQ ID NO: 23205 - RNA, 32 nt, Human
aacuuuccagguuuauacuauaccucaagacc

SEQ ID NO: 23206 - RNA, 32 nt, Human
aacuuuccaguuuacccugcucccucucucug

SEQ ID NO: 23207 - RNA, 32 nt, Human
aacuuuccaugcacacugacagcaaggggguu

SEQ ID NO: 23208 - RNA, 32 nt, Human
aacuuucccagccucguagcccagcacuucuc

SEQ ID NO: 23209 - RNA, 32 nt, Human
aacuuuccccauacaggaaaacuugaaaauua

SEQ ID NO: 23210 - RNA, 32 nt, Human
aacuuucccugacgcaccuugugggaucaaag

SEQ ID NO: 23211 - RNA, 32 nt, Human
aacuuuccuccuaguacugcuuuugcuguauc

SEQ ID NO: 23212 - RNA, 32 nt, Human
aacuuuccugccaccuucauccuugccucccu

SEQ ID NO: 23213 - RNA, 32 nt, Human
aacuuuccuuuaacucccuuuuuacacuuuau

SEQ ID NO: 23214 - RNA, 32 nt, Human
aacuuuccuuugcccaauuauauguacauguc

SEQ ID NO: 23215 - RNA, 32 nt, Human
aacuuucgucugccuguuuuguggacuggcug

SEQ ID NO: 23216 - RNA, 32 nt, Human
aacuuucuaggcaccuagcagagaaagauaag

SEQ ID NO: 23217 - RNA, 32 nt, Human
aacuuucuauauuagacacccccagccaguuu

SEQ ID NO: 23218 - RNA, 32 nt, Human
aacuuucuauccuccccuccugcccugugucc

SEQ ID NO: 23219 - RNA, 21 nt, Human
aacuuucuauugccuguccca

SEQ ID NO: 23220 - RNA, 32 nt, Human
aacuuucucccugcaucucauaccuuuaccuc

SEQ ID NO: 23221 - RNA, 32 nt, Human
aacuuucucuaaggaccccaggacugugccuu

SEQ ID NO: 23222 - RNA, 32 nt, Human
aacuuucucugagccuugcuuccccucuguaa

SEQ ID NO: 23223 - RNA, 32 nt, Human
aacuuucugcagcuuuuccauagaagcccugg

SEQ ID NO: 23224 - RNA, 32 nt, Human
aacuuucuuauccaacuuuuucauaguaagug

SEQ ID NO: 23225 - RNA, 32 nt, Human
aacuuucuuccucucucuccaagaggauaugg

SEQ ID NO: 23226 - RNA, 32 nt, Human
aacuuucuuuuguguuuacaucaugccagggg

SEQ ID NO: 23227 - RNA, 32 nt, Human
aacuuugaauccuugucagccuggagaccagc

SEQ ID NO: 23228 - RNA, 32 nt, Human
aacuuugagaggccgaggcggguagaucacuu

SEQ ID NO: 23229 - RNA, 32 nt, Human
aacuuugagcacuuuguugaguuuugaaaaau

SEQ ID NO: 23230 - RNA, 32 nt, Human
aacuuugagccuuuuguaguccugaugaauaa

SEQ ID NO: 23231 - RNA, 32 nt, Human
aacuuugagcugguuggacggguuaacuugga

SEQ ID NO: 23232 - RNA, 32 nt, Human
aacuuugaggcucagagacagagcagaagaca

SEQ ID NO: 23233 - RNA, 32 nt, Human
aacuuugcagugaacuuugccucuuccuguuu

SEQ ID NO: 23234 - RNA, 32 nt, Human
aacuuugcaguuggaugaauagagaagggaaa

SEQ ID NO: 23235 - RNA, 32 nt, Human
aacuuugccuguguuguuucucugccuggaau

SEQ ID NO: 23236 - RNA, 22 nt, Human
aacuuugcucaggacauuugag

SEQ ID NO: 23237 - RNA, 32 nt, Human
aacuuugcuucaggcuggguagugguagaggu

SEQ ID NO: 23238 - RNA, 32 nt, Human
aacuuugcuucuuuggaaagguuuucuccuga

SEQ ID NO: 23239 - RNA, 32 nt, Human
aacuuuggaaacugccauuucauucacacaag

SEQ ID NO: 23240 - RNA, 32 nt, Human
aacuuuggaagacuguaacuuguucagaggca

SEQ ID NO: 23241 - RNA, 32 nt, Human
aacuuuggagcagaauccugcacauuaaagga

SEQ ID NO: 23242 - RNA, 32 nt, Human
aacuuuggagcuuguaugugagucagauugcu

SEQ ID NO: 23243 - RNA, 32 nt, Human
aacuuuggaguacuguuucuuccuucaaacug

SEQ ID NO: 23244 - RNA, 32 nt, Human
aacuuuggcaaaaagugaacacaauucaaaua

SEQ ID NO: 23245 - RNA, 32 nt, Human
aacuuuggcaccuuccagaaugccuagaggaa

SEQ ID NO: 23246 - RNA, 32 nt, Human
aacuuugggaaaggggcuagcuagcaaaggua

SEQ ID NO: 23247 - RNA, 32 nt, Human
aacuuugggaagccgaggugggcagaucaccu

SEQ ID NO: 23248 - RNA, 32 nt, Human
aacuuugggaggccgagacgggcagaucacuu

SEQ ID NO: 23249 - RNA, 32 nt, Human
aacuuugggaggccgaggcaggaggaucacuu

SEQ ID NO: 23250 - RNA, 32 nt, Human
aacuuugggaggccgaggcagguggaucacaa

SEQ ID NO: 23251 - RNA, 32 nt, Human
aacuuugggaggccgaggugaguggauugcuu

SEQ ID NO: 23252 - RNA, 32 nt, Human
aacuuugggaggccgaggugggaggagcgcuu

SEQ ID NO: 23253 - RNA, 31 nt, Human
aacuuugggaggccuagauggguggaucacu

SEQ ID NO: 23254 - RNA, 32 nt, Human
aacuuugggaggcugaggcagguggaucacuu

SEQ ID NO: 23255 - RNA, 32 nt, Human
aacuuugggagucccaggcgggcggaucaccu

SEQ ID NO: 23256 - RNA, 32 nt, Human
aacuuugggcauggaagaaagacuggaaacua

SEQ ID NO: 23257 - RNA, 32 nt, Human
aacuuugguggugguuucuucagaaucaugaa

SEQ ID NO: 23258 - RNA, 24 nt, Human
aacuuuguaaaggaaucaauagua

SEQ ID NO: 23259 - RNA, 32 nt, Human
aacuuuguagaacuuaaauacuugaauauuca

SEQ ID NO: 23260 - RNA, 32 nt, Human
aacuuuguauaugaaucaaaacaaacgagcag

SEQ ID NO: 23261 - RNA, 21 nt, Human
aacuuuguauugcccaaagua

SEQ ID NO: 23262 - RNA, 32 nt, Human
aacuuugucuaucacucuccccaacaaccuag

SEQ ID NO: 23263 - RNA, 32 nt, Human
aacuuugucuucaaguaaucugacagcauuaa

SEQ ID NO: 23264 - RNA, 32 nt, Human
aacuuugucuuugcucagaaccagcuccaccc

SEQ ID NO: 23265 - RNA, 32 nt, Human
aacuuugugguuugcuguuuagccuucaguuu

SEQ ID NO: 23266 - RNA, 32 nt, Human
aacuuuuaaaaucuauuucauuucuuaguuau

SEQ ID NO: 23267 - RNA, 32 nt, Human
aacuuuuaacccaagcgguggggaaggaagcc

SEQ ID NO: 23268 - RNA, 32 nt, Human
aacuuuuaagacaacaguguggaacacaauca

SEQ ID NO: 23269 - RNA, 32 nt, Human
aacuuuuaaucuccucuucucccuucuccucc

SEQ ID NO: 23270 - RNA, 32 nt, Human
aacuuuuaaugucuuuuuaaaagaugugggac

SEQ ID NO: 23271 - RNA, 32 nt, Human
aacuuuuacacaguuugccuucagagacaguc

SEQ ID NO: 23272 - RNA, 32 nt, Human
aacuuuuacaucuuuucuuccaaaauaaaagu

SEQ ID NO: 23273 - RNA, 32 nt, Human
aacuuuuacuauauaccuuuccuuggccacca

SEQ ID NO: 23274 - RNA, 32 nt, Human
aacuuuuagccugaaaccaacuuuaugccacu

SEQ ID NO: 23275 - RNA, 32 nt, Human
aacuuuuagcucucuuucuucucaaugucuaa

SEQ ID NO: 23276 - RNA, 32 nt, Human
aacuuuucaaagaaauuuuuagauggaggcaa

SEQ ID NO: 23277 - RNA, 32 nt, Human
aacuuuucaagacauuggaaacaaauagaaca

SEQ ID NO: 23278 - RNA, 32 nt, Human
aacuuuucagacacagcagggccccgcgcagc

SEQ ID NO: 23279 - RNA, 32 nt, Human
aacuuuucccucacuguuccccaaaacaugca

SEQ ID NO: 23280 - RNA, 32 nt, Human
aacuuuucccuucucaguuccucucucgaaag

SEQ ID NO: 23281 - RNA, 32 nt, Human
aacuuuuccucuuaccuuccuuucucuuuccu

SEQ ID NO: 23282 - RNA, 32 nt, Human
aacuuuucuauauuugguuucucuccacacau

SEQ ID NO: 23283 - RNA, 32 nt, Human
aacuuuucuuuccuugaugugggauguucuuc

SEQ ID NO: 23284 - RNA, 32 nt, Human
aacuuuuggcaaauaaaagcauuuaaaaagac

SEQ ID NO: 23285 - RNA, 32 nt, Human
aacuuuuguaaauauauaaauauacauagaca

SEQ ID NO: 23286 - RNA, 32 nt, Human
aacuuuuguaauuaacaacagcaacaauaaca

SEQ ID NO: 23287 - RNA, 32 nt, Human
aacuuuuguggacugagcggccgcagagacug

SEQ ID NO: 23288 - RNA, 32 nt, Human
aacuuuuuaacacagaaauacuuccugcgagc

SEQ ID NO: 23289 - RNA, 32 nt, Human
aacuuuuuacagaacuagcacagcagaaauac

SEQ ID NO: 23290 - RNA, 32 nt, Human
aacuuuuuccagaucucaugucuggcuuaaua

SEQ ID NO: 23291 - RNA, 32 nt, Human
aagaaaaacaaggacuuccugggaggcugugg

SEQ ID NO: 23292 - RNA, 32 nt, Human
aagaaaaaccacucccaguccccagcccuuca

SEQ ID NO: 23293 - RNA, 32 nt, Human
aagaaaaacccauuuucuggggagaaauucaa

SEQ ID NO: 23294 - RNA, 32 nt, Human
aagaaaaacuuuaagaaaaugagccaaugggc

SEQ ID NO: 23295 - RNA, 32 nt, Human
aagaaaaagaaaccuggcuuacugaacaguaa

SEQ ID NO: 23296 - RNA, 32 nt, Human
aagaaaaagagagagagccacguacagagaga

SEQ ID NO: 23297 - RNA, 32 nt, Human
aagaaaaagaggaagaagaagaaggaggaaaa

SEQ ID NO: 23298 - RNA, 32 nt, Human
aagaaaaagaggaagaagaagaaggaggagga

SEQ ID NO: 23299 - RNA, 32 nt, Human
aagaaaaagaggaggaaaaagguagggagaaa

SEQ ID NO: 23300 - RNA, 32 nt, Human
aagaaaaagaggaggaaaaaguggauuacaca

SEQ ID NO: 23301 - RNA, 32 nt, Human
aagaaaaaggaaggaaggaaacaaggaaggaa

SEQ ID NO: 23302 - RNA, 32 nt, Human
aagaaaaaugacaguaaagauuagcugggagu

SEQ ID NO: 23303 - RNA, 32 nt, Human
aagaaaaaugcuguuuauucaugcugagguga

SEQ ID NO: 23304 - RNA, 32 nt, Human
aagaaaaauggguggaagacaagugcagggaa

SEQ ID NO: 23305 - RNA, 32 nt, Human
aagaaaaauuagcagccaggugcaguggcuca

SEQ ID NO: 23306 - RNA, 32 nt, Human
aagaaaacaaaccauugcuuaugcuguuauau

SEQ ID NO: 23307 - RNA, 32 nt, Human
aagaaaacacagaugcugucuuugcauucgac

SEQ ID NO: 23308 - RNA, 32 nt, Human
aagaaaacacggagccuucccuccaggugccc

SEQ ID NO: 23309 - RNA, 32 nt, Human
aagaaaacagcauggccaguaaacugagcaag

SEQ ID NO: 23310 - RNA, 32 nt, Human
aagaaaaccaaacaaacccaggccugauggga

SEQ ID NO: 23311 - RNA, 23 nt, Human
aagaaaaccaaauuauuguucaa

SEQ ID NO: 23312 - RNA, 32 nt, Human
aagaaaaccaggaagcccagcaagaaaagccg

SEQ ID NO: 23313 - RNA, 32 nt, Human
aagaaaaccaguauuugauuuaagcuagguuu

SEQ ID NO: 23314 - RNA, 32 nt, Human
aagaaaacgcugacauaugcugccuucucugu

SEQ ID NO: 23315 - RNA, 32 nt, Human
aagaaaacucacugccuuuaccuacuagaauu

SEQ ID NO: 23316 - RNA, 32 nt, Human
aagaaaacucaggugggcaaagggccucagug

SEQ ID NO: 23317 - RNA, 32 nt, Human
aagaaaacuuggcaaauacagcuuuggacugg

SEQ ID NO: 23318 - RNA, 32 nt, Human
aagaaaacuuuccucccucaauagugaagugu

SEQ ID NO: 23319 - RNA, 32 nt, Human
aagaaaacuuucugcugaaagugucauugcug

SEQ ID NO: 23320 - RNA, 32 nt, Human
aagaaaacuuugacuaauagagcccaggaagg

SEQ ID NO: 23321 - RNA, 32 nt, Human
aagaaaagaacugcuugcauuucuuuauuucu

SEQ ID NO: 23322 - RNA, 32 nt, Human
aagaaaagaaggagggagagagggaggaagga

SEQ ID NO: 23323 - RNA, 32 nt, Human
aagaaaagagcaccuccucauuuuagaguaca

SEQ ID NO: 23324 - RNA, 32 nt, Human
aagaaaagaggaggaggaggaggaagaaagaa

SEQ ID NO: 23325 - RNA, 32 nt, Human
aagaaaagaggugguucucugcagugaucguu

SEQ ID NO: 23326 - RNA, 22 nt, Human
aagaaaagaguuccuuuugccu

SEQ ID NO: 23327 - RNA, 32 nt, Human
aagaaaagccacccccugcacccuccauagcc

SEQ ID NO: 23328 - RNA, 32 nt, Human
aagaaaaggaacccuggccugaggcaggugac

SEQ ID NO: 23329 - RNA, 32 nt, Human
aagaaaaggaagcaaagaaaauagcugccaaa

SEQ ID NO: 23330 - RNA, 32 nt, Human
aagaaaaggacacuuaccccaaaacuucaauc

SEQ ID NO: 23331 - RNA, 23 nt, Human
aagaaaaggacuuucuccaggca

SEQ ID NO: 23332 - RNA, 32 nt, Human
aagaaaaggagaaaagggucaccacccugaaa

SEQ ID NO: 23333 - RNA, 32 nt, Human
aagaaaaggcaaugaaaguaaccacaaaagug

SEQ ID NO: 23334 - RNA, 32 nt, Human
aagaaaaggcagcaaagguaaguucagagacc

SEQ ID NO: 23335 - RNA, 32 nt, Human
aagaaaaggcagcacgugguuuuaugaaggua

SEQ ID NO: 23336 - RNA, 32 nt, Human
aagaaaaggcucaggggugagguggagaggga

SEQ ID NO: 23337 - RNA, 21 nt, Human
aagaaaagggauccccaggua

SEQ ID NO: 23338 - RNA, 32 nt, Human
aagaaaaguaaauaggccgggcgcgguagcuc

SEQ ID NO: 23339 - RNA, 32 nt, Human
aagaaaauaagaacccagcagcauggaacuuc

SEQ ID NO: 23340 - RNA, 32 nt, Human
aagaaaaucaaucuuggcugggcacgguggcu

SEQ ID NO: 23341 - RNA, 32 nt, Human
aagaaaaucaggcuggccaacggggugaaacc

SEQ ID NO: 23342 - RNA, 32 nt, Human
aagaaaauccugcuugacaaaaaccgucacuu

SEQ ID NO: 23343 - RNA, 32 nt, Human
aagaaaaugaguucucaaggagggaaugcuuu

SEQ ID NO: 23344 - RNA, 32 nt, Human
aagaaaaugcuugcuaaugccugcuugcacua

SEQ ID NO: 23345 - RNA, 32 nt, Human
aagaaaauggaugacaaagaaauugagaaucu

SEQ ID NO: 23346 - RNA, 22 nt, Human
aagaaaaugucuuucucuuccu

SEQ ID NO: 23347 - RNA, 32 nt, Human
aagaaaauguuacugaacuauugacugaaagu

SEQ ID NO: 23348 - RNA, 32 nt, Human
aagaaaauguuuugaguauaugugacagaaaa

SEQ ID NO: 23349 - RNA, 32 nt, Human
aagaaaauucauuuucauuguugucuccuucc

SEQ ID NO: 23350 - RNA, 32 nt, Human
aagaaaauuugaaaaguuaaagaugguugcac

SEQ ID NO: 23351 - RNA, 32 nt, Human
aagaaaauuuggaaaauuuuaaaacugugaag

SEQ ID NO: 23352 - RNA, 32 nt, Human
aagaaacaaaagaaagcaucaugugaauaaaa

SEQ ID NO: 23353 - RNA, 32 nt, Human
aagaaacaaacaaaagcugaacacauuuccuu

SEQ ID NO: 23354 - RNA, 32 nt, Human
aagaaacaaagcuucccuaacagccccacagu

SEQ ID NO: 23355 - RNA, 32 nt, Human
aagaaacaaccucaaagaccucaggccgccug

SEQ ID NO: 23356 - RNA, 22 nt, Human
aagaaacaacuuucucucacuu

SEQ ID NO: 23357 - RNA, 32 nt, Human
aagaaacacagcaacaaugacuuaaccauaua

SEQ ID NO: 23358 - RNA, 32 nt, Human
aagaaacaccuaccugcugugaccucacaaac

SEQ ID NO: 23359 - RNA, 32 nt, Human
aagaaacacugauuuucuuucagggagacuuc

SEQ ID NO: 23360 - RNA, 22 nt, Human
aagaaacagaaaaccccagggg

SEQ ID NO: 23361 - RNA, 32 nt, Human
aagaaacagaagacuggccuuuuuggugcucc

SEQ ID NO: 23362 - RNA, 32 nt, Human
aagaaacagaaguuuagcaagggucaugaaga

SEQ ID NO: 23363 - RNA, 32 nt, Human
aagaaacagcauggagaaaacccgguacgcuc

SEQ ID NO: 23364 - RNA, 22 nt, Human
aagaaacagcuagcuccugccu

SEQ ID NO: 23365 - RNA, 23 nt, Human
aagaaacagcuugacuucagagg

SEQ ID NO: 23366 - RNA, 32 nt, Human
aagaaacaggcagaaagagagacaaagacaga

SEQ ID NO: 23367 - RNA, 24 nt, Human
aagaaacaggcauagaaucugccu

SEQ ID NO: 23368 - RNA, 32 nt, Human
aagaaacauccaaaagcacauuucauuucucc

SEQ ID NO: 23369 - RNA, 22 nt, Human
aagaaacauuuguauguucuua

SEQ ID NO: 23370 - RNA, 25 nt, Human
aagaaacauuuuugaaguuuucuua

SEQ ID NO: 23371 - RNA, 32 nt, Human
aagaaaccacuucuuugcucauucauaauaag

SEQ ID NO: 23372 - RNA, 32 nt, Human
aagaaaccagccccaguaaucaguaagucagg

SEQ ID NO: 23373 - RNA, 32 nt, Human
aagaaaccauuugagauuugaaucuaaugguu

SEQ ID NO: 23374 - RNA, 32 nt, Human
aagaaacccaccauaaccagcccacugucacc

SEQ ID NO: 23375 - RNA, 32 nt, Human
aagaaacccugacuaacgcauugagaaaagcc

SEQ ID NO: 23376 - RNA, 32 nt, Human
aagaaacccuuaaaacaagugagcauugugaa

SEQ ID NO: 23377 - RNA, 32 nt, Human
aagaaaccugcucuaguuuuacaggaccauau

SEQ ID NO: 23378 - RNA, 32 nt, Human
aagaaaccuggcaaagaaaacggucucgacaa

SEQ ID NO: 23379 - RNA, 32 nt, Human
aagaaacucucauguaccaaguugucucacuu

SEQ ID NO: 23380 - RNA, 32 nt, Human
aagaaacuggaaggaggaauucuggcuggaau

SEQ ID NO: 23381 - RNA, 32 nt, Human
aagaaacuggcuguggggucccagacaugcca

SEQ ID NO: 23382 - RNA, 26 nt, Human
aagaaacuucugaauuucucuugcuu

SEQ ID NO: 23383 - RNA, 32 nt, Human
aagaaacuuuuacaucuuuucuuccaaaauaa

SEQ ID NO: 23384 - RNA, 32 nt, Human
aagaaagaaaaaggaaggaaggaaacaaggaa

SEQ ID NO: 23385 - RNA, 32 nt, Human
aagaaagaaaaaugggaaaauuuggaaaguga

SEQ ID NO: 23386 - RNA, 32 nt, Human
aagaaagaaacauccaaaaaggccaacgaucu

SEQ ID NO: 23387 - RNA, 32 nt, Human
aagaaagaaagaaagaaagaaaagaaagaaag

SEQ ID NO: 23388 - RNA, 32 nt, Human
aagaaagaaagaaagaaagaaagaaaacaguu

SEQ ID NO: 23389 - RNA, 32 nt, Human
aagaaagaaagaaagaaagaaagaaaagaaag

SEQ ID NO: 23390 - RNA, 32 nt, Human
aagaaagaaagaaagaaagaaagaaaauauca

SEQ ID NO: 23391 - RNA, 32 nt, Human
aagaaagaaagaaagaaagaaagaaagaaaag

SEQ ID NO: 23392 - RNA, 32 nt, Human
aagaaagaaagaaagaaagaaagaaagaaaga

SEQ ID NO: 23393 - RNA, 32 nt, Human
aagaaagaaagaaagaaagaaagaaagaaauc

SEQ ID NO: 23394 - RNA, 32 nt, Human
aagaaagaaagaaagaaagaaagaaaucuacc

SEQ ID NO: 23395 - RNA, 32 nt, Human
aagaaagaaagaaagaaagaaagaagaacggc

SEQ ID NO: 23396 - RNA, 32 nt, Human
aagaaagaaagaaagaaagaaaggaauccuac

SEQ ID NO: 23397 - RNA, 32 nt, Human
aagaaagaaagaaagaaagaagaacggccagg

SEQ ID NO: 23398 - RNA, 32 nt, Human
aagaaagaaagaaagagaaaagaaaagaaaag

SEQ ID NO: 23399 - RNA, 32 nt, Human
aagaaagaaagaaagggaaagauggaaggaag

SEQ ID NO: 23400 - RNA, 32 nt, Human
aagaaagaaagagaugccugguuuucacagac

SEQ ID NO: 23401 - RNA, 32 nt, Human
aagaaagaagaaaaggagaaggaagaagaaga

SEQ ID NO: 23402 - RNA, 21 nt, Human
aagaaagaagggagaguaaua

SEQ ID NO: 23403 - RNA, 32 nt, Human
aagaaagaaggugggagcggagagcgcaggcg

SEQ ID NO: 23404 - RNA, 32 nt, Human
aagaaagaaugaugcaaauauguggaccccca

SEQ ID NO: 23405 - RNA, 32 nt, Human
aagaaagaaugugaguaacuguuguuuugcaa

SEQ ID NO: 23406 - RNA, 32 nt, Human
aagaaagacacauuuuguuugugugacacuua

SEQ ID NO: 23407 - RNA, 32 nt, Human
aagaaagacaucacaucccucuccucuccucc

SEQ ID NO: 23408 - RNA, 32 nt, Human
aagaaagacuccguaaucuuaaacagaugcaa

SEQ ID NO: 23409 - RNA, 32 nt, Human
aagaaagacucuauugugguuacuugaaaaau

SEQ ID NO: 23410 - RNA, 32 nt, Human
aagaaagagaaaaagaaagaaaggaaagaaag

SEQ ID NO: 23411 - RNA, 32 nt, Human
aagaaagagaaaaggucccagcugagagaaaa

SEQ ID NO: 23412 - RNA, 32 nt, Human
aagaaagagaaaccagguauucugcuacaguu

SEQ ID NO: 23413 - RNA, 32 nt, Human
aagaaagagagaaagaaagaaagaaagagaga

SEQ ID NO: 23414 - RNA, 32 nt, Human
aagaaagagcaucuucucucccacugcacccc

SEQ ID NO: 23415 - RNA, 32 nt, Human
aagaaagaggcagaggagcgacagagaugacu

SEQ ID NO: 23416 - RNA, 32 nt, Human
aagaaagagggaagcgucagauccuagaaaga

SEQ ID NO: 23417 - RNA, 32 nt, Human
aagaaagaucagauuguuacugugucugugua

SEQ ID NO: 23418 - RNA, 32 nt, Human
aagaaagaucccuggaucccaggaugauuaua

SEQ ID NO: 23419 - RNA, 23 nt, Human
aagaaagaugcauccucuugccu

SEQ ID NO: 23420 - RNA, 32 nt, Human
aagaaagauggauacuaugaugcugaaugugc

SEQ ID NO: 23421 - RNA, 32 nt, Human
aagaaagaugggaggaagugcagcaggaauag

SEQ ID NO: 23422 - RNA, 32 nt, Human
aagaaagauuaaggaggaaggaauacaucugg

SEQ ID NO: 23423 - RNA, 32 nt, Human
aagaaagcaaaaggccuguucugguggggaga

SEQ ID NO: 23424 - RNA, 32 nt, Human
aagaaagcaacuccaacccacacacugcaaau

SEQ ID NO: 23425 - RNA, 32 nt, Human
aagaaagcacaauuaauuuuauagagagguuu

SEQ ID NO: 23426 - RNA, 32 nt, Human
aagaaagcagcccagggugccaugccugacag

SEQ ID NO: 23427 - RNA, 32 nt, Human
aagaaagcaguuuagggccacccagaagaaaa

SEQ ID NO: 23428 - RNA, 32 nt, Human
aagaaagccagacaacuucuguuucuucucuu

SEQ ID NO: 23429 - RNA, 32 nt, Human
aagaaagccaucucuuccucugaucugggguc

SEQ ID NO: 23430 - RNA, 32 nt, Human
aagaaagcccucaaucaaaagcagaaacagaa

SEQ ID NO: 23431 - RNA, 32 nt, Human
aagaaagccgaaguccuugaaaccauuuagga

SEQ ID NO: 23432 - RNA, 32 nt, Human
aagaaagcgcugacagcucaaauggaucccau

SEQ ID NO: 23433 - RNA, 32 nt, Human
aagaaagcucgggcccuggaggcugcggcucu

SEQ ID NO: 23434 - RNA, 32 nt, Human
aagaaagcucuuccacccuccuucaccuaucu

SEQ ID NO: 23435 - RNA, 32 nt, Human
aagaaagcugauagcuccuccauguugguaaa

SEQ ID NO: 23436 - RNA, 32 nt, Human
aagaaagcuguggaaaggaccugccccacaug

SEQ ID NO: 23437 - RNA, 32 nt, Human
aagaaagcuuguggaaagucucucuccuuccu

SEQ ID NO: 23438 - RNA, 32 nt, Human
aagaaagcuuuggauaguaccuauuauaagaa

SEQ ID NO: 23439 - RNA, 32 nt, Human
aagaaaggacuagcauaugagacuucugguac

SEQ ID NO: 23440 - RNA, 32 nt, Human
aagaaaggagagaaaagcaaaugaaguuuagg

SEQ ID NO: 23441 - RNA, 32 nt, Human
aagaaaggagagaagcagauuccaggggaaga

SEQ ID NO: 23442 - RNA, 32 nt, Human
aagaaaggagaguccaagaccaccugccccuc

SEQ ID NO: 23443 - RNA, 17 nt, Human
aagaaaggagcagaaug

SEQ ID NO: 23444 - RNA, 32 nt, Human
aagaaaggagccaaggaagagauuaagaaaaa

SEQ ID NO: 23445 - RNA, 32 nt, Human
aagaaaggagccaaggcaaagagggaccacug

SEQ ID NO: 23446 - RNA, 32 nt, Human
aagaaaggagucagggacagagaaaaagauuc

SEQ ID NO: 23447 - RNA, 32 nt, Human
aagaaaggaguuaagagaggaaggaggagcua

SEQ ID NO: 23448 - RNA, 20 nt, Human
aagaaaggaucaacaagcag

SEQ ID NO: 23449 - RNA, 19 nt, Human
aagaaaggaucaucagcaa

SEQ ID NO: 23450 - RNA, 32 nt, Human
aagaaaggaucucuggggcuuccgggggugag

SEQ ID NO: 23451 - RNA, 23 nt, Human
aagaaaggcaagagcucaagguc

SEQ ID NO: 23452 - RNA, 32 nt, Human
aagaaaggcacauguuuaagaggaauaccuaa

SEQ ID NO: 23453 - RNA, 32 nt, Human
aagaaaggccgacgugcaagaaacccagccuc

SEQ ID NO: 23454 - RNA, 32 nt, Human
aagaaagggaaagauggaaggaaggaaggaaa

SEQ ID NO: 23455 - RNA, 32 nt, Human
aagaaagggacaauggcucugaguggaaacug

SEQ ID NO: 23456 - RNA, 32 nt, Human
aagaaagggaccccucuccaguccuggcuccu

SEQ ID NO: 23457 - RNA, 32 nt, Human
aagaaagggagaccuaagggugaacaguggcc

SEQ ID NO: 23458 - RNA, 32 nt, Human
aagaaagggaguggaggugcagcgaaggaccc

SEQ ID NO: 23459 - RNA, 32 nt, Human
aagaaagggcaggcggcucggcgggcgucuuc

SEQ ID NO: 23460 - RNA, 32 nt, Human
aagaaagggcauugccaugacaucucaaagca

SEQ ID NO: 23461 - RNA, 32 nt, Human
aagaaagggcuggaacugaggguaaagaaggg

SEQ ID NO: 23462 - RNA, 32 nt, Human
aagaaagggcuggauucugccauaccuuuggg

SEQ ID NO: 23463 - RNA, 32 nt, Human
aagaaaggggccugggcagcagguguggccag

SEQ ID NO: 23464 - RNA, 32 nt, Human
aagaaaggugaguuugagcugccuucccuagc

SEQ ID NO: 23465 - RNA, 32 nt, Human
aagaaaggugcauggacccccugcugcucugc

SEQ ID NO: 23466 - RNA, 32 nt, Human
aagaaagguguuccuucccauggauauuugua

SEQ ID NO: 23467 - RNA, 32 nt, Human
aagaaaguaucugugagaacagccugggagaa

SEQ ID NO: 23468 - RNA, 32 nt, Human
aagaaagucaccaagugucuuaagcuguuuua

SEQ ID NO: 23469 - RNA, 32 nt, Human
aagaaagugaagauaacugcaagucagcugga

SEQ ID NO: 23470 - RNA, 32 nt, Human
aagaaagugagaagauagaguacuggaucaga

SEQ ID NO: 23471 - RNA, 32 nt, Human
aagaaagugcaugcaggaauauucagggaguc

SEQ ID NO: 23472 - RNA, 32 nt, Human
aagaaaguuauucaguaccuugcccauguugc

SEQ ID NO: 23473 - RNA, 32 nt, Human
aagaaauacaaggaggaggaggguuagcaggc

SEQ ID NO: 23474 - RNA, 32 nt, Human
aagaaauaccuugccccguuuuugcccaauca

SEQ ID NO: 23475 - RNA, 25 nt, Human
aagaaauacucagagacagaagcau

SEQ ID NO: 23476 - RNA, 21 nt, Human
aagaaauaggaggcauuuuca

SEQ ID NO: 23477 - RNA, 32 nt, Human
aagaaauauuacaccuaaucucauguuuagaa

SEQ ID NO: 23478 - RNA, 32 nt, Human
aagaaauauuuuagcucugaaggauuuaguag

SEQ ID NO: 23479 - RNA, 25 nt, Human
aagaaauauuuuuaagauguucuua

SEQ ID NO: 23480 - RNA, 32 nt, Human
aagaaaucaagagaggagagaggagcccccac

SEQ ID NO: 23481 - RNA, 32 nt, Human
aagaaaucacauaggagauaagccucaugaau

SEQ ID NO: 23482 - RNA, 32 nt, Human
aagaaauccauggcuuuugucuucuuaauguu

SEQ ID NO: 23483 - RNA, 32 nt, Human
aagaaauccugccucugugcagcagaggagcu

SEQ ID NO: 23484 - RNA, 32 nt, Human
aagaaaucgagccugucccuugugcacuuggg

SEQ ID NO: 23485 - RNA, 32 nt, Human
aagaaaucgauguuaccuugcugguagauaga

SEQ ID NO: 23486 - RNA, 32 nt, Human
aagaaaucugaaagcaccucugacauuccuuu

SEQ ID NO: 23487 - RNA, 32 nt, Human
aagaaaugaaaccaggaagguuuucagaucac

SEQ ID NO: 23488 - RNA, 32 nt, Human
aagaaaugaauagacuaucuagaacuugagaa

SEQ ID NO: 23489 - RNA, 32 nt, Human
aagaaaugacaaucacagccacugcaacuuca

SEQ ID NO: 23490 - RNA, 32 nt, Human
aagaaaugagccagacauggugguguaugccu

SEQ ID NO: 23491 - RNA, 32 nt, Human
aagaaaugagguaaagaguuuaaaccagggaa

SEQ ID NO: 23492 - RNA, 32 nt, Human
aagaaaugagguaccuuuucaaagugcagccg

SEQ ID NO: 23493 - RNA, 32 nt, Human
aagaaaugaugaagaaaaagaauaggcuggag

SEQ ID NO: 23494 - RNA, 32 nt, Human
aagaaaugcagaaaggagagagagggaucuga

SEQ ID NO: 23495 - RNA, 32 nt, Human
aagaaaugcaggaagggaacagggaacaaggc

SEQ ID NO: 23496 - RNA, 32 nt, Human
aagaaaugcaugcacacagguaguauggcaac

SEQ ID NO: 23497 - RNA, 32 nt, Human
aagaaaugcauuuauguaagaucugugaguac

SEQ ID NO: 23498 - RNA, 32 nt, Human
aagaaaugccuagaaaguguugucaacauuuu

SEQ ID NO: 23499 - RNA, 30 nt, Human
aagaaauggaaaugacuacaaauaaguuga

SEQ ID NO: 23500 - RNA, 32 nt, Human
aagaaauggaacauaaccagcaccccagaacc

SEQ ID NO: 23501 - RNA, 32 nt, Human
aagaaauggaacuuaauguugugccaaaguua

SEQ ID NO: 23502 - RNA, 32 nt, Human
aagaaauggaagcacagcuucuuucagacuuc

SEQ ID NO: 23503 - RNA, 30 nt, Human
aagaaauggaggaagcaaagaaaaugauau

SEQ ID NO: 23504 - RNA, 32 nt, Human
aagaaauggauacagucuaaagaauuaacuca

SEQ ID NO: 23505 - RNA, 32 nt, Human
aagaaauggcuuuggagaaaacagacaacauc

SEQ ID NO: 23506 - RNA, 32 nt, Human
aagaaaugggaguugucagagcauuaaaaugc

SEQ ID NO: 23507 - RNA, 32 nt, Human
aagaaaugucuauuuuucuuuguucccaauua

SEQ ID NO: 23508 - RNA, 32 nt, Human
aagaaaugugaagagaaaauacacagacacaa

SEQ ID NO: 23509 - RNA, 32 nt, Human
aagaaauguguauaaguaauuaugauauugca

SEQ ID NO: 23510 - RNA, 32 nt, Human
aagaaauuacaguuuacguccauuccaaguug

SEQ ID NO: 23511 - RNA, 32 nt, Human
aagaaauuccauaugaaaaacuccacucaugu

SEQ ID NO: 23512 - RNA, 32 nt, Human
aagaaauucugacagaugacaucagaagacac

SEQ ID NO: 23513 - RNA, 32 nt, Human
aagaaauugaggucacagcaaaaugaaggugu

SEQ ID NO: 23514 - RNA, 24 nt, Human
aagaaauugcccuggcacuuuuca

SEQ ID NO: 23515 - RNA, 32 nt, Human
aagaaauugggugagaggagauagguagcucc

SEQ ID NO: 23516 - RNA, 23 nt, Human
aagaaauugugaucacuucuuca

SEQ ID NO: 23517 - RNA, 32 nt, Human
aagaaauuguucccuuccccuguguucaaugu

SEQ ID NO: 23518 - RNA, 32 nt, Human
aagaaauuugcauuccugaucuucccaacuuc

SEQ ID NO: 23519 - RNA, 32 nt, Human
aagaaauuugucaggcugggugcaguggcuca

SEQ ID NO: 23520 - RNA, 32 nt, Human
aagaaauuuucccuuuuuaauugccucuauag

SEQ ID NO: 23521 - RNA, 32 nt, Human
aagaacaaaaugcuuaacuuuaucucuuaauu

SEQ ID NO: 23522 - RNA, 32 nt, Human
aagaacaaauaaacaacucaccagagauuuau

SEQ ID NO: 23523 - RNA, 32 nt, Human
aagaacaagagggaggagaaagugagaagcag

SEQ ID NO: 23524 - RNA, 32 nt, Human
aagaacaaguaagcaacucaccagagauuuau

SEQ ID NO: 23525 - RNA, 32 nt, Human
aagaacaaucacuaaaccacacucaccccagc

SEQ ID NO: 23526 - RNA, 32 nt, Human
aagaacacccuucuggcccucagucuguuccc

SEQ ID NO: 23527 - RNA, 32 nt, Human
aagaacacuccaauucagccugagugcaaccu

SEQ ID NO: 23528 - RNA, 32 nt, Human
aagaacagaacagccaaugacugaagacagga

SEQ ID NO: 23529 - RNA, 25 nt, Human
aagaacagaagauuauguucuugua

SEQ ID NO: 23530 - RNA, 32 nt, Human
aagaacagacauucaggccaggcacggugacu

SEQ ID NO: 23531 - RNA, 32 nt, Human
aagaacagagaggaggaggagggagaaauggc

SEQ ID NO: 23532 - RNA, 32 nt, Human
aagaacagagguuucucaaaugccucaguccc

SEQ ID NO: 23533 - RNA, 32 nt, Human
aagaacagagugagagaggcccauggcugauu

SEQ ID NO: 23534 - RNA, 26 nt, Human
aagaacagcagagagaaugagcaagg

SEQ ID NO: 23535 - RNA, 32 nt, Human
aagaacagccuggguaacacagggagacucug

SEQ ID NO: 23536 - RNA, 32 nt, Human
aagaacagcuccaaccuccccuucaccuucuc

SEQ ID NO: 23537 - RNA, 32 nt, Human
aagaacagugagaaggguaggggccaggggcc

SEQ ID NO: 23538 - RNA, 22 nt, Human
aagaacaguggaagagaagcau

SEQ ID NO: 23539 - RNA, 20 nt, Human
aagaacaguggggugguuca

SEQ ID NO: 23540 - RNA, 32 nt, Human
aagaacauaccuaauauauacacuucuuuuaa

SEQ ID NO: 23541 - RNA, 32 nt, Human
aagaacaucaaccaugucuuacacuccaggag

SEQ ID NO: 23542 - RNA, 32 nt, Human
aagaacaucagaaaauagaccuccuuccuccu

SEQ ID NO: 23543 - RNA, 32 nt, Human
aagaacauccuggaggccaggaguucgacacu

SEQ ID NO: 23544 - RNA, 32 nt, Human
aagaacauguaacguacuacugccaucuuagu

SEQ ID NO: 23545 - RNA, 32 nt, Human
aagaacauugcuuuuugcaaaaucagauuaaa

SEQ ID NO: 23546 - RNA, 32 nt, Human
aagaacauuuuccucccuuccuuuguguccuu

SEQ ID NO: 23547 - RNA, 32 nt, Human
aagaaccaaucuuugaauagccaucugcuaua

SEQ ID NO: 23548 - RNA, 32 nt, Human
aagaaccacugacaauguaacucucucauugu

SEQ ID NO: 23549 - RNA, 32 nt, Human
aagaaccagcacugccggagccucgcuguggu

SEQ ID NO: 23550 - RNA, 32 nt, Human
aagaaccagcucauguuuggaaaaggaaucuu

SEQ ID NO: 23551 - RNA, 32 nt, Human
aagaaccaggaggccugggagaugcagcugga

SEQ ID NO: 23552 - RNA, 32 nt, Human
aagaaccaggauacaucuuauuucucaaaaug

SEQ ID NO: 23553 - RNA, 32 nt, Human
aagaaccaggaucucuggagaaacaguugggc

SEQ ID NO: 23554 - RNA, 32 nt, Human
aagaaccaggccagauuggugugcacagugcc

SEQ ID NO: 23555 - RNA, 32 nt, Human
aagaaccagggucugucauccccacagccccu

SEQ ID NO: 23556 - RNA, 32 nt, Human
aagaacccccaugaacaccaacaucuccaggu

SEQ ID NO: 23557 - RNA, 32 nt, Human
aagaacccuuagacccucagagcuggaggugu

SEQ ID NO: 23558 - RNA, 21 nt, Human
aagaacccuuaguguccugua

SEQ ID NO: 23559 - RNA, 32 nt, Human
aagaaccgguuuccucccagacuaugucuuac

SEQ ID NO: 23560 - RNA, 32 nt, Human
aagaaccguuuggaaauaaaucacauagagcc

SEQ ID NO: 23561 - RNA, 32 nt, Human
aagaaccuagucuagagacaaugaugcuaguu

SEQ ID NO: 23562 - RNA, 32 nt, Human
aagaaccuaucucugaaaacauagaaguuucc

SEQ ID NO: 23563 - RNA, 32 nt, Human
aagaaccucuacuuaaaccucacaucuuauau

SEQ ID NO: 23564 - RNA, 32 nt, Human
aagaaccugaauacugaacuugauucaggcag

SEQ ID NO: 23565 - RNA, 32 nt, Human
aagaaccugccugagcggcugcuccgagaaag

SEQ ID NO: 23566 - RNA, 32 nt, Human
aagaaccugccugauggggagugucggcugug

SEQ ID NO: 23567 - RNA, 32 nt, Human
aagaaccugggagcuggaggcugguccaccuc

SEQ ID NO: 23568 - RNA, 32 nt, Human
aagaaccuggucacaggacucugccuccucuu

SEQ ID NO: 23569 - RNA, 32 nt, Human
aagaaccuucuagucugaucugauccacugac

SEQ ID NO: 23570 - RNA, 32 nt, Human
aagaaccuugcgauuugcacauauugaguuua

SEQ ID NO: 23571 - RNA, 32 nt, Human
aagaaccuuuuaaacaaaucguccugucacaa

SEQ ID NO: 23572 - RNA, 32 nt, Human
aagaacgcugaacccaaggucuugccucaaaa

SEQ ID NO: 23573 - RNA, 32 nt, Human
aagaacgcuuuccccacugugugucuucuccc

SEQ ID NO: 23574 - RNA, 32 nt, Human
aagaacggcugggcucaaagauaaaaggaagg

SEQ ID NO: 23575 - RNA, 32 nt, Human
aagaacgggaagcauuuucuuccucaccuuug

SEQ ID NO: 23576 - RNA, 32 nt, Human
aagaacguaguuuggaaaacacuggccuaucg

SEQ ID NO: 23577 - RNA, 32 nt, Human
aagaacguauuguuguauuccuccaguguuaa

SEQ ID NO: 23578 - RNA, 32 nt, Human
aagaacgucauuuugggaccuauaucucagug

SEQ ID NO: 23579 - RNA, 32 nt, Human
aagaacgugccaggcaggaggcccccugaagu

SEQ ID NO: 23580 - RNA, 32 nt, Human
aagaacguggccaccugcccagcuucacaccu

SEQ ID NO: 23581 - RNA, 32 nt, Human
aagaacuaaagaaggagaaggaagaggaagaa

SEQ ID NO: 23582 - RNA, 32 nt, Human
aagaacuaaaucauaggccgggcacagucgcu

SEQ ID NO: 23583 - RNA, 22 nt, Human
aagaacuacagaacuguuucag

SEQ ID NO: 23584 - RNA, 32 nt, Human
aagaacuacuucacaguaguugcagugaggau

SEQ ID NO: 23585 - RNA, 32 nt, Human
aagaacucaacauggcaaagcaaaugguaaaa

SEQ ID NO: 23586 - RNA, 32 nt, Human
aagaacucaccacaagccaccuuuuguagugu

SEQ ID NO: 23587 - RNA, 32 nt, Human
aagaacucagcaaucauuggcaagaagagcaa

SEQ ID NO: 23588 - RNA, 32 nt, Human
aagaacucauacgugggaauguuuucacuggc

SEQ ID NO: 23589 - RNA, 20 nt, Human
aagaacuccacaacugaaga

SEQ ID NO: 23590 - RNA, 32 nt, Human
aagaacuccaggagacaggccugaacucuaga

SEQ ID NO: 23591 - RNA, 32 nt, Human
aagaacucucaugccuggccaucccaguguac

SEQ ID NO: 23592 - RNA, 32 nt, Human
aagaacucugcagcuuccugccuucuggguca

SEQ ID NO: 23593 - RNA, 32 nt, Human
aagaacugagccuggucggcugaggccagucc

SEQ ID NO: 23594 - RNA, 32 nt, Human
aagaacugaugcuccuugggugcugcugcuac

SEQ ID NO: 23595 - RNA, 32 nt, Human
aagaacugcauagguuacucucaguauaugau

SEQ ID NO: 23596 - RNA, 32 nt, Human
aagaacugccaagacguuaaagaagggugaag

SEQ ID NO: 23597 - RNA, 32 nt, Human
aagaacugcugcaggucgaggggaagagagga

SEQ ID NO: 23598 - RNA, 32 nt, Human
aagaacuggaaccccagcuucccuccagccuc

SEQ ID NO: 23599 - RNA, 24 nt, Human
aagaacugggauuacaggcaugag

SEQ ID NO: 23600 - RNA, 32 nt, Human
aagaacugggauuacaggcaugaggcaccgug

SEQ ID NO: 23601 - RNA, 21 nt, Human
aagaacugggcuggaauuagc

SEQ ID NO: 23602 - RNA, 32 nt, Human
aagaacuggucuuggucuaucaguaccucuuc

SEQ ID NO: 23603 - RNA, 32 nt, Human
aagaacuuaaccaguucuccccagaucucagc

SEQ ID NO: 23604 - RNA, 32 nt, Human
aagaacuuacugauucuugagaacaaagacua

SEQ ID NO: 23605 - RNA, 32 nt, Human
aagaacuucagaaaucugcaacauaauuuuau

SEQ ID NO: 23606 - RNA, 32 nt, Human
aagaacuucagguuguucugauucuugagccu

SEQ ID NO: 23607 - RNA, 32 nt, Human
aagaacuuccccuucccugucucccaucccuc

SEQ ID NO: 23608 - RNA, 32 nt, Human
aagaacuuccuugagucacauucuccuuaaaa

SEQ ID NO: 23609 - RNA, 32 nt, Human
aagaacuugcccugacagccucuggcucccgc

SEQ ID NO: 23610 - RNA, 32 nt, Human
aagaacuugcgugugcugggggagaggaagcc

SEQ ID NO: 23611 - RNA, 32 nt, Human
aagaacuuggagcaaaaauucccacugucaua

SEQ ID NO: 23612 - RNA, 32 nt, Human
aagaacuugggucauggggaggaagcacagcu

SEQ ID NO: 23613 - RNA, 32 nt, Human
aagaacuugguggccugggucccuggagcccu

SEQ ID NO: 23614 - RNA, 32 nt, Human
aagaacuugucccucaggcuuguugcccucug

SEQ ID NO: 23615 - RNA, 32 nt, Human
aagaacuuucccggcggggaggaccggagaca

SEQ ID NO: 23616 - RNA, 32 nt, Human
aagaacuuugacuggccggcagccugcauugc

SEQ ID NO: 23617 - RNA, 32 nt, Human
aagaagaaaagaaagaaagaaagaaagagaaa

SEQ ID NO: 23618 - RNA, 32 nt, Human
aagaagaaaagcuuggaguagagcagaaggga

SEQ ID NO: 23619 - RNA, 32 nt, Human
aagaagaaaauguuaauuucuguaagaauaaa

SEQ ID NO: 23620 - RNA, 32 nt, Human
aagaagaaagaaagagggaaagagaaauaaaa

SEQ ID NO: 23621 - RNA, 32 nt, Human
aagaagaaagagagaagggggaagggaaagga

SEQ ID NO: 23622 - RNA, 32 nt, Human
aagaagaaagagcgggagaaccaaauaaggca

SEQ ID NO: 23623 - RNA, 32 nt, Human
aagaagaaaggagagcguauuuuaguuucaaa

SEQ ID NO: 23624 - RNA, 32 nt, Human
aagaagaaccagacugaggaaaagaggcuuuu

SEQ ID NO: 23625 - RNA, 24 nt, Human
aagaagaacucucugaccuccuca

SEQ ID NO: 23626 - RNA, 32 nt, Human
aagaagaagaaggaggaggaggaggaggagga

SEQ ID NO: 23627 - RNA, 32 nt, Human
aagaagaagaggaagaagaaaaagaggaagaa

SEQ ID NO: 23628 - RNA, 32 nt, Human
aagaagaagaggaggaagagagggaaagagag

SEQ ID NO: 23629 - RNA, 32 nt, Human
aagaagaagaggaggaggaggaggaggaagaa

SEQ ID NO: 23630 - RNA, 32 nt, Human
aagaagaaggaggaggaggaggaggaggagga

SEQ ID NO: 23631 - RNA, 32 nt, Human
aagaagaaggcagugggaaaacuggguuuauc

SEQ ID NO: 23632 - RNA, 32 nt, Human
aagaagaaggugggaggaugugaauuguuagu

SEQ ID NO: 23633 - RNA, 32 nt, Human
aagaagaaguagucuguaggccuugucuguua

SEQ ID NO: 23634 - RNA, 32 nt, Human
aagaagaauaagcaagaaagaaaagaaggaag

SEQ ID NO: 23635 - RNA, 24 nt, Human
aagaagaaugagcucaacauucca

SEQ ID NO: 23636 - RNA, 32 nt, Human
aagaagaauuccaguguggugaugccaugccc

SEQ ID NO: 23637 - RNA, 32 nt, Human
aagaagacaccagagaagccuaugaugacaag

SEQ ID NO: 23638 - RNA, 32 nt, Human
aagaagaccaaguaagaggagcuucaucucag

SEQ ID NO: 23639 - RNA, 32 nt, Human
aagaagaccugacaaaccaggaaugauuucau

SEQ ID NO: 23640 - RNA, 32 nt, Human
aagaagacgaggaggaugaagauggugaagaa

SEQ ID NO: 23641 - RNA, 32 nt, Human
aagaagacugacuggguggaggcucugccuug

SEQ ID NO: 23642 - RNA, 23 nt, Human
aagaagacugcagcaaggucaga

SEQ ID NO: 23643 - RNA, 32 nt, Human
aagaagacugggcugguguaagaaauagaucc

SEQ ID NO: 23644 - RNA, 32 nt, Human
aagaagacuguugccacuuaaccauuccaugc

SEQ ID NO: 23645 - RNA, 32 nt, Human
aagaagacuuagaaacauagcucaaagugaac

SEQ ID NO: 23646 - RNA, 32 nt, Human
aagaagagaaacaguaaccucacuuugaaaau

SEQ ID NO: 23647 - RNA, 32 nt, Human
aagaagagaaagaggaagggaaagaaagagau

SEQ ID NO: 23648 - RNA, 32 nt, Human
aagaagagaagagauuggcaaauggggcuccu

SEQ ID NO: 23649 - RNA, 32 nt, Human
aagaagagacauccuccagacucuccaggcaa

SEQ ID NO: 23650 - RNA, 32 nt, Human
aagaagagagaagagagacaaagaucacuaca

SEQ ID NO: 23651 - RNA, 32 nt, Human
aagaagagagaaucacuugagcucaggaguuc

SEQ ID NO: 23652 - RNA, 32 nt, Human
aagaagagagagccuguggggauagccuuauc

SEQ ID NO: 23653 - RNA, 32 nt, Human
aagaagagagagugugacagagagggagagga

SEQ ID NO: 23654 - RNA, 32 nt, Human
aagaagagagauuugugccucugugauccuca

SEQ ID NO: 23655 - RNA, 32 nt, Human
aagaagagagcuucucuuccuccucuggacgc

SEQ ID NO: 23656 - RNA, 32 nt, Human
aagaagagaggaagcgggguaguggguggggg

SEQ ID NO: 23657 - RNA, 32 nt, Human
aagaagagagggaggaagaaagggagagagaa

SEQ ID NO: 23658 - RNA, 32 nt, Human
aagaagagagguggggguggaggggaauuagu

SEQ ID NO: 23659 - RNA, 32 nt, Human
aagaagagauucacaaaaacaaagaaucacaa

SEQ ID NO: 23660 - RNA, 31 nt, Human
aagaagagauuucucccuguuauaagcagca

SEQ ID NO: 23661 - RNA, 32 nt, Human
aagaagagauuuuuagagugggaagaagaggc

SEQ ID NO: 23662 - RNA, 32 nt, Human
aagaagagcaugggagaggugggagggguucu

SEQ ID NO: 23663 - RNA, 32 nt, Human
aagaagagccaugggacacagaguugacccag

SEQ ID NO: 23664 - RNA, 32 nt, Human
aagaagagcuucuauuuuuggaaagggcugcu

SEQ ID NO: 23665 - RNA, 20 nt, Human
aagaagaggaaagcaaggua

SEQ ID NO: 23666 - RNA, 32 nt, Human
aagaagaggaagaaugacccuuugcauggcac

SEQ ID NO: 23667 - RNA, 32 nt, Human
aagaagaggaagacgaggaggaaugggggccg

SEQ ID NO: 23668 - RNA, 32 nt, Human
aagaagaggaagagacaucaguaaugcaugca

SEQ ID NO: 23669 - RNA, 32 nt, Human
aagaagaggaagagaggccugagcgagcauau

SEQ ID NO: 23670 - RNA, 32 nt, Human
aagaagaggaagaggaaagaaagacaagucag

SEQ ID NO: 23671 - RNA, 32 nt, Human
aagaagaggagagagaaagaaagggagagaag

SEQ ID NO: 23672 - RNA, 32 nt, Human
aagaagaggagccucagaagaaaacaaaguuc

SEQ ID NO: 23673 - RNA, 32 nt, Human
aagaagaggaggaagacgaggauuaauuucau

SEQ ID NO: 23674 - RNA, 24 nt, Human
aagaagaggaggagacgccaagca

SEQ ID NO: 23675 - RNA, 32 nt, Human
aagaagaggaggaggagagcgacgggacggga

SEQ ID NO: 23676 - RNA, 32 nt, Human
aagaagaggaggaggaggaagaggaggaggag

SEQ ID NO: 23677 - RNA, 32 nt, Human
aagaagaggaggaggaggagaugguggccgag

SEQ ID NO: 23678 - RNA, 32 nt, Human
aagaagaggaggaggaggaggaggaagaagaa

SEQ ID NO: 23679 - RNA, 32 nt, Human
aagaagaggaggaggaggaggaggaggaggag

SEQ ID NO: 23680 - RNA, 22 nt, Human
aagaagaggaggaggccaggca

SEQ ID NO: 23681 - RNA, 32 nt, Human
aagaagaggcugcugucaacacacacaguccc

SEQ ID NO: 23682 - RNA, 32 nt, Human
aagaagagggccugggagaagagucugacgag

SEQ ID NO: 23683 - RNA, 32 nt, Human
aagaagagggcuguggucauacacacugugua

SEQ ID NO: 23684 - RNA, 32 nt, Human
aagaagagggucugcauuuuccuaaacccagu

SEQ ID NO: 23685 - RNA, 32 nt, Human
aagaagagguacucggagcuggagcagcagcu

SEQ ID NO: 23686 - RNA, 32 nt, Human
aagaagaggucacuagauguugcagugaaaaa

SEQ ID NO: 23687 - RNA, 32 nt, Human
aagaagaggugaccccgggucugguggauuuc

SEQ ID NO: 23688 - RNA, 32 nt, Human
aagaagaguaauuucaugaaugcagacuacau

SEQ ID NO: 23689 - RNA, 32 nt, Human
aagaagaguauuacagccuggaccagcagagc

SEQ ID NO: 23690 - RNA, 32 nt, Human
aagaagaguccaaauacaguagcuuaaauuua

SEQ ID NO: 23691 - RNA, 32 nt, Human
aagaagagugugaccaggagaccuuaugcuac

SEQ ID NO: 23692 - RNA, 32 nt, Human
aagaagaguguucuucugguaaagcuaaaauu

SEQ ID NO: 23693 - RNA, 32 nt, Human
aagaagaguuaccucauuuucucuacaugauc

SEQ ID NO: 23694 - RNA, 32 nt, Human
aagaagaguuccggcagcuuuccccaggaaag

SEQ ID NO: 23695 - RNA, 32 nt, Human
aagaagauacacugcagcugaagagggcuggg

SEQ ID NO: 23696 - RNA, 32 nt, Human
aagaagaucagucacccaaaaagauaaaauau

SEQ ID NO: 23697 - RNA, 32 nt, Human
aagaagaucugggggaauaaaaagccaacagu

SEQ ID NO: 23698 - RNA, 31 nt, Human
aagaagaugaauuuggcugagauuugugaua

SEQ ID NO: 23699 - RNA, 32 nt, Human
aagaagaugaugacuagcaguacucugaaugg

SEQ ID NO: 23700 - RNA, 31 nt, Human
aagaagaugaugagacagaggcagagccauu

SEQ ID NO: 23701 - RNA, 32 nt, Human
aagaagaugccauugcacuccagccugggcaa

SEQ ID NO: 23702 - RNA, 32 nt, Human
aagaagauggagacucuuaagcaaagaauggu

SEQ ID NO: 23703 - RNA, 32 nt, Human
aagaagauggauguccucaaaagagaaggaac

SEQ ID NO: 23704 - RNA, 32 nt, Human
aagaagauggggaaaugagagaauacaucuuu

SEQ ID NO: 23705 - RNA, 32 nt, Human
aagaagauucucgccccuucccucucucccug

SEQ ID NO: 23706 - RNA, 32 nt, Human
aagaagauugugcuaaggcuugagugcauuga

SEQ ID NO: 23707 - RNA, 32 nt, Human
aagaagcaaaaagaggaggaggaagaggagcu

SEQ ID NO: 23708 - RNA, 32 nt, Human
aagaagcaaaguuauaauguguuucauuuugc

SEQ ID NO: 23709 - RNA, 32 nt, Human
aagaagcaacagaaaagaccaaaguggaagag

SEQ ID NO: 23710 - RNA, 32 nt, Human
aagaagcaagcucucugucaaugggaggugca

SEQ ID NO: 23711 - RNA, 32 nt, Human
aagaagcacagaauuccucaacucccagugug

SEQ ID NO: 23712 - RNA, 32 nt, Human
aagaagcaccugccauuuagagcugcugaacu

SEQ ID NO: 23713 - RNA, 32 nt, Human
aagaagcagaagaagaacuccaggcaggaagc

SEQ ID NO: 23714 - RNA, 32 nt, Human
aagaagcagaggccuccucuggagugagaggc

SEQ ID NO: 23715 - RNA, 32 nt, Human
aagaagcagccuguuuucacucagcuuaauuc

SEQ ID NO: 23716 - RNA, 32 nt, Human
aagaagcagcucaagggcaggaguaugaaacu

SEQ ID NO: 23717 - RNA, 32 nt, Human
aagaagcaggagaaggcaacugagauccuuca

SEQ ID NO: 23718 - RNA, 32 nt, Human
aagaagcaggagcugcugaaguugcuggucaa

SEQ ID NO: 23719 - RNA, 32 nt, Human
aagaagcaggagguggagaagacccagugaag

SEQ ID NO: 23720 - RNA, 32 nt, Human
aagaagcaggccgagggugguggcucacgcau

SEQ ID NO: 23721 - RNA, 32 nt, Human
aagaagcauauauggguuggaauuaugccaaa

SEQ ID NO: 23722 - RNA, 32 nt, Human
aagaagcauggcgcaccagccucugcaacuag

SEQ ID NO: 23723 - RNA, 32 nt, Human
aagaagccaaagcagaaaccccugauaaaccc

SEQ ID NO: 23724 - RNA, 32 nt, Human
aagaagccacaggcagggccugagggagcccc

SEQ ID NO: 23725 - RNA, 32 nt, Human
aagaagccacauuccucauuggucaguuucuu

SEQ ID NO: 23726 - RNA, 32 nt, Human
aagaagccaccugcauagccguauccauuacc

SEQ ID NO: 23727 - RNA, 32 nt, Human
aagaagccagauccuagccacuuggagcugcc

SEQ ID NO: 23728 - RNA, 32 nt, Human
aagaagccagcaggcgaaaagcagggacugcc

SEQ ID NO: 23729 - RNA, 32 nt, Human
aagaagccagggaagcagugcaauggcuucaa

SEQ ID NO: 23730 - RNA, 32 nt, Human
aagaagcccauuuugaggccauuuugagccuu

SEQ ID NO: 23731 - RNA, 32 nt, Human
aagaagcccuccgagguuuuccggacagacuu

SEQ ID NO: 23732 - RNA, 32 nt, Human
aagaagcccugcccuccagccacagcagucca

SEQ ID NO: 23733 - RNA, 32 nt, Human
aagaagcccugccuacugugcccuguggccuu

SEQ ID NO: 23734 - RNA, 32 nt, Human
aagaagcccugccugcccucugccaccgggcu

SEQ ID NO: 23735 - RNA, 32 nt, Human
aagaagccgaaaccaagcaaaucagauggccc

SEQ ID NO: 23736 - RNA, 32 nt, Human
aagaagccggacgacagccacacacacgacga

SEQ ID NO: 23737 - RNA, 32 nt, Human
aagaagccuggguccaggcucuccccuucccc

SEQ ID NO: 23738 - RNA, 32 nt, Human
aagaagccuuaaaugagagcuaauccaauuua

SEQ ID NO: 23739 - RNA, 32 nt, Human
aagaagcggggagagagagggauagaaaacaa

SEQ ID NO: 23740 - RNA, 32 nt, Human
aagaagcuaugcugcuucccagccuggcuucc

SEQ ID NO: 23741 - RNA, 32 nt, Human
aagaagcucaaggaagcucagggaaaauggac

SEQ ID NO: 23742 - RNA, 32 nt, Human
aagaagcucaucgcugguuuaagcacagguuu

SEQ ID NO: 23743 - RNA, 32 nt, Human
aagaagcugaggcaccuccuacucccaucuga

SEQ ID NO: 23744 - RNA, 32 nt, Human
aagaagcugauggaucuuucucaggacuggca

SEQ ID NO: 23745 - RNA, 32 nt, Human
aagaagcugcugguucuguaccacaggccuca

SEQ ID NO: 23746 - RNA, 32 nt, Human
aagaagcugggcaugggugcaccccacccccu

SEQ ID NO: 23747 - RNA, 32 nt, Human
aagaagcugggcuguaacaauucaggguuuuc

SEQ ID NO: 23748 - RNA, 32 nt, Human
aagaagcuguuguccccucucgaacccugacc

SEQ ID NO: 23749 - RNA, 32 nt, Human
aagaagcuuccccucauggcucuguccaccac

SEQ ID NO: 23750 - RNA, 32 nt, Human
aagaagcuugcagcuuacaucuguccugggcu

SEQ ID NO: 23751 - RNA, 32 nt, Human
aagaaggaaaccaggaguuuuguuuagcgagu

SEQ ID NO: 23752 - RNA, 32 nt, Human
aagaaggaaauggaagaauucagguacauuaa

SEQ ID NO: 23753 - RNA, 32 nt, Human
aagaaggaacacauauuauacacauaaugaug

SEQ ID NO: 23754 - RNA, 32 nt, Human
aagaaggaagaaaagaaggaguggaggaagac

SEQ ID NO: 23755 - RNA, 32 nt, Human
aagaaggaaggaaggaaggaaggaaggaagga

SEQ ID NO: 23756 - RNA, 32 nt, Human
aagaaggaagguggcgaaggcagugagugcuc

SEQ ID NO: 23757 - RNA, 32 nt, Human
aagaaggaaguaaaagggagagagggagggag

SEQ ID NO: 23758 - RNA, 32 nt, Human
aagaaggacaagaaggaggaagacaagaagug

SEQ ID NO: 23759 - RNA, 32 nt, Human
aagaaggacacagagccggggagcagccccug

SEQ ID NO: 23760 - RNA, 32 nt, Human
aagaaggacguggagcgcaaaagagaaaucca

SEQ ID NO: 23761 - RNA, 32 nt, Human
aagaaggagaaaggaaagaaaaaccuaguuuc

SEQ ID NO: 23762 - RNA, 32 nt, Human
aagaaggagaagaaguacauggaggccaggcc

SEQ ID NO: 23763 - RNA, 32 nt, Human
aagaaggagacagaugccaucuggggagggac

SEQ ID NO: 23764 - RNA, 32 nt, Human
aagaaggagaccaggaagccacccuaacacuc

SEQ ID NO: 23765 - RNA, 32 nt, Human
aagaaggagagggagaaaggcccgagccccug

SEQ ID NO: 23766 - RNA, 32 nt, Human
aagaaggaggaaugcuggacuggaggccccug

SEQ ID NO: 23767 - RNA, 32 nt, Human
aagaaggaggaggaggaggaggaggaggaggg

SEQ ID NO: 23768 - RNA, 32 nt, Human
aagaaggaggcuggagagaccaggauccuucc

SEQ ID NO: 23769 - RNA, 32 nt, Human
aagaaggagguggacgaugccuuaguggagau

SEQ ID NO: 23770 - RNA, 32 nt, Human
aagaaggagucacuguucauucugagcaaaaa

SEQ ID NO: 23771 - RNA, 32 nt, Human
aagaaggcacaacuaucucaggccuuaaaugg

SEQ ID NO: 23772 - RNA, 32 nt, Human
aagaaggcaccuuggaaggcacugccuugggc

SEQ ID NO: 23773 - RNA, 32 nt, Human
aagaaggcauccagcaagaacugcacaagaaa

SEQ ID NO: 23774 - RNA, 32 nt, Human
aagaaggcaugucugggcaagugggugccuuu

SEQ ID NO: 23775 - RNA, 32 nt, Human
aagaaggccaucaagguguucuccagugccaa

SEQ ID NO: 23776 - RNA, 32 nt, Human
aagaaggccauggacagaacggagacuagguu

SEQ ID NO: 23777 - RNA, 32 nt, Human
aagaaggccuuugugcccccaaaaagaggcga

SEQ ID NO: 23778 - RNA, 22 nt, Human
aagaaggcggccugcaccagga

SEQ ID NO: 23779 - RNA, 32 nt, Human
aagaaggcguggagaagagggagggagcgaga

SEQ ID NO: 23780 - RNA, 32 nt, Human
aagaaggcuggauucugagguccugggaagga

SEQ ID NO: 23781 - RNA, 32 nt, Human
aagaagggaagagagcagcaguagcuuaagcc

SEQ ID NO: 23782 - RNA, 32 nt, Human
aagaagggaagucacuugcuucauggccaggg

SEQ ID NO: 23783 - RNA, 22 nt, Human
aagaagggacuggacauuccca

SEQ ID NO: 23784 - RNA, 32 nt, Human
aagaagggagagagaguggaugccagggacac

SEQ ID NO: 23785 - RNA, 32 nt, Human
aagaagggauccucuuucaaaggcuaccuuua

SEQ ID NO: 23786 - RNA, 32 nt, Human
aagaagggcacuaugaauuaagccacacaaau

SEQ ID NO: 23787 - RNA, 32 nt, Human
aagaagggcaggcaggaaggggaggggcagug

SEQ ID NO: 23788 - RNA, 32 nt, Human
aagaaggggaaaaacugacaacuaacaaaacc

SEQ ID NO: 23789 - RNA, 32 nt, Human
aagaaggggaaacugaggcccagggaggagag

SEQ ID NO: 23790 - RNA, 32 nt, Human
aagaaggggagaggagguugugugggacaagg

SEQ ID NO: 23791 - RNA, 32 nt, Human
aagaagggggaaggaaaacaaacuucgccacu

SEQ ID NO: 23792 - RNA, 32 nt, Human
aagaaggggucuaauaacaaacuacagcaaca

SEQ ID NO: 23793 - RNA, 32 nt, Human
aagaaggucaaggcuuugcuuuugaaaauauc

SEQ ID NO: 23794 - RNA, 32 nt, Human
aagaaggugaagcccaaaagcucuuaaggaga

SEQ ID NO: 23795 - RNA, 32 nt, Human
aagaaggugauuagucaguagggugugaaaau

SEQ ID NO: 23796 - RNA, 32 nt, Human
aagaaggugccugcuucucuuuugccuucuac

SEQ ID NO: 23797 - RNA, 32 nt, Human
aagaaggugcuguucagagaaggagaaggaaa

SEQ ID NO: 23798 - RNA, 32 nt, Human
aagaaggugguuuuccccacaucccuuugcau

SEQ ID NO: 23799 - RNA, 32 nt, Human
aagaagguuagauuugcacagucuacugggua

SEQ ID NO: 23800 - RNA, 32 nt, Human
aagaagguuauggauaugaagaugcauuuuug

SEQ ID NO: 23801 - RNA, 32 nt, Human
aagaagguuuucagugauuauaccucagguau

SEQ ID NO: 23802 - RNA, 21 nt, Human
aagaaguaccugccucugccu

SEQ ID NO: 23803 - RNA, 32 nt, Human
aagaaguagcugccagaugacagaacaaagua

SEQ ID NO: 23804 - RNA, 32 nt, Human
aagaaguaggaaaugagggcagggggauacag

SEQ ID NO: 23805 - RNA, 32 nt, Human
aagaaguaguggcuccaagaacugaaugcaaa

SEQ ID NO: 23806 - RNA, 32 nt, Human
aagaaguagugguucauccaucagggggccag

SEQ ID NO: 23807 - RNA, 32 nt, Human
aagaagucaagcagauuuuuaaggcuuuggag

SEQ ID NO: 23808 - RNA, 32 nt, Human
aagaagucagcagucuacagugcaaaagaggg

SEQ ID NO: 23809 - RNA, 32 nt, Human
aagaagucagcuuuuuggauucugaguauuuu

SEQ ID NO: 23810 - RNA, 32 nt, Human
aagaagucauuugccagcagauuucuuagagg

SEQ ID NO: 23811 - RNA, 32 nt, Human
aagaaguccccagcagcacacacacauuucca

SEQ ID NO: 23812 - RNA, 32 nt, Human
aagaaguccuccucccuuucugggcuuccaua

SEQ ID NO: 23813 - RNA, 32 nt, Human
aagaagucuguggaguugagugguuacuucaa

SEQ ID NO: 23814 - RNA, 32 nt, Human
aagaagugacgcaucucuggccugugagcccc

SEQ ID NO: 23815 - RNA, 31 nt, Human
aagaagugacuuccguugcauaccaaagccg

SEQ ID NO: 23816 - RNA, 32 nt, Human
aagaagugagcaaagacguggccacauuucua

SEQ ID NO: 23817 - RNA, 23 nt, Human
aagaagugaggauguagaagcca

SEQ ID NO: 23818 - RNA, 32 nt, Human
aagaagugaugccaccaucucuagccauaaua

SEQ ID NO: 23819 - RNA, 32 nt, Human
aagaagugaugggaaugcagagacaggaggca

SEQ ID NO: 23820 - RNA, 32 nt, Human
aagaagugauugagccacaaguauacugaagg

SEQ ID NO: 23821 - RNA, 32 nt, Human
aagaagugcaggcagagccaucugccaggccc

SEQ ID NO: 23822 - RNA, 32 nt, Human
aagaagugcuuggcuggggaugguggcucacg

SEQ ID NO: 23823 - RNA, 20 nt, Human
aagaaguggaaccugggacc

SEQ ID NO: 23824 - RNA, 32 nt, Human
aagaaguggaguugguggaugggugggcaugg

SEQ ID NO: 23825 - RNA, 32 nt, Human
aagaaguggcagccuggccccugcugccggac

SEQ ID NO: 23826 - RNA, 32 nt, Human
aagaagugggaagaagaaggagcucuacaggg

SEQ ID NO: 23827 - RNA, 21 nt, Human
aagaagugggauuagaagaca

SEQ ID NO: 23828 - RNA, 32 nt, Human
aagaagugggguggaagaaguggggugggacg

SEQ ID NO: 23829 - RNA, 32 nt, Human
aagaagugguggagccucagggccagggcagg

SEQ ID NO: 23830 - RNA, 32 nt, Human
aagaaguuacugggagcugcuauuuuauauua

SEQ ID NO: 23831 - RNA, 32 nt, Human
aagaaguucagacacuucuggaaaugaagcaa

SEQ ID NO: 23832 - RNA, 32 nt, Human
aagaaguucugcaaaccuccccuggacccuug

SEQ ID NO: 23833 - RNA, 32 nt, Human
aagaaguugauauuucuuauacuuacaaagag

SEQ ID NO: 23834 - RNA, 32 nt, Human
aagaaguugcuuccuguugccagcaugaccua

SEQ ID NO: 23835 - RNA, 32 nt, Human
aagaaguuggaucauucagugaagauuugggg

SEQ ID NO: 23836 - RNA, 32 nt, Human
aagaaguugguguuucgcugggcccugguacu

SEQ ID NO: 23837 - RNA, 32 nt, Human
aagaaguuuaguguuuugcagcuuugagcuag

SEQ ID NO: 23838 - RNA, 21 nt, Human
aagaaguuuauccggaagcca

SEQ ID NO: 23839 - RNA, 25 nt, Human
aagaauaaaauaugacuguuuuagg

SEQ ID NO: 23840 - RNA, 32 nt, Human
aagaauaacagaauaggaggaaaacaagggga

SEQ ID NO: 23841 - RNA, 32 nt, Human
aagaauaaccacugcacuccaaccugggcaac

SEQ ID NO: 23842 - RNA, 32 nt, Human
aagaauaagucauggagccugaagggugccua

SEQ ID NO: 23843 - RNA, 32 nt, Human
aagaauagaaagagggagagguuggugccgcc

SEQ ID NO: 23844 - RNA, 32 nt, Human
aagaauagacuugcuugggugguaguacguug

SEQ ID NO: 23845 - RNA, 32 nt, Human
aagaauagagguuauucuguaauggaaaagug

SEQ ID NO: 23846 - RNA, 32 nt, Human
aagaauagaguuaggcaccagaagaagaguag

SEQ ID NO: 23847 - RNA, 32 nt, Human
aagaauagccugggcaacauagcaagacccca

SEQ ID NO: 23848 - RNA, 32 nt, Human
aagaauagcuuugacaaaaugauugaagccau

SEQ ID NO: 23849 - RNA, 32 nt, Human
aagaauagguggaggaaucauggccaaaucaa

SEQ ID NO: 23850 - RNA, 32 nt, Human
aagaauaguauuaaaagucagaggcuuuacua

SEQ ID NO: 23851 - RNA, 32 nt, Human
aagaauaguucucauuggaggcugaggucgaa

SEQ ID NO: 23852 - RNA, 32 nt, Human
aagaauauaaugaggaauagcuggauucuaga

SEQ ID NO: 23853 - RNA, 22 nt, Human
aagaauauauaaccacuguagg

SEQ ID NO: 23854 - RNA, 32 nt, Human
aagaauaucugucauccugcuaaugugcauug

SEQ ID NO: 23855 - RNA, 23 nt, Human
aagaauaugaaaaagcagagcga

SEQ ID NO: 23856 - RNA, 32 nt, Human
aagaauauguacauucuugcucugcacuguau

SEQ ID NO: 23857 - RNA, 32 nt, Human
aagaauauguugugagcaucuuuccaugauau

SEQ ID NO: 23858 - RNA, 32 nt, Human
aagaauauuaguuguauauaaaauuagauuag

SEQ ID NO: 23859 - RNA, 32 nt, Human
aagaauauugaggcugggugcaaugcaucaca

SEQ ID NO: 23860 - RNA, 32 nt, Human
aagaauauugccugguuaaaauucugcauugc

SEQ ID NO: 23861 - RNA, 20 nt, Human
aagaauauuucuguucuagg

SEQ ID NO: 23862 - RNA, 32 nt, Human
aagaaucaaaauuccuguuaauaaaagaaaaa

SEQ ID NO: 23863 - RNA, 24 nt, Human
aagaaucaaggaccaaggauccca

SEQ ID NO: 23864 - RNA, 32 nt, Human
aagaaucacagaauucuaguacauguagguaa

SEQ ID NO: 23865 - RNA, 32 nt, Human
aagaaucacccaggccagacacaauggcucau

SEQ ID NO: 23866 - RNA, 32 nt, Human
aagaaucacuggcuucuaugcgcuucuuuucu

SEQ ID NO: 23867 - RNA, 32 nt, Human
aagaaucacuugaacccaggaggcagagugag

SEQ ID NO: 23868 - RNA, 32 nt, Human
aagaaucacuugaacccaggaggcggagguug

SEQ ID NO: 23869 - RNA, 32 nt, Human
aagaaucacuugaacccgggaggcagagguug

SEQ ID NO: 23870 - RNA, 32 nt, Human
aagaaucagaggaggaagaggaagaggaggag

SEQ ID NO: 23871 - RNA, 32 nt, Human
aagaaucauggcucuguagccauuucaaccag

SEQ ID NO: 23872 - RNA, 32 nt, Human
aagaaucauguacuccagccucccuugagaca

SEQ ID NO: 23873 - RNA, 24 nt, Human
aagaaucauguguacuguuuuagg

SEQ ID NO: 23874 - RNA, 32 nt, Human
aagaaucauuccuguacuacagaaggguuaag

SEQ ID NO: 23875 - RNA, 32 nt, Human
aagaauccagaggcggggcucggaugaacccu

SEQ ID NO: 23876 - RNA, 32 nt, Human
aagaauccaguaccuugcacauagaaguagca

SEQ ID NO: 23877 - RNA, 32 nt, Human
aagaauccaucagcaaccucagaccaacccaa

SEQ ID NO: 23878 - RNA, 32 nt, Human
aagaaucccaguuccuccugaccaacccacug

SEQ ID NO: 23879 - RNA, 32 nt, Human
aagaaucccuauaccucauuuguauuuuuaaa

SEQ ID NO: 23880 - RNA, 32 nt, Human
aagaaucccucagagcaggaggccauccugug

SEQ ID NO: 23881 - RNA, 32 nt, Human
aagaauccguguccucccuggaccucagaaug

SEQ ID NO: 23882 - RNA, 32 nt, Human
aagaauccuaaccucaaagggucguggugaga

SEQ ID NO: 23883 - RNA, 32 nt, Human
aagaauccuagaggcaggugacccaccuggag

SEQ ID NO: 23884 - RNA, 32 nt, Human
aagaauccugaggaccuggagugcaaugagaa

SEQ ID NO: 23885 - RNA, 32 nt, Human
aagaauccugcucucccucugccuucugccau

SEQ ID NO: 23886 - RNA, 19 nt, Human
aagaauccugcuuccacca

SEQ ID NO: 23887 - RNA, 32 nt, Human
aagaaucgacuccuuaguaucuugucaugcca

SEQ ID NO: 23888 - RNA, 32 nt, Human
aagaaucgccugaacccgggaggcagaggcug

SEQ ID NO: 23889 - RNA, 32 nt, Human
aagaaucgcuugaacccaggaggcggagguug

SEQ ID NO: 23890 - RNA, 32 nt, Human
aagaaucgcuugaacccgggaggcagagguug

SEQ ID NO: 23891 - RNA, 32 nt, Human
aagaaucuaaaaccagcucugggaaacaaaug

SEQ ID NO: 23892 - RNA, 32 nt, Human
aagaaucuacagccuuccccggcagcccagcc

SEQ ID NO: 23893 - RNA, 26 nt, Human
aagaaucuagcucagaauguuuuagg

SEQ ID NO: 23894 - RNA, 32 nt, Human
aagaaucuauagcauuaguauacacuggcaca

SEQ ID NO: 23895 - RNA, 32 nt, Human
aagaaucucaugaacccaggaggcagagguug

SEQ ID NO: 23896 - RNA, 32 nt, Human
aagaaucucccagagaaggagagguguuuggu

SEQ ID NO: 23897 - RNA, 32 nt, Human
aagaaucuggacaauccugccagccugaaggg

SEQ ID NO: 23898 - RNA, 32 nt, Human
aagaaucugguuuaaauggcauugugguccga

SEQ ID NO: 23899 - RNA, 32 nt, Human
aagaaucuguuccccagcuagguggggaaaau

SEQ ID NO: 23900 - RNA, 32 nt, Human
aagaaucuugaaagaguuugaaugacccaccc

SEQ ID NO: 23901 - RNA, 32 nt, Human
aagaaucuuuucuucccugacccaagaugagg

SEQ ID NO: 23902 - RNA, 32 nt, Human
aagaaugaaguccaggaggagaagggcucauu

SEQ ID NO: 23903 - RNA, 32 nt, Human
aagaaugaaucuucugaaaauauuuuaaguga

SEQ ID NO: 23904 - RNA, 32 nt, Human
aagaaugacagccacagggagauggugguggg

SEQ ID NO: 23905 - RNA, 32 nt, Human
aagaaugaccugggaagccaaaguucagcuca

SEQ ID NO: 23906 - RNA, 32 nt, Human
aagaaugacgcuggcuuaauaggacucuccau

SEQ ID NO: 23907 - RNA, 32 nt, Human
aagaaugaggagaaagcaagaagagugacccc

SEQ ID NO: 23908 - RNA, 32 nt, Human
aagaaugauacagaauuaacuuuaaaaauaaa

SEQ ID NO: 23909 - RNA, 24 nt, Human
aagaaugaugcuucuugcaacaaa

SEQ ID NO: 23910 - RNA, 32 nt, Human
aagaaugcaccacugcaguccagccuaggcaa

SEQ ID NO: 23911 - RNA, 32 nt, Human
aagaaugccgagaaacugcaccucuuauaauu

SEQ ID NO: 23912 - RNA, 32 nt, Human
aagaaugccugagacgcccccagggaauaagg

SEQ ID NO: 23913 - RNA, 32 nt, Human
aagaaugcuugaagucagcgucuuccauucca

SEQ ID NO: 23914 - RNA, 32 nt, Human
aagaaugcuugugauuuuuguacauugauuuu

SEQ ID NO: 23915 - RNA, 32 nt, Human
aagaauggaaaaagaugucccaaugcugcccc

SEQ ID NO: 23916 - RNA, 32 nt, Human
aagaauggaaagguggcuugagcucagcuccu

SEQ ID NO: 23917 - RNA, 32 nt, Human
aagaauggaccuuugaguuaaauccaguguuu

SEQ ID NO: 23918 - RNA, 32 nt, Human
aagaauggagucuaaucccagcacuuugggag

SEQ ID NO: 23919 - RNA, 32 nt, Human
aagaauggagugaagaaaggcaguauggcagg

SEQ ID NO: 23920 - RNA, 32 nt, Human
aagaauggcgaggggagagcagaggagaaggu

SEQ ID NO: 23921 - RNA, 32 nt, Human
aagaauggcguaaacccaggagguggauugcg

SEQ ID NO: 23922 - RNA, 32 nt, Human
aagaauggcgugaacccggaaggcagagcuug

SEQ ID NO: 23923 - RNA, 32 nt, Human
aagaauggcgugaacccgggaggcagagguug

SEQ ID NO: 23924 - RNA, 32 nt, Human
aagaauggcuucaggcuggggcugcagucacc

SEQ ID NO: 23925 - RNA, 32 nt, Human
aagaauggcuugaacccuggaggcagagguug

SEQ ID NO: 23926 - RNA, 32 nt, Human
aagaaugggaaagagaaagagacagagacugg

SEQ ID NO: 23927 - RNA, 32 nt, Human
aagaaugggauaccuccagguuccaguaaaau

SEQ ID NO: 23928 - RNA, 32 nt, Human
aagaaugggggcagugggggaaggaaggggag

SEQ ID NO: 23929 - RNA, 29 nt, Human
aagaauggguaagacguuuucccagcugg

SEQ ID NO: 23930 - RNA, 32 nt, Human
aagaaugguggggaccccuguacuugggggag

SEQ ID NO: 23931 - RNA, 32 nt, Human
aagaauguaacaguguuaguauuuugaauaaa

SEQ ID NO: 23932 - RNA, 32 nt, Human
aagaauguaauaugcagcauucuccaaacuga

SEQ ID NO: 23933 - RNA, 32 nt, Human
aagaauguacccugguagccagccuggcagug

SEQ ID NO: 23934 - RNA, 32 nt, Human
aagaauguaccuuuucuuuuuagaaagccaaa

SEQ ID NO: 23935 - RNA, 32 nt, Human
aagaauguggagaaguacaaggaagcagcucg

SEQ ID NO: 23936 - RNA, 32 nt, Human
aagaauguggagaaguauaaggaagcagcucg

SEQ ID NO: 23937 - RNA, 32 nt, Human
aagaaugugggauuuggagucagacaagccug

SEQ ID NO: 23938 - RNA, 32 nt, Human
aagaauguguuguccaaaaugccugcuuaguu

SEQ ID NO: 23939 - RNA, 32 nt, Human
aagaauguucaucucacuacuauucuucuaca

SEQ ID NO: 23940 - RNA, 32 nt, Human
aagaauguuuaucggcugggcugcagugcccc

SEQ ID NO: 23941 - RNA, 24 nt, Human
aagaauuacaaagacaauggcaua

SEQ ID NO: 23942 - RNA, 32 nt, Human
aagaauuacagaauggaagggaugugugcucu

SEQ ID NO: 23943 - RNA, 32 nt, Human
aagaauucaagauucaguccaaauugcagaaa

SEQ ID NO: 23944 - RNA, 32 nt, Human
aagaauucauacuuaauuccacugacugccac

SEQ ID NO: 23945 - RNA, 32 nt, Human
aagaauucauauaugaaucagaugagaaugcc

SEQ ID NO: 23946 - RNA, 32 nt, Human
aagaauucccauugcccagccucagugcauuu

SEQ ID NO: 23947 - RNA, 32 nt, Human
aagaauuccccuggcauauuacaaagccacca

SEQ ID NO: 23948 - RNA, 32 nt, Human
aagaauucccugagugggccaggcuggugccc

SEQ ID NO: 23949 - RNA, 32 nt, Human
aagaauucgagaucagccugaccaacauggug

SEQ ID NO: 23950 - RNA, 32 nt, Human
aagaauucuaacacaggagcuguccugaggcu

SEQ ID NO: 23951 - RNA, 32 nt, Human
aagaauucuuuguccuuugcugauugguuuug

SEQ ID NO: 23952 - RNA, 32 nt, Human
aagaauugaacccaggagguggagguugcagu

SEQ ID NO: 23953 - RNA, 32 nt, Human
aagaauugaggaagaauggugugggagaggga

SEQ ID NO: 23954 - RNA, 32 nt, Human
aagaauugcuugaacccaggaggcagagguug

SEQ ID NO: 23955 - RNA, 32 nt, Human
aagaauugcuugaacccaggaggcggagguug

SEQ ID NO: 23956 - RNA, 32 nt, Human
aagaauugcuugaacccgggaggcagaggcug

SEQ ID NO: 23957 - RNA, 32 nt, Human
aagaauuggccuggcugggugcaguggcucac

SEQ ID NO: 23958 - RNA, 32 nt, Human
aagaauugguauguaugaugugaucuggucca

SEQ ID NO: 23959 - RNA, 32 nt, Human
aagaauuguauaauauacccccaugaacuugu

SEQ ID NO: 23960 - RNA, 23 nt, Human
aagaauuguuguguaacucaaag

SEQ ID NO: 23961 - RNA, 22 nt, Human
aagaauuuaaagaaucaaaaaa

SEQ ID NO: 23962 - RNA, 32 nt, Human
aagaauuuaaucaggcugggcaccguggcuca

SEQ ID NO: 23963 - RNA, 32 nt, Human
aagaauuuaccagaaauauuugcucaauauga

SEQ ID NO: 23964 - RNA, 32 nt, Human
aagaauuuaguagagacaggagagaggaugaa

SEQ ID NO: 23965 - RNA, 32 nt, Human
aagaauuuauucaccaguuccucugcaaccca

SEQ ID NO: 23966 - RNA, 32 nt, Human
aagaauuucagaaccacugguauccagagaaa

SEQ ID NO: 23967 - RNA, 32 nt, Human
aagaauuucaugaagcauacacaaguaucaau

SEQ ID NO: 23968 - RNA, 32 nt, Human
aagaauuucuucucucaguccaaugguauaau

SEQ ID NO: 23969 - RNA, 32 nt, Human
aagaauuugccaucaguagcaguauuaagcag

SEQ ID NO: 23970 - RNA, 32 nt, Human
aagaauuugcuucuccaaaccucucuuuuggc

SEQ ID NO: 23971 - RNA, 32 nt, Human
aagaauuuggcacaguuacucacuuuguguaa

SEQ ID NO: 23972 - RNA, 23 nt, Human
aagacaaaaacaaaacaacaaca

SEQ ID NO: 23973 - RNA, 32 nt, Human
aagacaaaagcauuuccauuucaacgaguuug

SEQ ID NO: 23974 - RNA, 32 nt, Human
aagacaaaauaacaauagaaaccauucacaca

SEQ ID NO: 23975 - RNA, 32 nt, Human
aagacaaaauucaagaaaacacacacauacau

SEQ ID NO: 23976 - RNA, 20 nt, Human
aagacaaacaaaacaaaaca

SEQ ID NO: 23977 - RNA, 19 nt, Human
aagacaaaccugggugcag

SEQ ID NO: 23978 - RNA, 32 nt, Human
aagacaaacggaugcacccgucuuuagaacca

SEQ ID NO: 23979 - RNA, 32 nt, Human
aagacaaagauccauguagacugggucagcuu

SEQ ID NO: 23980 - RNA, 32 nt, Human
aagacaaagcuccucagugagcugguguauaa

SEQ ID NO: 23981 - RNA, 32 nt, Human
aagacaaaugcccguuuuccuccaguccauga

SEQ ID NO: 23982 - RNA, 32 nt, Human
aagacaacagggugcacugcugccuguacuuc

SEQ ID NO: 23983 - RNA, 32 nt, Human
aagacaacaugcugagaccagaggcuucacca

SEQ ID NO: 23984 - RNA, 32 nt, Human
aagacaaccauccugaagaaguucaaugggga

SEQ ID NO: 23985 - RNA, 32 nt, Human
aagacaaccucggggacauggacacaacaaga

SEQ ID NO: 23986 - RNA, 32 nt, Human
aagacaacggcuguaagagaacuccacaagag

SEQ ID NO: 23987 - RNA, 32 nt, Human
aagacaagaaacaaacuguuguaaaauuucaa

SEQ ID NO: 23988 - RNA, 32 nt, Human
aagacaagagccaaguaaagacagaggcaggg

SEQ ID NO: 23989 - RNA, 32 nt, Human
aagacaagcagggcuaauuccaaaaagcaagg

SEQ ID NO: 23990 - RNA, 32 nt, Human
aagacaagcagguggaggcauccagugauuuc

SEQ ID NO: 23991 - RNA, 32 nt, Human
aagacaaggcucccccucugacccuuccuguu

SEQ ID NO: 23992 - RNA, 32 nt, Human
aagacaagggagcagucccugaagacgcuucu

SEQ ID NO: 23993 - RNA, 22 nt, Human
aagacaaugacuugcacuggga

SEQ ID NO: 23994 - RNA, 32 nt, Human
aagacaaugucagaacaggcuuguaaaugagg

SEQ ID NO: 23995 - RNA, 32 nt, Human
aagacaauguuguaaucccagcaaguugcuaa

SEQ ID NO: 23996 - RNA, 32 nt, Human
aagacaauuaugccaucagacaauguuaagaa

SEQ ID NO: 23997 - RNA, 32 nt, Human
aagacaauucuuuauacaacagugcuaaaaau

SEQ ID NO: 23998 - RNA, 32 nt, Human
aagacacaaaugcaugaacaaguuuuaaugua

SEQ ID NO: 23999 - RNA, 32 nt, Human
aagacacaacggaauagacccaaaaagauaau

SEQ ID NO: 24000 - RNA, 32 nt, Human
aagacacacacccaggcaaccccugggcugug

SEQ ID NO: 24001 - RNA, 32 nt, Human
aagacacacagcaaacggagccucagagugca

SEQ ID NO: 24002 - RNA, 31 nt, Human
aagacacaccagauauuuaggagggaauuag

SEQ ID NO: 24003 - RNA, 32 nt, Human
aagacacagagagagacauugagaugaaacgg

SEQ ID NO: 24004 - RNA, 32 nt, Human
aagacacagaugggguaccugggcacagcggc

SEQ ID NO: 24005 - RNA, 32 nt, Human
aagacacagcagaacagaaaguucaacugcuu

SEQ ID NO: 24006 - RNA, 32 nt, Human
aagacacagccucagaauggccagauggauug

SEQ ID NO: 24007 - RNA, 32 nt, Human
aagacacaggacugugaaagaaagugaugaug

SEQ ID NO: 24008 - RNA, 32 nt, Human
aagacacaggcagggagagacaaagauccagg

SEQ ID NO: 24009 - RNA, 32 nt, Human
aagacacagggagagacaguuggccucaggcu

SEQ ID NO: 24010 - RNA, 19 nt, Human
aagacacauggagcagagc

SEQ ID NO: 24011 - RNA, 32 nt, Human
aagacaccaucuccaucuugaaagaguaacug

SEQ ID NO: 24012 - RNA, 32 nt, Human
aagacaccccuccacagagcuuggcaucaugg

SEQ ID NO: 24013 - RNA, 32 nt, Human
aagacaccccuccagucaacccacagacccca

SEQ ID NO: 24014 - RNA, 32 nt, Human
aagacacccucagaccacagggcggcgccacg

SEQ ID NO: 24015 - RNA, 32 nt, Human
aagacaccuccaggagcccagcucacagccac

SEQ ID NO: 24016 - RNA, 23 nt, Human
aagacacgauuccucagaccagu

SEQ ID NO: 24017 - RNA, 32 nt, Human
aagacacuccccugauuccuacaccgagggaa

SEQ ID NO: 24018 - RNA, 32 nt, Human
aagacacucuggagacagaggaggaaacagug

SEQ ID NO: 24019 - RNA, 32 nt, Human
aagacacucuugauaguucucuuccgauucag

SEQ ID NO: 24020 - RNA, 32 nt, Human
aagacacugaagacuccaaaaaguaggaggaa

SEQ ID NO: 24021 - RNA, 32 nt, Human
aagacacugaauucccaccauuuccuuuucug

SEQ ID NO: 24022 - RNA, 18 nt, Human
aagacacugcugcuuuua

SEQ ID NO: 24023 - RNA, 32 nt, Human
aagacacugucaagccugggccugucaaagcc

SEQ ID NO: 24024 - RNA, 31 nt, Human
aagacacugucucaugggccugugcugucac

SEQ ID NO: 24025 - RNA, 32 nt, Human
aagacacuuuggggaacagaagaacgucuuaa

SEQ ID NO: 24026 - RNA, 32 nt, Human
aagacagaaagccacaggagcccccacguagc

SEQ ID NO: 24027 - RNA, 32 nt, Human
aagacagaaagcccagaaggagcccagaagca

SEQ ID NO: 24028 - RNA, 32 nt, Human
aagacagaaauccaauaucuacauacccuguu

SEQ ID NO: 24029 - RNA, 32 nt, Human
aagacagaacugcucucucugaccuucuucau

SEQ ID NO: 24030 - RNA, 32 nt, Human
aagacagaagcagcugcuggcuucuucagcug

SEQ ID NO: 24031 - RNA, 32 nt, Human
aagacagaaggcgaaggagacccccugccgua

SEQ ID NO: 24032 - RNA, 32 nt, Human
aagacagaccugcaagucuucgucucaaggga

SEQ ID NO: 24033 - RNA, 32 nt, Human
aagacagacuccuuccuguugccuugugaaga

SEQ ID NO: 24034 - RNA, 32 nt, Human
aagacagacuuucccuuccucccagcagcagc

SEQ ID NO: 24035 - RNA, 32 nt, Human
aagacagagaaaagggaaucuugauugaauuc

SEQ ID NO: 24036 - RNA, 32 nt, Human
aagacagagaaaaucacuuauuucucuaagug

SEQ ID NO: 24037 - RNA, 32 nt, Human
aagacagagacuuaaagagauuagagaggugg

SEQ ID NO: 24038 - RNA, 32 nt, Human
aagacagagagugacuaggcagaggaaagaca

SEQ ID NO: 24039 - RNA, 32 nt, Human
aagacagagccccagagucagcucguguuggc

SEQ ID NO: 24040 - RNA, 32 nt, Human
aagacagagcccugaagccuugcucaaggccc

SEQ ID NO: 24041 - RNA, 32 nt, Human
aagacagaggcagagacugaagugaugcugcc

SEQ ID NO: 24042 - RNA, 32 nt, Human
aagacagaggcagagauuggagugacgcaucu

SEQ ID NO: 24043 - RNA, 32 nt, Human
aagacagaggcgggaggauugagugggccagg

SEQ ID NO: 24044 - RNA, 32 nt, Human
aagacagaguccugcagaguccuuccagccua

SEQ ID NO: 24045 - RNA, 32 nt, Human
aagacagagucuuaaagagguuagagaggugg

SEQ ID NO: 24046 - RNA, 32 nt, Human
aagacagagugaugcugucaaugaaagcucuu

SEQ ID NO: 24047 - RNA, 32 nt, Human
aagacagauaaaucugaaggucauguggcauc

SEQ ID NO: 24048 - RNA, 32 nt, Human
aagacagauucucacucaguugcccaggcugg

SEQ ID NO: 24049 - RNA, 32 nt, Human
aagacagcaagaauugguggucugggcuggau

SEQ ID NO: 24050 - RNA, 32 nt, Human
aagacagcaccacugcacuccagccuggguga

SEQ ID NO: 24051 - RNA, 32 nt, Human
aagacagcaccauugcaccccagccugagcaa

SEQ ID NO: 24052 - RNA, 32 nt, Human
aagacagcagaggcacgcauccccuuggagag

SEQ ID NO: 24053 - RNA, 32 nt, Human
aagacagcagugagcuaugcucacaccacugc

SEQ ID NO: 24054 - RNA, 32 nt, Human
aagacagcaguuuccccugcugucacugucuc

SEQ ID NO: 24055 - RNA, 32 nt, Human
aagacagcauugaggcacaucucaccaucagc

SEQ ID NO: 24056 - RNA, 32 nt, Human
aagacagccaacuuaguugcagacaucaccuc

SEQ ID NO: 24057 - RNA, 32 nt, Human
aagacagccagccgcaaaggcagcccagggcu

SEQ ID NO: 24058 - RNA, 32 nt, Human
aagacagcucaucugguuucuuccugcaucuu

SEQ ID NO: 24059 - RNA, 32 nt, Human
aagacagcugggaggugacugcuguacuguca

SEQ ID NO: 24060 - RNA, 32 nt, Human
aagacagcuguacuguuugcuucagccaauga

SEQ ID NO: 24061 - RNA, 32 nt, Human
aagacaggaggaagaaagggagagagggccag

SEQ ID NO: 24062 - RNA, 32 nt, Human
aagacaggcugcacgcggcggcgggcuccucg

SEQ ID NO: 24063 - RNA, 32 nt, Human
aagacaggcuggaugagaucucaggccgagcu

SEQ ID NO: 24064 - RNA, 32 nt, Human
aagacagggaaaggaaggcagcaggaggccac

SEQ ID NO: 24065 - RNA, 32 nt, Human
aagacagggaacacuugugagcacacagagca

SEQ ID NO: 24066 - RNA, 32 nt, Human
aagacagggacagccuuuguuuucugagauac

SEQ ID NO: 24067 - RNA, 32 nt, Human
aagacagggagagagacacggagagagacgca

SEQ ID NO: 24068 - RNA, 32 nt, Human
aagacagggguuucaccaucuuggccaggcug

SEQ ID NO: 24069 - RNA, 32 nt, Human
aagacagggucucacucucauugcccaggcug

SEQ ID NO: 24070 - RNA, 32 nt, Human
aagacaguagccaagauuauucacacauacca

SEQ ID NO: 24071 - RNA, 32 nt, Human
aagacagucaugccugcccuugugugucaaaa

SEQ ID NO: 24072 - RNA, 32 nt, Human
aagacagucgagaagccagggggagaaagaac

SEQ ID NO: 24073 - RNA, 32 nt, Human
aagacagugcaugaagccaggggacauccgcc

SEQ ID NO: 24074 - RNA, 32 nt, Human
aagacagugccauugcacuccagccugcacaa

SEQ ID NO: 24075 - RNA, 32 nt, Human
aagacaguguccagugcuccagccuaggaguc

SEQ ID NO: 24076 - RNA, 32 nt, Human
aagacaguuuuucuagguaccaugaaggaaga

SEQ ID NO: 24077 - RNA, 32 nt, Human
aagacauacacauacaaauggcaaacagguau

SEQ ID NO: 24078 - RNA, 32 nt, Human
aagacauagaacccuuauaaagaauuauuaac

SEQ ID NO: 24079 - RNA, 32 nt, Human
aagacauauagaggcagaaggacaggaauaau

SEQ ID NO: 24080 - RNA, 31 nt, Human
aagacaucacauaaauaaaguuacaaaugga

SEQ ID NO: 24081 - RNA, 32 nt, Human
aagacaucagagaacacacacagggaaaaccc

SEQ ID NO: 24082 - RNA, 32 nt, Human
aagacaucauuuccuuguuccuauuucuuguu

SEQ ID NO: 24083 - RNA, 32 nt, Human
aagacauccgaugguauacuuacucgaacccg

SEQ ID NO: 24084 - RNA, 32 nt, Human
aagacauccuuucuaaagauucaaguggacuu

SEQ ID NO: 24085 - RNA, 32 nt, Human
aagacaucuagaaacauuacaccacacacacc

SEQ ID NO: 24086 - RNA, 32 nt, Human
aagacaucucacucuucugacauccugcaguc

SEQ ID NO: 24087 - RNA, 32 nt, Human
aagacaucuuaggaggaaagauaaaaaugugg

SEQ ID NO: 24088 - RNA, 32 nt, Human
aagacaucuuucuccucugaagggcuuggcag

SEQ ID NO: 24089 - RNA, 32 nt, Human
aagacaugaauagauguuucacugaagaggau

SEQ ID NO: 24090 - RNA, 32 nt, Human
aagacaugcuguuaacucagucugacuggaag

SEQ ID NO: 24091 - RNA, 32 nt, Human
aagacauggaaagcugggaggacagagggcaa

SEQ ID NO: 24092 - RNA, 32 nt, Human
aagacauggaaaucuccauccaaugaggaugu

SEQ ID NO: 24093 - RNA, 32 nt, Human
aagacauggacccccaaugcauucauauuugc

SEQ ID NO: 24094 - RNA, 32 nt, Human
aagacauguguuugcuccuccuucaccuucug

SEQ ID NO: 24095 - RNA, 32 nt, Human
aagacauucuccacugaauuuuaacuuuccuu

SEQ ID NO: 24096 - RNA, 32 nt, Human
aagacauucuuuuguuaacagguuuguuucuu

SEQ ID NO: 24097 - RNA, 32 nt, Human
aagacauugaaggacugcagaaauguaugggu

SEQ ID NO: 24098 - RNA, 32 nt, Human
aagacauugcucacaagcagauuuccccagcg

SEQ ID NO: 24099 - RNA, 32 nt, Human
aagacauuucuaguuuuauuuuaccaauaauu

SEQ ID NO: 24100 - RNA, 24 nt, Human
aagacauuucuuuccucugcucac

SEQ ID NO: 24101 - RNA, 20 nt, Human
aagaccaaaccugggcccug

SEQ ID NO: 24102 - RNA, 32 nt, Human
aagaccaaagaccaaguuaucaucucaccaca

SEQ ID NO: 24103 - RNA, 22 nt, Human
aagaccaacagccuacgugcca

SEQ ID NO: 24104 - RNA, 21 nt, Human
aagaccaacagccugggccag

SEQ ID NO: 24105 - RNA, 32 nt, Human
aagaccaaccuggugaaaccccgucucuacaa

SEQ ID NO: 24106 - RNA, 32 nt, Human
aagaccaacucuggacacugaggcuccauucc

SEQ ID NO: 24107 - RNA, 32 nt, Human
aagaccaacugaccuucuccuaggcagcuccu

SEQ ID NO: 24108 - RNA, 32 nt, Human
aagaccaagaccgcaggaaggacuggggccac

SEQ ID NO: 24109 - RNA, 32 nt, Human
aagaccaagcaugacuccccacccucaacuuu

SEQ ID NO: 24110 - RNA, 20 nt, Human
aagaccaagcccccugccag

SEQ ID NO: 24111 - RNA, 32 nt, Human
aagaccaagcccuuucucugugccucacaaca

SEQ ID NO: 24112 - RNA, 24 nt, Human
aagaccaauaaaugcagagccagu

SEQ ID NO: 24113 - RNA, 32 nt, Human
aagaccacacaccuugagaaguagaagaguca

SEQ ID NO: 24114 - RNA, 32 nt, Human
aagaccacacuccuaugaccaucugaucgucg

SEQ ID NO: 24115 - RNA, 32 nt, Human
aagaccaccauaaagaaagugcauuucaauug

SEQ ID NO: 24116 - RNA, 32 nt, Human
aagaccacccaccugcugcuccuucagcugga

SEQ ID NO: 24117 - RNA, 32 nt, Human
aagaccaccccuccucauuccagaacgaacag

SEQ ID NO: 24118 - RNA, 32 nt, Human
aagaccaccuaguccaaagcucucauuguaca

SEQ ID NO: 24119 - RNA, 32 nt, Human
aagaccacgagacaccagaaaguuggagaaca

SEQ ID NO: 24120 - RNA, 24 nt, Human
aagaccacgcugccggguugcaaa

SEQ ID NO: 24121 - RNA, 32 nt, Human
aagaccacuggaaccaaccucuugcauaagug

SEQ ID NO: 24122 - RNA, 32 nt, Human
aagaccacugguuuuguuugaucuagucccug

SEQ ID NO: 24123 - RNA, 32 nt, Human
aagaccagaaguagcugggauuuguuugcaaa

SEQ ID NO: 24124 - RNA, 32 nt, Human
aagaccagaggagugugcugugcuggcaagug

SEQ ID NO: 24125 - RNA, 32 nt, Human
aagaccagaguuuuucaggagaaaacuggagg

SEQ ID NO: 24126 - RNA, 32 nt, Human
aagaccagccaccugucacaggugcaguuguc

SEQ ID NO: 24127 - RNA, 32 nt, Human
aagaccagcccagcucccuccagccugucccu

SEQ ID NO: 24128 - RNA, 24 nt, Human
aagaccagcccaggcaacaaaguc

SEQ ID NO: 24129 - RNA, 32 nt, Human
aagaccagcccgguaccucucuccccacuggc

SEQ ID NO: 24130 - RNA, 32 nt, Human
aagaccagccuaaaggucaacauaggcagacu

SEQ ID NO: 24131 - RNA, 32 nt, Human
aagaccagccugaccaacauggagaaacgcca

SEQ ID NO: 24132 - RNA, 32 nt, Human
aagaccagccugaccaacguggagaaacccca

SEQ ID NO: 24133 - RNA, 32 nt, Human
aagaccagccugaccaacguggagaaacuccg

SEQ ID NO: 24134 - RNA, 32 nt, Human
aagaccagccugacccacauggagaaacgcca

SEQ ID NO: 24135 - RNA, 32 nt, Human
aagaccagccuggacaacacagcagaccccgu

SEQ ID NO: 24136 - RNA, 32 nt, Human
aagaccagccuggacaacauagugagaccuug

SEQ ID NO: 24137 - RNA, 32 nt, Human
aagaccagccuggacaacauggcaagacccau

SEQ ID NO: 24138 - RNA, 32 nt, Human
aagaccagccuggacagcuuagugagaucccg

SEQ ID NO: 24139 - RNA, 32 nt, Human
aagaccagccuggccaacaugaugagaccucc

SEQ ID NO: 24140 - RNA, 32 nt, Human
aagaccagccuggccaacauggcagaaacccc

SEQ ID NO: 24141 - RNA, 32 nt, Human
aagaccagccuggccaacauggugagacaccg

SEQ ID NO: 24142 - RNA, 32 nt, Human
aagaccagccuggccaacaugguggaacccag

SEQ ID NO: 24143 - RNA, 32 nt, Human
aagaccagccuggccaacaugguggaacccua

SEQ ID NO: 24144 - RNA, 32 nt, Human
aagaccagccugggaaaaauagcaagaccuug

SEQ ID NO: 24145 - RNA, 32 nt, Human
aagaccagccugggaaacauagcaagauccug

SEQ ID NO: 24146 - RNA, 32 nt, Human
aagaccagccugggaaauauagcaagaccuua

SEQ ID NO: 24147 - RNA, 32 nt, Human
aagaccagccugggaacacagcgagacccucu

SEQ ID NO: 24148 - RNA, 32 nt, Human
aagaccagccugggcaaaauagcaagaccgug

SEQ ID NO: 24149 - RNA, 32 nt, Human
aagaccagccugggcaaaauagcaagaccuug

SEQ ID NO: 24150 - RNA, 32 nt, Human
aagaccagccugggcaaaguagggagaccccu

SEQ ID NO: 24151 - RNA, 32 nt, Human
aagaccagccugggcaacaaagugagaccccc

SEQ ID NO: 24152 - RNA, 32 nt, Human
aagaccagccugggcaacacagcaagacccau

SEQ ID NO: 24153 - RNA, 32 nt, Human
aagaccagccugggcaacacagcaagacccug

SEQ ID NO: 24154 - RNA, 32 nt, Human
aagaccagccugggcaacacagcaagauccug

SEQ ID NO: 24155 - RNA, 32 nt, Human
aagaccagccugggcaacacagcgagacccca

SEQ ID NO: 24156 - RNA, 32 nt, Human
aagaccagccugggcaacacagggaggcuacc

SEQ ID NO: 24157 - RNA, 32 nt, Human
aagaccagccugggcaacacagugagacuuca

SEQ ID NO: 24158 - RNA, 32 nt, Human
aagaccagccugggcaacacagugaggccccc

SEQ ID NO: 24159 - RNA, 32 nt, Human
aagaccagccugggcaacacagugagugagac

SEQ ID NO: 24160 - RNA, 32 nt, Human
aagaccagccugggcaacagaacaagacucau

SEQ ID NO: 24161 - RNA, 32 nt, Human
aagaccagccugggcaacauaaugagacccug

SEQ ID NO: 24162 - RNA, 32 nt, Human
aagaccagccugggcaacauaaugagaccuca

SEQ ID NO: 24163 - RNA, 32 nt, Human
aagaccagccugggcaacauagcaagacccca

SEQ ID NO: 24164 - RNA, 32 nt, Human
aagaccagccugggcaacauagcaagacccug

SEQ ID NO: 24165 - RNA, 32 nt, Human
aagaccagccugggcaacauagcaagauccug

SEQ ID NO: 24166 - RNA, 32 nt, Human
aagaccagccugggcaacauagcgagaccccu

SEQ ID NO: 24167 - RNA, 32 nt, Human
aagaccagccugggcaacauaggaagacuccg

SEQ ID NO: 24168 - RNA, 32 nt, Human
aagaccagccugggcaacauagggagacccca

SEQ ID NO: 24169 - RNA, 32 nt, Human
aagaccagccugggcaacauagggagaccccc

SEQ ID NO: 24170 - RNA, 32 nt, Human
aagaccagccugggcaacauagggagacccug

SEQ ID NO: 24171 - RNA, 32 nt, Human
aagaccagccugggcaacauaguaagacccca

SEQ ID NO: 24172 - RNA, 32 nt, Human
aagaccagccugggcaacauagugagaaaaug

SEQ ID NO: 24173 - RNA, 32 nt, Human
aagaccagccugggcaacauagugagaaccuu

SEQ ID NO: 24174 - RNA, 32 nt, Human
aagaccagccugggcaacauagugagaaugca

SEQ ID NO: 24175 - RNA, 32 nt, Human
aagaccagccugggcaacauagugagacccca

SEQ ID NO: 24176 - RNA, 32 nt, Human
aagaccagccugggcaacauagugagaccugc

SEQ ID NO: 24177 - RNA, 32 nt, Human
aagaccagccugggcaacauagugagacgccc

SEQ ID NO: 24178 - RNA, 32 nt, Human
aagaccagccugggcaacauagugagacuccu

SEQ ID NO: 24179 - RNA, 32 nt, Human
aagaccagccugggcaacauagugagacucug

SEQ ID NO: 24180 - RNA, 32 nt, Human
aagaccagccugggcaacauggcaagacccug

SEQ ID NO: 24181 - RNA, 32 nt, Human
aagaccagccugggcaacauggcgagacccca

SEQ ID NO: 24182 - RNA, 32 nt, Human
aagaccagccugggcaacauggugagacccca

SEQ ID NO: 24183 - RNA, 32 nt, Human
aagaccagccugggcaacauggugagauuuca

SEQ ID NO: 24184 - RNA, 32 nt, Human
aagaccagccugggcaacauugggagacucca

SEQ ID NO: 24185 - RNA, 32 nt, Human
aagaccagccugggcaacguagcaagaccuug

SEQ ID NO: 24186 - RNA, 32 nt, Human
aagaccagccugggcaacucaggaagacccca

SEQ ID NO: 24187 - RNA, 32 nt, Human
aagaccagccugggcaacuuagggagauaccc

SEQ ID NO: 24188 - RNA, 32 nt, Human
aagaccagccugggcaacuuagugaggccccg

SEQ ID NO: 24189 - RNA, 32 nt, Human
aagaccagccugggcaagauagcaagaccuug

SEQ ID NO: 24190 - RNA, 32 nt, Human
aagaccagccugggcaauauagugagacccca

SEQ ID NO: 24191 - RNA, 32 nt, Human
aagaccagccugggcuacagagcaagaccuca

SEQ ID NO: 24192 - RNA, 32 nt, Human
aagaccagccuggggaacauagagagaccugu

SEQ ID NO: 24193 - RNA, 32 nt, Human
aagaccagccuggguaacaaagugagaccccc

SEQ ID NO: 24194 - RNA, 32 nt, Human
aagaccagccuggguaacaugggguggaacaa

SEQ ID NO: 24195 - RNA, 32 nt, Human
aagaccagccuggguaucauagggagaccccg

SEQ ID NO: 24196 - RNA, 32 nt, Human
aagaccagccuggucaacauagugagacacug

SEQ ID NO: 24197 - RNA, 32 nt, Human
aagaccagccuggucaauauagcaagaccacg

SEQ ID NO: 24198 - RNA, 32 nt, Human
aagaccagccuucuccaucuucagccuccugc

SEQ ID NO: 24199 - RNA, 32 nt, Human
aagaccagcugaccaacacggugaaaccccau

SEQ ID NO: 24200 - RNA, 20 nt, Human
aagaccagcuggaacugagc

SEQ ID NO: 24201 - RNA, 20 nt, Human
aagaccagcuuggccaaggu

SEQ ID NO: 24202 - RNA, 32 nt, Human
aagaccaggaaggaagggccaccuucccugaa

SEQ ID NO: 24203 - RNA, 21 nt, Human
aagaccaggaccucaugcgag

SEQ ID NO: 24204 - RNA, 32 nt, Human
aagaccaggagaagagagagcacuuucuuccc

SEQ ID NO: 24205 - RNA, 32 nt, Human
aagaccagggaggcccuuaagaaaauauagca

SEQ ID NO: 24206 - RNA, 25 nt, Human
aagaccagggcuagagucaacaguc

SEQ ID NO: 24207 - RNA, 32 nt, Human
aagaccaggguggagaggaauaagagacuaag

SEQ ID NO: 24208 - RNA, 32 nt, Human
aagaccagguugugagggaagacgaauuuacu

SEQ ID NO: 24209 - RNA, 32 nt, Human
aagaccagucuccaccaccaaagucauggcuc

SEQ ID NO: 24210 - RNA, 27 nt, Human
aagaccauagguuagaaaaauaacuca

SEQ ID NO: 24211 - RNA, 32 nt, Human
aagaccaucacugaacucaaggacuugugcug

SEQ ID NO: 24212 - RNA, 32 nt, Human
aagaccauccaggaaaacaugaccucaccaaa

SEQ ID NO: 24213 - RNA, 32 nt, Human
aagaccauccauccucccuucguccaccacuc

SEQ ID NO: 24214 - RNA, 32 nt, Human
aagaccaucgucaacgugcagaccauguuccg

SEQ ID NO: 24215 - RNA, 32 nt, Human
aagaccaucuuccacuuuaucccaucugggag

SEQ ID NO: 24216 - RNA, 21 nt, Human
aagaccauggcccaggauccc

SEQ ID NO: 24217 - RNA, 32 nt, Human
aagaccauggguggaugcugucuucucucuuc

SEQ ID NO: 24218 - RNA, 31 nt, Human
aagaccaugucugggagcuucuacuuuguaa

SEQ ID NO: 24219 - RNA, 32 nt, Human
aagaccauucuuuccaaccucuggguucuugc

SEQ ID NO: 24220 - RNA, 32 nt, Human
aagacccaaagccagacuuccccaaauuccua

SEQ ID NO: 24221 - RNA, 32 nt, Human
aagacccacccagggagcgguuucaguggcgc

SEQ ID NO: 24222 - RNA, 28 nt, Human
aagacccagagaccugccucaccagugc

SEQ ID NO: 24223 - RNA, 32 nt, Human
aagacccaggagagacagagaugcgaaccacc

SEQ ID NO: 24224 - RNA, 21 nt, Human
aagacccagucucuacuguug

SEQ ID NO: 24225 - RNA, 32 nt, Human
aagacccagucuuggcuuuacuuucuuggggu

SEQ ID NO: 24226 - RNA, 32 nt, Human
aagacccaguuucuuguuaauaagugccaacu

SEQ ID NO: 24227 - RNA, 21 nt, Human
aagacccaucuuaaagcuaag

SEQ ID NO: 24228 - RNA, 32 nt, Human
aagacccauuucuacaaaaauacaaaacuuag

SEQ ID NO: 24229 - RNA, 32 nt, Human
aagaccccacuggccaccccucccucuggucc

SEQ ID NO: 24230 - RNA, 32 nt, Human
aagaccccaggaggccaaagggcugcagucac

SEQ ID NO: 24231 - RNA, 32 nt, Human
aagaccccaguauuugcugcuauuuuuaaaac

SEQ ID NO: 24232 - RNA, 32 nt, Human
aagacccccaggaaggaaacagauuuaagcaa

SEQ ID NO: 24233 - RNA, 32 nt, Human
aagaccccgagcauccuuaacaucccagcacc

SEQ ID NO: 24234 - RNA, 32 nt, Human
aagaccccgagugcuggggagcagggagcagg

SEQ ID NO: 24235 - RNA, 32 nt, Human
aagaccccucccccgcuuccucccuuccuuuc

SEQ ID NO: 24236 - RNA, 32 nt, Human
aagacccuggacagaggcugguggggcccccu

SEQ ID NO: 24237 - RNA, 32 nt, Human
aagacccuggaccugaguggcaucagacugac

SEQ ID NO: 24238 - RNA, 32 nt, Human
aagacccuguaguauuugcugugggccugacc

SEQ ID NO: 24239 - RNA, 32 nt, Human
aagacccugucuugaagacccugaccucaagu

SEQ ID NO: 24240 - RNA, 32 nt, Human
aagacccuuggcuggcuuccuccgcucugggu

SEQ ID NO: 24241 - RNA, 19 nt, Human
aagacccuuguuucugcca

SEQ ID NO: 24242 - RNA, 32 nt, Human
aagacccuuugucagccaaucacaguuugaaa

SEQ ID NO: 24243 - RNA, 32 nt, Human
aagaccgaucuuccgcuaucacccuaaucucc

SEQ ID NO: 24244 - RNA, 32 nt, Human
aagaccgcaccacugcacuccagccugggcga

SEQ ID NO: 24245 - RNA, 22 nt, Human
aagaccgccgcccgacucuggg

SEQ ID NO: 24246 - RNA, 32 nt, Human
aagaccggcaauaacacuugcuggugaagaug

SEQ ID NO: 24247 - RNA, 32 nt, Human
aagaccgugccacuguacuccagccugggcag

SEQ ID NO: 24248 - RNA, 32 nt, Human
aagaccguguggacgaggacccccaggcaagc

SEQ ID NO: 24249 - RNA, 32 nt, Human
aagaccguucucuccaaaucagagagcuacuc

SEQ ID NO: 24250 - RNA, 32 nt, Human
aagaccuaagacacuuuuccacccuccaccac

SEQ ID NO: 24251 - RNA, 32 nt, Human
aagaccuaagcucacccagcuaguaguuacuu

SEQ ID NO: 24252 - RNA, 32 nt, Human
aagaccuaaggguuuuaucuccuccccuugaa

SEQ ID NO: 24253 - RNA, 31 nt, Human
aagaccuaaguguccaggagacagaaggaga

SEQ ID NO: 24254 - RNA, 32 nt, Human
aagaccuacugagugagaaucuugagggugga

SEQ ID NO: 24255 - RNA, 32 nt, Human
aagaccucaccacucccacccaaucccaaacg

SEQ ID NO: 24256 - RNA, 32 nt, Human
aagaccucaggcuucauuaucaucucauuucc

SEQ ID NO: 24257 - RNA, 32 nt, Human
aagaccucauacaguaguccccacuuauucau

SEQ ID NO: 24258 - RNA, 32 nt, Human
aagaccucauucuuaucugugugucugcauuu

SEQ ID NO: 24259 - RNA, 32 nt, Human
aagaccuccagaaucuccugacuuuagggaau

SEQ ID NO: 24260 - RNA, 32 nt, Human
aagaccuccgcuucacugccccggcugguccc

SEQ ID NO: 24261 - RNA, 32 nt, Human
aagaccuccuggguccucucaggcucccccuu

SEQ ID NO: 24262 - RNA, 32 nt, Human
aagaccucuccucagcccaugcccagcuguca

SEQ ID NO: 24263 - RNA, 32 nt, Human
aagaccucucuuuacuccuuuuagaccuuuuu

SEQ ID NO: 24264 - RNA, 32 nt, Human
aagaccugaccccagccccaaucugaucagac

SEQ ID NO: 24265 - RNA, 31 nt, Human
aagaccugacuuauggagcacuuguaaccug

SEQ ID NO: 24266 - RNA, 32 nt, Human
aagaccugcaccuaaguggccauguuugcuca

SEQ ID NO: 24267 - RNA, 32 nt, Human
aagaccugcagcuucagcaucacuugagaagu

SEQ ID NO: 24268 - RNA, 32 nt, Human
aagaccugccacggcaaguggagcugcuggau

SEQ ID NO: 24269 - RNA, 32 nt, Human
aagaccugcccaggugucggauaagagccugc

SEQ ID NO: 24270 - RNA, 31 nt, Human
aagaccugccucuggggcaaaugucagcaca

SEQ ID NO: 24271 - RNA, 32 nt, Human
aagaccugcgggggacagcaggaggacagccg

SEQ ID NO: 24272 - RNA, 32 nt, Human
aagaccuggagucuaugcuaggaagcugagau

SEQ ID NO: 24273 - RNA, 32 nt, Human
aagaccuggaucucccuuuuacauggacccua

SEQ ID NO: 24274 - RNA, 32 nt, Human
aagaccugggcuguggugugugggucuuggcc

SEQ ID NO: 24275 - RNA, 32 nt, Human
aagaccuggggaaggaagaaugaggacagucc

SEQ ID NO: 24276 - RNA, 31 nt, Human
aagaccuggguggaaagcgguuuggaugaaa

SEQ ID NO: 24277 - RNA, 32 nt, Human
aagaccuggucagccuaaaucuucccaguccc

SEQ ID NO: 24278 - RNA, 32 nt, Human
aagaccuguuuauacauugaaggaagaaaaga

SEQ ID NO: 24279 - RNA, 32 nt, Human
aagaccuucaauccaccaacauguagaaauug

SEQ ID NO: 24280 - RNA, 32 nt, Human
aagaccuucagcuguauuuccacagauuucuc

SEQ ID NO: 24281 - RNA, 32 nt, Human
aagaccuucauaccuagaccuguuccgcacac

SEQ ID NO: 24282 - RNA, 32 nt, Human
aagaccuuccuuuccuccuuuuuccauauugc

SEQ ID NO: 24283 - RNA, 32 nt, Human
aagaccuucucccuuuucuuuggccccauauu

SEQ ID NO: 24284 - RNA, 32 nt, Human
aagaccuucucuagguuuucuagcuuucauua

SEQ ID NO: 24285 - RNA, 32 nt, Human
aagaccuuuacaacagcaacaaaaagaacaaa

SEQ ID NO: 24286 - RNA, 32 nt, Human
aagaccuuuagagaaagagaaugggagcauau

SEQ ID NO: 24287 - RNA, 32 nt, Human
aagaccuuuccuuucauguccagaagaaugua

SEQ ID NO: 24288 - RNA, 32 nt, Human
aagaccuuuggccaaagcagggcuuaaaagau

SEQ ID NO: 24289 - RNA, 32 nt, Human
aagacgaaaaggaggcuucuaggcacccggga

SEQ ID NO: 24290 - RNA, 23 nt, Human
aagacgaaacucugcaacuuggc

SEQ ID NO: 24291 - RNA, 32 nt, Human
aagacgaaguucuggcaaauguggaaaaccug

SEQ ID NO: 24292 - RNA, 32 nt, Human
aagacgaccagaaaguccaucccucaugagug

SEQ ID NO: 24293 - RNA, 32 nt, Human
aagacgacggaggcggggcaacaggcggggag

SEQ ID NO: 24294 - RNA, 32 nt, Human
aagacgaggggaacaaaaccagcuggauccau

SEQ ID NO: 24295 - RNA, 32 nt, Human
aagacgaugcagccgcuuuucuuuuugaaaug

SEQ ID NO: 24296 - RNA, 32 nt, Human
aagacgccaaaaacaauugcaacagaagcaaa

SEQ ID NO: 24297 - RNA, 32 nt, Human
aagacgccagagcuagccaccacccacacugc

SEQ ID NO: 24298 - RNA, 32 nt, Human
aagacgccauugcaccccagccugggcaauga

SEQ ID NO: 24299 - RNA, 32 nt, Human
aagacgccuuucuccuccaacccaaccucauc

SEQ ID NO: 24300 - RNA, 32 nt, Human
aagacgcggcaggccggccgagggcaccccga

SEQ ID NO: 24301 - RNA, 32 nt, Human
aagacgcguagcagcacacacuucacaaagcc

SEQ ID NO: 24302 - RNA, 32 nt, Human
aagacgcugaggaggaggaggaggcggaggag

SEQ ID NO: 24303 - RNA, 32 nt, Human
aagacgcugagugggagcugucaggcaguagc

SEQ ID NO: 24304 - RNA, 32 nt, Human
aagacgcugccucccacaucaccuuucuuucc

SEQ ID NO: 24305 - RNA, 17 nt, Human
aagacgcuggacuuggc

SEQ ID NO: 24306 - RNA, 19 nt, Human
aagacggacagcccugagg

SEQ ID NO: 24307 - RNA, 32 nt, Human
aagacggagaggagggaaauggggcccuuucc

SEQ ID NO: 24308 - RNA, 32 nt, Human
aagacggagagggcagagcaagaacugcacug

SEQ ID NO: 24309 - RNA, 32 nt, Human
aagacggauccaagggggacagccuggagucg

SEQ ID NO: 24310 - RNA, 32 nt, Human
aagacggauuucacauccacaggacggucuug

SEQ ID NO: 24311 - RNA, 21 nt, Human
aagacggcagcaggacugggg

SEQ ID NO: 24312 - RNA, 32 nt, Human
aagacggcaggaccaggcaugggggagcugga

SEQ ID NO: 24313 - RNA, 32 nt, Human
aagacggccacgaccugggagcagcagguccc

SEQ ID NO: 24314 - RNA, 32 nt, Human
aagacgggaagagggugggagagccagagcaa

SEQ ID NO: 24315 - RNA, 32 nt, Human
aagacgggagucggcagccaggaguucccgug

SEQ ID NO: 24316 - RNA, 32 nt, Human
aagacgggccuccugauaaucgucuugggcau

SEQ ID NO: 24317 - RNA, 32 nt, Human
aagacgggcugcucuuccagacuggcugugcc

SEQ ID NO: 24318 - RNA, 32 nt, Human
aagacgggcugucgcugcugcaccaccagcag

SEQ ID NO: 24319 - RNA, 32 nt, Human
aagacggggguuucaccauguuggcccagcug

SEQ ID NO: 24320 - RNA, 32 nt, Human
aagacggguuaagccuuucuugcuuucaaaua

SEQ ID NO: 24321 - RNA, 32 nt, Human
aagacgucaggugacuucaguccugcugcagu

SEQ ID NO: 24322 - RNA, 23 nt, Human
aagacguccucuucccucugccu

SEQ ID NO: 24323 - RNA, 32 nt, Human
aagacgucucugucugcccugugaaagcguuu

SEQ ID NO: 24324 - RNA, 32 nt, Human
aagacgugagccacggcaccuggccugaauuu

SEQ ID NO: 24325 - RNA, 32 nt, Human
aagacgugauagagggaauauaagagcauuua

SEQ ID NO: 24326 - RNA, 32 nt, Human
aagacgugccucuuccccuucugccauaaugg

SEQ ID NO: 24327 - RNA, 32 nt, Human
aagacguggauuuucuggaagacauggcuugg

SEQ ID NO: 24328 - RNA, 32 nt, Human
aagacgugucgcacuuuucaguuguuuguauu

SEQ ID NO: 24329 - RNA, 24 nt, Human
aagacguuaaaauuuuaggacaga

SEQ ID NO: 24330 - RNA, 32 nt, Human
aagacguuccuuaggcccugugcucagagaaa

SEQ ID NO: 24331 - RNA, 32 nt, Human
aagacuaaauagguuuaccaugugccagucuc

SEQ ID NO: 24332 - RNA, 32 nt, Human
aagacuaacagucuuuuuagaaguaaauauau

SEQ ID NO: 24333 - RNA, 32 nt, Human
aagacuaagacacugauccaacugaauaaaua

SEQ ID NO: 24334 - RNA, 32 nt, Human
aagacuaaguaagaaaugaaauguccuaucaa

SEQ ID NO: 24335 - RNA, 32 nt, Human
aagacuacacagaaaaucuggaaacaguugca

SEQ ID NO: 24336 - RNA, 32 nt, Human
aagacuaccagcucugucuuucuacccucuaa

SEQ ID NO: 24337 - RNA, 32 nt, Human
aagacuacgccacugcacuccagccuggaggc

SEQ ID NO: 24338 - RNA, 32 nt, Human
aagacuacuaugaacaguuuucuuuuaaaauu

SEQ ID NO: 24339 - RNA, 24 nt, Human
aagacuacugccccaccccagagg

SEQ ID NO: 24340 - RNA, 32 nt, Human
aagacuagaagagagggaggaggagcuggagc

SEQ ID NO: 24341 - RNA, 32 nt, Human
aagacuagaaggacuaaaagcaguugaaugua

SEQ ID NO: 24342 - RNA, 32 nt, Human
aagacuagagaagguaacagcuucagcuucag

SEQ ID NO: 24343 - RNA, 32 nt, Human
aagacuagccugggcaacacagucagacucca

SEQ ID NO: 24344 - RNA, 32 nt, Human
aagacuagccugggcaacauagcgagacugca

SEQ ID NO: 24345 - RNA, 32 nt, Human
aagacuagccugggcaacauagugagacucgg

SEQ ID NO: 24346 - RNA, 32 nt, Human
aagacuaggcacagccauuuguguuaauuaaa

SEQ ID NO: 24347 - RNA, 32 nt, Human
aagacuaucuucccucccuucccugaauucag

SEQ ID NO: 24348 - RNA, 32 nt, Human
aagacuaugacucgcgcacagcucugcauguu

SEQ ID NO: 24349 - RNA, 32 nt, Human
aagacuaugccacugcacucccgccuggguga

SEQ ID NO: 24350 - RNA, 32 nt, Human
aagacuaugccauuaaaugaccacauuaacga

SEQ ID NO: 24351 - RNA, 32 nt, Human
aagacucaaagucacugguauauuggauuaag

SEQ ID NO: 24352 - RNA, 32 nt, Human
aagacucaacuuccuggucauaacuucucccc

SEQ ID NO: 24353 - RNA, 32 nt, Human
aagacucaacuugcaacugugcccuccacacu

SEQ ID NO: 24354 - RNA, 32 nt, Human
aagacucaaucuguagcuaguaugaauauuuu

SEQ ID NO: 24355 - RNA, 32 nt, Human
aagacucagaugccgaaaacucguccucccga

SEQ ID NO: 24356 - RNA, 32 nt, Human
aagacucagcaacuccagccucuguagcauug

SEQ ID NO: 24357 - RNA, 32 nt, Human
aagacucagccaagaguucucuuuauucccuu

SEQ ID NO: 24358 - RNA, 32 nt, Human
aagacucaugccauaggugacauucuaaaaua

SEQ ID NO: 24359 - RNA, 32 nt, Human
aagacuccaaaguuccauuggaaaagauaugg

SEQ ID NO: 24360 - RNA, 32 nt, Human
aagacuccaggaaaaacagcuuccauggcaca

SEQ ID NO: 24361 - RNA, 32 nt, Human
aagacuccagugggacugggaugagcugcgug

SEQ ID NO: 24362 - RNA, 32 nt, Human
aagacuccaucucaaaaacaaaaacaaaacaa

SEQ ID NO: 24363 - RNA, 32 nt, Human
aagacuccaucucaaaaacaaacaaacaaaaa

SEQ ID NO: 24364 - RNA, 32 nt, Human
aagacucccacucccugaaaucuggagugaag

SEQ ID NO: 24365 - RNA, 32 nt, Human
aagacucccugcaccaggcccuaggaggccuc

SEQ ID NO: 24366 - RNA, 32 nt, Human
aagacucgcccauuuuggaaugugaccgucug

SEQ ID NO: 24367 - RNA, 32 nt, Human
aagacucgggucucuggccucccagccaggcc

SEQ ID NO: 24368 - RNA, 32 nt, Human
aagacucgguccuucuggaaucuuguaacggu

SEQ ID NO: 24369 - RNA, 32 nt, Human
aagacucuaugcucuguaguucuuuccacaaa

SEQ ID NO: 24370 - RNA, 32 nt, Human
aagacucuccacccucacucccagauccugca

SEQ ID NO: 24371 - RNA, 32 nt, Human
aagacucugccucaccugccuccuugaaggaa

SEQ ID NO: 24372 - RNA, 32 nt, Human
aagacucugucucaaaaacaaacaaacaaaca

SEQ ID NO: 24373 - RNA, 32 nt, Human
aagacugaagaaugugcugauggagcagugcu

SEQ ID NO: 24374 - RNA, 32 nt, Human
aagacugaagaggcuggagugcaguggcgcaa

SEQ ID NO: 24375 - RNA, 32 nt, Human
aagacugaagcauccccaccucaggauucagc

SEQ ID NO: 24376 - RNA, 32 nt, Human
aagacugaagugaaagaagaaccagagcuuca

SEQ ID NO: 24377 - RNA, 32 nt, Human
aagacugaagugaaagaagaaccggagcuuca

SEQ ID NO: 24378 - RNA, 32 nt, Human
aagacugacaacaggccagugcagacuuugcu

SEQ ID NO: 24379 - RNA, 32 nt, Human
aagacugaccagcuucuucugaagacuucugc

SEQ ID NO: 24380 - RNA, 32 nt, Human
aagacugacccacugcauuccagccuggcgac

SEQ ID NO: 24381 - RNA, 32 nt, Human
aagacugaccuugaauucagccuggguguuca

SEQ ID NO: 24382 - RNA, 20 nt, Human
aagacugacuuaucacucug

SEQ ID NO: 24383 - RNA, 32 nt, Human
aagacugagggcaggaaggaggggccccagga

SEQ ID NO: 24384 - RNA, 32 nt, Human
aagacugcacaaaauuacagugcuaauguaua

SEQ ID NO: 24385 - RNA, 32 nt, Human
aagacugcaccacugcacuccagccugggcaa

SEQ ID NO: 24386 - RNA, 31 nt, Human
aagacugcagaucagcaccucucugcccaga

SEQ ID NO: 24387 - RNA, 32 nt, Human
aagacugcagcugcugaaguucugagccgggc

SEQ ID NO: 24388 - RNA, 32 nt, Human
aagacugcaguccuucacuacauggcugggua

SEQ ID NO: 24389 - RNA, 32 nt, Human
aagacugcagugagcuaugauccugccacugc

SEQ ID NO: 24390 - RNA, 32 nt, Human
aagacugcagugagcucucauugggccacugc

SEQ ID NO: 24391 - RNA, 32 nt, Human
aagacugcagugagcugagaucacaccacugu

SEQ ID NO: 24392 - RNA, 32 nt, Human
aagacugcagugagcugugaucgugccacugc

SEQ ID NO: 24393 - RNA, 32 nt, Human
aagacugcaguuucuucacagaucucaggaag

SEQ ID NO: 24394 - RNA, 32 nt, Human
aagacugccaaguacaauuaugauaucuuacu

SEQ ID NO: 24395 - RNA, 23 nt, Human
aagacugccccuaccaccacagg

SEQ ID NO: 24396 - RNA, 32 nt, Human
aagacugccugcuccugagacuucugagaagg

SEQ ID NO: 24397 - RNA, 32 nt, Human
aagacugccuggcuguccugcccagccuuccu

SEQ ID NO: 24398 - RNA, 32 nt, Human
aagacugccuucaguaggaacaagcuggcuuc

SEQ ID NO: 24399 - RNA, 32 nt, Human
aagacugcgccacugcacuccagccugggcaa

SEQ ID NO: 24400 - RNA, 32 nt, Human
aagacugcgccauugcacuccagcccgggcaa

SEQ ID NO: 24401 - RNA, 32 nt, Human
aagacugcucaggccauuucagcagcagccag

SEQ ID NO: 24402 - RNA, 32 nt, Human
aagacugcuccugguggccugugcauagggaa

SEQ ID NO: 24403 - RNA, 32 nt, Human
aagacuggaagcaggugaggcacacagagggg

SEQ ID NO: 24404 - RNA, 32 nt, Human
aagacuggaauguggagaacuggggagugccc

SEQ ID NO: 24405 - RNA, 32 nt, Human
aagacuggacacaauuccgaagagcugcccag

SEQ ID NO: 24406 - RNA, 32 nt, Human
aagacuggaccucugugccaagcaguaucccu

SEQ ID NO: 24407 - RNA, 32 nt, Human
aagacuggcaaggaggcucaggugcuuccauc

SEQ ID NO: 24408 - RNA, 32 nt, Human
aagacuggcauggcucagagguugugagaaag

SEQ ID NO: 24409 - RNA, 25 nt, Human
aagacuggccaggcccaaggaccca

SEQ ID NO: 24410 - RNA, 32 nt, Human
aagacuggccugaucaauaugaugaaaccccu

SEQ ID NO: 24411 - RNA, 23 nt, Human
aagacuggcuggcaauaaaguca

SEQ ID NO: 24412 - RNA, 32 nt, Human
aagacuggcuuuuuguucuucucacacaauua

SEQ ID NO: 24413 - RNA, 32 nt, Human
aagacugggacccaccuuaucuggcuucacuc

SEQ ID NO: 24414 - RNA, 32 nt, Human
aagacugggcuagggagaaugcagagagguuu

SEQ ID NO: 24415 - RNA, 32 nt, Human
aagacuggugggaagugagcagcuggagggaa

SEQ ID NO: 24416 - RNA, 32 nt, Human
aagacuguaguauacuaugaucgugccugugg

SEQ ID NO: 24417 - RNA, 32 nt, Human
aagacuguaugggcgccagggugaaggaaacc

SEQ ID NO: 24418 - RNA, 32 nt, Human
aagacugucauuguuucucuaggaaauguaug

SEQ ID NO: 24419 - RNA, 32 nt, Human
aagacugucuucagcgugaacuaaaguucaca

SEQ ID NO: 24420 - RNA, 24 nt, Human
aagacugugaaaaaugauaacuca

SEQ ID NO: 24421 - RNA, 32 nt, Human
aagacugugccacugcacuccagccugggcaa

SEQ ID NO: 24422 - RNA, 32 nt, Human
aagacugugccacugcacuccagccuggguga

SEQ ID NO: 24423 - RNA, 21 nt, Human
aagacugugggaccaggaccc

SEQ ID NO: 24424 - RNA, 32 nt, Human
aagacugugugaaaaugcccauuuuccuaaau

SEQ ID NO: 24425 - RNA, 32 nt, Human
aagacuguugccguuuuaguguggagauaagu

SEQ ID NO: 24426 - RNA, 32 nt, Human
aagacuguugucuuguucuugugguguuugga

SEQ ID NO: 24427 - RNA, 32 nt, Human
aagacuguuuggugcuucugucuuucaccauu

SEQ ID NO: 24428 - RNA, 32 nt, Human
aagacuuagaaacauagcucaaagugaacacu

SEQ ID NO: 24429 - RNA, 32 nt, Human
aagacuuagaauagucagcuauccugagcaaa

SEQ ID NO: 24430 - RNA, 32 nt, Human
aagacuuagauucauuuauugcuaucugaggc

SEQ ID NO: 24431 - RNA, 32 nt, Human
aagacuuaggauaccucucucacuuucuguuu

SEQ ID NO: 24432 - RNA, 32 nt, Human
aagacuuaggggccacuuauaaaucaagaaga

SEQ ID NO: 24433 - RNA, 32 nt, Human
aagacuuauuuuuguggcaguuugccauucag

SEQ ID NO: 24434 - RNA, 31 nt, Human
aagacuucaauaaaugacuguuuaaaaaggu

SEQ ID NO: 24435 - RNA, 32 nt, Human
aagacuucagaauugggaacuaaaccaugaau

SEQ ID NO: 24436 - RNA, 32 nt, Human
aagacuucauaagcucaucacaggggagggaa

SEQ ID NO: 24437 - RNA, 32 nt, Human
aagacuucaucccucuggggcuguucacgugg

SEQ ID NO: 24438 - RNA, 32 nt, Human
aagacuucauuucaccaacccagaaccuccuu

SEQ ID NO: 24439 - RNA, 32 nt, Human
aagacuucccagaggaagugcgccuuuuucau

SEQ ID NO: 24440 - RNA, 32 nt, Human
aagacuuccuuuccucuccucucgccuccugg

SEQ ID NO: 24441 - RNA, 32 nt, Human
aagacuucucaaggaggugccucagucagauc

SEQ ID NO: 24442 - RNA, 32 nt, Human
aagacuucucaaggaggugccuccaucagacc

SEQ ID NO: 24443 - RNA, 22 nt, Human
aagacuucuccaggcccauguc

SEQ ID NO: 24444 - RNA, 32 nt, Human
aagacuucucucucccaucaccuugcccucau

SEQ ID NO: 24445 - RNA, 32 nt, Human
aagacuucuggacaauuuuucacuuucacaga

SEQ ID NO: 24446 - RNA, 32 nt, Human
aagacuugaaaccaacucgcacccucaaagcu

SEQ ID NO: 24447 - RNA, 32 nt, Human
aagacuugaauccaagauuccugucucuaaau

SEQ ID NO: 24448 - RNA, 32 nt, Human
aagacuugccaagaaucuugggauuuaucuuu

SEQ ID NO: 24449 - RNA, 32 nt, Human
aagacuugcuugaacccgggaggcagagguug

SEQ ID NO: 24450 - RNA, 32 nt, Human
aagacuuguccaagagucuugauguccuaaac

SEQ ID NO: 24451 - RNA, 32 nt, Human
aagacuuguccagguuccucaguuaauuagga

SEQ ID NO: 24452 - RNA, 32 nt, Human
aagacuuuauuaaaucagcgcguuuaacagga

SEQ ID NO: 24453 - RNA, 32 nt, Human
aagacuuuccuaaaucucuaucucuuuauaua

SEQ ID NO: 24454 - RNA, 32 nt, Human
aagacuuucucuuuuccuuuaaagcuaaagac

SEQ ID NO: 24455 - RNA, 32 nt, Human
aagacuuucuuccuccuguuucucguugaguu

SEQ ID NO: 24456 - RNA, 32 nt, Human
aagagaaaaaggcugaaaagaaggaauauacc

SEQ ID NO: 24457 - RNA, 32 nt, Human
aagagaaaacaugccuuucuuuguugaaucac

SEQ ID NO: 24458 - RNA, 32 nt, Human
aagagaaaagcuggaggaaggccgugggcaau

SEQ ID NO: 24459 - RNA, 32 nt, Human
aagagaaaaggagagagguugagcgagcgaga

SEQ ID NO: 24460 - RNA, 32 nt, Human
aagagaaaaggagcccuggugacuugcccagg

SEQ ID NO: 24461 - RNA, 32 nt, Human
aagagaaacugaggcccagaggcggagggcag

SEQ ID NO: 24462 - RNA, 18 nt, Human
aagagaaagaaggccaga

SEQ ID NO: 24463 - RNA, 32 nt, Human
aagagaaagagaaggaaggaaggagaaagaga

SEQ ID NO: 24464 - RNA, 31 nt, Human
aagagaaagagacauucacuuggagggcucu

SEQ ID NO: 24465 - RNA, 32 nt, Human
aagagaaagagagagaggagaagggagugagg

SEQ ID NO: 24466 - RNA, 32 nt, Human
aagagaaagaggaggagaauuaagaagaggau

SEQ ID NO: 24467 - RNA, 32 nt, Human
aagagaaagagggggaaaggaggaccgaagag

SEQ ID NO: 24468 - RNA, 32 nt, Human
aagagaaagguagaaauaaaaacuccuuaacu

SEQ ID NO: 24469 - RNA, 32 nt, Human
aagagaaagguagaacuaaaaacuccuuaacu

SEQ ID NO: 24470 - RNA, 19 nt, Human
aagagaaaucggucauuca

SEQ ID NO: 24471 - RNA, 32 nt, Human
aagagaaaugugccucauuugccauuugagaa

SEQ ID NO: 24472 - RNA, 18 nt, Human
aagagaacaaacugcagg

SEQ ID NO: 24473 - RNA, 32 nt, Human
aagagaacaguugaguucucucaguuggguag

SEQ ID NO: 24474 - RNA, 32 nt, Human
aagagaaccugcagccugccucagcucaggcu

SEQ ID NO: 24475 - RNA, 32 nt, Human
aagagaacgcuugagcauccuuggcaacagcc

SEQ ID NO: 24476 - RNA, 32 nt, Human
aagagaacguugcuguaucucaguccaggaga

SEQ ID NO: 24477 - RNA, 32 nt, Human
aagagaacuaccucauaugcaggaugagccaa

SEQ ID NO: 24478 - RNA, 32 nt, Human
aagagaacugaauguucagagcagcguuugua

SEQ ID NO: 24479 - RNA, 32 nt, Human
aagagaacugcuggcauauugagcccucucuc

SEQ ID NO: 24480 - RNA, 32 nt, Human
aagagaacuuagaaagcaugguauggcacagg

SEQ ID NO: 24481 - RNA, 32 nt, Human
aagagaacuuccgagaccucacagagaaauuc

SEQ ID NO: 24482 - RNA, 32 nt, Human
aagagaagaacuagcagagaaauuguauuuca

SEQ ID NO: 24483 - RNA, 32 nt, Human
aagagaagacuuccuuuccucuccucucgccu

SEQ ID NO: 24484 - RNA, 32 nt, Human
aagagaagagccaggaggaagaaagaauggcu

SEQ ID NO: 24485 - RNA, 32 nt, Human
aagagaagaggcugcggcuguacuggaggggg

SEQ ID NO: 24486 - RNA, 32 nt, Human
aagagaagagggcccagcccagagccaccugg

SEQ ID NO: 24487 - RNA, 32 nt, Human
aagagaagagguggugguauugggggaaagug

SEQ ID NO: 24488 - RNA, 32 nt, Human
aagagaagcaccagaagagaugccaagaaguu

SEQ ID NO: 24489 - RNA, 32 nt, Human
aagagaagcagguguuaauguaaguugcugug

SEQ ID NO: 24490 - RNA, 32 nt, Human
aagagaagcugaugcagccggugcuccaccca

SEQ ID NO: 24491 - RNA, 32 nt, Human
aagagaaggaacccucacacaccacugauagg

SEQ ID NO: 24492 - RNA, 32 nt, Human
aagagaaggagcaguggcucaugugggggccu

SEQ ID NO: 24493 - RNA, 32 nt, Human
aagagaaggccagcagaucagugagagugcaa

SEQ ID NO: 24494 - RNA, 32 nt, Human
aagagaagggcuuaguaacuguugugugggug

SEQ ID NO: 24495 - RNA, 32 nt, Human
aagagaaggucuuguacgugccuaaguucuag

SEQ ID NO: 24496 - RNA, 32 nt, Human
aagagaaguagaagaacggcuacagaaggaac

SEQ ID NO: 24497 - RNA, 32 nt, Human
aagagaaguggcagaggcugagaacagaaaga

SEQ ID NO: 24498 - RNA, 32 nt, Human
aagagaaucaaccagcugaguccugcaaaucc

SEQ ID NO: 24499 - RNA, 32 nt, Human
aagagaauccacccucucuggcccugggacau

SEQ ID NO: 24500 - RNA, 32 nt, Human
aagagaaugaauguaugauugugaacugugaa

SEQ ID NO: 24501 - RNA, 32 nt, Human
aagagaauggaaagcagcacacuccguccccu

SEQ ID NO: 24502 - RNA, 32 nt, Human
aagagaauggcgaaccuaggaggcagaguuug

SEQ ID NO: 24503 - RNA, 32 nt, Human
aagagaauuccuauuccuugaggucccuuggg

SEQ ID NO: 24504 - RNA, 32 nt, Human
aagagaauuuauuuccuucuccacucucucca

SEQ ID NO: 24505 - RNA, 32 nt, Human
aagagaauuucucaagaaaaaucccagcaacg

SEQ ID NO: 24506 - RNA, 32 nt, Human
aagagacaaaggagacuccugagggauuuaga

SEQ ID NO: 24507 - RNA, 32 nt, Human
aagagacaagggagaaaacacaauguauagcc

SEQ ID NO: 24508 - RNA, 32 nt, Human
aagagacaagugcuugguaccuacaugcaaag

SEQ ID NO: 24509 - RNA, 32 nt, Human
aagagacacaugcacccguauguucauugcag

SEQ ID NO: 24510 - RNA, 32 nt, Human
aagagacacauguguuagcugcagccuuuuga

SEQ ID NO: 24511 - RNA, 32 nt, Human
aagagacacugccuuuucagcagcagauacug

SEQ ID NO: 24512 - RNA, 25 nt, Human
aagagacagaaaccagccccagagg

SEQ ID NO: 24513 - RNA, 32 nt, Human
aagagacagaagccaaccuugccccucccuuc

SEQ ID NO: 24514 - RNA, 32 nt, Human
aagagacagaggaggggucaggaggcacugcu

SEQ ID NO: 24515 - RNA, 32 nt, Human
aagagacagaguuucgcuuguugcccaggcug

SEQ ID NO: 24516 - RNA, 19 nt, Human
aagagacagcuuuuagagg

SEQ ID NO: 24517 - RNA, 32 nt, Human
aagagacaggcagagaaggagagaggcagaga

SEQ ID NO: 24518 - RNA, 32 nt, Human
aagagacagggucuucuauguugcccaggcug

SEQ ID NO: 24519 - RNA, 32 nt, Human
aagagacagugcuguagccuugagacuaauga

SEQ ID NO: 24520 - RNA, 32 nt, Human
aagagacaguguccagaagaagcaucuuccuc

SEQ ID NO: 24521 - RNA, 32 nt, Human
aagagacauguuugcagaacccuuuaggaugg

SEQ ID NO: 24522 - RNA, 32 nt, Human
aagagaccaagcuuguuucccugcuggccaaa

SEQ ID NO: 24523 - RNA, 32 nt, Human
aagagaccagccuggccaguauggugaaaccc

SEQ ID NO: 24524 - RNA, 32 nt, Human
aagagaccaucuuugccugcacagcacucuuc

SEQ ID NO: 24525 - RNA, 32 nt, Human
aagagaccccacaggaguucuggccugugacu

SEQ ID NO: 24526 - RNA, 32 nt, Human
aagagaccccgugcccuuuaaccggcauuugc

SEQ ID NO: 24527 - RNA, 32 nt, Human
aagagacccuggggcugggugugguggcucac

SEQ ID NO: 24528 - RNA, 32 nt, Human
aagagaccucacucuucucuugcuuucgugag

SEQ ID NO: 24529 - RNA, 32 nt, Human
aagagaccuuagcugcuccaaccuggugcuga

SEQ ID NO: 24530 - RNA, 32 nt, Human
aagagaccuucagagaagacauggcuuccaga

SEQ ID NO: 24531 - RNA, 32 nt, Human
aagagaccuuggcugcucacuguccacaugug

SEQ ID NO: 24532 - RNA, 32 nt, Human
aagagacggaguuucgcucuucuucccaugcu

SEQ ID NO: 24533 - RNA, 32 nt, Human
aagagacgggagagaggagagagaaagagaga

SEQ ID NO: 24534 - RNA, 32 nt, Human
aagagacgggucucacuauguugcccaggcug

SEQ ID NO: 24535 - RNA, 32 nt, Human
aagagacuacuagguuaccacucugggcauug

SEQ ID NO: 24536 - RNA, 32 nt, Human
aagagacuccagcauggccuucuguuugcccc

SEQ ID NO: 24537 - RNA, 32 nt, Human
aagagacugagggucagagaggucacauggcu

SEQ ID NO: 24538 - RNA, 32 nt, Human
aagagacuggccaacaggaccaaccaagcacc

SEQ ID NO: 24539 - RNA, 32 nt, Human
aagagacuggggccuacacagaggcaggcaug

SEQ ID NO: 24540 - RNA, 32 nt, Human
aagagacuggggcgcagccucuccccaacacg

SEQ ID NO: 24541 - RNA, 32 nt, Human
aagagacugucucugaggcaccaccuuugcug

SEQ ID NO: 24542 - RNA, 32 nt, Human
aagagacuuccagcaccucucaguugaaugaa

SEQ ID NO: 24543 - RNA, 32 nt, Human
aagagacuuccucugguuuccucaggaggaaa

SEQ ID NO: 24544 - RNA, 32 nt, Human
aagagacuuccucuuggcguucaggaaacaca

SEQ ID NO: 24545 - RNA, 32 nt, Human
aagagacuugcgcgcacgcacaguccucugga

SEQ ID NO: 24546 - RNA, 32 nt, Human
aagagagaaaagacaagggaagaaaagaagaa

SEQ ID NO: 24547 - RNA, 32 nt, Human
aagagagaaagaaagagaaaguacucagaggc

SEQ ID NO: 24548 - RNA, 32 nt, Human
aagagagaaaucuagugucuauugcaggagaa

SEQ ID NO: 24549 - RNA, 32 nt, Human
aagagagaaaugacaggagccugcucuaaggc

SEQ ID NO: 24550 - RNA, 32 nt, Human
aagagagaagaaaagaagaauggagagagagg

SEQ ID NO: 24551 - RNA, 32 nt, Human
aagagagaaggaagaauggcaaaggaaggaag

SEQ ID NO: 24552 - RNA, 32 nt, Human
aagagagaaucacuugagcucaggaguucaag

SEQ ID NO: 24553 - RNA, 32 nt, Human
aagagagaaugcuucuuacaggaacaguuacc

SEQ ID NO: 24554 - RNA, 32 nt, Human
aagagagaauggaagagacaaaagaggcuaug

SEQ ID NO: 24555 - RNA, 32 nt, Human
aagagagaccagagcucacucuccagugugug

SEQ ID NO: 24556 - RNA, 32 nt, Human
aagagagacuauucaauaaaaacucacugggu

SEQ ID NO: 24557 - RNA, 32 nt, Human
aagagagagaaaaggagagaggaagacacaca

SEQ ID NO: 24558 - RNA, 32 nt, Human
aagagagaucagacugucacugugucuaugua

SEQ ID NO: 24559 - RNA, 32 nt, Human
aagagagaucagacugucacugugucuauguc

SEQ ID NO: 24560 - RNA, 32 nt, Human
aagagagaucagacuguuacugugucuacaua

SEQ ID NO: 24561 - RNA, 32 nt, Human
aagagagaucagacuguuacugugucuaugua

SEQ ID NO: 24562 - RNA, 32 nt, Human
aagagagaucagauuguuacugugucugugua

SEQ ID NO: 24563 - RNA, 32 nt, Human
aagagagauccaguaugcaccccucagcuuuc

SEQ ID NO: 24564 - RNA, 32 nt, Human
aagagagaucguggagagagccagggcccaga

SEQ ID NO: 24565 - RNA, 32 nt, Human
aagagagauggaaaacuugaugacuagcucca

SEQ ID NO: 24566 - RNA, 32 nt, Human
aagagagcaacgaggaaaggagagggacucug

SEQ ID NO: 24567 - RNA, 32 nt, Human
aagagagcaggauggagaauggaaggaaagcc

SEQ ID NO: 24568 - RNA, 18 nt, Human
aagagagccaggcccuug

SEQ ID NO: 24569 - RNA, 32 nt, Human
aagagagcucaagaggaaugcuuugugagaag

SEQ ID NO: 24570 - RNA, 32 nt, Human
aagagaggaaaucagucgcugaguauuauuug

SEQ ID NO: 24571 - RNA, 31 nt, Human
aagagaggaauugugccucagaagcuguaug

SEQ ID NO: 24572 - RNA, 32 nt, Human
aagagaggaccagaccaggcagaggaacauuu

SEQ ID NO: 24573 - RNA, 32 nt, Human
aagagaggagucaacccaggggagcaggauuc

SEQ ID NO: 24574 - RNA, 32 nt, Human
aagagaggagugggacaguccucuccaccaag

SEQ ID NO: 24575 - RNA, 21 nt, Human
aagagaggaugacacaucaaa

SEQ ID NO: 24576 - RNA, 32 nt, Human
aagagaggcaaaggcucucacuccaggacagu

SEQ ID NO: 24577 - RNA, 32 nt, Human
aagagaggccaguacaaagcccauggauuuug

SEQ ID NO: 24578 - RNA, 32 nt, Human
aagagaggcccaggcuggggcagcccugagag

SEQ ID NO: 24579 - RNA, 32 nt, Human
aagagaggccuucucauccccaagcucuccag

SEQ ID NO: 24580 - RNA, 32 nt, Human
aagagagggaacagggcuucucuagauuauuu

SEQ ID NO: 24581 - RNA, 32 nt, Human
aagagagggaagagaaagcacagagcagagaa

SEQ ID NO: 24582 - RNA, 32 nt, Human
aagagagggagaaagagagggagaaagggaga

SEQ ID NO: 24583 - RNA, 32 nt, Human
aagagagggaggaggaaaggaaggagagagau

SEQ ID NO: 24584 - RNA, 32 nt, Human
aagagagggaggaggagcuggagcuauccuac

SEQ ID NO: 24585 - RNA, 32 nt, Human
aagagagggauaaaauucaggagcaaguuucc

SEQ ID NO: 24586 - RNA, 32 nt, Human
aagagagggaugcauggagauagccccacagg

SEQ ID NO: 24587 - RNA, 32 nt, Human
aagagagggcagagucuggauuugaacccuug

SEQ ID NO: 24588 - RNA, 32 nt, Human
aagagagguagaauggugcuaguuuccuauuu

SEQ ID NO: 24589 - RNA, 32 nt, Human
aagagagguguguacagcaaggaagcaaaaau

SEQ ID NO: 24590 - RNA, 32 nt, Human
aagagagguuucuuuucuggaccucaguuucu

SEQ ID NO: 24591 - RNA, 32 nt, Human
aagagaguaugcauuaaaacaaaagcccgcuu

SEQ ID NO: 24592 - RNA, 32 nt, Human
aagagagugagaggagcaacagugaaaggcca

SEQ ID NO: 24593 - RNA, 32 nt, Human
aagagaguguuugagagcagaagcuauggcaa

SEQ ID NO: 24594 - RNA, 32 nt, Human
aagagaguucaucagggacugauuacguagga

SEQ ID NO: 24595 - RNA, 32 nt, Human
aagagaguuggccagguguggugacucacacc

SEQ ID NO: 24596 - RNA, 32 nt, Human
aagagauaaacaguaacccuuccaggagccca

SEQ ID NO: 24597 - RNA, 32 nt, Human
aagagauaauaugccaggggguugaugccagg

SEQ ID NO: 24598 - RNA, 32 nt, Human
aagagauaggagacagagaaagggacaggaga

SEQ ID NO: 24599 - RNA, 32 nt, Human
aagagauagggagggaggggacauaaagggaa

SEQ ID NO: 24600 - RNA, 32 nt, Human
aagagauaugaggaaaauuguuaaggaaguca

SEQ ID NO: 24601 - RNA, 32 nt, Human
aagagaucaagaccagccugaccaacguggcg

SEQ ID NO: 24602 - RNA, 32 nt, Human
aagagaucaagaccauagugaccaacauagug

SEQ ID NO: 24603 - RNA, 32 nt, Human
aagagaucaagagguugaagcugcagugagcu

SEQ ID NO: 24604 - RNA, 32 nt, Human
aagagaucagaaugaugaguccagaaccccug

SEQ ID NO: 24605 - RNA, 32 nt, Human
aagagaucagggagggcuaaaguugugucuua

SEQ ID NO: 24606 - RNA, 32 nt, Human
aagagaucccuaauaugccuccugaaaugcag

SEQ ID NO: 24607 - RNA, 32 nt, Human
aagagaucccuuaagaaguuagaaggcuuaag

SEQ ID NO: 24608 - RNA, 32 nt, Human
aagagauccuccugccuaagcccccaaauagc

SEQ ID NO: 24609 - RNA, 32 nt, Human
aagagaucgagaccagccuggccaacauagua

SEQ ID NO: 24610 - RNA, 32 nt, Human
aagagaucgagaccagccuggccaacguggug

SEQ ID NO: 24611 - RNA, 32 nt, Human
aagagaucuuuucagcugcuauuuuggaauaa

SEQ ID NO: 24612 - RNA, 30 nt, Human
aagagaugaaaccaggaggcaggagaaugu

SEQ ID NO: 24613 - RNA, 32 nt, Human
aagagaugaaucuguugggauuucuucuuuua

SEQ ID NO: 24614 - RNA, 32 nt, Human
aagagaugcaagacuuucaacugacuggcaaa

SEQ ID NO: 24615 - RNA, 32 nt, Human
aagagaugcacgcaguuggcucuugcaagccu

SEQ ID NO: 24616 - RNA, 32 nt, Human
aagagaugccuaaaauguuuucuauuuaaaaa

SEQ ID NO: 24617 - RNA, 32 nt, Human
aagagaugccugggcgucaccaugccacagcu

SEQ ID NO: 24618 - RNA, 32 nt, Human
aagagauggaggaggaggacuggcccagaauu

SEQ ID NO: 24619 - RNA, 30 nt, Human
aagagauggcagcagaggcuggggaagccg

SEQ ID NO: 24620 - RNA, 32 nt, Human
aagagaugggagguugggggaggugagcauaa

SEQ ID NO: 24621 - RNA, 32 nt, Human
aagagaugugagccaguuuucccagccuguuu

SEQ ID NO: 24622 - RNA, 32 nt, Human
aagagauguuuccccagguuccauaccaucug

SEQ ID NO: 24623 - RNA, 32 nt, Human
aagagauucccugaguagcaccuucaggcuag

SEQ ID NO: 24624 - RNA, 32 nt, Human
aagagauuccuuucuucuugugacaaaacauc

SEQ ID NO: 24625 - RNA, 32 nt, Human
aagagauucuccccaauuucuuugcagguauc

SEQ ID NO: 24626 - RNA, 32 nt, Human
aagagauuuacucaucuauccaagcacuuaau

SEQ ID NO: 24627 - RNA, 27 nt, Human
aagagcaaaaaugagaccuguauauua

SEQ ID NO: 24628 - RNA, 32 nt, Human
aagagcaaaagccgugaaaggaagcgaagucg

SEQ ID NO: 24629 - RNA, 31 nt, Human
aagagcaaaaguaccuccaugccaagucccu

SEQ ID NO: 24630 - RNA, 21 nt, Human
aagagcaaaauacuggguuga

SEQ ID NO: 24631 - RNA, 32 nt, Human
aagagcaaacuuuagugucucuaaguuaugac

SEQ ID NO: 24632 - RNA, 32 nt, Human
aagagcaaagggaacccagcaguucugaguga

SEQ ID NO: 24633 - RNA, 32 nt, Human
aagagcaaagucaacagaaaaucagcccagca

SEQ ID NO: 24634 - RNA, 32 nt, Human
aagagcaacuaaaaauguaaaauugguuaaaa

SEQ ID NO: 24635 - RNA, 24 nt, Human
aagagcaacuggagauagaagcau

SEQ ID NO: 24636 - RNA, 32 nt, Human
aagagcaagaaaucuacagcugguguaaaaua

SEQ ID NO: 24637 - RNA, 32 nt, Human
aagagcaagcuggagaggcugggcaggggcug

SEQ ID NO: 24638 - RNA, 32 nt, Human
aagagcaagggaucacugugcuggguuuaaau

SEQ ID NO: 24639 - RNA, 32 nt, Human
aagagcaagugccuuggccgggcacaguggcu

SEQ ID NO: 24640 - RNA, 32 nt, Human
aagagcaaugugccgucuucugucuuuggaaa

SEQ ID NO: 24641 - RNA, 32 nt, Human
aagagcacacagagaagggaagaaggggccau

SEQ ID NO: 24642 - RNA, 32 nt, Human
aagagcacagccgucuuucacggucacagaga

SEQ ID NO: 24643 - RNA, 32 nt, Human
aagagcaccagccagggcaacauagcgugacc

SEQ ID NO: 24644 - RNA, 32 nt, Human
aagagcaccccaauuuuccuuuggagaaccuc

SEQ ID NO: 24645 - RNA, 32 nt, Human
aagagcaccucugccuucuuccucuguugcca

SEQ ID NO: 24646 - RNA, 32 nt, Human
aagagcacugaauuuccuaggggaaggugagc

SEQ ID NO: 24647 - RNA, 32 nt, Human
aagagcacugcacugacgguuuggagaccuga

SEQ ID NO: 24648 - RNA, 21 nt, Human
aagagcacugcaugagcaagg

SEQ ID NO: 24649 - RNA, 32 nt, Human
aagagcacuuccuugccuccguaaggccagag

SEQ ID NO: 24650 - RNA, 32 nt, Human
aagagcacuugucuuucuccugccucagcagc

SEQ ID NO: 24651 - RNA, 21 nt, Human
aagagcagaacuccugacuac

SEQ ID NO: 24652 - RNA, 23 nt, Human
aagagcagaaugucuguauacua

SEQ ID NO: 24653 - RNA, 32 nt, Human
aagagcagagcugcagacaggaauaagaagaa

SEQ ID NO: 24654 - RNA, 32 nt, Human
aagagcagagggagcauggcccagggguguug

SEQ ID NO: 24655 - RNA, 32 nt, Human
aagagcagcacuucucagcuauuaaaggcccc

SEQ ID NO: 24656 - RNA, 32 nt, Human
aagagcagcagcacccucagggcauccgaugg

SEQ ID NO: 24657 - RNA, 32 nt, Human
aagagcagccugggcaaaauagugagacaccg

SEQ ID NO: 24658 - RNA, 32 nt, Human
aagagcagccugggcaauacagcaagaccuca

SEQ ID NO: 24659 - RNA, 32 nt, Human
aagagcagccugggcaauauagaaagaccucu

SEQ ID NO: 24660 - RNA, 31 nt, Human
aagagcagcuaaaaccuacucacuuagcaug

SEQ ID NO: 24661 - RNA, 32 nt, Human
aagagcagcucgaagaccauccuggccauagc

SEQ ID NO: 24662 - RNA, 32 nt, Human
aagagcagcugcuaggggcugaagcgaagggg

SEQ ID NO: 24663 - RNA, 32 nt, Human
aagagcaggagaaaagacguaaaccuacccca

SEQ ID NO: 24664 - RNA, 32 nt, Human
aagagcaggagaaaauagaugucccagaacaa

SEQ ID NO: 24665 - RNA, 32 nt, Human
aagagcagggcagaggguggcaguggcacaua

SEQ ID NO: 24666 - RNA, 32 nt, Human
aagagcaggggagguuuaguuggucucagcac

SEQ ID NO: 24667 - RNA, 32 nt, Human
aagagcagucagaaguaucuguuucuccuaga

SEQ ID NO: 24668 - RNA, 32 nt, Human
aagagcaguucguggaauuuugcccaucugac

SEQ ID NO: 24669 - RNA, 32 nt, Human
aagagcaguucugcagcuggccuuguuccuuc

SEQ ID NO: 24670 - RNA, 32 nt, Human
aagagcaucaccuccaaucauccugguggccu

SEQ ID NO: 24671 - RNA, 32 nt, Human
aagagcaugcuuacacccuacugugaaaaggg

SEQ ID NO: 24672 - RNA, 32 nt, Human
aagagcauugcaucuuugcugaauccagaugg

SEQ ID NO: 24673 - RNA, 32 nt, Human
aagagccaagagcaggaugagguggaggcguu

SEQ ID NO: 24674 - RNA, 32 nt, Human
aagagccaagaggcaucucagauuugucaaca

SEQ ID NO: 24675 - RNA, 32 nt, Human
aagagccacacacccauuuuccucacuuuccc

SEQ ID NO: 24676 - RNA, 32 nt, Human
aagagccacagcaccuagccugaggcugacua

SEQ ID NO: 24677 - RNA, 32 nt, Human
aagagccacugaaagcagaauaccuguuucaa

SEQ ID NO: 24678 - RNA, 32 nt, Human
aagagccacugcacaacagccaaggaacuuug

SEQ ID NO: 24679 - RNA, 32 nt, Human
aagagccagaaacgugguucuucaaguagauc

SEQ ID NO: 24680 - RNA, 32 nt, Human
aagagccagaagcaggguucugggaauuuugc

SEQ ID NO: 24681 - RNA, 32 nt, Human
aagagccaggagaccagggagggagcuugugg

SEQ ID NO: 24682 - RNA, 32 nt, Human
aagagccaggagaccagggagggaguuugugg

SEQ ID NO: 24683 - RNA, 32 nt, Human
aagagccaggagacccaggagggagcuugugg

SEQ ID NO: 24684 - RNA, 32 nt, Human
aagagccaggaggcucagagucugcagcagca

SEQ ID NO: 24685 - RNA, 32 nt, Human
aagagccagggagggcagcccaggcccaagug

SEQ ID NO: 24686 - RNA, 32 nt, Human
aagagccauggugaaaccgcaucucuacuaaa

SEQ ID NO: 24687 - RNA, 32 nt, Human
aagagcccaggagguugagaaugcagugagcu

SEQ ID NO: 24688 - RNA, 32 nt, Human
aagagcccauagggcagagcugagucggcaga

SEQ ID NO: 24689 - RNA, 32 nt, Human
aagagcccauaucaacaacacacccauguaug

SEQ ID NO: 24690 - RNA, 32 nt, Human
aagagccccaucccuucucucucugccaccau

SEQ ID NO: 24691 - RNA, 32 nt, Human
aagagcccccuccagaccacucuacagcugcu

SEQ ID NO: 24692 - RNA, 32 nt, Human
aagagccccuaccuugaaaagaagguuggagu

SEQ ID NO: 24693 - RNA, 32 nt, Human
aagagccccugcccugcccuagcugaggcaca

SEQ ID NO: 24694 - RNA, 32 nt, Human
aagagcccgcaugcauuuguggcuccacaacu

SEQ ID NO: 24695 - RNA, 32 nt, Human
aagagcccgccgucugcaggggccuggaggaa

SEQ ID NO: 24696 - RNA, 32 nt, Human
aagagcccuggaauauaaaaagacaugagaug

SEQ ID NO: 24697 - RNA, 32 nt, Human
aagagccgacuugcugaaucuuccagccuuca

SEQ ID NO: 24698 - RNA, 32 nt, Human
aagagccggacaagggcucuggacucaaccug

SEQ ID NO: 24699 - RNA, 32 nt, Human
aagagccucuuuccuucauaccaucuucagau

SEQ ID NO: 24700 - RNA, 32 nt, Human
aagagccugacacccaucccucugcccuccac

SEQ ID NO: 24701 - RNA, 32 nt, Human
aagagccugagugacagagcaagaccccaucu

SEQ ID NO: 24702 - RNA, 32 nt, Human
aagagccugcagccccugucagaugccagcca

SEQ ID NO: 24703 - RNA, 32 nt, Human
aagagccugccacccucccccuucaaugcacc

SEQ ID NO: 24704 - RNA, 32 nt, Human
aagagccuggacagauguaaugagaacuaaag

SEQ ID NO: 24705 - RNA, 32 nt, Human
aagagccugggcaacauagugagaccccaucu

SEQ ID NO: 24706 - RNA, 32 nt, Human
aagagccugggcugaugaugauguggcagaac

SEQ ID NO: 24707 - RNA, 32 nt, Human
aagagccuguaaucucagcuacucaggaggcu

SEQ ID NO: 24708 - RNA, 32 nt, Human
aagagccuuacaugaguccucucacuuaaucu

SEQ ID NO: 24709 - RNA, 32 nt, Human
aagagccuucaggagugucuguccacaggcag

SEQ ID NO: 24710 - RNA, 32 nt, Human
aagagccuucucucuuccuguugacacuugcc

SEQ ID NO: 24711 - RNA, 32 nt, Human
aagagcgaggcuguagcggcugccuguugagg

SEQ ID NO: 24712 - RNA, 32 nt, Human
aagagcgcaccauugcacuccagccuugggcg

SEQ ID NO: 24713 - RNA, 32 nt, Human
aagagcgggagaggagauggagaaacagaccc

SEQ ID NO: 24714 - RNA, 32 nt, Human
aagagcgguugucuguuugcugugccauuucu

SEQ ID NO: 24715 - RNA, 32 nt, Human
aagagcgugccuggacccugggagguguggug

SEQ ID NO: 24716 - RNA, 32 nt, Human
aagagcuaaagauggcugaauuucuagaugac

SEQ ID NO: 24717 - RNA, 32 nt, Human
aagagcuaagggccguuugcaguggcucaagc

SEQ ID NO: 24718 - RNA, 32 nt, Human
aagagcuaauccucaucugucauauccagaaa

SEQ ID NO: 24719 - RNA, 32 nt, Human
aagagcuaccugaggcagaagcuccaggcccu

SEQ ID NO: 24720 - RNA, 32 nt, Human
aagagcuagggagggugcacaggcgcuggcac

SEQ ID NO: 24721 - RNA, 31 nt, Human
aagagcucaaaccauuuuacauuccuguuug

SEQ ID NO: 24722 - RNA, 32 nt, Human
aagagcucauagacugacugguccagaagaca

SEQ ID NO: 24723 - RNA, 32 nt, Human
aagagcuccagaaaucugcacaggguucucuu

SEQ ID NO: 24724 - RNA, 32 nt, Human
aagagcuccuccauaauucagcauuaaccagc

SEQ ID NO: 24725 - RNA, 19 nt, Human
aagagcuccuggacgcaga

SEQ ID NO: 24726 - RNA, 18 nt, Human
aagagcucucaacccaga

SEQ ID NO: 24727 - RNA, 32 nt, Human
aagagcucuccaggaaaacauuggauauauug

SEQ ID NO: 24728 - RNA, 32 nt, Human
aagagcucugcaggcuuuccacugccuguauu

SEQ ID NO: 24729 - RNA, 32 nt, Human
aagagcucugcuugcucaacacuugcuuuaug

SEQ ID NO: 24730 - RNA, 32 nt, Human
aagagcucuguauuaacgagcuacucauugag

SEQ ID NO: 24731 - RNA, 23 nt, Human
aagagcucuugggaagacagaga

SEQ ID NO: 24732 - RNA, 32 nt, Human
aagagcugaacaaacagaucgaggagcagaag

SEQ ID NO: 24733 - RNA, 32 nt, Human
aagagcugaagaauaaaaauaugcugucuggc

SEQ ID NO: 24734 - RNA, 32 nt, Human
aagagcugaagcagaagaauaagccauccucu

SEQ ID NO: 24735 - RNA, 32 nt, Human
aagagcugaaugaaggccugguggcaggaugg

SEQ ID NO: 24736 - RNA, 32 nt, Human
aagagcugacucugagcccuggcccagccaag

SEQ ID NO: 24737 - RNA, 24 nt, Human
aagagcugagauuacaggcgugag

SEQ ID NO: 24738 - RNA, 32 nt, Human
aagagcugagauuacaggcgugagccaccaug

SEQ ID NO: 24739 - RNA, 32 nt, Human
aagagcugagccaagucacaggagauuauaug

SEQ ID NO: 24740 - RNA, 21 nt, Human
aagagcugagcgcagcugaca

SEQ ID NO: 24741 - RNA, 32 nt, Human
aagagcugaugaaaucucagucuuuuguaucu

SEQ ID NO: 24742 - RNA, 32 nt, Human
aagagcugccaggcagugucuuagaugugaga

SEQ ID NO: 24743 - RNA, 32 nt, Human
aagagcuggcaaagguggcucuccaguuaguu

SEQ ID NO: 24744 - RNA, 32 nt, Human
aagagcuggcagcugcugaugguguuucccaa

SEQ ID NO: 24745 - RNA, 32 nt, Human
aagagcuggcuguaaucccgccucccgccagc

SEQ ID NO: 24746 - RNA, 19 nt, Human
aagagcugggaauuuauga

SEQ ID NO: 24747 - RNA, 32 nt, Human
aagagcugggagagacacaggaaagagaaaag

SEQ ID NO: 24748 - RNA, 24 nt, Human
aagagcugggauuacaagugugag

SEQ ID NO: 24749 - RNA, 32 nt, Human
aagagcugggauuacaggcaugagccacugug

SEQ ID NO: 24750 - RNA, 32 nt, Human
aagagcugggauuacaggcaugagucaccacg

SEQ ID NO: 24751 - RNA, 24 nt, Human
aagagcugggauuacaggcgugag

SEQ ID NO: 24752 - RNA, 32 nt, Human
aagagcugggauuacaggcgugagacaccgcg

SEQ ID NO: 24753 - RNA, 24 nt, Human
aagagcugggauuacaggugugag

SEQ ID NO: 24754 - RNA, 32 nt, Human
aagagcugggauuacaggugugagcuaccgcg

SEQ ID NO: 24755 - RNA, 32 nt, Human
aagagcugggcauuuagaaagaugucauuugc

SEQ ID NO: 24756 - RNA, 19 nt, Human
aagagcuggggcagaggca

SEQ ID NO: 24757 - RNA, 32 nt, Human
aagagcuggguccuucccccugcuccaucuga

SEQ ID NO: 24758 - RNA, 32 nt, Human
aagagcuuaaaaccagcccaggcaacauggca

SEQ ID NO: 24759 - RNA, 32 nt, Human
aagagcuuacuggguaguuagaguucaucagg

SEQ ID NO: 24760 - RNA, 25 nt, Human
aagagcuuaucuaagaagggaagag

SEQ ID NO: 24761 - RNA, 32 nt, Human
aagagcuugcccaggcuuccucucucucccuu

SEQ ID NO: 24762 - RNA, 19 nt, Human
aagagcuuggaggaccagg

SEQ ID NO: 24763 - RNA, 32 nt, Human
aagagcuuggaggaccaggcacuuugaggaag

SEQ ID NO: 24764 - RNA, 32 nt, Human
aagagcuugugacuggacuccagccugggcaa

SEQ ID NO: 24765 - RNA, 32 nt, Human
aagagcuuugaucuucucagccaggagaagag

SEQ ID NO: 24766 - RNA, 32 nt, Human
aagaggaaaaacacagaacucuccaaagcuuu

SEQ ID NO: 24767 - RNA, 32 nt, Human
aagaggaaaagaacauuccaggcagacagcac

SEQ ID NO: 24768 - RNA, 32 nt, Human
aagaggaaagaaacacaaaaaguggcuugaug

SEQ ID NO: 24769 - RNA, 32 nt, Human
aagaggaaagagaagagaucgcucagggguga

SEQ ID NO: 24770 - RNA, 32 nt, Human
aagaggaaagagacucauguugcucaauguga

SEQ ID NO: 24771 - RNA, 32 nt, Human
aagaggaaauaaugccuccaccauuuucuacc

SEQ ID NO: 24772 - RNA, 32 nt, Human
aagaggaaaucagggucucgcucuguugcuca

SEQ ID NO: 24773 - RNA, 32 nt, Human
aagaggaaauggugacccaaguguggggguug

SEQ ID NO: 24774 - RNA, 32 nt, Human
aagaggaaauugagacacagagacagacauga

SEQ ID NO: 24775 - RNA, 32 nt, Human
aagaggaacagcugcuggccuuggaagacuac

SEQ ID NO: 24776 - RNA, 32 nt, Human
aagaggaacggcugggaucaguuagugauguc

SEQ ID NO: 24777 - RNA, 32 nt, Human
aagaggaagaaagaacagauguucacagcuga

SEQ ID NO: 24778 - RNA, 32 nt, Human
aagaggaagaagaggaaggaaaaggagucagu

SEQ ID NO: 24779 - RNA, 31 nt, Human
aagaggaagagagagacccucacugcugggg

SEQ ID NO: 24780 - RNA, 32 nt, Human
aagaggaagagagagacccucacugcugggga

SEQ ID NO: 24781 - RNA, 32 nt, Human
aagaggaagaggagaauggauguuggggguac

SEQ ID NO: 24782 - RNA, 32 nt, Human
aagaggaagaggagcgugaggagggaggcgag

SEQ ID NO: 24783 - RNA, 32 nt, Human
aagaggaagaggaggaaggcgacggcaacagu

SEQ ID NO: 24784 - RNA, 32 nt, Human
aagaggaagaggaggaggaggagaccggcagc

SEQ ID NO: 24785 - RNA, 32 nt, Human
aagaggaagaggcugcaauggagcagcacacc

SEQ ID NO: 24786 - RNA, 32 nt, Human
aagaggaagauccaggaguccauagaaaagcu

SEQ ID NO: 24787 - RNA, 32 nt, Human
aagaggaagcugagcuauacuacuuuuaaaau

SEQ ID NO: 24788 - RNA, 32 nt, Human
aagaggaagggcagguacuagguguuucauuu

SEQ ID NO: 24789 - RNA, 32 nt, Human
aagaggaagggccuugugggauacaccuugca

SEQ ID NO: 24790 - RNA, 32 nt, Human
aagaggaauaagaauggagcaguacaugggaa

SEQ ID NO: 24791 - RNA, 32 nt, Human
aagaggaauauucugguuuauuuccuagacug

SEQ ID NO: 24792 - RNA, 18 nt, Human
aagaggaauggacuuggc

SEQ ID NO: 24793 - RNA, 32 nt, Human
aagaggacacagaagaguuguauagcaccaga

SEQ ID NO: 24794 - RNA, 32 nt, Human
aagaggacacagaaggauucugcaaauagccu

SEQ ID NO: 24795 - RNA, 32 nt, Human
aagaggacagagccaugcaguccacagaccac

SEQ ID NO: 24796 - RNA, 32 nt, Human
aagaggaccacacuccagcccaggacaaaagc

SEQ ID NO: 24797 - RNA, 32 nt, Human
aagaggaccacacuccagcccaggacaaaugc

SEQ ID NO: 24798 - RNA, 32 nt, Human
aagaggaccaggaggagcucaucuuuggugag

SEQ ID NO: 24799 - RNA, 32 nt, Human
aagaggacccaagagagugccgugcugaggcu

SEQ ID NO: 24800 - RNA, 32 nt, Human
aagaggacccugggugucagugagaucucagc

SEQ ID NO: 24801 - RNA, 32 nt, Human
aagaggaccuggcacacagucaguauucagug

SEQ ID NO: 24802 - RNA, 32 nt, Human
aagaggaccuugcuguccgccugcacugcuuc

SEQ ID NO: 24803 - RNA, 32 nt, Human
aagaggacgaggaggaugaggagggggagagc

SEQ ID NO: 24804 - RNA, 32 nt, Human
aagaggacgaggggcgcaaggcuuccuccggg

SEQ ID NO: 24805 - RNA, 24 nt, Human
aagaggacugggaauaaagucaga

SEQ ID NO: 24806 - RNA, 32 nt, Human
aagaggacuucgggguagaggcugggaggagc

SEQ ID NO: 24807 - RNA, 32 nt, Human
aagaggagaaaaaggagaaaaaguaaacaugu

SEQ ID NO: 24808 - RNA, 32 nt, Human
aagaggagaaaguucuggagaggaugguggug

SEQ ID NO: 24809 - RNA, 32 nt, Human
aagaggagaaugcacaaguguaacuccugguu

SEQ ID NO: 24810 - RNA, 32 nt, Human
aagaggagagaagagagcugaaauaucaaaug

SEQ ID NO: 24811 - RNA, 32 nt, Human
aagaggagagagaagagauggacagaccucag

SEQ ID NO: 24812 - RNA, 32 nt, Human
aagaggagagccaacauucacauuuaccaugg

SEQ ID NO: 24813 - RNA, 21 nt, Human
aagaggagauugaaacugaaa

SEQ ID NO: 24814 - RNA, 32 nt, Human
aagaggagccccgagcagggaggcuggggccu

SEQ ID NO: 24815 - RNA, 19 nt, Human
aagaggagccgagcgcggc

SEQ ID NO: 24816 - RNA, 23 nt, Human
aagaggagccugugaauucagag

SEQ ID NO: 24817 - RNA, 23 nt, Human
aagaggagcuagagcuugccuca

SEQ ID NO: 24818 - RNA, 32 nt, Human
aagaggagcugcagggaccauggccagguuac

SEQ ID NO: 24819 - RNA, 32 nt, Human
aagaggagcugguaccauuucuucugaaacug

SEQ ID NO: 24820 - RNA, 32 nt, Human
aagaggaggaagaggaaggggagagggacgag

SEQ ID NO: 24821 - RNA, 32 nt, Human
aagaggaggaagaggaugaccugagugagcug

SEQ ID NO: 24822 - RNA, 32 nt, Human
aagaggaggaagcaaugggggaauaugacacc

SEQ ID NO: 24823 - RNA, 22 nt, Human
aagaggaggacuaaacucagag

SEQ ID NO: 24824 - RNA, 19 nt, Human
aagaggaggagaaggggga

SEQ ID NO: 24825 - RNA, 32 nt, Human
aagaggaggagaauuaagaagaggaugaucgg

SEQ ID NO: 24826 - RNA, 32 nt, Human
aagaggaggaggaaggaaagaaagaaagcgag

SEQ ID NO: 24827 - RNA, 32 nt, Human
aagaggaggaggaggaagaggaggaggaggaa

SEQ ID NO: 24828 - RNA, 32 nt, Human
aagaggaggaggaggaagaggggagcacaaag

SEQ ID NO: 24829 - RNA, 32 nt, Human
aagaggaggaggaggagaccggcagcaacucu

SEQ ID NO: 24830 - RNA, 32 nt, Human
aagaggaggaggaggagaggcggcggggaagg

SEQ ID NO: 24831 - RNA, 32 nt, Human
aagaggaggaggaggagaugguggccgaggaa

SEQ ID NO: 24832 - RNA, 32 nt, Human
aagaggaggaggaggaggaagaauaggaggaa

SEQ ID NO: 24833 - RNA, 32 nt, Human
aagaggaggaggaggaggagaaggaggagaga

SEQ ID NO: 24834 - RNA, 32 nt, Human
aagaggaggaggaggaggagcuggaggaggag

SEQ ID NO: 24835 - RNA, 32 nt, Human
aagaggaggaggaggaggaggaagaagaaaga

SEQ ID NO: 24836 - RNA, 32 nt, Human
aagaggaggaggaggaggaggaagcugaagac

SEQ ID NO: 24837 - RNA, 32 nt, Human
aagaggaggaggaggaggaggaaggggcuugg

SEQ ID NO: 24838 - RNA, 32 nt, Human
aagaggaggaggaggaggaggaggaggaggag

SEQ ID NO: 24839 - RNA, 32 nt, Human
aagaggaggggaggaggaggaggaggaggagg

SEQ ID NO: 24840 - RNA, 32 nt, Human
aagaggaggugaccugucccaucugccuggag

SEQ ID NO: 24841 - RNA, 32 nt, Human
aagaggagguggcaaugguagauccacccuua

SEQ ID NO: 24842 - RNA, 24 nt, Human
aagaggaguucaccaguuucaaag

SEQ ID NO: 24843 - RNA, 22 nt, Human
aagaggaguucccugcucaagg

SEQ ID NO: 24844 - RNA, 32 nt, Human
aagaggauccuugauguggaagauagaaaaag

SEQ ID NO: 24845 - RNA, 32 nt, Human
aagaggaugaccagagccaaggcucacagaaa

SEQ ID NO: 24846 - RNA, 32 nt, Human
aagaggaugcaggucuuuaagagccaucagcu

SEQ ID NO: 24847 - RNA, 31 nt, Human
aagaggauggacaaagauucucaggggcugc

SEQ ID NO: 24848 - RNA, 32 nt, Human
aagaggauggcagaggcugcugggccuuggaa

SEQ ID NO: 24849 - RNA, 32 nt, Human
aagaggauugcuugaguccaggaguuugagac

SEQ ID NO: 24850 - RNA, 32 nt, Human
aagaggauuuuccaguguuucuggcaguuggu

SEQ ID NO: 24851 - RNA, 32 nt, Human
aagaggcaaccuguugaauuuacucucucaga

SEQ ID NO: 24852 - RNA, 32 nt, Human
aagaggcaaggcagaaauggaugaugaacauc

SEQ ID NO: 24853 - RNA, 32 nt, Human
aagaggcaccuugugcaauauucccaucccug

SEQ ID NO: 24854 - RNA, 32 nt, Human
aagaggcagagggaggcagccagcggggcgug

SEQ ID NO: 24855 - RNA, 32 nt, Human
aagaggcagcagacacaaauaaggugguccuu

SEQ ID NO: 24856 - RNA, 22 nt, Human
aagaggcagcagcaucccaaga

SEQ ID NO: 24857 - RNA, 21 nt, Human
aagaggcagccuggccagagg

SEQ ID NO: 24858 - RNA, 20 nt, Human
aagaggcagcuucgagccca

SEQ ID NO: 24859 - RNA, 20 nt, Human
aagaggcaggcaccccagag

SEQ ID NO: 24860 - RNA, 32 nt, Human
aagaggcaggcagaggcugaggcugauuccac

SEQ ID NO: 24861 - RNA, 20 nt, Human
aagaggcagggaccuaaagg

SEQ ID NO: 24862 - RNA, 32 nt, Human
aagaggcaucugguucucucauguggauggau

SEQ ID NO: 24863 - RNA, 20 nt, Human
aagaggcauggccccaacgg

SEQ ID NO: 24864 - RNA, 32 nt, Human
aagaggccacgcuguaccuaguaugguaugca

SEQ ID NO: 24865 - RNA, 32 nt, Human
aagaggcccagggaauccucuggaccaccaga

SEQ ID NO: 24866 - RNA, 32 nt, Human
aagaggcccaugugccuguuucugccauguaa

SEQ ID NO: 24867 - RNA, 32 nt, Human
aagaggccccgugaaggaggcagugaggagcu

SEQ ID NO: 24868 - RNA, 32 nt, Human
aagaggccccuggauggaugcauggggaaggu

SEQ ID NO: 24869 - RNA, 32 nt, Human
aagaggcccggcggaggcggcggugcagcgcu

SEQ ID NO: 24870 - RNA, 32 nt, Human
aagaggcccugaucccagcucauucaggggag

SEQ ID NO: 24871 - RNA, 32 nt, Human
aagaggcccuggaggaggguggggcuggccgg

SEQ ID NO: 24872 - RNA, 32 nt, Human
aagaggcccugggccgaggugcagugacccug

SEQ ID NO: 24873 - RNA, 32 nt, Human
aagaggcccugguuuggggcugugccagcuca

SEQ ID NO: 24874 - RNA, 32 nt, Human
aagaggccgccgcugccaccuccugggcagcu

SEQ ID NO: 24875 - RNA, 32 nt, Human
aagaggccgccugcacacagagcccaguuaau

SEQ ID NO: 24876 - RNA, 32 nt, Human
aagaggccugggauauuaggacuuugggguuu

SEQ ID NO: 24877 - RNA, 32 nt, Human
aagaggcgcuucuccccuccccuacaccuaaa

SEQ ID NO: 24878 - RNA, 32 nt, Human
aagaggcucacugcccuaucuccuucuuuccu

SEQ ID NO: 24879 - RNA, 32 nt, Human
aagaggcuccaaaaggaagaaaaagaaaaccc

SEQ ID NO: 24880 - RNA, 32 nt, Human
aagaggcucccgcgucccaaccccucgcgccc

SEQ ID NO: 24881 - RNA, 32 nt, Human
aagaggcucggcaccuucuuggaagaaaucau

SEQ ID NO: 24882 - RNA, 32 nt, Human
aagaggcucucaucuuuuccagguagaaggug

SEQ ID NO: 24883 - RNA, 32 nt, Human
aagaggcucucuuguucuccaucaggagagcc

SEQ ID NO: 24884 - RNA, 32 nt, Human
aagaggcugagaugagcagugaacuaagaggc

SEQ ID NO: 24885 - RNA, 32 nt, Human
aagaggcugcaauauuccauccugggugucug

SEQ ID NO: 24886 - RNA, 32 nt, Human
aagaggcugcaauauuccguccugggugucug

SEQ ID NO: 24887 - RNA, 32 nt, Human
aagaggcugguaggcaggugcauuaucaacag

SEQ ID NO: 24888 - RNA, 32 nt, Human
aagaggcuguguccucaguuacccuggaagga

SEQ ID NO: 24889 - RNA, 32 nt, Human
aagaggcuuccagagaaaacggcacaccaauc

SEQ ID NO: 24890 - RNA, 32 nt, Human
aagaggcuuggaccugggcagcuccugccccu

SEQ ID NO: 24891 - RNA, 32 nt, Human
aagaggcuuucucucugaccucauuccaagau

SEQ ID NO: 24892 - RNA, 32 nt, Human
aagagggaagaguggacggugccugggaaugg

SEQ ID NO: 24893 - RNA, 32 nt, Human
aagagggaagucagagguggcgguuaguuggg

SEQ ID NO: 24894 - RNA, 32 nt, Human
aagagggacagagagguuuagaaccuugaccu

SEQ ID NO: 24895 - RNA, 32 nt, Human
aagagggacuccugggcucaucugcccuccau

SEQ ID NO: 24896 - RNA, 32 nt, Human
aagagggacuccuugccucucccuauggccug

SEQ ID NO: 24897 - RNA, 32 nt, Human
aagagggagagaagaaagaagaaaaggagaag

SEQ ID NO: 24898 - RNA, 32 nt, Human
aagagggagagagaagcaggagagggggagga

SEQ ID NO: 24899 - RNA, 32 nt, Human
aagagggagaggggaaggagcugguagugaca

SEQ ID NO: 24900 - RNA, 32 nt, Human
aagagggagaggggagacuguagccuggaagg

SEQ ID NO: 24901 - RNA, 32 nt, Human
aagagggagagugagaggaccaaguccaagug

SEQ ID NO: 24902 - RNA, 32 nt, Human
aagagggagccgguuugggagagaccauugca

SEQ ID NO: 24903 - RNA, 32 nt, Human
aagagggaggcagagauuggagaaucacagcc

SEQ ID NO: 24904 - RNA, 32 nt, Human
aagagggaggcaggaggguuagagugaguagu

SEQ ID NO: 24905 - RNA, 32 nt, Human
aagagggagggaagaaaggaagaaaagaagga

SEQ ID NO: 24906 - RNA, 32 nt, Human
aagagggagggaaggaaggagagcaaaaucuu

SEQ ID NO: 24907 - RNA, 32 nt, Human
aagagggagggagggaggagugcugaagauug

SEQ ID NO: 24908 - RNA, 32 nt, Human
aagagggaggggacagaggcccugccacgucc

SEQ ID NO: 24909 - RNA, 32 nt, Human
aagagggagucacuugaugcuuucagguuaau

SEQ ID NO: 24910 - RNA, 32 nt, Human
aagagggagucuggcaccagccgcagccgggg

SEQ ID NO: 24911 - RNA, 32 nt, Human
aagagggauuggggcaggggaggcagaagggg

SEQ ID NO: 24912 - RNA, 32 nt, Human
aagagggcagaggaacaguuuuuccucucuga

SEQ ID NO: 24913 - RNA, 32 nt, Human
aagagggcagcagcccagcuguuuagguugcu

SEQ ID NO: 24914 - RNA, 32 nt, Human
aagagggcagcucugccuucccauguggucac

SEQ ID NO: 24915 - RNA, 32 nt, Human
aagagggcagggaguuugggcuugguuuugaa

SEQ ID NO: 24916 - RNA, 32 nt, Human
aagagggcauuuucaauucuguaggcucagca

SEQ ID NO: 24917 - RNA, 32 nt, Human
aagagggccacugaggaaggaggaauucaaag

SEQ ID NO: 24918 - RNA, 32 nt, Human
aagagggcccugagcuggcuccagaagcagag

SEQ ID NO: 24919 - RNA, 32 nt, Human
aagagggccgaaacucuucaccuugauguaug

SEQ ID NO: 24920 - RNA, 32 nt, Human
aagagggcgccagugaggaggaagggaaggcg

SEQ ID NO: 24921 - RNA, 32 nt, Human
aagaggggacaggugucagagcagggagaaau

SEQ ID NO: 24922 - RNA, 32 nt, Human
aagaggggaccgagcgcccaccccaggacucc

SEQ ID NO: 24923 - RNA, 32 nt, Human
aagaggggagagagcagagggagggggaggaa

SEQ ID NO: 24924 - RNA, 32 nt, Human
aagaggggagcacgugcccccugcauccauuc

SEQ ID NO: 24925 - RNA, 32 nt, Human
aagaggggaugagacauucaguugagggcauu

SEQ ID NO: 24926 - RNA, 32 nt, Human
aagaggggcucugccauuaguuggacccuggg

SEQ ID NO: 24927 - RNA, 32 nt, Human
aagaggggcugcugccaucugccccagacugu

SEQ ID NO: 24928 - RNA, 19 nt, Human
aagaggggcuggaccuggc

SEQ ID NO: 24929 - RNA, 32 nt, Human
aagaggggcuuccuugggaccaguguaaggaa

SEQ ID NO: 24930 - RNA, 32 nt, Human
aagagggggaggaggaagaggggaaggaggag

SEQ ID NO: 24931 - RNA, 32 nt, Human
aagagggggcauucacuccucuuuuucuuauu

SEQ ID NO: 24932 - RNA, 32 nt, Human
aagaggggguuagagagaaggcagguugagac

SEQ ID NO: 24933 - RNA, 32 nt, Human
aagagggucaacacccuuggcccccagccaag

SEQ ID NO: 24934 - RNA, 32 nt, Human
aagagggucaccaggcugagccucggccagaa

SEQ ID NO: 24935 - RNA, 32 nt, Human
aagaggguccaggaccucacuggacugugccc

SEQ ID NO: 24936 - RNA, 32 nt, Human
aagagggugagcccugaguggagccaggugag

SEQ ID NO: 24937 - RNA, 31 nt, Human
aagagguauaauggauauggcauucauuaaa

SEQ ID NO: 24938 - RNA, 32 nt, Human
aagagguaugccaguagcacacugguggcuuc

SEQ ID NO: 24939 - RNA, 32 nt, Human
aagaggucaaagcuacgugaggagccggggaa

SEQ ID NO: 24940 - RNA, 32 nt, Human
aagaggucacgggggcuaauugcuggcuggcu

SEQ ID NO: 24941 - RNA, 31 nt, Human
aagaggucacucaguugugcuguggagaaug

SEQ ID NO: 24942 - RNA, 32 nt, Human
aagaggucagggaacuccuuacccuagccagg

SEQ ID NO: 24943 - RNA, 32 nt, Human
aagaggucaguaaacuguucuaggggucuuca

SEQ ID NO: 24944 - RNA, 32 nt, Human
aagaggucauaaacuugggccugggugguugc

SEQ ID NO: 24945 - RNA, 32 nt, Human
aagagguccacaaccaggugugcacuguucac

SEQ ID NO: 24946 - RNA, 32 nt, Human
aagagguccagccguggagaaacauccgggac

SEQ ID NO: 24947 - RNA, 32 nt, Human
aagaggucccauauuccugagugcagggguag

SEQ ID NO: 24948 - RNA, 32 nt, Human
aagaggucgauggauuuaccccuggacccaua

SEQ ID NO: 24949 - RNA, 32 nt, Human
aagaggucgugggucuucugagcccagcugau

SEQ ID NO: 24950 - RNA, 32 nt, Human
aagaggucuagucccauauguggaagucuuuu

SEQ ID NO: 24951 - RNA, 32 nt, Human
aagaggucucagaccuugcacaaugccagaag

SEQ ID NO: 24952 - RNA, 32 nt, Human
aagaggucuucugccuuuccuuuccccgugag

SEQ ID NO: 24953 - RNA, 32 nt, Human
aagaggugcagccucuggaaguggaucaaacu

SEQ ID NO: 24954 - RNA, 32 nt, Human
aagaggugcuacugacuuucucagccucugaa

SEQ ID NO: 24955 - RNA, 32 nt, Human
aagaggugcuggagaggaaagcagggagccac

SEQ ID NO: 24956 - RNA, 32 nt, Human
aagagguggaggaggaggaggaagagguggag

SEQ ID NO: 24957 - RNA, 32 nt, Human
aagagguggaggaggaggaggaggagguggug

SEQ ID NO: 24958 - RNA, 32 nt, Human
aagagguggcugagcacuggggugggcuuggc

SEQ ID NO: 24959 - RNA, 32 nt, Human
aagagguggugguauugggggaaagugacuuc

SEQ ID NO: 24960 - RNA, 32 nt, Human
aagagguguaggucggcuugguuuucugcuac

SEQ ID NO: 24961 - RNA, 32 nt, Human
aagagguuccauccugguucucaguccacaug

SEQ ID NO: 24962 - RNA, 32 nt, Human
aagagguugcagugagcugagaucccaccacu

SEQ ID NO: 24963 - RNA, 32 nt, Human
aagagguuggugagcgucugcagccgcggcgu

SEQ ID NO: 24964 - RNA, 32 nt, Human
aagagguuucaguuggcugauagaauaucuuu

SEQ ID NO: 24965 - RNA, 24 nt, Human
aagagguuucuuucugcaccagga

SEQ ID NO: 24966 - RNA, 32 nt, Human
aagaguaaaccaggauaaaucaugaggaaccu

SEQ ID NO: 24967 - RNA, 32 nt, Human
aagaguaaauucucucccucccuacugaggcc

SEQ ID NO: 24968 - RNA, 32 nt, Human
aagaguaauagggaugagauauuaaauggccu

SEQ ID NO: 24969 - RNA, 32 nt, Human
aagaguacaaaaccagcugaaaagcaugcgcc

SEQ ID NO: 24970 - RNA, 32 nt, Human
aagaguacacucagccacugucacaggcauau

SEQ ID NO: 24971 - RNA, 32 nt, Human
aagaguacagcagaaaaugucuacugaacgga

SEQ ID NO: 24972 - RNA, 32 nt, Human
aagaguagagucugucucugucacccaggcug

SEQ ID NO: 24973 - RNA, 32 nt, Human
aagaguagcuggagagugagcugugcgugugu

SEQ ID NO: 24974 - RNA, 32 nt, Human
aagaguaggggccugaauccugcuacaacuau

SEQ ID NO: 24975 - RNA, 32 nt, Human
aagaguaggggccuuaacgacacuagugcaaa

SEQ ID NO: 24976 - RNA, 32 nt, Human
aagaguaggugguuagggcugucaggagcacu

SEQ ID NO: 24977 - RNA, 32 nt, Human
aagaguagugaauacaacacacaaccaggcag

SEQ ID NO: 24978 - RNA, 32 nt, Human
aagaguauuucaaaugcaagaaaugagaaaua

SEQ ID NO: 24979 - RNA, 32 nt, Human
aagagucaaauaauuugcaaccagcuuaugag

SEQ ID NO: 24980 - RNA, 32 nt, Human
aagagucaacuguacuuugcuauauucaucca

SEQ ID NO: 24981 - RNA, 32 nt, Human
aagagucaccuugucuucucucgacuuguucc

SEQ ID NO: 24982 - RNA, 32 nt, Human
aagagucacuaacucucuuuucccaagccuuu

SEQ ID NO: 24983 - RNA, 32 nt, Human
aagagucacugcagagcccaccuggccugcaa

SEQ ID NO: 24984 - RNA, 32 nt, Human
aagagucacuugaacccaggaggcagagguug

SEQ ID NO: 24985 - RNA, 32 nt, Human
aagagucagaagugguaauacagggaauggca

SEQ ID NO: 24986 - RNA, 32 nt, Human
aagagucauccagcucuugcucagugaagagg

SEQ ID NO: 24987 - RNA, 32 nt, Human
aagaguccaagaagccagcaccaccccauccg

SEQ ID NO: 24988 - RNA, 32 nt, Human
aagaguccaaggaagggagggagcagccacuc

SEQ ID NO: 24989 - RNA, 32 nt, Human
aagaguccaguggagccucaguguuuugaaua

SEQ ID NO: 24990 - RNA, 32 nt, Human
aagaguccuggaccaggagugcggagaacugg

SEQ ID NO: 24991 - RNA, 32 nt, Human
aagagucggagaccagccugggcaacacaggg

SEQ ID NO: 24992 - RNA, 32 nt, Human
aagagucggauuaccaaaacacugccugcucu

SEQ ID NO: 24993 - RNA, 32 nt, Human
aagagucguauguaacugucccagacuccucu

SEQ ID NO: 24994 - RNA, 32 nt, Human
aagagucuaugugagaaaaagcauugagcagc

SEQ ID NO: 24995 - RNA, 32 nt, Human
aagagucugagaccagccuggcuaacauggug

SEQ ID NO: 24996 - RNA, 32 nt, Human
aagagucugauuaauguucucucuccauguuu

SEQ ID NO: 24997 - RNA, 32 nt, Human
aagagucugcagcauuuguucuccuggcuccc

SEQ ID NO: 24998 - RNA, 32 nt, Human
aagagucugcaguucacugauguuucagauuu

SEQ ID NO: 24999 - RNA, 32 nt, Human
aagagucuggcucucccuucucugugacccgg

SEQ ID NO: 25000 - RNA, 32 nt, Human
aagagucugggucuccgggccaaccugagggc

SEQ ID NO: 25001 - RNA, 32 nt, Human
aagagucuucagagagaugaugggaggggcca

SEQ ID NO: 25002 - RNA, 32 nt, Human
aagagugacaaauggucagagcaaagcauuuc

SEQ ID NO: 25003 - RNA, 32 nt, Human
aagagugacuccgucggaggaaaaugacuccc

SEQ ID NO: 25004 - RNA, 32 nt, Human
aagagugacuccugaagcccugcgcuaacacu

SEQ ID NO: 25005 - RNA, 32 nt, Human
aagagugagggagggaaggaaggaacuacaag

SEQ ID NO: 25006 - RNA, 32 nt, Human
aagagugagggcagaugucuccagccaggacu

SEQ ID NO: 25007 - RNA, 32 nt, Human
aagagugaggggcagagacuuccagucacuga

SEQ ID NO: 25008 - RNA, 32 nt, Human
aagagugauagggagagggagcgaggcuggug

SEQ ID NO: 25009 - RNA, 25 nt, Human
aagagugaucauugccacaccagga

SEQ ID NO: 25010 - RNA, 32 nt, Human
aagagugcaaaucugccagccuaggcaacaua

SEQ ID NO: 25011 - RNA, 32 nt, Human
aagagugcaacaaaugcuucuauuccauagcu

SEQ ID NO: 25012 - RNA, 32 nt, Human
aagagugcaaggcugcucaggucuccaagcgc

SEQ ID NO: 25013 - RNA, 32 nt, Human
aagagugcacacacacgcacacaagaggguaa

SEQ ID NO: 25014 - RNA, 32 nt, Human
aagagugcacuacuguacuccagccagggcaa

SEQ ID NO: 25015 - RNA, 32 nt, Human
aagagugcagccaccaccccugagccaccugu

SEQ ID NO: 25016 - RNA, 32 nt, Human
aagagugcagugguaugaucucagcucacugc

SEQ ID NO: 25017 - RNA, 32 nt, Human
aagagugccucugcuuucuccuccucuccucc

SEQ ID NO: 25018 - RNA, 32 nt, Human
aagagugcgauaugaggguacagugaguuugg

SEQ ID NO: 25019 - RNA, 32 nt, Human
aagaguggagugcggccagcaaguuugagacc

SEQ ID NO: 25020 - RNA, 22 nt, Human
aagaguggauuacaggcaugag

SEQ ID NO: 25021 - RNA, 32 nt, Human
aagaguggcguggaugacagagacgagaagaa

SEQ ID NO: 25022 - RNA, 32 nt, Human
aagagugggagggagggcuggggauggauggg

SEQ ID NO: 25023 - RNA, 32 nt, Human
aagagugggcuuuccagggucuuuacugggaa

SEQ ID NO: 25024 - RNA, 32 nt, Human
aagaguggugcuggccccgaaccuuuccuguu

SEQ ID NO: 25025 - RNA, 32 nt, Human
aagaguguaggcaggccaggugcaguggcuca

SEQ ID NO: 25026 - RNA, 32 nt, Human
aagagugucuaugacuuauuuccuucacuuaa

SEQ ID NO: 25027 - RNA, 32 nt, Human
aagagugugagaaacuggaugaagacagcugu

SEQ ID NO: 25028 - RNA, 32 nt, Human
aagagugugcucguuuuaaauucauguugauu

SEQ ID NO: 25029 - RNA, 32 nt, Human
aagagugugcugccccuccccaucuccaugcc

SEQ ID NO: 25030 - RNA, 32 nt, Human
aagagugugcugggaaaaaggaagcauuucuu

SEQ ID NO: 25031 - RNA, 32 nt, Human
aagagugugguguuuaauuuucacaaauuugu

SEQ ID NO: 25032 - RNA, 32 nt, Human
aagagugugucuugcaucaacagcugucuuau

SEQ ID NO: 25033 - RNA, 32 nt, Human
aagaguguucagccacagucccacaagccuca

SEQ ID NO: 25034 - RNA, 32 nt, Human
aagaguguucauuucacaccuuaucaggcaau

SEQ ID NO: 25035 - RNA, 32 nt, Human
aagaguguuccuuguuuugguuacacucgaaa

SEQ ID NO: 25036 - RNA, 32 nt, Human
aagaguuaaagaaaccgaacaauaaguggcaa

SEQ ID NO: 25037 - RNA, 32 nt, Human
aagaguuaaagaccagccuggucaauauagca

SEQ ID NO: 25038 - RNA, 32 nt, Human
aagaguuacugaucuaugaaauggcagagaau

SEQ ID NO: 25039 - RNA, 32 nt, Human
aagaguuagauucccccuuucuccuuauugcc

SEQ ID NO: 25040 - RNA, 32 nt, Human
aagaguuauuguacauuacugaccacgcucau

SEQ ID NO: 25041 - RNA, 32 nt, Human
aagaguucaagaccagccugaccaacaugaca

SEQ ID NO: 25042 - RNA, 32 nt, Human
aagaguucaagaccagccugacgaacauggug

SEQ ID NO: 25043 - RNA, 32 nt, Human
aagaguucaagaccagccuggccaacaugaug

SEQ ID NO: 25044 - RNA, 32 nt, Human
aagaguucaagaccagccuggccaacauggug

SEQ ID NO: 25045 - RNA, 32 nt, Human
aagaguucaagaccagccuggccaauacaaaa

SEQ ID NO: 25046 - RNA, 32 nt, Human
aagaguucaagaccagccuggccaauauggug

SEQ ID NO: 25047 - RNA, 32 nt, Human
aagaguucaagaccagccuggccaucauggug

SEQ ID NO: 25048 - RNA, 32 nt, Human
aagaguucaagaccagccugggaaacauagca

SEQ ID NO: 25049 - RNA, 32 nt, Human
aagaguucaagaccagccugggaaacauggca

SEQ ID NO: 25050 - RNA, 32 nt, Human
aagaguucaagaccagccugggcaacauagcg

SEQ ID NO: 25051 - RNA, 32 nt, Human
aagaguucaagaccagccugggcaacauggcg

SEQ ID NO: 25052 - RNA, 32 nt, Human
aagaguucaaugaggaaagagaggaaguggag

SEQ ID NO: 25053 - RNA, 32 nt, Human
aagaguucaugauucuuuagguaaugucaaaa

SEQ ID NO: 25054 - RNA, 32 nt, Human
aagaguuccaaagagccucuggcccaggcccc

SEQ ID NO: 25055 - RNA, 32 nt, Human
aagaguuccauggcucgggguggagcuagggu

SEQ ID NO: 25056 - RNA, 32 nt, Human
aagaguucgagaccagccuagcuaacauggca

SEQ ID NO: 25057 - RNA, 32 nt, Human
aagaguucgagaccagccugaccaacauggag

SEQ ID NO: 25058 - RNA, 32 nt, Human
aagaguucgagaccagccugaccaacauggug

SEQ ID NO: 25059 - RNA, 32 nt, Human
aagaguucgagaccagccugaccaacguggug

SEQ ID NO: 25060 - RNA, 32 nt, Human
aagaguucgagaccagccuggccaacauggug

SEQ ID NO: 25061 - RNA, 32 nt, Human
aagaguucgagaccagccugggcaacauggag

SEQ ID NO: 25062 - RNA, 32 nt, Human
aagaguucgagaccagccugggcaacauggug

SEQ ID NO: 25063 - RNA, 32 nt, Human
aagaguucgaggccagccuggccaacauggug

SEQ ID NO: 25064 - RNA, 32 nt, Human
aagaguucgugaccagccuggccaauauggug

SEQ ID NO: 25065 - RNA, 32 nt, Human
aagaguugaccaggaacccuaaagcauccaga

SEQ ID NO: 25066 - RNA, 32 nt, Human
aagaguugagacaaacguuuccuacauucuuu

SEQ ID NO: 25067 - RNA, 32 nt, Human
aagaguugcagcuucaacagggccacagggau

SEQ ID NO: 25068 - RNA, 32 nt, Human
aagaguugcucuggagagguagggccagagga

SEQ ID NO: 25069 - RNA, 32 nt, Human
aagaguugcugggaccuuuccuagagaaccgg

SEQ ID NO: 25070 - RNA, 32 nt, Human
aagaguuggagaccagccugggcaacauggug

SEQ ID NO: 25071 - RNA, 19 nt, Human
aagaguugggugucuccuu

SEQ ID NO: 25072 - RNA, 32 nt, Human
aagaguuuaagccagcaugauccagauggguu

SEQ ID NO: 25073 - RNA, 32 nt, Human
aagaguuucagaccagccugggcaacauagcc

SEQ ID NO: 25074 - RNA, 32 nt, Human
aagaguuucaggaaguggguugcuaggcaguu

SEQ ID NO: 25075 - RNA, 32 nt, Human
aagaguuucagggcacuggcgaaggugaaagg

SEQ ID NO: 25076 - RNA, 32 nt, Human
aagaguuuccauuguagaauguuuucacauac

SEQ ID NO: 25077 - RNA, 32 nt, Human
aagaguuugagaccagccugaccaacauggug

SEQ ID NO: 25078 - RNA, 32 nt, Human
aagaguuugagaccagccugagcaacauauca

SEQ ID NO: 25079 - RNA, 32 nt, Human
aagaguuugagaccagccuggacaacauaaug

SEQ ID NO: 25080 - RNA, 32 nt, Human
aagaguuugagaccagccuggccaacauggca

SEQ ID NO: 25081 - RNA, 32 nt, Human
aagaguuugagaccagccuggccaacauggug

SEQ ID NO: 25082 - RNA, 32 nt, Human
aagaguuugagaccagccugggcaacauggca

SEQ ID NO: 25083 - RNA, 32 nt, Human
aagaguuugaggccagccuggccaacauggca

SEQ ID NO: 25084 - RNA, 32 nt, Human
aagaguuugccgaccuaacucggguugaaacu

SEQ ID NO: 25085 - RNA, 32 nt, Human
aagaguuuugaggcugggcgcaauggcucacg

SEQ ID NO: 25086 - RNA, 32 nt, Human
aagauaaaaguuaaauagaaauaaaagcaguc

SEQ ID NO: 25087 - RNA, 32 nt, Human
aagauaaauacuuggcuaaucuuccauuuaca

SEQ ID NO: 25088 - RNA, 32 nt, Human
aagauaaauccuuaagaauucagucuaaauua

SEQ ID NO: 25089 - RNA, 32 nt, Human
aagauaaauugucaaguaaagcaccucaauuc

SEQ ID NO: 25090 - RNA, 32 nt, Human
aagauaacacauacuccagccaccucaccuga

SEQ ID NO: 25091 - RNA, 32 nt, Human
aagauaaccaacaggagaacaaacccagccau

SEQ ID NO: 25092 - RNA, 32 nt, Human
aagauaacccugagacaugguggaggagaagg

SEQ ID NO: 25093 - RNA, 32 nt, Human
aagauaaccuggguuucccucagaaucugccc

SEQ ID NO: 25094 - RNA, 32 nt, Human
aagauaacucacaguuuugcccucgagccaau

SEQ ID NO: 25095 - RNA, 32 nt, Human
aagauaacugccucuuguacuuggauguguag

SEQ ID NO: 25096 - RNA, 32 nt, Human
aagauaagaagcagagggguccuugguaaugu

SEQ ID NO: 25097 - RNA, 21 nt, Human
aagauaagacaguggcauaga

SEQ ID NO: 25098 - RNA, 32 nt, Human
aagauaagacuuguuucuuucugucucucucu

SEQ ID NO: 25099 - RNA, 32 nt, Human
aagauaaggaauaugcuuaucuuccaauuuga

SEQ ID NO: 25100 - RNA, 32 nt, Human
aagauaauccagacugauauucaucccaggaa

SEQ ID NO: 25101 - RNA, 32 nt, Human
aagauaaucccccaggagcuccuguugacauc

SEQ ID NO: 25102 - RNA, 32 nt, Human
aagauaaugugacagaaugaugucagguuagg

SEQ ID NO: 25103 - RNA, 32 nt, Human
aagauaauuguuuguaaucauagguguugaaa

SEQ ID NO: 25104 - RNA, 32 nt, Human
aagauacacaugcggccaacaagcauguuuua

SEQ ID NO: 25105 - RNA, 32 nt, Human
aagauacacuggguaaucacuaacccauuauu

SEQ ID NO: 25106 - RNA, 32 nt, Human
aagauacacuuuaagccagacaccuaauucuu

SEQ ID NO: 25107 - RNA, 32 nt, Human
aagauacagacuguuuguuuaccagacauucu

SEQ ID NO: 25108 - RNA, 32 nt, Human
aagauacauuucacucacccuccaccccugcu

SEQ ID NO: 25109 - RNA, 32 nt, Human
aagauaccuaaaagagauuucaagagauuuaa

SEQ ID NO: 25110 - RNA, 25 nt, Human
aagauaccucaaaaugcagaagcaa

SEQ ID NO: 25111 - RNA, 32 nt, Human
aagauaccuugaucuuggacuuccacccucca

SEQ ID NO: 25112 - RNA, 32 nt, Human
aagauaccuugaugaagaccuggacuauugaa

SEQ ID NO: 25113 - RNA, 32 nt, Human
aagauacgaugaucagggaauguaauaauccg

SEQ ID NO: 25114 - RNA, 32 nt, Human
aagauacgauuugaugaugacacuggcacauu

SEQ ID NO: 25115 - RNA, 32 nt, Human
aagauacggguggggagggaagauauccagaa

SEQ ID NO: 25116 - RNA, 32 nt, Human
aagauacgucugaguugaugggaccaacaggg

SEQ ID NO: 25117 - RNA, 32 nt, Human
aagauacuaucuuuaccguaguaguucaggcc

SEQ ID NO: 25118 - RNA, 32 nt, Human
aagauacucaccaggaccaggaaggggacucu

SEQ ID NO: 25119 - RNA, 32 nt, Human
aagauacucacuaggaccaggaaggggacucu

SEQ ID NO: 25120 - RNA, 32 nt, Human
aagauacugagccucucaccucccagcccuca

SEQ ID NO: 25121 - RNA, 32 nt, Human
aagauacuuccucuucagcuggaagaaggcag

SEQ ID NO: 25122 - RNA, 32 nt, Human
aagauacuugcagcaagugauaaaggauuagu

SEQ ID NO: 25123 - RNA, 32 nt, Human
aagauagaagcauaaauuacaauguggaaugc

SEQ ID NO: 25124 - RNA, 32 nt, Human
aagauagacagaaaaaugucaucauauugaaa

SEQ ID NO: 25125 - RNA, 32 nt, Human
aagauagagaaagagagcagcauguaguagaa

SEQ ID NO: 25126 - RNA, 32 nt, Human
aagauagagcaggagucaggagaccugggucc

SEQ ID NO: 25127 - RNA, 32 nt, Human
aagauagcaccacugcacuccagccugggaga

SEQ ID NO: 25128 - RNA, 32 nt, Human
aagauagcaccacugcacuccaggcuggguga

SEQ ID NO: 25129 - RNA, 32 nt, Human
aagauagcaccacugcacuuuagccugggcga

SEQ ID NO: 25130 - RNA, 32 nt, Human
aagauagcugagaagcaccuuucaaauggcac

SEQ ID NO: 25131 - RNA, 32 nt, Human
aagauaggaagggagcacuuucuaggcuagga

SEQ ID NO: 25132 - RNA, 32 nt, Human
aagauaggcaauaguguauaaauaucauguaa

SEQ ID NO: 25133 - RNA, 32 nt, Human
aagauaggcagaaaagaagcuuuugccaguug

SEQ ID NO: 25134 - RNA, 32 nt, Human
aagauaggcucgugccuacaaucccagcacuu

SEQ ID NO: 25135 - RNA, 32 nt, Human
aagauagggaaaggaaaggagggagaaucuga

SEQ ID NO: 25136 - RNA, 32 nt, Human
aagauagggcaguuaacuaaagagcacuuuau

SEQ ID NO: 25137 - RNA, 32 nt, Human
aagauagguguuacagaacauggagggaacca

SEQ ID NO: 25138 - RNA, 32 nt, Human
aagauagguguuaguguggucuguucuuuacc

SEQ ID NO: 25139 - RNA, 32 nt, Human
aagauagugccacugcacuccagccugggcaa

SEQ ID NO: 25140 - RNA, 32 nt, Human
aagauagugccacugcacuucagccuggguga

SEQ ID NO: 25141 - RNA, 32 nt, Human
aagauagugccaucgcacuccagccuggacaa

SEQ ID NO: 25142 - RNA, 32 nt, Human
aagauauaaaggugucagcuaguuuuaagugu

SEQ ID NO: 25143 - RNA, 32 nt, Human
aagauauaacaaaacuggcacauguacccaug

SEQ ID NO: 25144 - RNA, 32 nt, Human
aagauauaauuucuugaaaaucuuaucagaag

SEQ ID NO: 25145 - RNA, 32 nt, Human
aagauauacugcccccaugcaggcaggaugug

SEQ ID NO: 25146 - RNA, 32 nt, Human
aagauauagagaggagaggagugaagaaaagg

SEQ ID NO: 25147 - RNA, 32 nt, Human
aagauauauguguauacauacauguaucuggu

SEQ ID NO: 25148 - RNA, 32 nt, Human
aagauauauuuauaguucacuuuuggguuuuu

SEQ ID NO: 25149 - RNA, 21 nt, Human
aagauauccaaaacaaauuaa

SEQ ID NO: 25150 - RNA, 32 nt, Human
aagauauccaucuuuuucuuuuuaacccuaau

SEQ ID NO: 25151 - RNA, 32 nt, Human
aagauaugaaaagaguguggaucuucuggaga

SEQ ID NO: 25152 - RNA, 32 nt, Human
aagauaugcaagugucaaauaugcaaaagaaa

SEQ ID NO: 25153 - RNA, 32 nt, Human
aagauaugucaucugcugguuguguuaucacu

SEQ ID NO: 25154 - RNA, 32 nt, Human
aagauauuagauaaguggguaauucagagagu

SEQ ID NO: 25155 - RNA, 32 nt, Human
aagauauuucagcugagucagaacagccuugc

SEQ ID NO: 25156 - RNA, 32 nt, Human
aagaucaaaagcuuccucuuccucaggacagc

SEQ ID NO: 25157 - RNA, 32 nt, Human
aagaucaacagcaaucugaagacucugacuaa

SEQ ID NO: 25158 - RNA, 32 nt, Human
aagaucaagauaagcuggaugaaguagugugc

SEQ ID NO: 25159 - RNA, 32 nt, Human
aagaucaagccauuguacuccagccuggacaa

SEQ ID NO: 25160 - RNA, 32 nt, Human
aagaucacaccacuacacuccagccugggcga

SEQ ID NO: 25161 - RNA, 32 nt, Human
aagaucacaccacuccacuccagucuggacaa

SEQ ID NO: 25162 - RNA, 32 nt, Human
aagaucacaccacugaccucuagccugguggc

SEQ ID NO: 25163 - RNA, 32 nt, Human
aagaucacaccacugcacuccaaccuggacaa

SEQ ID NO: 25164 - RNA, 32 nt, Human
aaggaagcucugaggaugguugcagugaggaa

SEQ ID NO: 25165 - RNA, 32 nt, Human
aaggaagcuucaaaacauugauaauucaagau

SEQ ID NO: 25166 - RNA, 32 nt, Human
aaggaaggaaacgggacccaggggaagaaagc

SEQ ID NO: 25167 - RNA, 32 nt, Human
aaggaaggaaagaagagaggaaagaaaggagg

SEQ ID NO: 25168 - RNA, 32 nt, Human
aaggaaggaagucaaggcugcagugagcuaug

SEQ ID NO: 25169 - RNA, 32 nt, Human
aaggaaggaggaaaggagaggggccuccauac

SEQ ID NO: 25170 - RNA, 32 nt, Human
aaggaaggauucaccaccuccaggaaaagugu

SEQ ID NO: 25171 - RNA, 32 nt, Human
aaggaaggcauuuggaccccugccuuuucauu

SEQ ID NO: 25172 - RNA, 32 nt, Human
aaggaaggcugugccaucuuugggcacugcca

SEQ ID NO: 25173 - RNA, 32 nt, Human
aaggaaggcuuccuggacaagguaguucccca

SEQ ID NO: 25174 - RNA, 32 nt, Human
aaggaagggaaaacugauggccaaccuagagc

SEQ ID NO: 25175 - RNA, 32 nt, Human
aaggaagggaaaggguguuacaaggaaaggcu

SEQ ID NO: 25176 - RNA, 32 nt, Human
aaggaagggaacuggagcuggcccagggcugu

SEQ ID NO: 25177 - RNA, 32 nt, Human
aaggaagggaagcaucugcccaacccuccccc

SEQ ID NO: 25178 - RNA, 32 nt, Human
aaggaagggaagggagggaggucuguucuauc

SEQ ID NO: 25179 - RNA, 32 nt, Human
aaggaagggauggaaggcucuaccccuccgug

SEQ ID NO: 25180 - RNA, 32 nt, Human
aaggaagggauuaaagagggugggaaaucuau

SEQ ID NO: 25181 - RNA, 32 nt, Human
aaggaagggcuggauugggccccuuuggugua

SEQ ID NO: 25182 - RNA, 32 nt, Human
aaggaagggcuggguuuucagcuucugggacc

SEQ ID NO: 25183 - RNA, 32 nt, Human
aaggaagggcugugcauugaggguuccaugcu

SEQ ID NO: 25184 - RNA, 32 nt, Human
aaggaagggcuuggcuugccagaggaauuuuc

SEQ ID NO: 25185 - RNA, 32 nt, Human
aaggaaggggcuuugagaggcaaagaugaugg

SEQ ID NO: 25186 - RNA, 32 nt, Human
aaggaagguacaggcaggaugauccagggauu

SEQ ID NO: 25187 - RNA, 32 nt, Human
aaggaagguagaaaaugcuggugggucuccgu

SEQ ID NO: 25188 - RNA, 32 nt, Human
aaggaagguagcagauauaggugcagggugcc

SEQ ID NO: 25189 - RNA, 17 nt, Human
aaggaaguacccugggg

SEQ ID NO: 25190 - RNA, 32 nt, Human
aaggaagucacuucuacucagacuugaccugc

SEQ ID NO: 25191 - RNA, 32 nt, Human
aaggaagucuaggagcugggaggaaaagaaaa

SEQ ID NO: 25192 - RNA, 32 nt, Human
aaggaagucuguuucagaacuuuagggccuuu

SEQ ID NO: 25193 - RNA, 18 nt, Human
aaggaagugaaauucuga

SEQ ID NO: 25194 - RNA, 32 nt, Human
aaggaagugacugcagaaagcucacagcgacc

SEQ ID NO: 25195 - RNA, 32 nt, Human
aaggaaguggguggcaggugugaggggaugcu

SEQ ID NO: 25196 - RNA, 32 nt, Human
aaggaaguguuuguaaucccagcacuuuggga

SEQ ID NO: 25197 - RNA, 31 nt, Human
aaggaauacagcuagcaagaaagcaauuuau

SEQ ID NO: 25198 - RNA, 32 nt, Human
aaggaauaguuugaagcuaauaccaucaggcu

SEQ ID NO: 25199 - RNA, 32 nt, Human
aaggaauaucucuucucagaaggaaagaauaa

SEQ ID NO: 25200 - RNA, 32 nt, Human
aaggaauaugaacaagaugccugcuggugaac

SEQ ID NO: 25201 - RNA, 31 nt, Human
aaggaauauggcuagaauaacauugccaaac

SEQ ID NO: 25202 - RNA, 32 nt, Human
aaggaaucccagccuggauccaacacagccau

SEQ ID NO: 25203 - RNA, 32 nt, Human
aaggaauccgugacccacagagcuagacagau

SEQ ID NO: 25204 - RNA, 32 nt, Human
aaggaaucucacugauaaaacucucaaugagg

SEQ ID NO: 25205 - RNA, 32 nt, Human
aaggaaucugaaggcacuggaaucacuccaca

SEQ ID NO: 25206 - RNA, 32 nt, Human
aaggaaugaacuauugauacagcaaccugaau

SEQ ID NO: 25207 - RNA, 21 nt, Human
aaggaaugaccucugggcuga

SEQ ID NO: 25208 - RNA, 32 nt, Human
aaggaaugagccaugcugcacuguucaagaag

SEQ ID NO: 25209 - RNA, 32 nt, Human
aaggaaugagccugaaguucauaaagaauaca

SEQ ID NO: 25210 - RNA, 32 nt, Human
aaggaaugaucaugaaugcaaagggaaagagg

SEQ ID NO: 25211 - RNA, 18 nt, Human
aaggaaugcagccuugcu

SEQ ID NO: 25212 - RNA, 30 nt, Human
aaggaaugcccaggagagagcacaugguug

SEQ ID NO: 25213 - RNA, 32 nt, Human
aaggaauggagcaagacacagaugaauuagag

SEQ ID NO: 25214 - RNA, 32 nt, Human
aaggaauggaguuuuucagccuguggcccagc

SEQ ID NO: 25215 - RNA, 32 nt, Human
aaggaauggcuugccaagaaucaccaugaggu

SEQ ID NO: 25216 - RNA, 32 nt, Human
aaggaaugugaggaagaaagaaaggcagggca

SEQ ID NO: 25217 - RNA, 32 nt, Human
aaggaaugugcauaauggagagaagacauauu

SEQ ID NO: 25218 - RNA, 32 nt, Human
aaggaaugugccagaaugcugaaccuucuugu

SEQ ID NO: 25219 - RNA, 32 nt, Human
aaggaauguggacuuuauuggaagcauggaug

SEQ ID NO: 25220 - RNA, 25 nt, Human
aaggaaugugggagaugagucaagg

SEQ ID NO: 25221 - RNA, 32 nt, Human
aaggaauguggggaauuuaucuaacuuguuua

SEQ ID NO: 25222 - RNA, 32 nt, Human
aaggaauuaaggcucuuacaaaugggcuuaag

SEQ ID NO: 25223 - RNA, 32 nt, Human
aaggaauuaggaggugggcacuuuaagggaug

SEQ ID NO: 25224 - RNA, 32 nt, Human
aaggaauuaggguggucuacuugaggcagaug

SEQ ID NO: 25225 - RNA, 32 nt, Human
aaggaauucaaugucaauuccuuuacgagaaa

SEQ ID NO: 25226 - RNA, 32 nt, Human
aaggaauugcagcugcuuacauagccccacga

SEQ ID NO: 25227 - RNA, 32 nt, Human
aaggaauugucugacccuagaggcagaugcug

SEQ ID NO: 25228 - RNA, 24 nt, Human
aaggaauuuagagguagggaaaag

SEQ ID NO: 25229 - RNA, 32 nt, Human
aaggaauuuuuacaggaaccugguaucaaacc

SEQ ID NO: 25230 - RNA, 19 nt, Human
aaggacaaaaaugggcugg

SEQ ID NO: 25231 - RNA, 32 nt, Human
aaggacaaaccucccaccucacagacagccaa

SEQ ID NO: 25232 - RNA, 32 nt, Human
aaggacaaagacaaagcuaaacucccggaauc

SEQ ID NO: 25233 - RNA, 32 nt, Human
aaggacaaauugugcuauguccacacauuaga

SEQ ID NO: 25234 - RNA, 21 nt, Human
aaggacaacacacugggccga

SEQ ID NO: 25235 - RNA, 32 nt, Human
aaggacaacuaagauugcacuucguaguaaag

SEQ ID NO: 25236 - RNA, 32 nt, Human
aaggacaaggcuagaucaugaagaaccuugac

SEQ ID NO: 25237 - RNA, 32 nt, Human
aaggacaaggucuguaccuaacagcaguagga

SEQ ID NO: 25238 - RNA, 23 nt, Human
aaggacaaguaagagugaggcca

SEQ ID NO: 25239 - RNA, 32 nt, Human
aaggacaauaaauauucaaaaugcaucccuaa

SEQ ID NO: 25240 - RNA, 32 nt, Human
aaggacaauggcugggacuguuggacagcauc

SEQ ID NO: 25241 - RNA, 32 nt, Human
aaggacaaugggagccacugggcuuggcuuuc

SEQ ID NO: 25242 - RNA, 16 nt, Human
aaggacacaaacugga

SEQ ID NO: 25243 - RNA, 32 nt, Human
aaggacacaagaaucaaucagaccuucucccu

SEQ ID NO: 25244 - RNA, 32 nt, Human
aaggacacaagccugguguucuggagaccucg

SEQ ID NO: 25245 - RNA, 16 nt, Human
aaggacacacacagga

SEQ ID NO: 25246 - RNA, 32 nt, Human
aaggacacaccuaugacacagcaucagguggu

SEQ ID NO: 25247 - RNA, 32 nt, Human
aaggacacagaaggcagucuuaagaagaugaa

SEQ ID NO: 25248 - RNA, 22 nt, Human
aaggacacagacccaaaagcca

SEQ ID NO: 25249 - RNA, 21 nt, Human
aaggacacagcacugggcugg

SEQ ID NO: 25250 - RNA, 32 nt, Human
aaggacacaucucuccagcaaaggacaccucu

SEQ ID NO: 25251 - RNA, 21 nt, Human
aaggacacaucugacauccug

SEQ ID NO: 25252 - RNA, 32 nt, Human
aaggacacauucccagaugggauuacugaguc

SEQ ID NO: 25253 - RNA, 32 nt, Human
aaggacaccaaacuguucugcuuguuaccuuc

SEQ ID NO: 25254 - RNA, 17 nt, Human
aaggacaccauaccuca

SEQ ID NO: 25255 - RNA, 20 nt, Human
aaggacacccgaggccccug

SEQ ID NO: 25256 - RNA, 24 nt, Human
aaggacaccucacuuucuggcucu

SEQ ID NO: 25257 - RNA, 19 nt, Human
aaggacaccuccagccucc

SEQ ID NO: 25258 - RNA, 32 nt, Human
aaggacaccucucuccagcaaaggacaccugc

SEQ ID NO: 25259 - RNA, 32 nt, Human
aaggacaccucuuuccaaacaggccaucaaau

SEQ ID NO: 25260 - RNA, 32 nt, Human
aaggacacuggcagacuuccagaagggccccc

SEQ ID NO: 25261 - RNA, 32 nt, Human
aaggacacuguacacaacaucgcuaaugacgg

SEQ ID NO: 25262 - RNA, 32 nt, Human
aaggacacuguggggucuggguccccagaacu

SEQ ID NO: 25263 - RNA, 32 nt, Human
aaggacacuuccucuaggaugccauccugagc

SEQ ID NO: 25264 - RNA, 32 nt, Human
aaggacacuuugaagugggaagaugguucaug

SEQ ID NO: 25265 - RNA, 32 nt, Human
aaggacagaacauugccuuccucgugcagagc

SEQ ID NO: 25266 - RNA, 32 nt, Human
aaggacagacacagugccucaccuguaaucca

SEQ ID NO: 25267 - RNA, 32 nt, Human
aaggacagacuggccgggcaggcgugacucag

SEQ ID NO: 25268 - RNA, 18 nt, Human
aaggacagacuuggcaaa

SEQ ID NO: 25269 - RNA, 32 nt, Human
aaggacagagucucucucugucacccaggcug

SEQ ID NO: 25270 - RNA, 24 nt, Human
aaggacagcacaggaggagaaaag

SEQ ID NO: 25271 - RNA, 32 nt, Human
aaggacagcagguggaguaggcacagauggaa

SEQ ID NO: 25272 - RNA, 32 nt, Human
aaggacagcauggugaucaggcaauuucucug

SEQ ID NO: 25273 - RNA, 32 nt, Human
aaggacagccuggguaauauaggaagacccug

SEQ ID NO: 25274 - RNA, 24 nt, Human
aaggacagcggcggcagcagcuca

SEQ ID NO: 25275 - RNA, 32 nt, Human
aaggacaggagagacauggaguggcgcuggac

SEQ ID NO: 25276 - RNA, 32 nt, Human
aaggacaggagagaugucagguggggaugaag

SEQ ID NO: 25277 - RNA, 32 nt, Human
aaggacaggagccaccuuccucucucucaccu

SEQ ID NO: 25278 - RNA, 32 nt, Human
aaggacaggauuugguaagugauugacuucuu

SEQ ID NO: 25279 - RNA, 32 nt, Human
aaggacaggcagggagggaggccaggccucgc

SEQ ID NO: 25280 - RNA, 32 nt, Human
aaggacaggccugcccaugcaggagaccaucu

SEQ ID NO: 25281 - RNA, 32 nt, Human
aaggacagggcuagggcauuuggccaggaugg

SEQ ID NO: 25282 - RNA, 32 nt, Human
aaggacagucaaagaagcagcccaguggaacc

SEQ ID NO: 25283 - RNA, 32 nt, Human
aaggacagucuauucaagggcacacaaguuca

SEQ ID NO: 25284 - RNA, 32 nt, Human
aaggacagucuuuggccagagcagaaaucuua

SEQ ID NO: 25285 - RNA, 32 nt, Human
aaggacagugugcuugguuagaguaaaggacg

SEQ ID NO: 25286 - RNA, 32 nt, Human
aaggacauaagaggucaagcucagggaaggaa

SEQ ID NO: 25287 - RNA, 32 nt, Human
aaggacauagccaggccaggugcagugacuca

SEQ ID NO: 25288 - RNA, 32 nt, Human
aaggacaugagacuaagagaaaccuugcaaac

SEQ ID NO: 25289 - RNA, 32 nt, Human
aaggacaugcuuuccaagcucaugugguuguu

SEQ ID NO: 25290 - RNA, 32 nt, Human
aaggacauugaauauuaggaggaaaaagucau

SEQ ID NO: 25291 - RNA, 32 nt, Human
aaggaccaaagacaagugaauuuucugagggu

SEQ ID NO: 25292 - RNA, 32 nt, Human
aaggaccaccccgggcccucuaugccuggcca

SEQ ID NO: 25293 - RNA, 31 nt, Human
aaggaccacgggaggagguguaggagagaag

SEQ ID NO: 25294 - RNA, 32 nt, Human
aaggaccaggaccacuugcaugaugggugugg

SEQ ID NO: 25295 - RNA, 32 nt, Human
aaggacccaagugacucugauguuuacaaagc

SEQ ID NO: 25296 - RNA, 32 nt, Human
aaggacccacuguucuucaucagugacccagg

SEQ ID NO: 25297 - RNA, 32 nt, Human
aaggacccaggccacauugcuguggggaugua

SEQ ID NO: 25298 - RNA, 32 nt, Human
aaggacccaggcucugccaacauuguggacau

SEQ ID NO: 25299 - RNA, 32 nt, Human
aaggaccccaaagucaggauguuguuugaucu

SEQ ID NO: 25300 - RNA, 32 nt, Human
aaggaccccacugucuccuaaggccccggagg

SEQ ID NO: 25301 - RNA, 32 nt, Human
aaggaccccugccuccuugugccccugcuccc

SEQ ID NO: 25302 - RNA, 32 nt, Human
aaggacccuacaggauggggacaggaacaagg

SEQ ID NO: 25303 - RNA, 32 nt, Human
aaggacccugagaaggagguugcggcuaaaga

SEQ ID NO: 25304 - RNA, 32 nt, Human
aaggacccugauuccauuucaugagaaaugau

SEQ ID NO: 25305 - RNA, 32 nt, Human
aaggacccugcaccucggccucccaaaguguu

SEQ ID NO: 25306 - RNA, 32 nt, Human
aaggacccuuuuuccccucuaucugccugaaa

SEQ ID NO: 25307 - RNA, 32 nt, Human
aaggaccgagaggcgggaggagcagcggcuca

SEQ ID NO: 25308 - RNA, 32 nt, Human
aaggaccgcugccuggccugcauugaggaacc

SEQ ID NO: 25309 - RNA, 19 nt, Human
aaggaccggccugggcuga

SEQ ID NO: 25310 - RNA, 30 nt, Human
aaggaccggcucuccauggcuccugcgccu

SEQ ID NO: 25311 - RNA, 32 nt, Human
aaggaccguccaccccuccgcgcuggcggugu

SEQ ID NO: 25312 - RNA, 32 nt, Human
aaggaccguccggucaguaggcaccaauccca

SEQ ID NO: 25313 - RNA, 32 nt, Human
aaggaccucacugcccgccuuccccucccacc

SEQ ID NO: 25314 - RNA, 32 nt, Human
aaggaccucacugucuccagcuaugcccagug

SEQ ID NO: 25315 - RNA, 32 nt, Human
aaggaccucccccacccuucucacacucugcc

SEQ ID NO: 25316 - RNA, 32 nt, Human
aaggaccuccucucuggcaguaucauggccac

SEQ ID NO: 25317 - RNA, 32 nt, Human
aaggaccugccuccccggaagugccuuaaccu

SEQ ID NO: 25318 - RNA, 32 nt, Human
aaggaccuggauucaucaaagcuuaaaguaaa

SEQ ID NO: 25319 - RNA, 32 nt, Human
aaggaccuggggcuggugaggggcccggagga

SEQ ID NO: 25320 - RNA, 32 nt, Human
aaggaccuugccucucuggaaucugucaaccc

SEQ ID NO: 25321 - RNA, 32 nt, Human
aaggaccuuuggcaaaugaagguuuacauuuc

SEQ ID NO: 25322 - RNA, 32 nt, Human
aaggacgacacacaguauggaucacauauugu

SEQ ID NO: 25323 - RNA, 32 nt, Human
aaggacgagggcgagggcacggccggguccug

SEQ ID NO: 25324 - RNA, 32 nt, Human
aaggacgauaggaaggaggaaagaagaaagag

SEQ ID NO: 25325 - RNA, 17 nt, Human
aaggacgcauuucccca

SEQ ID NO: 25326 - RNA, 32 nt, Human
aaggacgccuucugcuuggcaguauuaacugg

SEQ ID NO: 25327 - RNA, 32 nt, Human
aaggacgccuugaauguaugugguguugcuag

SEQ ID NO: 25328 - RNA, 32 nt, Human
aaggacggacgggagcuccacugugaaucggc

SEQ ID NO: 25329 - RNA, 32 nt, Human
aaggacgggugaggcaggggacacauuaugaa

SEQ ID NO: 25330 - RNA, 32 nt, Human
aaggacgguuugguggccagagcgaggucuuc

SEQ ID NO: 25331 - RNA, 32 nt, Human
aaggacuagcccaaggccaacauuaacaagcc

SEQ ID NO: 25332 - RNA, 32 nt, Human
aaggacuaugcugcccuuuugacaucaaagac

SEQ ID NO: 25333 - RNA, 32 nt, Human
aaggacuauuaaguguauuaaaaugaaacagu

SEQ ID NO: 25334 - RNA, 32 nt, Human
aaggacucacagucugccagacacugcuaggu

SEQ ID NO: 25335 - RNA, 32 nt, Human
aaggacucacaugggagagaaacccuaugagu

SEQ ID NO: 25336 - RNA, 32 nt, Human
aaggacucagaacaaaccaaaaagcagcucca

SEQ ID NO: 25337 - RNA, 32 nt, Human
aaggacucagagagucagacagugccacuugg

SEQ ID NO: 25338 - RNA, 32 nt, Human
aaggacuccaccgcugcccuccuggaacugcu

SEQ ID NO: 25339 - RNA, 32 nt, Human
aaggacuccuaccugggugaugaggcccagag

SEQ ID NO: 25340 - RNA, 32 nt, Human
aaggacucgguggaaagagcagaacaccauag

SEQ ID NO: 25341 - RNA, 32 nt, Human
aaggacugaaucgccacuacagccugggugca

SEQ ID NO: 25342 - RNA, 32 nt, Human
aaggacugcccuuugcucuaucaccuuugcau

SEQ ID NO: 25343 - RNA, 32 nt, Human
aaggacugcgagcacagucagcacuuuggcag

SEQ ID NO: 25344 - RNA, 32 nt, Human
aaggacugcuaacaagaaagcuuccaucucaa

SEQ ID NO: 25345 - RNA, 24 nt, Human
aaggacugcuucugcccucugccu

SEQ ID NO: 25346 - RNA, 21 nt, Human
aaggacuggaaaaaugaacug

SEQ ID NO: 25347 - RNA, 32 nt, Human
aaggacuggaaauguguauuauggaagauucg

SEQ ID NO: 25348 - RNA, 32 nt, Human
aaggacuggaagguggcgguggugaaggugca

SEQ ID NO: 25349 - RNA, 32 nt, Human
aaggacuggacuuggcuuauuucuuccugucu

SEQ ID NO: 25350 - RNA, 32 nt, Human
aaggacuggagcuucaggguucucgggauucg

SEQ ID NO: 25351 - RNA, 32 nt, Human
aaggacugggagaggcagagcaagccucagag

SEQ ID NO: 25352 - RNA, 32 nt, Human
aaggacuggucuuccuggagccugugucagcu

SEQ ID NO: 25353 - RNA, 32 nt, Human
aaggacuuaagcccucaagcuaggcaagacac

SEQ ID NO: 25354 - RNA, 32 nt, Human
aaggacuuaagugagaaagaacaagagaagcu

SEQ ID NO: 25355 - RNA, 32 nt, Human
aaggacuucacuuaugcuucugagcauccuga

SEQ ID NO: 25356 - RNA, 32 nt, Human
aaggacuuccuagagaagguagucccugaagg

SEQ ID NO: 25357 - RNA, 32 nt, Human
aaggacuuccuguccagcuccaaccugcaaag

SEQ ID NO: 25358 - RNA, 32 nt, Human
aaggacuugaaccucaagcucucucuaaggag

SEQ ID NO: 25359 - RNA, 32 nt, Human
aaggacuugaagcccggcaucuuccgaccugc

SEQ ID NO: 25360 - RNA, 32 nt, Human
aaggacuugccaggcuggacaaugcccguuga

SEQ ID NO: 25361 - RNA, 32 nt, Human
aaggacuuggcuccaaaacaaaacaaaacaaa

SEQ ID NO: 25362 - RNA, 26 nt, Human
aaggacuugguacaggaagggagaag

SEQ ID NO: 25363 - RNA, 32 nt, Human
aaggacuuucaggcugagaggauagcacagga

SEQ ID NO: 25364 - RNA, 32 nt, Human
aaggacuuugcagccggcacagggucugcucu

SEQ ID NO: 25365 - RNA, 21 nt, Human
aaggagaaaaaaguggagcca

SEQ ID NO: 25366 - RNA, 32 nt, Human
aaggagaaaaugugauugcaugugguaguugu

SEQ ID NO: 25367 - RNA, 32 nt, Human
aaggagaaacagggcucagcuggcaucuguac

SEQ ID NO: 25368 - RNA, 32 nt, Human
aaggagaaaccuggcagauaccaccuuaacca

SEQ ID NO: 25369 - RNA, 32 nt, Human
aaggagaaacugaggauguucucugauggaca

SEQ ID NO: 25370 - RNA, 32 nt, Human
aaggagaaagagaaaugcaggagccgcggggc

SEQ ID NO: 25371 - RNA, 32 nt, Human
aaggagaaagagacauuacagagcagacagcu

SEQ ID NO: 25372 - RNA, 32 nt, Human
aaggagaaaggaaagaaaaaccuaguuucacu

SEQ ID NO: 25373 - RNA, 32 nt, Human
aaggagaaaggagccggaccaagaugggcaca

SEQ ID NO: 25374 - RNA, 31 nt, Human
aaggagaaauaggaguugcaggcagcagcag

SEQ ID NO: 25375 - RNA, 32 nt, Human
aaggagaaauaucaaccagacacugcauggca

SEQ ID NO: 25376 - RNA, 32 nt, Human
aaggagaagaaauauguaaaguauauuuaaac

SEQ ID NO: 25377 - RNA, 32 nt, Human
aaggagaagauggaggaggaggguggcagcag

SEQ ID NO: 25378 - RNA, 23 nt, Human
aaggagaagcacagcaauauaca

SEQ ID NO: 25379 - RNA, 32 nt, Human
aaggagaagcagcaggaaugaugcuuugauac

SEQ ID NO: 25380 - RNA, 32 nt, Human
aaggagaagggagggucuagaagaggcagccc

SEQ ID NO: 25381 - RNA, 32 nt, Human
aaggagaaggucaaggcugcagugagccauca

SEQ ID NO: 25382 - RNA, 32 nt, Human
aaggagaagugaggaagccaggagacugcagu

SEQ ID NO: 25383 - RNA, 32 nt, Human
aaggagaaugacagaugcaauucuuccugcca

SEQ ID NO: 25384 - RNA, 32 nt, Human
aaggagaauggcccaguccucucccaagucca

SEQ ID NO: 25385 - RNA, 32 nt, Human
aaggagacagaagaaggaagagagacgguaac

SEQ ID NO: 25386 - RNA, 32 nt, Human
aaggagacagaggcauggaccacuggcuuuug

SEQ ID NO: 25387 - RNA, 32 nt, Human
aaggagacccagacuucaccuguccuuuuuaa

SEQ ID NO: 25388 - RNA, 32 nt, Human
aaggagagaaagacuuagaacauacacagauc

SEQ ID NO: 25389 - RNA, 32 nt, Human
aaggagagaagggaagugaaaaguagaguaac

SEQ ID NO: 25390 - RNA, 32 nt, Human
aaggagagacaggcacaaaauggaagagauga

SEQ ID NO: 25391 - RNA, 32 nt, Human
aaggagagacuggccuagccucccagccuaca

SEQ ID NO: 25392 - RNA, 32 nt, Human
aaggagagagagggaucugauggcaaaguauu

SEQ ID NO: 25393 - RNA, 32 nt, Human
aaggagagaggaagaggagcagaagggggcag

SEQ ID NO: 25394 - RNA, 32 nt, Human
aaggagagaggaagcaagggaaggaggaagaa

SEQ ID NO: 25395 - RNA, 32 nt, Human
aaggagagagggaagaaaagaucuuuugcccu

SEQ ID NO: 25396 - RNA, 32 nt, Human
aaggagagagggagggcggagggcggaggggc

SEQ ID NO: 25397 - RNA, 32 nt, Human
aaggagagagugaauggauacagagcugaaug

SEQ ID NO: 25398 - RNA, 32 nt, Human
aaggagagauagacgcgaaagugugcugcuau

SEQ ID NO: 25399 - RNA, 32 nt, Human
aaggagaggaaccauuugugcagaucaucuag

SEQ ID NO: 25400 - RNA, 32 nt, Human
aaggagaggagaagaaggaagaaggagaagga

SEQ ID NO: 25401 - RNA, 32 nt, Human
aaggagaggauucagguaaagaccuggaugug

SEQ ID NO: 25402 - RNA, 32 nt, Human
aaggagaggccccagaaccccaaagcagacag

SEQ ID NO: 25403 - RNA, 32 nt, Human
aaggagagggaaugugcaggaacagaggcguc

SEQ ID NO: 25404 - RNA, 32 nt, Human
aaggagagggagagagagguaagggucugguc

SEQ ID NO: 25405 - RNA, 20 nt, Human
aaggagagggcuuuagggga

SEQ ID NO: 25406 - RNA, 32 nt, Human
aaggagagugugggcagcuggagccagguccu

SEQ ID NO: 25407 - RNA, 32 nt, Human
aaggagaguugcuuugagagcuuguuuuuaca

SEQ ID NO: 25408 - RNA, 32 nt, Human
aaggagauaaacauuugagucagugggcuggg

SEQ ID NO: 25409 - RNA, 32 nt, Human
aaggagauaacuuauuaucugucgaaggcuua

SEQ ID NO: 25410 - RNA, 32 nt, Human
aaggagauacuacaugggagggggacacagaa

SEQ ID NO: 25411 - RNA, 32 nt, Human
aaggagaucaaugguuuaacaguuauccaugc

SEQ ID NO: 25412 - RNA, 32 nt, Human
aaggagaucacacccuugccccgcugagcccc

SEQ ID NO: 25413 - RNA, 32 nt, Human
aaggagaucacaccucuguccagccugcaccg

SEQ ID NO: 25414 - RNA, 32 nt, Human
aaggagaucucccucugggcaucuggcuuugc

SEQ ID NO: 25415 - RNA, 32 nt, Human
aaggagaugccacccccuccugcauuguucuu

SEQ ID NO: 25416 - RNA, 32 nt, Human
aaggagaugcccuagugguggcccagcuggcu

SEQ ID NO: 25417 - RNA, 32 nt, Human
aaggagauggagaggaaggacuacagaggaca

SEQ ID NO: 25418 - RNA, 32 nt, Human
aaggagaugguugcagaagauccacuuacuac

SEQ ID NO: 25419 - RNA, 22 nt, Human
aaggagaugucucucccucucc

SEQ ID NO: 25420 - RNA, 31 nt, Human
aaggagcaaaguccuaucacagcgggagggg

SEQ ID NO: 25421 - RNA, 32 nt, Human
aaggagcaacaaggagagggucugcuugagaa

SEQ ID NO: 25422 - RNA, 21 nt, Human
aaggagcaagccaggaagcca

SEQ ID NO: 25423 - RNA, 32 nt, Human
aaggagcacgccugggcugggccccagggagg

SEQ ID NO: 25424 - RNA, 32 nt, Human
aaggagcagagaguuaugcuguuucucccauu

SEQ ID NO: 25425 - RNA, 22 nt, Human
aaggagcagcaucuugauucac

SEQ ID NO: 25426 - RNA, 32 nt, Human
aaggagcagcccuacucuucaaaaguggcugc

SEQ ID NO: 25427 - RNA, 32 nt, Human
aaggagcagcuggaggaggagcagggaggcaa

SEQ ID NO: 25428 - RNA, 32 nt, Human
aaggagcaggccgcgugucacacccaucauug

SEQ ID NO: 25429 - RNA, 32 nt, Human
aaggagcaggcuuggagccagggaccaguggg

SEQ ID NO: 25430 - RNA, 32 nt, Human
aaggagcagggaugagacuggcaauggucaca

SEQ ID NO: 25431 - RNA, 32 nt, Human
aaggagcagggugagggaggggccccaggaga

SEQ ID NO: 25432 - RNA, 32 nt, Human
aaggagcagguggggcuggaggcccugcaggg

SEQ ID NO: 25433 - RNA, 32 nt, Human
aaggagcagugcgcuaagcuguggaaaauucc

SEQ ID NO: 25434 - RNA, 32 nt, Human
aaggagcauaggacagggcaaggcgggauaag

SEQ ID NO: 25435 - RNA, 32 nt, Human
aaggagcauauauguguaugaauagaccacau

SEQ ID NO: 25436 - RNA, 32 nt, Human
aaggagcauggacuggggucaguggguccagg

SEQ ID NO: 25437 - RNA, 32 nt, Human
aaggagcauggucacaggaaggugggguuuca

SEQ ID NO: 25438 - RNA, 32 nt, Human
aaggagcauuuggaagucacuggguggguugu

SEQ ID NO: 25439 - RNA, 24 nt, Human
aaggagccaacuuggcuuuuaccu

SEQ ID NO: 25440 - RNA, 32 nt, Human
aaggagccaagcugaaaaucaugugaaagaau

SEQ ID NO: 25441 - RNA, 32 nt, Human
aaggagccaauuuaaagaaaacuguuaauagu

SEQ ID NO: 25442 - RNA, 32 nt, Human
aaggagccacuucagaaaugugucacagaaaa

SEQ ID NO: 25443 - RNA, 32 nt, Human
aaggagccagggaguacgcaccccagacccau

SEQ ID NO: 25444 - RNA, 32 nt, Human
aaggagccaguggucucagaccugccacccca

SEQ ID NO: 25445 - RNA, 32 nt, Human
aaggagccaucucauccacagcucuuccuuga

SEQ ID NO: 25446 - RNA, 32 nt, Human
aaggagccaucuccaucuugaaggaacucaaa

SEQ ID NO: 25447 - RNA, 22 nt, Human
aaggagcccaggcccccucccu

SEQ ID NO: 25448 - RNA, 32 nt, Human
aaggagccccacagcaccuggagcugcccacu

SEQ ID NO: 25449 - RNA, 32 nt, Human
aaggagccccucucugcuuccuguugggcacc

SEQ ID NO: 25450 - RNA, 32 nt, Human
aaggagcccggcggaggcagcgguggguuugg

SEQ ID NO: 25451 - RNA, 32 nt, Human
aaggagccgggaggggcgcugcggggaagcca

SEQ ID NO: 25452 - RNA, 32 nt, Human
aaggagccucaccugccucccuucucugagua

SEQ ID NO: 25453 - RNA, 23 nt, Human
aaggagccugggaccaggagcca

SEQ ID NO: 25454 - RNA, 32 nt, Human
aaggagccugggagcacgcagaggccuguguu

SEQ ID NO: 25455 - RNA, 23 nt, Human
aaggagccuguauccacccugcc

SEQ ID NO: 25456 - RNA, 32 nt, Human
aaggagccuuccuccucuccccagacuccaga

SEQ ID NO: 25457 - RNA, 32 nt, Human
aaggagcggaaagagaagagagaagagugagc

SEQ ID NO: 25458 - RNA, 18 nt, Human
aaggagcggagaggggag

SEQ ID NO: 25459 - RNA, 32 nt, Human
aaggagcggaggaucggguccacccaaaguga

SEQ ID NO: 25460 - RNA, 32 nt, Human
aaggagcggaggcaccagcguucuccaccugg

SEQ ID NO: 25461 - RNA, 32 nt, Human
aaggagcuaguuuuccugagccugugugugca

SEQ ID NO: 25462 - RNA, 24 nt, Human
aaggagcucaaccucccugugccu

SEQ ID NO: 25463 - RNA, 32 nt, Human
aaggagcucccaggaggggcuucugggaagac

SEQ ID NO: 25464 - RNA, 32 nt, Human
aaggagcucugguuccagagaauuugcacaaa

SEQ ID NO: 25465 - RNA, 32 nt, Human
aaggagcugaccaggaggugucaguucccuga

SEQ ID NO: 25466 - RNA, 32 nt, Human
aaggagcugaggaggagaagccaaagaggagg

SEQ ID NO: 25467 - RNA, 32 nt, Human
aaggagcugcagcgauacaucgaagggcucaa

SEQ ID NO: 25468 - RNA, 32 nt, Human
aaggagcuggacaagcauaauuguucucccua

SEQ ID NO: 25469 - RNA, 32 nt, Human
aaggagcuggacugcaggggaggccacgugca

SEQ ID NO: 25470 - RNA, 32 nt, Human
aaggagcugguacuguccacugugcugucggu

SEQ ID NO: 25471 - RNA, 32 nt, Human
aaggagcugguaucauuuauacuuuuuguuug

SEQ ID NO: 25472 - RNA, 32 nt, Human
aaggagcuggugacccucuacaggagaagugc

SEQ ID NO: 25473 - RNA, 32 nt, Human
aaggagcugguggaggugagggaggcgcugag

SEQ ID NO: 25474 - RNA, 32 nt, Human
aaggagcugucuggaagguuugaauaaauaaa

SEQ ID NO: 25475 - RNA, 32 nt, Human
aaggagcuuccaggcuggggaagaucaucauu

SEQ ID NO: 25476 - RNA, 32 nt, Human
aaggagcuuggauuuuaaggcagcagcuugcu

SEQ ID NO: 25477 - RNA, 32 nt, Human
aaggagcuuugucccaccaugcuuccauuccc

SEQ ID NO: 25478 - RNA, 32 nt, Human
aaggaggaagaagaggaggaggagaaagaagc

SEQ ID NO: 25479 - RNA, 32 nt, Human
aaggaggaagaggaggaggaggaagaggggag

SEQ ID NO: 25480 - RNA, 32 nt, Human
aaggaggaagcugaagcgggcagaucacuuga

SEQ ID NO: 25481 - RNA, 32 nt, Human
aaggaggaaggaagaagguaaaggguggaugg

SEQ ID NO: 25482 - RNA, 32 nt, Human
aaggaggaaggagggagagggaaguaggaaag

SEQ ID NO: 25483 - RNA, 32 nt, Human
aaggaggaagucaccagcucgaggcgugugga

SEQ ID NO: 25484 - RNA, 32 nt, Human
aaggaggaggaagaggggcagguguagggagu

SEQ ID NO: 25485 - RNA, 32 nt, Human
aaggaggaggaggaggaggaggaggagggggc

SEQ ID NO: 25486 - RNA, 32 nt, Human
aaggaggaggcggggcugcacugugagcccga

SEQ ID NO: 25487 - RNA, 32 nt, Human
aaggaggauaauuuuuauugcauuuuacugua

SEQ ID NO: 25488 - RNA, 32 nt, Human
aaggaggaugagaaaggaagagagggagggag

SEQ ID NO: 25489 - RNA, 32 nt, Human
aaggaggauggagaaggaggugacagaaucug

SEQ ID NO: 25490 - RNA, 32 nt, Human
aaggaggcaaagugaucugucugggaacaguu

SEQ ID NO: 25491 - RNA, 32 nt, Human
aaggaggcacaaggaagagaguaugggaagaa

SEQ ID NO: 25492 - RNA, 32 nt, Human
aaggaggcacugggcucagccugggcauuaaa

SEQ ID NO: 25493 - RNA, 17 nt, Human
aaggaggcagaagggga

SEQ ID NO: 25494 - RNA, 32 nt, Human
aaggaggcagggcaaggccgggcuugggggca

SEQ ID NO: 25495 - RNA, 32 nt, Human
aaggaggcagugaccuucaaggauguggcugu

SEQ ID NO: 25496 - RNA, 32 nt, Human
aaggaggccaagcagugccugccuaugaaauu

SEQ ID NO: 25497 - RNA, 32 nt, Human
aaggaggccaguuguaggaaugagcacuagaa

SEQ ID NO: 25498 - RNA, 32 nt, Human
aaggaggccaugaucccucccugagcuuuuuc

SEQ ID NO: 25499 - RNA, 32 nt, Human
aaggaggcccacuugugucuuaggcaggcaag

SEQ ID NO: 25500 - RNA, 32 nt, Human
aaggaggcccaggaguagaggcugcagcgccc

SEQ ID NO: 25501 - RNA, 32 nt, Human
aaggaggccuccacuccuuccaucucuuccuu

SEQ ID NO: 25502 - RNA, 32 nt, Human
aaggaggcggggccugcagcaggcuuggaggc

SEQ ID NO: 25503 - RNA, 32 nt, Human
aaggaggcuagcuucuagccuggguggccauu

SEQ ID NO: 25504 - RNA, 32 nt, Human
aaggaggcugucagaggccgucucagcuccca

SEQ ID NO: 25505 - RNA, 32 nt, Human
aaggagggaaggaaguagggaggcagggaaga

SEQ ID NO: 25506 - RNA, 32 nt, Human
aaggagggaaggagggagaggaaggcagggga

SEQ ID NO: 25507 - RNA, 32 nt, Human
aaggagggagaagggaaggaaggaaagaagag

SEQ ID NO: 25508 - RNA, 32 nt, Human
aaggagggagaagggaaggagugaaggaagga

SEQ ID NO: 25509 - RNA, 32 nt, Human
aaggagggagagagaggagagagaaggaaaua

SEQ ID NO: 25510 - RNA, 32 nt, Human
aaggagggagagagggaggaaggaagaaggug

SEQ ID NO: 25511 - RNA, 32 nt, Human
aaggagggaggaaauaugucccuugcacacca

SEQ ID NO: 25512 - RNA, 32 nt, Human
aaggagggaggaucacuugaacucaggaauuc

SEQ ID NO: 25513 - RNA, 32 nt, Human
aaggagggaguaucaguucugagccacagaug

SEQ ID NO: 25514 - RNA, 32 nt, Human
aaggagggaugccaccagaugacacugggauc

SEQ ID NO: 25515 - RNA, 32 nt, Human
aaggagggccugggccagcuuugaaaaggcag

SEQ ID NO: 25516 - RNA, 32 nt, Human
aaggagggccuuauaagucaagccauggaauu

SEQ ID NO: 25517 - RNA, 32 nt, Human
aaggagggcuacggaaacuaaaaguuucgggg

SEQ ID NO: 25518 - RNA, 32 nt, Human
aaggaggggagaaagcgggcucucacccccuc

SEQ ID NO: 25519 - RNA, 32 nt, Human
aaggaggggagaggaggggaaggggaggcaga

SEQ ID NO: 25520 - RNA, 32 nt, Human
aaggaggggauuagggguggggcaguuuuugu

SEQ ID NO: 25521 - RNA, 32 nt, Human
aaggaggggcagcagggugugugcauaugaga

SEQ ID NO: 25522 - RNA, 32 nt, Human
aaggaggggccgcggcuggcccaggagagaac

SEQ ID NO: 25523 - RNA, 32 nt, Human
aaggaggggucuaggagcucugucccuuguaa

SEQ ID NO: 25524 - RNA, 32 nt, Human
aaggagggguggaggaagaggaagggccaaac

SEQ ID NO: 25525 - RNA, 32 nt, Human
aaggagggguugcuucccucccuaccucaucc

SEQ ID NO: 25526 - RNA, 32 nt, Human
aaggagggucucuugcccaucucuccggccac

SEQ ID NO: 25527 - RNA, 23 nt, Human
aaggaggguggaucaccugaggu

SEQ ID NO: 25528 - RNA, 32 nt, Human
aaggaggucaagcaucuucggccgauauuuaa

SEQ ID NO: 25529 - RNA, 32 nt, Human
aaggaggucaccaagcagguugacccuccccu

SEQ ID NO: 25530 - RNA, 32 nt, Human
aaggagguccccaagaucuccaccccagucau

SEQ ID NO: 25531 - RNA, 32 nt, Human
aaggaggugaaaucccugccucaggccaaggg

SEQ ID NO: 25532 - RNA, 32 nt, Human
aaggaggugcagguaaagggugcagugcagcc

SEQ ID NO: 25533 - RNA, 32 nt, Human
aaggaggugccaagccuguuugucuucauugu

SEQ ID NO: 25534 - RNA, 32 nt, Human
aaggagguggagccaccggcccggccuggauu

SEQ ID NO: 25535 - RNA, 32 nt, Human
aaggaggugggacuagagucaaccuggaauag

SEQ ID NO: 25536 - RNA, 32 nt, Human
aaggaggugggccacacccaggaagggaaagc

SEQ ID NO: 25537 - RNA, 32 nt, Human
aaggagguggggauccgagugcagugagagcc

SEQ ID NO: 25538 - RNA, 32 nt, Human
aaggaggugguuggccagagauggggaacagc

SEQ ID NO: 25539 - RNA, 32 nt, Human
aaggaggugguuguggggaaccaccuggagag

SEQ ID NO: 25540 - RNA, 32 nt, Human
aaggagguuauucauaaauauuggacaguuua

SEQ ID NO: 25541 - RNA, 32 nt, Human
aaggagguugagcucuucacugugucuuucca

SEQ ID NO: 25542 - RNA, 32 nt, Human
aaggagguuguuaucuggccaucuucauuccc

SEQ ID NO: 25543 - RNA, 32 nt, Human
aaggaguacuccaagacagagacagaggcgcc

SEQ ID NO: 25544 - RNA, 32 nt, Human
aaggaguacugaugauggaagcaucugguccc

SEQ ID NO: 25545 - RNA, 32 nt, Human
aaggaguacugcagaggucacagggaagucac

SEQ ID NO: 25546 - RNA, 32 nt, Human
aaggaguaggcuuggggguggggagagagaaa

SEQ ID NO: 25547 - RNA, 32 nt, Human
aaggaguauguccugaggagggguugggaugg

SEQ ID NO: 25548 - RNA, 32 nt, Human
aaggagucaacuugcaggcuguuaaagaccuc

SEQ ID NO: 25549 - RNA, 32 nt, Human
aaggagucaagaacaauucacaguaugagaag

SEQ ID NO: 25550 - RNA, 32 nt, Human
aaggagucacgccucccgccucccggagcugc

SEQ ID NO: 25551 - RNA, 32 nt, Human
aaggaguccgggaggugccugugguuugcacc

SEQ ID NO: 25552 - RNA, 32 nt, Human
aaggagucgaggcuguaccucucuuugcaaga

SEQ ID NO: 25553 - RNA, 32 nt, Human
aaggagucucuugucuacaggcagcaucgggg

SEQ ID NO: 25554 - RNA, 22 nt, Human
aaggagucugcauagccaggaa

SEQ ID NO: 25555 - RNA, 22 nt, Human
aaggagugaaaccuuuagggca

SEQ ID NO: 25556 - RNA, 19 nt, Human
aaggagugaacaagagcca

SEQ ID NO: 25557 - RNA, 32 nt, Human
aaggagugaacaagagccaggagaccagggag

SEQ ID NO: 25558 - RNA, 19 nt, Human
aaggagugacaaggaagcu

SEQ ID NO: 25559 - RNA, 32 nt, Human
aaggagugagccaugugcaaaauucuguaagu

SEQ ID NO: 25560 - RNA, 18 nt, Human
aaggagugauggaagcca

SEQ ID NO: 25561 - RNA, 32 nt, Human
aaggagugcaccacugcacuccagccugggca

SEQ ID NO: 25562 - RNA, 32 nt, Human
aaggagugcaggacacuuucaugagugcagga

SEQ ID NO: 25563 - RNA, 32 nt, Human
aaggagugcauggccacagccaccuccacccc

SEQ ID NO: 25564 - RNA, 32 nt, Human
aaggagugccugaauagcuuggaaaaguaaca

SEQ ID NO: 25565 - RNA, 32 nt, Human
aaggagugcggcaccuucccgucugaugcugg

SEQ ID NO: 25566 - RNA, 20 nt, Human
aaggaguggaagaggagaca

SEQ ID NO: 25567 - RNA, 32 nt, Human
aaggaguguccuuuacccucccagccuccagg

SEQ ID NO: 25568 - RNA, 32 nt, Human
aaggagugucugcuugaaggccuggaccaccc

SEQ ID NO: 25569 - RNA, 32 nt, Human
aaggagugugcccagugcccuugggcaggacc

SEQ ID NO: 25570 - RNA, 32 nt, Human
aaggagugugccgccacacccagccugagcaa

SEQ ID NO: 25571 - RNA, 32 nt, Human
aaggagugugcugcgugcugcccacaccguga

SEQ ID NO: 25572 - RNA, 32 nt, Human
aaggaguucacucaaguucccaagguauucug

SEQ ID NO: 25573 - RNA, 32 nt, Human
aaggaguucuccacuaucuccugggccacgcc

SEQ ID NO: 25574 - RNA, 32 nt, Human
aaggaguuggaagugaagucuaugaugugaaa

SEQ ID NO: 25575 - RNA, 32 nt, Human
aaggaguuggaggaggaggaggaggaggcgag

SEQ ID NO: 25576 - RNA, 32 nt, Human
aaggaguuggggaaggaagagggcgagaucuu

SEQ ID NO: 25577 - RNA, 32 nt, Human
aaggaguuucaagagccuuucuugucaauaua

SEQ ID NO: 25578 - RNA, 32 nt, Human
aaggaguuucgcucuuguccaggcuggaguau

SEQ ID NO: 25579 - RNA, 32 nt, Human
aaggaguuucugauagucuccugcuguuuuac

SEQ ID NO: 25580 - RNA, 32 nt, Human
aaggaguuuucuuuuucucuuuaguacuuacg

SEQ ID NO: 25581 - RNA, 32 nt, Human
aaggauaagguggaggagacaagugaguuaga

SEQ ID NO: 25582 - RNA, 32 nt, Human
aaggauaaugauuucauaauuuucuauuugaa

SEQ ID NO: 25583 - RNA, 32 nt, Human
aaggauaauggaguuccucuccucugcuuucc

SEQ ID NO: 25584 - RNA, 32 nt, Human
aaggauaauuagcugaaagcuaugaugauaua

SEQ ID NO: 25585 - RNA, 21 nt, Human
aaggauacucgucaucggcca

SEQ ID NO: 25586 - RNA, 32 nt, Human
aaggauagcucuaaguguggguugcaguuacu

SEQ ID NO: 25587 - RNA, 32 nt, Human
aaggauaggaaagaggauaugauggguuugaa

SEQ ID NO: 25588 - RNA, 32 nt, Human
aaggauagugugaagaucuuuggcaugauuua

SEQ ID NO: 25589 - RNA, 32 nt, Human
aaggauauaaggauacagaaagcaauggaaga

SEQ ID NO: 25590 - RNA, 32 nt, Human
aaggauauguacugggaagaccacagagaaag

SEQ ID NO: 25591 - RNA, 32 nt, Human
aaggauauucacugcaacaaugucuuaaaugu

SEQ ID NO: 25592 - RNA, 32 nt, Human
aaggaucaccugagcccaggaggucaagacug

SEQ ID NO: 25593 - RNA, 32 nt, Human
aaggaucaccuugaggccaggaguuuaaggcc

SEQ ID NO: 25594 - RNA, 32 nt, Human
aaggaucacugcacccagcccaaggucuugcc

SEQ ID NO: 25595 - RNA, 32 nt, Human
aaggaucacuugaacccaggaguucaagaaua

SEQ ID NO: 25596 - RNA, 32 nt, Human
aaggaucagagggaacuuggguuguuuuggga

SEQ ID NO: 25597 - RNA, 32 nt, Human
aaggauccaguauugaggaaagaaaaacugca

SEQ ID NO: 25598 - RNA, 32 nt, Human
aaggauccuccaggagcucugcuuagccaauc

SEQ ID NO: 25599 - RNA, 32 nt, Human
aaggauccucuccacuccauguuugcaauaca

SEQ ID NO: 25600 - RNA, 32 nt, Human
aaggauccugcaggaaccaaaggcagguaggu

SEQ ID NO: 25601 - RNA, 32 nt, Human
aaggaucgcuugaaccugggaggcagagguug

SEQ ID NO: 25602 - RNA, 32 nt, Human
aaggaucgcuugagcccaggaguucaagaaca

SEQ ID NO: 25603 - RNA, 32 nt, Human
aaggaucgcuugagcccaggaguuugagacca

SEQ ID NO: 25604 - RNA, 32 nt, Human
aaggaucgugucugcugacuguuucauucacu

SEQ ID NO: 25605 - RNA, 32 nt, Human
aaggaucuaugcuuuuucuguggugugucacu

SEQ ID NO: 25606 - RNA, 32 nt, Human
aaggaucucauggcagaacagcggaagacuug

SEQ ID NO: 25607 - RNA, 32 nt, Human
aaggaucucccagaaaacaggaagaaugucau

SEQ ID NO: 25608 - RNA, 20 nt, Human
aaggaucucgaucucugcag

SEQ ID NO: 25609 - RNA, 32 nt, Human
aaggaucucugagaccacagaggcucagacuc

SEQ ID NO: 25610 - RNA, 32 nt, Human
aaggaucugcagaauuugucaggccugccuag

SEQ ID NO: 25611 - RNA, 32 nt, Human
aaggaucugggagcuguccagccaggucuggu

SEQ ID NO: 25612 - RNA, 32 nt, Human
aaggaucugggcucagugaugugaaacauacu

SEQ ID NO: 25613 - RNA, 32 nt, Human
aaggaucuugcagccagcacagaggccucuuc

SEQ ID NO: 25614 - RNA, 32 nt, Human
aaggaugaaccugguggggaugccugggcucc

SEQ ID NO: 25615 - RNA, 29 nt, Human
aaggaugaagaaaaggaagaaggaggaag

SEQ ID NO: 25616 - RNA, 32 nt, Human
aaggaugaagaaaauggaaacagaggaggaaa

SEQ ID NO: 25617 - RNA, 32 nt, Human
aaggaugacaagaaaaacauggggaaacagau

SEQ ID NO: 25618 - RNA, 32 nt, Human
aaggaugacaggccuccgcuggaaaugcaaag

SEQ ID NO: 25619 - RNA, 23 nt, Human
aaggaugacauagagcuggcucc

SEQ ID NO: 25620 - RNA, 32 nt, Human
aaggaugacucagcagggaugauucagcagag

SEQ ID NO: 25621 - RNA, 32 nt, Human
aaggaugacuggccaccuccucccuccugccu

SEQ ID NO: 25622 - RNA, 32 nt, Human
aaggaugagaugggaggauggcuugaggccag

SEQ ID NO: 25623 - RNA, 32 nt, Human
aaggaugagcaggcucucugccaucugcccac

SEQ ID NO: 25624 - RNA, 29 nt, Human
aaggaugcaauguccacacaugcuaaagg

SEQ ID NO: 25625 - RNA, 32 nt, Human
aaggaugcagacuuaccccacccuccaccccu

SEQ ID NO: 25626 - RNA, 32 nt, Human
aaggaugcagccgccgaugccgguccggcuuc

SEQ ID NO: 25627 - RNA, 32 nt, Human
aaggaugccacuguucuuaucuccuccaauuu

SEQ ID NO: 25628 - RNA, 29 nt, Human
aaggaugccuccauuccugcuucucaccu

SEQ ID NO: 25629 - RNA, 32 nt, Human
aaggaugccuuaucucuucucacuuuccuuuu

SEQ ID NO: 25630 - RNA, 32 nt, Human
aaggaugcuacacccaccaucucaucccaugg

SEQ ID NO: 25631 - RNA, 20 nt, Human
aaggaugcucgcagaagcca

SEQ ID NO: 25632 - RNA, 32 nt, Human
aaggaugcuucugguggacuucaggggacccc

SEQ ID NO: 25633 - RNA, 32 nt, Human
aaggauggaaagcaucauuucugccagcuucu

SEQ ID NO: 25634 - RNA, 32 nt, Human
aaggauggaaggcagaggguggguguggggcc

SEQ ID NO: 25635 - RNA, 32 nt, Human
aaggauggcacugaggcaccggagaucuugag

SEQ ID NO: 25636 - RNA, 32 nt, Human
aaggauggcagacgccuggugucaggaggggc

SEQ ID NO: 25637 - RNA, 29 nt, Human
aaggauggccaaggaaagaugccugaaaa

SEQ ID NO: 25638 - RNA, 32 nt, Human
aaggaugggaaaaacugcagucaucaacaaug

SEQ ID NO: 25639 - RNA, 32 nt, Human
aaggaugggaagagaaaaggagcaguuuuauu

SEQ ID NO: 25640 - RNA, 32 nt, Human
aaggaugggaggaugcuuggacccaggccuug

SEQ ID NO: 25641 - RNA, 32 nt, Human
aaggauggggaaaaagaaugccuuuaaguuug

SEQ ID NO: 25642 - RNA, 32 nt, Human
aaggauguaauucgcuuugcucucuccucauu

SEQ ID NO: 25643 - RNA, 32 nt, Human
aaggauguagcccguagguggggagggcagca

SEQ ID NO: 25644 - RNA, 32 nt, Human
aaggaugucaggccuggaccuccugggcagga

SEQ ID NO: 25645 - RNA, 23 nt, Human
aaggaugugacauggcuucuccu

SEQ ID NO: 25646 - RNA, 32 nt, Human
aaggaugugugauagaaggaaaaagaaugcuu

SEQ ID NO: 25647 - RNA, 32 nt, Human
aaggauguuucuggcagcacuuuucuaauaau

SEQ ID NO: 25648 - RNA, 32 nt, Human
aaggauuaauccaaaguaacuccuaaauaaca

SEQ ID NO: 25649 - RNA, 32 nt, Human
aaggauuaaugucgugcuugcugguggccacg

SEQ ID NO: 25650 - RNA, 32 nt, Human
aaggauuagaagaggaaacagaaacagguaac

SEQ ID NO: 25651 - RNA, 32 nt, Human
aaggauuauacugggggugaggggacaagaaa

SEQ ID NO: 25652 - RNA, 31 nt, Human
aaggauuauuuccacauuccucucucugaag

SEQ ID NO: 25653 - RNA, 32 nt, Human
aaggauucaccauucuagaugccaucaagagc

SEQ ID NO: 25654 - RNA, 32 nt, Human
aaggauucaguagagauccugaugauucuuuu

SEQ ID NO: 25655 - RNA, 32 nt, Human
aaggauucaguuauuuacugacaguggugagc

SEQ ID NO: 25656 - RNA, 32 nt, Human
aaggauucaguuuugcuuauuguguguugauu

SEQ ID NO: 25657 - RNA, 32 nt, Human
aaggauucauaaggagcuuaucugaacagauu

SEQ ID NO: 25658 - RNA, 32 nt, Human
aaggauuccagcuuucccuccuggccagaaau

SEQ ID NO: 25659 - RNA, 32 nt, Human
aaggauuccugcugaagucugaaccuuacugu

SEQ ID NO: 25660 - RNA, 32 nt, Human
aaggauucugaccccugugccucccauuuaug

SEQ ID NO: 25661 - RNA, 32 nt, Human
aaggauucugguaccuuuacccaaaccuacug

SEQ ID NO: 25662 - RNA, 32 nt, Human
aaggauugcugugugcuagacuuuccagugag

SEQ ID NO: 25663 - RNA, 32 nt, Human
aaggauugcuugagcccaggaguuugagacca

SEQ ID NO: 25664 - RNA, 30 nt, Human
aaggauuguagggagucagaaagacaaggg

SEQ ID NO: 25665 - RNA, 32 nt, Human
aaggauuguguccuccuccaccuucccugugc

SEQ ID NO: 25666 - RNA, 32 nt, Human
aaggauuguugaggggaugcagugaguucuuu

SEQ ID NO: 25667 - RNA, 32 nt, Human
aaggauuucacgagccuggccuggagaggaca

SEQ ID NO: 25668 - RNA, 32 nt, Human
aaggauuuccuacgaagauaaauuuaacuuua

SEQ ID NO: 25669 - RNA, 32 nt, Human
aaggauuugaugcuuuucucucagcauaggua

SEQ ID NO: 25670 - RNA, 32 nt, Human
aaggauuuggcucuaggaaggcuuccaugcag

SEQ ID NO: 25671 - RNA, 32 nt, Human
aaggauuuggggaucacacuguucaucagcug

SEQ ID NO: 25672 - RNA, 32 nt, Human
aaggauuugucaaggauagaguacaguuguag

SEQ ID NO: 25673 - RNA, 32 nt, Human
aaggauuuuaucagaguccugaugccacuaaa

SEQ ID NO: 25674 - RNA, 32 nt, Human
aaggauuuugagaugagcucguccuggaguau

SEQ ID NO: 25675 - RNA, 32 nt, Human
aaggcaaaaccugaaccaccuucugcacuuaa

SEQ ID NO: 25676 - RNA, 32 nt, Human
aaggcaaaaggaaaagagaaaagggaaagaaa

SEQ ID NO: 25677 - RNA, 32 nt, Human
aaggcaaaagugggguagggggaugugggaag

SEQ ID NO: 25678 - RNA, 21 nt, Human
aaggcaaacauuuguugcaag

SEQ ID NO: 25679 - RNA, 32 nt, Human
aaggcaaacucccuccuugcaaggaaaggaga

SEQ ID NO: 25680 - RNA, 32 nt, Human
aaggcaaacugaggcagcaugcacggaggcgg

SEQ ID NO: 25681 - RNA, 32 nt, Human
aaggcaaagaagggggaaggaaaacaaacuuc

SEQ ID NO: 25682 - RNA, 32 nt, Human
aaggcaaagaugagcagagccauggcccucuu

SEQ ID NO: 25683 - RNA, 18 nt, Human
aaggcaaagccccuggaa

SEQ ID NO: 25684 - RNA, 32 nt, Human
aaggcaaaggcagagcgaggugaaaaggcaug

SEQ ID NO: 25685 - RNA, 32 nt, Human
aaggcaaauacucaggguuugaagggagaccu

SEQ ID NO: 25686 - RNA, 32 nt, Human
aaggcaaauccacuuaaaagaucucuguaucu

SEQ ID NO: 25687 - RNA, 32 nt, Human
aaggcaaauguucauuguuuaauuagcacugg

SEQ ID NO: 25688 - RNA, 32 nt, Human
aaggcaacagucugaacucuccuggccagcuc

SEQ ID NO: 25689 - RNA, 22 nt, Human
aaggcaacgaaagcuguugaaa

SEQ ID NO: 25690 - RNA, 32 nt, Human
aaggcaacuaaagacaugaaaccucagguauc

SEQ ID NO: 25691 - RNA, 32 nt, Human
aaggcaacuccucugugaauuugccuuccagg

SEQ ID NO: 25692 - RNA, 32 nt, Human
aaggcaagaagagcacaugagcccaggaguuc

SEQ ID NO: 25693 - RNA, 32 nt, Human
aaggcaagaagaggaggaaggaauagcacagg

SEQ ID NO: 25694 - RNA, 32 nt, Human
aaggcaagacuggccuagccucccagccuaca

SEQ ID NO: 25695 - RNA, 32 nt, Human
aaggcaagcaaaucacuugagcucaggaguuc

SEQ ID NO: 25696 - RNA, 32 nt, Human
aaggcaagcauauuucuccucauaugaaugag

SEQ ID NO: 25697 - RNA, 32 nt, Human
aaggcaaggagagaagccugcgcugguaguga

SEQ ID NO: 25698 - RNA, 32 nt, Human
aaggcaaggagcauccaugcacccccacagua

SEQ ID NO: 25699 - RNA, 32 nt, Human
aaggcaaggcugcaggucuggcccaggggaau

SEQ ID NO: 25700 - RNA, 32 nt, Human
aaggcaauagagcagggggaaaaagagauugu

SEQ ID NO: 25701 - RNA, 32 nt, Human
aaggcaaugcugcucccugaguccaguccccg

SEQ ID NO: 25702 - RNA, 32 nt, Human
aaggcaauguagaaauucuccaggggagagug

SEQ ID NO: 25703 - RNA, 32 nt, Human
aaggcaauuagcucaggagaaaaagaaaaaca

SEQ ID NO: 25704 - RNA, 18 nt, Human
aaggcacaagaaucgcuu

SEQ ID NO: 25705 - RNA, 32 nt, Human
aaggcacaagugcacacacaucuaugcagaca

SEQ ID NO: 25706 - RNA, 31 nt, Human
aaggcacaaguguccuuggcuuucagaauuu

SEQ ID NO: 25707 - RNA, 32 nt, Human
aaggcacacguacgcacacacgcacaugcaca

SEQ ID NO: 25708 - RNA, 32 nt, Human
aaggcacacuccuguagcucugucgccaaaac

SEQ ID NO: 25709 - RNA, 32 nt, Human
aaggcacagcacagcaguacuccacauuguuu

SEQ ID NO: 25710 - RNA, 32 nt, Human
aaggcacagccauucuguucucacuugguucu

SEQ ID NO: 25711 - RNA, 32 nt, Human
aaggcacagccuugaugaucucagggaaaaau

SEQ ID NO: 25712 - RNA, 32 nt, Human
aaggcacagcuccucuagcccaaaaagcaaaa

SEQ ID NO: 25713 - RNA, 32 nt, Human
aaggcacagggaagcaucagcaaccaagguag

SEQ ID NO: 25714 - RNA, 32 nt, Human
aaggcacagguuuauucaaugaaaaucagacg

SEQ ID NO: 25715 - RNA, 32 nt, Human
aaggcacaugagugccuugagggcaggggcag

SEQ ID NO: 25716 - RNA, 32 nt, Human
aaggcaccaacuuggaaaugugcauagguugu

SEQ ID NO: 25717 - RNA, 32 nt, Human
aaggcaccagaauuugaggacagcgaggaggu

SEQ ID NO: 25718 - RNA, 32 nt, Human
aaggcaccauggucagacuggccaggccugag

SEQ ID NO: 25719 - RNA, 32 nt, Human
aaggcacccugccucugcagagcagaaagauc

SEQ ID NO: 25720 - RNA, 32 nt, Human
aaggcacccuggaaguggaagguucggucauu

SEQ ID NO: 25721 - RNA, 19 nt, Human
aaggcacccugguguggga

SEQ ID NO: 25722 - RNA, 32 nt, Human
aaggcaccgggcaccagcuguucaugcugaac

SEQ ID NO: 25723 - RNA, 19 nt, Human
aaggcaccuggcuccucag

SEQ ID NO: 25724 - RNA, 32 nt, Human
aaggcacgcuccuguccuccucauugcccagc

SEQ ID NO: 25725 - RNA, 32 nt, Human
aaggcacggagggagagacagcaagugccuuu

SEQ ID NO: 25726 - RNA, 32 nt, Human
aaggcacgggacaggcaugugacacuaggcca

SEQ ID NO: 25727 - RNA, 25 nt, Human
aaggcacguccacucacaagggacg

SEQ ID NO: 25728 - RNA, 32 nt, Human
aaggcacuccagccugggugacagagugagac

SEQ ID NO: 25729 - RNA, 32 nt, Human
aaggcacugagaccuccacccacuguggacuc

SEQ ID NO: 25730 - RNA, 32 nt, Human
aaggcacugcccucucugugccuugguuuccc

SEQ ID NO: 25731 - RNA, 32 nt, Human
aaggcacugcuccccuuccaucucuagcagau

SEQ ID NO: 25732 - RNA, 32 nt, Human
aaggcacugggucuuggcuggguugaagguuc

SEQ ID NO: 25733 - RNA, 32 nt, Human
aaggcacuguaccaccagccuacugagauugu

SEQ ID NO: 25734 - RNA, 32 nt, Human
aaggcacugucacugcccaccuccuugggccu

SEQ ID NO: 25735 - RNA, 32 nt, Human
aaggcacuugauggccuccaaaaauccugacu

SEQ ID NO: 25736 - RNA, 32 nt, Human
aaggcagaaaagaaggagagaggcagaccuua

SEQ ID NO: 25737 - RNA, 32 nt, Human
aaggcagaaagaggcagcaugggcacugccag

SEQ ID NO: 25738 - RNA, 32 nt, Human
aaggcagaaagccugggaauggguucggcagg

SEQ ID NO: 25739 - RNA, 32 nt, Human
aaggcagaagcagaaguagcugcuuuuuagca

SEQ ID NO: 25740 - RNA, 32 nt, Human
aaggcagaaugagugcuucagaaugugauuuc

SEQ ID NO: 25741 - RNA, 32 nt, Human
aaggcagacaugguuugcaaaccacaagaauc

SEQ ID NO: 25742 - RNA, 25 nt, Human
aaggcagaccgugugagggggccug

SEQ ID NO: 25743 - RNA, 32 nt, Human
aaggcagaccuacaggcgaggccgcagcagag

SEQ ID NO: 25744 - RNA, 32 nt, Human
aaggcagaccuccaaguuccucccugcucugc

SEQ ID NO: 25745 - RNA, 32 nt, Human
aaggcagaccucuccucucucuuuccaauccc

SEQ ID NO: 25746 - RNA, 32 nt, Human
aaggcagacuauucacagcccuauuuacuuac

SEQ ID NO: 25747 - RNA, 32 nt, Human
aaggcagagaaggaaggaugugcuugggaacu

SEQ ID NO: 25748 - RNA, 32 nt, Human
aaggcagagacuucagacuucucaguguguug

SEQ ID NO: 25749 - RNA, 32 nt, Human
aaggcagagagggaggacggcaccgagcggcu

SEQ ID NO: 25750 - RNA, 32 nt, Human
aaggcagagaucuaaccuggcuuguuuagggc

SEQ ID NO: 25751 - RNA, 32 nt, Human
aaggcagagcaucaucuuguucagccucagcu

SEQ ID NO: 25752 - RNA, 32 nt, Human
aaggcagagcccagacucuuggagcaguuguu

SEQ ID NO: 25753 - RNA, 32 nt, Human
aaggcagaggagcccauagccaugaggagccu

SEQ ID NO: 25754 - RNA, 32 nt, Human
aaggcagauaagauguuuaugggugaacccug

SEQ ID NO: 25755 - RNA, 32 nt, Human
aaggcagaugcaucagagccaagacccggccc

SEQ ID NO: 25756 - RNA, 32 nt, Human
aaggcagauggaucaugaggucagggguucaa

SEQ ID NO: 25757 - RNA, 32 nt, Human
aaggcagcaacaagcucuuuuguguuuaaggc

SEQ ID NO: 25758 - RNA, 32 nt, Human
aaggcagcaagguuggugacuuuggagaugca

SEQ ID NO: 25759 - RNA, 32 nt, Human
aaggcagcaauaaaagcacauuagaagucccc

SEQ ID NO: 25760 - RNA, 32 nt, Human
aaggcagcaaugagcuaugaucaugccacugu

SEQ ID NO: 25761 - RNA, 32 nt, Human
aaggcagcagcuuggcuaauacugagcaggua

SEQ ID NO: 25762 - RNA, 32 nt, Human
aaggcagcauuccaugaccagaaacagggaca

SEQ ID NO: 25763 - RNA, 32 nt, Human
aaggcagccagcccagcgaguccagcgguggc

SEQ ID NO: 25764 - RNA, 32 nt, Human
aaggcagccaggaagguggcucugcaggccca

SEQ ID NO: 25765 - RNA, 32 nt, Human
aaggcagcccaggagucagguaugcaggcauu

SEQ ID NO: 25766 - RNA, 32 nt, Human
aaggcagccccuuccuuccagccugggcucug

SEQ ID NO: 25767 - RNA, 32 nt, Human
aaggcagcccucauagugcaucaaagaauuca

SEQ ID NO: 25768 - RNA, 32 nt, Human
aaggcagcccugguacuuuccuaaguggcccc

SEQ ID NO: 25769 - RNA, 32 nt, Human
aaggcagccgagagcaucucccuggaggggcc

SEQ ID NO: 25770 - RNA, 32 nt, Human
aaggcagccgcuccggauccggaucuccaccu

SEQ ID NO: 25771 - RNA, 32 nt, Human
aaggcagccgugucuguguuuuugucucgcag

SEQ ID NO: 25772 - RNA, 19 nt, Human
aaggcagccuugacaggga

SEQ ID NO: 25773 - RNA, 32 nt, Human
aaggcagcgaagccucggggcccaagccccuc

SEQ ID NO: 25774 - RNA, 32 nt, Human
aaggcagcgcagccggugucccagggaccggu

SEQ ID NO: 25775 - RNA, 32 nt, Human
aaggcagcgucauagcaagggagggagagucc

SEQ ID NO: 25776 - RNA, 32 nt, Human
aaggcagcuaucucccuuucugugaucgggag

SEQ ID NO: 25777 - RNA, 32 nt, Human
aaggcagcucagaaaggauuaaggaagauagc

SEQ ID NO: 25778 - RNA, 16 nt, Human
aaggcagcucuggaca

SEQ ID NO: 25779 - RNA, 32 nt, Human
aaggcagcuucacuuccucuuugaggauggag

SEQ ID NO: 25780 - RNA, 32 nt, Human
aaggcagcuucucaggccccuucccaggccaa

SEQ ID NO: 25781 - RNA, 17 nt, Human
aaggcagcuucuggaca

SEQ ID NO: 25782 - RNA, 32 nt, Human
aaggcagcuuuccuuucuuuuguguguuuucu

SEQ ID NO: 25783 - RNA, 32 nt, Human
aaggcaggagagaaggacuuuggucuccggcc

SEQ ID NO: 25784 - RNA, 18 nt, Human
aaggcaggagaugcagca

SEQ ID NO: 25785 - RNA, 32 nt, Human
aaggcaggagggcccucagcuccuagggcugu

SEQ ID NO: 25786 - RNA, 32 nt, Human
aaggcaggaggguggcagcgucccggcugagu

SEQ ID NO: 25787 - RNA, 32 nt, Human
aaggcaggcagaugggccagaggagcagagag

SEQ ID NO: 25788 - RNA, 32 nt, Human
aaggcaggcagccugcccaggcccucccuccu

SEQ ID NO: 25789 - RNA, 20 nt, Human
aaggcaggcagguggaucac

SEQ ID NO: 25790 - RNA, 32 nt, Human
aaggcaggcauggucaaacccauuucacugac

SEQ ID NO: 25791 - RNA, 32 nt, Human
aaggcaggccucaggauugugcggagaaccau

SEQ ID NO: 25792 - RNA, 32 nt, Human
aaggcaggccugucugcgaugggaucugccua

SEQ ID NO: 25793 - RNA, 32 nt, Human
aaggcaggccuuuccuacaggggguggagaga

SEQ ID NO: 25794 - RNA, 32 nt, Human
aaggcaggcggaucacaugaggccaggaauuc

SEQ ID NO: 25795 - RNA, 32 nt, Human
aaggcagggaaagagggaaggagaggagagga

SEQ ID NO: 25796 - RNA, 32 nt, Human
aaggcagggcacugucuccugaggccagugcc

SEQ ID NO: 25797 - RNA, 32 nt, Human
aaggcagggcaucuaccuuccuccccucaggg

SEQ ID NO: 25798 - RNA, 32 nt, Human
aaggcagggccaugggcuuggaggcgggacac

SEQ ID NO: 25799 - RNA, 32 nt, Human
aaggcagggccguggauaugucuggaaaugua

SEQ ID NO: 25800 - RNA, 32 nt, Human
aaggcagggccucccuucaucuucuuaaauua

SEQ ID NO: 25801 - RNA, 32 nt, Human
aaggcagggccuuggucccugaggcuuccccc

SEQ ID NO: 25802 - RNA, 32 nt, Human
aaggcagggucugggugcgggaagagggcucg

SEQ ID NO: 25803 - RNA, 32 nt, Human
aaggcagguggaggggaggccaguguacaugu

SEQ ID NO: 25804 - RNA, 23 nt, Human
aaggcagguggaucaccugaggu

SEQ ID NO: 25805 - RNA, 32 nt, Human
aaggcagguggaucccuugagcucaggaguuc

SEQ ID NO: 25806 - RNA, 32 nt, Human
aaggcagguggaucgcuugagcucaggaguua

SEQ ID NO: 25807 - RNA, 32 nt, Human
aaggcaguaauuccccuuaggccuuguuauuu

SEQ ID NO: 25808 - RNA, 32 nt, Human
aaggcaguacagugucaaaaugaggauugugc

SEQ ID NO: 25809 - RNA, 32 nt, Human
aaggcaguaggcccggugugguggcucacgcc

SEQ ID NO: 25810 - RNA, 32 nt, Human
aaggcaguauaugauugugccaaaccuacacu

SEQ ID NO: 25811 - RNA, 31 nt, Human
aaggcagucaacacaagagggauggaucauu

SEQ ID NO: 25812 - RNA, 19 nt, Human
aaggcagucucccaaggac

SEQ ID NO: 25813 - RNA, 20 nt, Human
aaggcagucuggaaaaggcg

SEQ ID NO: 25814 - RNA, 32 nt, Human
aaggcagugaauuugggcaaugcuggaggccg

SEQ ID NO: 25815 - RNA, 21 nt, Human
aaggcagugaccaaggaggaa

SEQ ID NO: 25816 - RNA, 21 nt, Human
aaggcagugaccgaggaggaa

SEQ ID NO: 25817 - RNA, 19 nt, Human
aaggcaguggggcuggggg

SEQ ID NO: 25818 - RNA, 32 nt, Human
aaggcagugguaguggacaucacagaguauug

SEQ ID NO: 25819 - RNA, 32 nt, Human
aaggcaguuccaguuuuagcacagauuuguuu

SEQ ID NO: 25820 - RNA, 22 nt, Human
aaggcaguuugcaaaaaauguu

SEQ ID NO: 25821 - RNA, 32 nt, Human
aaggcauacaaguaucuaucuggacuucccug

SEQ ID NO: 25822 - RNA, 32 nt, Human
aaggcauacgaugcuacuauuaugcucuguuu

SEQ ID NO: 25823 - RNA, 32 nt, Human
aaggcauaggggaggccugcugugcuggcaau

SEQ ID NO: 25824 - RNA, 32 nt, Human
aaggcaucaauggcagaaacuacauaugagua

SEQ ID NO: 25825 - RNA, 32 nt, Human
aaggcaucacacacagcuuucuggcacgaauc

SEQ ID NO: 25826 - RNA, 32 nt, Human
aaggcaucagugagcgaugguugugccacugc

SEQ ID NO: 25827 - RNA, 31 nt, Human
aaggcaucauaagaagcuggcauuuauuucu

SEQ ID NO: 25828 - RNA, 21 nt, Human
aaggcauccagaagcuguauc

SEQ ID NO: 25829 - RNA, 32 nt, Human
aaggcauccauaccugcauuuugcauucuucg

SEQ ID NO: 25830 - RNA, 17 nt, Human
aaggcauccccacugga

SEQ ID NO: 25831 - RNA, 32 nt, Human
aaggcaucuaucugugcuagguuaaaugguug

SEQ ID NO: 25832 - RNA, 32 nt, Human
aaggcaucuccaggagcgcgccacaagccugg

SEQ ID NO: 25833 - RNA, 32 nt, Human
aaggcaucucuaaaagaaaggcagcagcccca

SEQ ID NO: 25834 - RNA, 32 nt, Human
aaggcaucucugagaaaguggccccagggaga

SEQ ID NO: 25835 - RNA, 32 nt, Human
aaggcaugaagagugggcuccaccugcuggcc

SEQ ID NO: 25836 - RNA, 32 nt, Human
aaggcaugagccaccgcacucagccacuuaag

SEQ ID NO: 25837 - RNA, 32 nt, Human
aaggcaugaggagagaggcugugucagaaacu

SEQ ID NO: 25838 - RNA, 32 nt, Human
aaggcauggcacuugagaaaugugaauaagau

SEQ ID NO: 25839 - RNA, 32 nt, Human
aaggcaugggcuuuguccuggugaucaguuug

SEQ ID NO: 25840 - RNA, 32 nt, Human
aaggcauguacaacacaaaucaugcuucugac

SEQ ID NO: 25841 - RNA, 32 nt, Human
aaggcauucaguuucaaaagggaaauggagaa

SEQ ID NO: 25842 - RNA, 32 nt, Human
aaggcauuccuauuuugcaguucagaacaaaa

SEQ ID NO: 25843 - RNA, 32 nt, Human
aaggcauuccuccugaaugcauccaugaauuu

SEQ ID NO: 25844 - RNA, 32 nt, Human
aaggcauuggugaagacaaaauggccucgccg

SEQ ID NO: 25845 - RNA, 32 nt, Human
aaggccaaaccagcuugacccuggcucacaga

SEQ ID NO: 25846 - RNA, 18 nt, Human
aaggccaaaggaaugggc

SEQ ID NO: 25847 - RNA, 32 nt, Human
aaggccaaccugggcaauagagcgagacccug

SEQ ID NO: 25848 - RNA, 22 nt, Human
aaggccaagacagguggaucac

SEQ ID NO: 25849 - RNA, 32 nt, Human
aaggccaaggaauugaaagggcuguaggggga

SEQ ID NO: 25850 - RNA, 19 nt, Human
aaggccacaaacuguucaa

SEQ ID NO: 25851 - RNA, 32 nt, Human
aaggccacaaacuguucaacacacacaaagug

SEQ ID NO: 25852 - RNA, 32 nt, Human
aaggccacaacagacccggcccugccagcggg

SEQ ID NO: 25853 - RNA, 23 nt, Human
aaggccacacacuccugcuucau

SEQ ID NO: 25854 - RNA, 32 nt, Human
aaggccacagaaaugggcacuaccuccuggcc

SEQ ID NO: 25855 - RNA, 32 nt, Human
aaggccacagcauaacccaccuaggcacaaag

SEQ ID NO: 25856 - RNA, 32 nt, Human
aaggccacagccacucugccacccugaggcuc

SEQ ID NO: 25857 - RNA, 32 nt, Human
aaggccacagggaccucugccccagaaagccu

SEQ ID NO: 25858 - RNA, 22 nt, Human
aaggccacaguccaaucccucu

SEQ ID NO: 25859 - RNA, 24 nt, Human
aaggccacauacagucucugucau

SEQ ID NO: 25860 - RNA, 22 nt, Human
aaggccacauacaucaaccuca

SEQ ID NO: 25861 - RNA, 23 nt, Human
aaggccacauauccucuuuucau

SEQ ID NO: 25862 - RNA, 23 nt, Human
aaggccacaugugcuccugucau

SEQ ID NO: 25863 - RNA, 30 nt, Human
aaggccaccacgacaagggccaccaguucc

SEQ ID NO: 25864 - RNA, 23 nt, Human
aaggccaccagaccuggcuucgc

SEQ ID NO: 25865 - RNA, 22 nt, Human
aaggccaccauuccugcuugau

SEQ ID NO: 25866 - RNA, 32 nt, Human
aaggccacggccgccucaccucgguuuuugcc

SEQ ID NO: 25867 - RNA, 32 nt, Human
aaggccacuaggauggauuggaagagaacugc

SEQ ID NO: 25868 - RNA, 32 nt, Human
aaggccacucucccugccuuuggauuucauag

SEQ ID NO: 25869 - RNA, 32 nt, Human
aaggccacugcacuccagccugagugacagaa

SEQ ID NO: 25870 - RNA, 23 nt, Human
aaggccacugcuuccugcuuugu

SEQ ID NO: 25871 - RNA, 32 nt, Human
aaggccacuggaagcucagccuccggguggca

SEQ ID NO: 25872 - RNA, 22 nt, Human
aaggccacugucuccugcucgc

SEQ ID NO: 25873 - RNA, 20 nt, Human
aaggccacugucuccugcuu

SEQ ID NO: 25874 - RNA, 32 nt, Human
aaggccacuuagauuuucuuuuucaaguuugg

SEQ ID NO: 25875 - RNA, 32 nt, Human
aaggccagaagauacaaagacagaccauccca

SEQ ID NO: 25876 - RNA, 32 nt, Human
aaggccagaaggagugaaacaugugaacuuuc

SEQ ID NO: 25877 - RNA, 32 nt, Human
aaggccagagagcauggagcugaguggagcca

SEQ ID NO: 25878 - RNA, 32 nt, Human
aaggccagaguccccaguguccccuccccucc

SEQ ID NO: 25879 - RNA, 32 nt, Human
aaggccagccuggacaacauaguaagacccua

SEQ ID NO: 25880 - RNA, 32 nt, Human
aaggccagccuggacgacauagcgagacucca

SEQ ID NO: 25881 - RNA, 21 nt, Human
aaggccagccugggaaacaug

SEQ ID NO: 25882 - RNA, 32 nt, Human
aaggccagccugggcaacauaguaagacucag

SEQ ID NO: 25883 - RNA, 19 nt, Human
aaggccaggagcacaggaa

SEQ ID NO: 25884 - RNA, 32 nt, Human
aaggccaggaggucaaggcugcggugagccgu

SEQ ID NO: 25885 - RNA, 32 nt, Human
aaggccaggaguucaagaccagccuggccaac

SEQ ID NO: 25886 - RNA, 32 nt, Human
aaggccaggaguucgagaccagccuggccaac

SEQ ID NO: 25887 - RNA, 32 nt, Human
aaggccaggaguucgagaccagccugggcaac

SEQ ID NO: 25888 - RNA, 32 nt, Human
aaggccaggaguuugaggcugcagugagcuau

SEQ ID NO: 25889 - RNA, 32 nt, Human
aaggccaggccugacggaagagcccagccuuc

SEQ ID NO: 25890 - RNA, 32 nt, Human
aaggccaggccuggagcuugccucuucaguau

SEQ ID NO: 25891 - RNA, 32 nt, Human
aaggccagggcucaggggaaacugaggcagga

SEQ ID NO: 25892 - RNA, 32 nt, Human
aaggccagguucuuagcacauccucuguucuc

SEQ ID NO: 25893 - RNA, 32 nt, Human
aaggccagucaucccuccucuguguugccaug

SEQ ID NO: 25894 - RNA, 32 nt, Human
aaggccaguucugcagugacaggcccaggggc

SEQ ID NO: 25895 - RNA, 24 nt, Human
aaggccauaaaauaucugguucau

SEQ ID NO: 25896 - RNA, 32 nt, Human
aaggccauaaacaaagacagacuuguaguuua

SEQ ID NO: 25897 - RNA, 32 nt, Human
aaggccauagggcauuaacugaaggaacugac

SEQ ID NO: 25898 - RNA, 20 nt, Human
aaggccauagucuguuuuac

SEQ ID NO: 25899 - RNA, 23 nt, Human
aaggccauauggccaucguguca

SEQ ID NO: 25900 - RNA, 22 nt, Human
aaggccaucccagagagacgga

SEQ ID NO: 25901 - RNA, 32 nt, Human
aaggccaucuagugagagauuucuccaaaugu

SEQ ID NO: 25902 - RNA, 32 nt, Human
aaggccaucugucccccgagagcccauugacc

SEQ ID NO: 25903 - RNA, 22 nt, Human
aaggccaucuuuuugcuuucac

SEQ ID NO: 25904 - RNA, 24 nt, Human
aaggccauggcaucccuuuuucau

SEQ ID NO: 25905 - RNA, 32 nt, Human
aaggccauguacaagaggaaguacucagccgc

SEQ ID NO: 25906 - RNA, 17 nt, Human
aaggccaugucuaugua

SEQ ID NO: 25907 - RNA, 32 nt, Human
aaggccaugucugacuucaaggaacucaguuu

SEQ ID NO: 25908 - RNA, 32 nt, Human
aaggccauuagaauugccccagcagagcagau

SEQ ID NO: 25909 - RNA, 32 nt, Human
aaggccauucugcuuugguuuggcucagccuc

SEQ ID NO: 25910 - RNA, 32 nt, Human
aaggcccaacaauacagaaacaaugucuucuu

SEQ ID NO: 25911 - RNA, 32 nt, Human
aaggcccacacccucccggggugaaauaacua

SEQ ID NO: 25912 - RNA, 32 nt, Human
aaggcccacaguucuugaugcagagaaccaaa

SEQ ID NO: 25913 - RNA, 32 nt, Human
aaggcccacauccuacaauugcuacuuccuga

SEQ ID NO: 25914 - RNA, 32 nt, Human
aaggcccaccucucuguacucugggcucuaaa

SEQ ID NO: 25915 - RNA, 21 nt, Human
aaggcccaccucuucuccaag

SEQ ID NO: 25916 - RNA, 32 nt, Human
aaggcccacugcaucacacagacuggugaggc

SEQ ID NO: 25917 - RNA, 32 nt, Human
aaggcccacuguccagcagcccccagguugcc

SEQ ID NO: 25918 - RNA, 32 nt, Human
aaggcccagagagguuuaacaacuuccucaga

SEQ ID NO: 25919 - RNA, 32 nt, Human
aaggcccagcgccagcccccguccucuguuaa

SEQ ID NO: 25920 - RNA, 32 nt, Human
aaggcccaggcagggccuggaagcagcggacc

SEQ ID NO: 25921 - RNA, 24 nt, Human
aaggcccaggcgcccaggguccca

SEQ ID NO: 25922 - RNA, 32 nt, Human
aaggcccauaaauacugguuaaacucuguuaa

SEQ ID NO: 25923 - RNA, 25 nt, Human
aaggcccauucuaugucugcuucgc

SEQ ID NO: 25924 - RNA, 32 nt, Human
aaggcccauuuggcuccugcagccucuuaugc

SEQ ID NO: 25925 - RNA, 22 nt, Human
aaggccccaacauagcuguauu

SEQ ID NO: 25926 - RNA, 32 nt, Human
aaggccccacacacaggugugcugcauuuggg

SEQ ID NO: 25927 - RNA, 32 nt, Human
aaggccccaggugcacaggaggcguggcugcu

SEQ ID NO: 25928 - RNA, 32 nt, Human
aaggccccaucuuucguugccauucuucauuc

SEQ ID NO: 25929 - RNA, 23 nt, Human
aaggccccauuccggggcuguuc

SEQ ID NO: 25930 - RNA, 32 nt, Human
aaggcccccgagagacagaggcaggguuuaaa

SEQ ID NO: 25931 - RNA, 20 nt, Human
aaggcccccuccuccaccca

SEQ ID NO: 25932 - RNA, 32 nt, Human
aaggcccccucuuccagaggaggagcagggau

SEQ ID NO: 25933 - RNA, 32 nt, Human
aaggcccccugccuuugccucacauaaacugu

SEQ ID NO: 25934 - RNA, 32 nt, Human
aaggccccuaggcugggucugggugcuuggcg

SEQ ID NO: 25935 - RNA, 32 nt, Human
aaggccccucugaggcagauggggcaggcggc

SEQ ID NO: 25936 - RNA, 32 nt, Human
aaggccccucugggcugaucuugugccauucu

SEQ ID NO: 25937 - RNA, 32 nt, Human
aaggccccuggccgcggcagagcucccugcca

SEQ ID NO: 25938 - RNA, 32 nt, Human
aaggccccugucccagccuggacgccacgcac

SEQ ID NO: 25939 - RNA, 32 nt, Human
aaggcccggaagaggggaccugagggagccag

SEQ ID NO: 25940 - RNA, 31 nt, Human
aaggcccucaauaaaggcuuccugaggaacg

SEQ ID NO: 25941 - RNA, 32 nt, Human
aaggcccuccacuguccuaagauaaagccucu

SEQ ID NO: 25942 - RNA, 32 nt, Human
aaggcccucuacugcccucuggguccagcaga

SEQ ID NO: 25943 - RNA, 32 nt, Human
aaggcccucugagggcccucaaauggacccug

SEQ ID NO: 25944 - RNA, 32 nt, Human
aaggcccugcagcuacagcugcuucauucccu

SEQ ID NO: 25945 - RNA, 32 nt, Human
aaggcccugcaucccuugccucaggccgggcu

SEQ ID NO: 25946 - RNA, 32 nt, Human
aaggcccugccaccccuuccuugaccccaagc

SEQ ID NO: 25947 - RNA, 31 nt, Human
aaggcccugcucucucccauccaagugacca

SEQ ID NO: 25948 - RNA, 32 nt, Human
aaggcccugcuguuguggccauguccacccug

SEQ ID NO: 25949 - RNA, 32 nt, Human
aaggcccuggcuugaugaggggaacucgcagc

SEQ ID NO: 25950 - RNA, 32 nt, Human
aaggcccugggcacaggcagagagcccaccgg

SEQ ID NO: 25951 - RNA, 32 nt, Human
aaggcccugggcuggaggaagacaucccagau

SEQ ID NO: 25952 - RNA, 32 nt, Human
aaggcccuguugggggaggugggcccggagcu

SEQ ID NO: 25953 - RNA, 32 nt, Human
aaggcccuuccuucuccccagaagaccaaccc

SEQ ID NO: 25954 - RNA, 32 nt, Human
aaggcccuuggggcugacagggccaggcagcc

SEQ ID NO: 25955 - RNA, 32 nt, Human
aaggcccuuucuguaugccccugggccugucc

SEQ ID NO: 25956 - RNA, 32 nt, Human
aaggccgaaauuugacuucugcaccuggauuu

SEQ ID NO: 25957 - RNA, 32 nt, Human
aaggccgacaaccaccagaagcuggaaggggu

SEQ ID NO: 25958 - RNA, 32 nt, Human
aaggccgacacgcuggcccugaggcaacggcu

SEQ ID NO: 25959 - RNA, 32 nt, Human
aaggccgaggcaggcggaucaccugaggucag

SEQ ID NO: 25960 - RNA, 32 nt, Human
aaggccgaggcagguggaucaccugaggucag

SEQ ID NO: 25961 - RNA, 32 nt, Human
aaggccgaggcgggcggaucaccugaggucag

SEQ ID NO: 25962 - RNA, 32 nt, Human
aaggccgaggcgggugggucaccugaggucag

SEQ ID NO: 25963 - RNA, 32 nt, Human
aaggccgaggggcagagguggcucucggcccu

SEQ ID NO: 25964 - RNA, 32 nt, Human
aaggccgagguggguggaucaccugaggucag

SEQ ID NO: 25965 - RNA, 32 nt, Human
aaggccgaguacucagacguccuggccaagcu

SEQ ID NO: 25966 - RNA, 32 nt, Human
aaggccgaguuccaccgcuggagcuccuacau

SEQ ID NO: 25967 - RNA, 32 nt, Human
aaggccgauguucucaucguguuaaguacauu

SEQ ID NO: 25968 - RNA, 32 nt, Human
aaggccgcaagguggaggagcugcgguggcag

SEQ ID NO: 25969 - RNA, 32 nt, Human
aaggccgcacacugaguuaacagcagaauuga

SEQ ID NO: 25970 - RNA, 32 nt, Human
aaggccgcagugaggugagaucgcgccauugc

SEQ ID NO: 25971 - RNA, 32 nt, Human
aaggccgccucugccaggaggccuucccaggu

SEQ ID NO: 25972 - RNA, 32 nt, Human
aaggccgcgcugccuuucccaucugucuaucu

SEQ ID NO: 25973 - RNA, 32 nt, Human
aaggccgcgucgugaucgacucggacacagag

SEQ ID NO: 25974 - RNA, 32 nt, Human
aaggccgcugccuugccugcacuggcaugucc

SEQ ID NO: 25975 - RNA, 32 nt, Human
aaggccgcuguucaccacagggcuaagagcua

SEQ ID NO: 25976 - RNA, 19 nt, Human
aaggccggcaggcaucucc

SEQ ID NO: 25977 - RNA, 32 nt, Human
aaggccgggacccccugcccaaccuguauggc

SEQ ID NO: 25978 - RNA, 32 nt, Human
aaggccgggcuucuugagcuguguugguuguc

SEQ ID NO: 25979 - RNA, 32 nt, Human
aaggccggggcaggggagccugugcugaugcc

SEQ ID NO: 25980 - RNA, 21 nt, Human
aaggccgucaacgaggcggug

SEQ ID NO: 25981 - RNA, 18 nt, Human
aaggccgugacccgugua

SEQ ID NO: 25982 - RNA, 32 nt, Human
aaggccuaaccagcacccaagaucaugcucau

SEQ ID NO: 25983 - RNA, 32 nt, Human
aaggccuacggguucaagaacaagcugaucau

SEQ ID NO: 25984 - RNA, 32 nt, Human
aaggccuagaguuugcucugauaugcauuugg

SEQ ID NO: 25985 - RNA, 23 nt, Human
aaggccucacagcaggcacccca

SEQ ID NO: 25986 - RNA, 32 nt, Human
aaggccucaccuuggacagaggucaauccuug

SEQ ID NO: 25987 - RNA, 32 nt, Human
aaggccucagccugugccugugucgagcucag

SEQ ID NO: 25988 - RNA, 23 nt, Human
aaggccucaggagagcaucacca

SEQ ID NO: 25989 - RNA, 32 nt, Human
aaggccucagugagcuauuaucacgccgcugc

SEQ ID NO: 25990 - RNA, 32 nt, Human
aaggccuccaccagccucucaccagaagagau

SEQ ID NO: 25991 - RNA, 32 nt, Human
aaggccuccagggcggggucuccauauaacua

SEQ ID NO: 25992 - RNA, 32 nt, Human
aaggccuccugucccugccugcucugggugcu

SEQ ID NO: 25993 - RNA, 32 nt, Human
aaggccucugcugccacugacagcuggcacug

SEQ ID NO: 25994 - RNA, 32 nt, Human
aaggccucugcuggagagacaccagcucucag

SEQ ID NO: 25995 - RNA, 32 nt, Human
aaggccucuggcuaccacgucuuuggacagag

SEQ ID NO: 25996 - RNA, 32 nt, Human
aaggccucugggaagguggaggccggcagggc

SEQ ID NO: 25997 - RNA, 32 nt, Human
aaggccucugggauuauacucugaagaacccg

SEQ ID NO: 25998 - RNA, 32 nt, Human
aaggccucugugaaugaaucagucccagggaa

SEQ ID NO: 25999 - RNA, 32 nt, Human
aaggccucuuagugggaaagugaggcaggguc

SEQ ID NO: 26000 - RNA, 32 nt, Human
aaggccugaaaccaccuuguuaccuuucauuu

SEQ ID NO: 26001 - RNA, 32 nt, Human
aaggccugaccuucagcaaaguucuugaaauu

SEQ ID NO: 26002 - RNA, 32 nt, Human
aaggccugagaacucuccaccugcaggaugag

SEQ ID NO: 26003 - RNA, 32 nt, Human
aaggccugagaguucacagaaccugcuagguc

SEQ ID NO: 26004 - RNA, 24 nt, Human
aaggccugaggacccaaggcccca

SEQ ID NO: 26005 - RNA, 21 nt, Human
aaggccugcagcaggacgagg

SEQ ID NO: 26006 - RNA, 32 nt, Human
aaggccugcccuccuuacccaccagaacaggg

SEQ ID NO: 26007 - RNA, 32 nt, Human
aaggccugcuaucuacagcacagugugucauu

SEQ ID NO: 26008 - RNA, 32 nt, Human
aaggccugcucaccaaucuuucuuucacaccg

SEQ ID NO: 26009 - RNA, 32 nt, Human
aaggccuggaaacaugcuuggcucacccagca

SEQ ID NO: 26010 - RNA, 32 nt, Human
aaggccuggaaggugcacugcccagugggucu

SEQ ID NO: 26011 - RNA, 32 nt, Human
aaggccuggaggagcaggaugaguaggagcau

SEQ ID NO: 26012 - RNA, 32 nt, Human
aaggccuggaggcaggggcagaggugacgaca

SEQ ID NO: 26013 - RNA, 32 nt, Human
aaggccuggccacaugcagacaggaggaagcu

SEQ ID NO: 26014 - RNA, 32 nt, Human
aaggccuggggcguccuggggucugggaggaa

SEQ ID NO: 26015 - RNA, 32 nt, Human
aaggccuguagacagaugggccaccaggcagg

SEQ ID NO: 26016 - RNA, 32 nt, Human
aaggccugucuaccauguucucugccuccccu

SEQ ID NO: 26017 - RNA, 32 nt, Human
aaggccugugccagguucccugugcccuccuc

SEQ ID NO: 26018 - RNA, 22 nt, Human
aaggccuguuuaaagggaaagg

SEQ ID NO: 26019 - RNA, 32 nt, Human
aaggccuucaaaggaaggcccugcuugggaca

SEQ ID NO: 26020 - RNA, 32 nt, Human
aaggccuucacugcagccccaucuccuccucc

SEQ ID NO: 26021 - RNA, 23 nt, Human
aaggccuucagucagggcucauc

SEQ ID NO: 26022 - RNA, 32 nt, Human
aaggccuuccaggacaggcucgguucuggucc

SEQ ID NO: 26023 - RNA, 32 nt, Human
aaggccuuccaggacuuccuccucuggguccu

SEQ ID NO: 26024 - RNA, 32 nt, Human
aaggccuucccuaccucacccugggcccagag

SEQ ID NO: 26025 - RNA, 32 nt, Human
aaggccuuccucugucuccaucagugccagcc

SEQ ID NO: 26026 - RNA, 23 nt, Human
aaggccuucguaaagguugcauc

SEQ ID NO: 26027 - RNA, 32 nt, Human
aaggccuugaggacuucauucugugccucucc

SEQ ID NO: 26028 - RNA, 32 nt, Human
aaggccuugagugcccucugcccaucggcuuc

SEQ ID NO: 26029 - RNA, 32 nt, Human
aaggccuugagugcccucugccgaccggcuuc

SEQ ID NO: 26030 - RNA, 32 nt, Human
aaggccuuggacugccuggaugaggcuauaau

SEQ ID NO: 26031 - RNA, 32 nt, Human
aaggccuuguagcagaggacuuggugacugua

SEQ ID NO: 26032 - RNA, 30 nt, Human
aaggccuuucucuccaugcuccuuuugcgg

SEQ ID NO: 26033 - RNA, 32 nt, Human
aaggccuuugcucuccucugacauugaggccu

SEQ ID NO: 26034 - RNA, 32 nt, Human
aaggccuuugugucuguguccuuguuuaauau

SEQ ID NO: 26035 - RNA, 32 nt, Human
aaggccuuuugaauuauacugcagggcaucuu

SEQ ID NO: 26036 - RNA, 32 nt, Human
aaggcgaagggguggagagugauaugaagagc

SEQ ID NO: 26037 - RNA, 32 nt, Human
aaggcgacaggaucaguccuucucuaggguuc

SEQ ID NO: 26038 - RNA, 32 nt, Human
aaggcgacccagguugaggaaguggauccagc

SEQ ID NO: 26039 - RNA, 32 nt, Human
aaggcgagacuccgccuuucuaaucacaaaug

SEQ ID NO: 26040 - RNA, 32 nt, Human
aaggcgagaggaagcaagggaaggaggaagaa

SEQ ID NO: 26041 - RNA, 32 nt, Human
aaggcgauguccagacacagacuuuaugauua

SEQ ID NO: 26042 - RNA, 32 nt, Human
aaggcgcacacgugcacacagcaccagcugag

SEQ ID NO: 26043 - RNA, 32 nt, Human
aaggcgcaugcgcucucauugcagccucggcg

SEQ ID NO: 26044 - RNA, 32 nt, Human
aaggcgccggggccggcccagagcagggccac

SEQ ID NO: 26045 - RNA, 32 nt, Human
aaggcgccuggaccuggcgaggacgcugcccg

SEQ ID NO: 26046 - RNA, 32 nt, Human
aaggcgcgaccggcggccaugcagccccgggg

SEQ ID NO: 26047 - RNA, 32 nt, Human
aaggcgcgucugucuggcaucuuggccgugaa

SEQ ID NO: 26048 - RNA, 32 nt, Human
aaggcgcucuuugccagcugaaaguucccacg

SEQ ID NO: 26049 - RNA, 32 nt, Human
aaggcgcuggguaggcagggaggggagcgcag

SEQ ID NO: 26050 - RNA, 32 nt, Human
aaggcggaccagccugccucugugaugacugc

SEQ ID NO: 26051 - RNA, 32 nt, Human
aaggcggagggcccuggggcuggacuccugga

SEQ ID NO: 26052 - RNA, 32 nt, Human
aaggcggagguguggaggagaggccggcuugg

SEQ ID NO: 26053 - RNA, 32 nt, Human
aaggcggaguagguggggugaggcggaucccg

SEQ ID NO: 26054 - RNA, 32 nt, Human
aaggcggagucgaucucccaaaaggagaagcc

SEQ ID NO: 26055 - RNA, 23 nt, Human
aaggcggauggaucaccugaggu

SEQ ID NO: 26056 - RNA, 23 nt, Human
aaggcggcacagcccagccgggg

SEQ ID NO: 26057 - RNA, 21 nt, Human
aaggcggcagagaggaugggg

SEQ ID NO: 26058 - RNA, 32 nt, Human
aaggcggcaguucccggaacaaacguggcaga

SEQ ID NO: 26059 - RNA, 32 nt, Human
aaggcggcauccgucugugcccugugccuuuc

SEQ ID NO: 26060 - RNA, 19 nt, Human
aaggcggccacggagcggg

SEQ ID NO: 26061 - RNA, 23 nt, Human
aaggcggccugcaccaggaccca

SEQ ID NO: 26062 - RNA, 32 nt, Human
aaggcggcucgcgguuccuccaccgccuccgc

SEQ ID NO: 26063 - RNA, 24 nt, Human
aaggcggcugugcggacgcagggu

SEQ ID NO: 26064 - RNA, 32 nt, Human
aaggcgggcagaucacuugagaucaggaguuu

SEQ ID NO: 26065 - RNA, 23 nt, Human
aaggcgggcggaucaccugaggu

SEQ ID NO: 26066 - RNA, 32 nt, Human
aaggcggggaaccugcuggcuacuguugcucc

SEQ ID NO: 26067 - RNA, 23 nt, Human
aaggcgggugaaucaccugaggu

SEQ ID NO: 26068 - RNA, 23 nt, Human
aaggcggguggaucacccgaggu

SEQ ID NO: 26069 - RNA, 23 nt, Human
aaggcggguggaucaccugaggc

SEQ ID NO: 26070 - RNA, 23 nt, Human
aaggcggguggaucaccugaggu

SEQ ID NO: 26071 - RNA, 32 nt, Human
aaggcgguacuaguucagacacuuuggaaguu

SEQ ID NO: 26072 - RNA, 32 nt, Human
aaggcguacaaaguagaaucaguagacuugcc

SEQ ID NO: 26073 - RNA, 32 nt, Human
aaggcgucauccaagaauucacuugaguccua

SEQ ID NO: 26074 - RNA, 32 nt, Human
aaggcgucgagguggaaaauaugccguuggau

SEQ ID NO: 26075 - RNA, 32 nt, Human
aaggcgucggcccucuggcaagauggcugcug

SEQ ID NO: 26076 - RNA, 19 nt, Human
aaggcgugaccaggaggaa

SEQ ID NO: 26077 - RNA, 32 nt, Human
aaggcgugagccaccaugcccagccuccuacc

SEQ ID NO: 26078 - RNA, 32 nt, Human
aaggcgugagccaccgcgccuggccugaugcc

SEQ ID NO: 26079 - RNA, 32 nt, Human
aaggcgugagccaccguaccuugcccuuggug

SEQ ID NO: 26080 - RNA, 32 nt, Human
aaggcgugagccaccgugcccagccuaauucu

SEQ ID NO: 26081 - RNA, 32 nt, Human
aaggcgugaggaugggaaggagggagguauuc

SEQ ID NO: 26082 - RNA, 32 nt, Human
aaggcguguguaugacacaguaacuggcagug

SEQ ID NO: 26083 - RNA, 21 nt, Human
aaggcuaaaauuuuggccaga

SEQ ID NO: 26084 - RNA, 32 nt, Human
aaggcuaagauuguuaaauaaaggaacugguc

SEQ ID NO: 26085 - RNA, 32 nt, Human
aaggcuaauagugagggaaaggccccacgacc

SEQ ID NO: 26086 - RNA, 32 nt, Human
aaggcuacaaauucagggucagcuguaugcac

SEQ ID NO: 26087 - RNA, 32 nt, Human
aaggcuacacacacauauggagcaccccaucc

SEQ ID NO: 26088 - RNA, 22 nt, Human
aaggcuacaggaccccugcuuc

SEQ ID NO: 26089 - RNA, 32 nt, Human
aaggcuacagugagcuaugaucacaccacugc

SEQ ID NO: 26090 - RNA, 25 nt, Human
aaggcuacauauacauaguugcuuc

SEQ ID NO: 26091 - RNA, 22 nt, Human
aaggcuacauauauucagcuuu

SEQ ID NO: 26092 - RNA, 32 nt, Human
aaggcuacugugagcuaugaucacgccacugc

SEQ ID NO: 26093 - RNA, 32 nt, Human
aaggcuacugugagcuaugauuggaccacuau

SEQ ID NO: 26094 - RNA, 26 nt, Human
aaggcuagaacauuauucugcuuuau

SEQ ID NO: 26095 - RNA, 32 nt, Human
aaggcuagaagacagggccccucuccaagcug

SEQ ID NO: 26096 - RNA, 32 nt, Human
aaggcuagaaugauacaagugagcaaaaguug

SEQ ID NO: 26097 - RNA, 32 nt, Human
aaggcuagagugaguaaggaauagagccaaau

SEQ ID NO: 26098 - RNA, 32 nt, Human
aaggcuagcaugcacggcuccacagcaggugg

SEQ ID NO: 26099 - RNA, 32 nt, Human
aaggcuagcauuguuugcacaaaaaguuggug

SEQ ID NO: 26100 - RNA, 32 nt, Human
aaggcuagccucccccuaacaauccuagacug

SEQ ID NO: 26101 - RNA, 32 nt, Human
aaggcuagccugggcaacacgcugagacccua

SEQ ID NO: 26102 - RNA, 32 nt, Human
aaggcuagugaugagcuucacccuggagcucc

SEQ ID NO: 26103 - RNA, 18 nt, Human
aaggcuaguggcugugua

SEQ ID NO: 26104 - RNA, 23 nt, Human
aaggcuauacuugucuuguucac

SEQ ID NO: 26105 - RNA, 32 nt, Human
aaggcuauagugugcuaugaucaugccuguga

SEQ ID NO: 26106 - RNA, 23 nt, Human
aaggcuaugacagucugcuacgc

SEQ ID NO: 26107 - RNA, 32 nt, Human
aaggcuauggugagccgugauugugccacugc

SEQ ID NO: 26108 - RNA, 32 nt, Human
aaggcuaugugaugaauggugaagacacuuaa

SEQ ID NO: 26109 - RNA, 32 nt, Human
aaggcucaaagugugagaaccuguucuggauu

SEQ ID NO: 26110 - RNA, 32 nt, Human
aaggcucacagcccugagcucuuuacgggagc

SEQ ID NO: 26111 - RNA, 32 nt, Human
aaggcucaccccagugcugcuggcuucuccuc

SEQ ID NO: 26112 - RNA, 32 nt, Human
aaggcucacgcugaggggacuuggagggaggg

SEQ ID NO: 26113 - RNA, 32 nt, Human
aaggcucacugcaaccucaaccuucugguuuc

SEQ ID NO: 26114 - RNA, 32 nt, Human
aaggcucacugcagccucaaccuucuggguuc

SEQ ID NO: 26115 - RNA, 32 nt, Human
aaggcucacugcagccuugaacaccuggacuc

SEQ ID NO: 26116 - RNA, 32 nt, Human
aaggcucagcucuaagaccugcaccugcuucu

SEQ ID NO: 26117 - RNA, 32 nt, Human
aaggcucaggcagcccagucugaaagugaacu

SEQ ID NO: 26118 - RNA, 32 nt, Human
aaggcucaucagucuauccuucugccuccaua

SEQ ID NO: 26119 - RNA, 32 nt, Human
aaggcuccaaagcucuccaacacaaacaagac

SEQ ID NO: 26120 - RNA, 32 nt, Human
aaggcuccauuucucauuuucccaacuuuuau

SEQ ID NO: 26121 - RNA, 32 nt, Human
aaggcucccaacaaugcuauacagcgcaguug

SEQ ID NO: 26122 - RNA, 32 nt, Human
aaggcucccacuguuuauccauuauucauuga

SEQ ID NO: 26123 - RNA, 32 nt, Human
aaggcucccucccucacuaggccccuggcuac

SEQ ID NO: 26124 - RNA, 32 nt, Human
aaggcuccgagugcccugggggucaccccucc

SEQ ID NO: 26125 - RNA, 31 nt, Human
aaggcuccggcucccaggccuguguccuacc

SEQ ID NO: 26126 - RNA, 32 nt, Human
aaggcuccuaaauuugaguuguuugcuaauca

SEQ ID NO: 26127 - RNA, 32 nt, Human
aaggcuccuccccaccauguaauggcuuccuc

SEQ ID NO: 26128 - RNA, 32 nt, Human
aaggcucgaggagagcgcggcucacgagagau

SEQ ID NO: 26129 - RNA, 32 nt, Human
aaggcucgccuuggcgagcucuugccuuuucu

SEQ ID NO: 26130 - RNA, 32 nt, Human
aaggcucgcugcucugcucccugccggggcua

SEQ ID NO: 26131 - RNA, 32 nt, Human
aaggcucggaggugggccggugaggcaagcaa

SEQ ID NO: 26132 - RNA, 32 nt, Human
aaggcucucacugccccuucgccauccuagag

SEQ ID NO: 26133 - RNA, 32 nt, Human
aaggcucuccacccgccagcauccuuagcgag

SEQ ID NO: 26134 - RNA, 32 nt, Human
aaggcucuccauauagacuacagacuugucag

SEQ ID NO: 26135 - RNA, 21 nt, Human
aaggcucucuuccugcuuuac

SEQ ID NO: 26136 - RNA, 32 nt, Human
aaggcucugaaauaaaaugccauaguuuguga

SEQ ID NO: 26137 - RNA, 32 nt, Human
aaggcucugaaguuggggccacagccggucuc

SEQ ID NO: 26138 - RNA, 32 nt, Human
aaggcucugaguagcucaugcuuccagacuga

SEQ ID NO: 26139 - RNA, 32 nt, Human
aaggcucuggagugggacaggggauagcguuu

SEQ ID NO: 26140 - RNA, 32 nt, Human
aaggcucugggaugcaugucucuccuucucua

SEQ ID NO: 26141 - RNA, 32 nt, Human
aaggcucugggcagacggcucaggaacuggga

SEQ ID NO: 26142 - RNA, 22 nt, Human
aaggcucugugccaaggaggga

SEQ ID NO: 26143 - RNA, 32 nt, Human
aaggcucuucuuccucaccgagcaugcuuccc

SEQ ID NO: 26144 - RNA, 32 nt, Human
aaggcugaagacagagagcugaugagauuuuc

SEQ ID NO: 26145 - RNA, 30 nt, Human
aaggcugaagcuugcucagaaaggcagaaa

SEQ ID NO: 26146 - RNA, 32 nt, Human
aaggcugaccaacauggcaaaaccccgucucu

SEQ ID NO: 26147 - RNA, 32 nt, Human
aaggcugagaaggaacagggaacauuggagcu

SEQ ID NO: 26148 - RNA, 32 nt, Human
aaggcugagacccgagaagggagccagccugu

SEQ ID NO: 26149 - RNA, 32 nt, Human
aaggcugagaugggaagaucacuugagccccg

SEQ ID NO: 26150 - RNA, 32 nt, Human
aaggcugagcacuuaucuggaucauuugguca

SEQ ID NO: 26151 - RNA, 32 nt, Human
aaggcugagcuguuggcacccugcugcggccg

SEQ ID NO: 26152 - RNA, 32 nt, Human
aaggcugaggcaggaggcucucuugagaauag

SEQ ID NO: 26153 - RNA, 32 nt, Human
aaggcugaggcaggcagaucaccugaggucag

SEQ ID NO: 26154 - RNA, 32 nt, Human
aaggcugaggcgggcggaucaccugaggucaa

SEQ ID NO: 26155 - RNA, 32 nt, Human
aaggcugaggucuccccuguaaccuuaugaga

SEQ ID NO: 26156 - RNA, 32 nt, Human
aaggcugagguggguggaucaccugaagucag

SEQ ID NO: 26157 - RNA, 32 nt, Human
aaggcugaguuuacauaaaugaucuagauuga

SEQ ID NO: 26158 - RNA, 32 nt, Human
aaggcugcaacacccagaccuccaggagagac

SEQ ID NO: 26159 - RNA, 32 nt, Human
aaggcugcaacccuauggccucuuggagacag

SEQ ID NO: 26160 - RNA, 32 nt, Human
aaggcugcagaaaguccuaggcucagauagga

SEQ ID NO: 26161 - RNA, 32 nt, Human
aaggcugcagagagcuaugaucaucccacugc

SEQ ID NO: 26162 - RNA, 32 nt, Human
aaggcugcagagcaagggcagcaggaccccaa

SEQ ID NO: 26163 - RNA, 32 nt, Human
aaggcugcagcugcacacugcucuggcccuuc

SEQ ID NO: 26164 - RNA, 22 nt, Human
aaggcugcaggcacuggcagug

SEQ ID NO: 26165 - RNA, 32 nt, Human
aaggcugcaggcacuggcagugggaagaggca

SEQ ID NO: 26166 - RNA, 32 nt, Human
aaggcugcagggaccucugcccaggaaagcca

SEQ ID NO: 26167 - RNA, 32 nt, Human
aaggcugcagugaacuaugauggugccacugc

SEQ ID NO: 26168 - RNA, 32 nt, Human
aaggcugcagugaacuaugauugcaucacugc

SEQ ID NO: 26169 - RNA, 32 nt, Human
aaggcugcagugaacuaugauugugccacugc

SEQ ID NO: 26170 - RNA, 32 nt, Human
aaggcugcagugagcaaugauggugccacugc

SEQ ID NO: 26171 - RNA, 32 nt, Human
aaggcugcagugagccaagaucccgccacugc

SEQ ID NO: 26172 - RNA, 32 nt, Human
aaggcugcagugagccaugaucaugccacugc

SEQ ID NO: 26173 - RNA, 32 nt, Human
aaggcugcagugagccaugaugguaccccugc

SEQ ID NO: 26174 - RNA, 32 nt, Human
aaggcugcagugagccaugauucacagcacug

SEQ ID NO: 26175 - RNA, 32 nt, Human
aaggcugcagugagccaugauugcaccacugc

SEQ ID NO: 26176 - RNA, 32 nt, Human
aaggcugcagugagccaugauugcaccccugc

SEQ ID NO: 26177 - RNA, 32 nt, Human
aaggcugcagugagccaugguugcaccacuac

SEQ ID NO: 26178 - RNA, 32 nt, Human
aaggcugcagugagccauguucacaccgcugc

SEQ ID NO: 26179 - RNA, 32 nt, Human
aaggcugcagugagccauguucaugacacugc

SEQ ID NO: 26180 - RNA, 32 nt, Human
aaggcugcagugagccgugaaaggccacugca

SEQ ID NO: 26181 - RNA, 32 nt, Human
aaggcugcagugagccgugauggcgccacugc

SEQ ID NO: 26182 - RNA, 32 nt, Human
aaggcugcagugagccgugauugcaccacugc

SEQ ID NO: 26183 - RNA, 32 nt, Human
aaggcugcagugagcuaugaugaugccacugu

SEQ ID NO: 26184 - RNA, 32 nt, Human
aaggcugcagugagcuaugauugcgccgcugc

SEQ ID NO: 26185 - RNA, 32 nt, Human
aaggcugcagugagcuauggucaugccacugc

SEQ ID NO: 26186 - RNA, 32 nt, Human
aaggcugcagugagcuaugguugcaccacugu

SEQ ID NO: 26187 - RNA, 32 nt, Human
aaggcugcagugagcucaugaucauaccacug

SEQ ID NO: 26188 - RNA, 32 nt, Human
aaggcugcagugagcugcaaucacaccacuac

SEQ ID NO: 26189 - RNA, 32 nt, Human
aaggcugcagugagcugugaucacaccacugc

SEQ ID NO: 26190 - RNA, 32 nt, Human
aaggcugcagugagcugugaucaugcuacugc

SEQ ID NO: 26191 - RNA, 32 nt, Human
aaggcugcagugagcugugaucauggcacugc

SEQ ID NO: 26192 - RNA, 32 nt, Human
aaggcugcagugagcugugaucgugccacugc

SEQ ID NO: 26193 - RNA, 32 nt, Human
aaggcugcagugagcugugaugacaccacugc

SEQ ID NO: 26194 - RNA, 32 nt, Human
aaggcugcagugagcugugauggcgccacugc

SEQ ID NO: 26195 - RNA, 32 nt, Human
aaggcugcagugagcugugauggcgucagugu

SEQ ID NO: 26196 - RNA, 32 nt, Human
aaggcugcagugagcugugauugugccaccac

SEQ ID NO: 26197 - RNA, 32 nt, Human
aaggcugcagugagcuuggauaacgacugcac

SEQ ID NO: 26198 - RNA, 32 nt, Human
aaggcugcagugagcuuugaucacaccacugc

SEQ ID NO: 26199 - RNA, 32 nt, Human
aaggcugcagugagucaugaucgcaccacugc

SEQ ID NO: 26200 - RNA, 32 nt, Human
aaggcugcagugagucgugauugugccacugc

SEQ ID NO: 26201 - RNA, 32 nt, Human
aaggcugcagugagucgugauuuugccacugc

SEQ ID NO: 26202 - RNA, 32 nt, Human
aaggcugcagugaguugugaucacaccauugc

SEQ ID NO: 26203 - RNA, 32 nt, Human
aaggcugccagccuguguacguguaauggggg

SEQ ID NO: 26204 - RNA, 32 nt, Human
aaggcugccccuaggugcaugccugcgccagc

SEQ ID NO: 26205 - RNA, 32 nt, Human
aaggcugccugggagccccgccucccuaccau

SEQ ID NO: 26206 - RNA, 32 nt, Human
aaggcugccuguaccucucaagcuuugcauuu

SEQ ID NO: 26207 - RNA, 32 nt, Human
aaggcugccuguauuacauugcuuuggggagu

SEQ ID NO: 26208 - RNA, 32 nt, Human
aaggcugcggugagccgugauugugccaaugu

SEQ ID NO: 26209 - RNA, 22 nt, Human
aaggcugcuaccaaguguuguu

SEQ ID NO: 26210 - RNA, 24 nt, Human
aaggcugcuaugaccuguguucac

SEQ ID NO: 26211 - RNA, 32 nt, Human
aaggcugcugugagcuaugauugugccacugc

SEQ ID NO: 26212 - RNA, 32 nt, Human
aaggcugcuguugcugaaagagacuugggcua

SEQ ID NO: 26213 - RNA, 32 nt, Human
aaggcugcuucaaagauuaucugauuccuuua

SEQ ID NO: 26214 - RNA, 32 nt, Human
aaggcuggaaagucaucugccuuuaauaacuc

SEQ ID NO: 26215 - RNA, 21 nt, Human
aaggcuggaagcaucacacua

SEQ ID NO: 26216 - RNA, 32 nt, Human
aaggcuggagaaggacaugagaucagggccug

SEQ ID NO: 26217 - RNA, 32 nt, Human
aaggcuggagccagggagcgcuggaggaaacc

SEQ ID NO: 26218 - RNA, 32 nt, Human
aaggcuggagcuggaacccugccacucuucag

SEQ ID NO: 26219 - RNA, 32 nt, Human
aaggcuggagggcaauggcaugauuucagcuc

SEQ ID NO: 26220 - RNA, 32 nt, Human
aaggcuggaucuuggagaaugugagaagccag

SEQ ID NO: 26221 - RNA, 32 nt, Human
aaggcuggccaguucugcaagaaaggcaagga

SEQ ID NO: 26222 - RNA, 32 nt, Human
aaggcugggaggaggugggcuagaugaucuuu

SEQ ID NO: 26223 - RNA, 32 nt, Human
aaggcugggauaugaugagagauuccagccca

SEQ ID NO: 26224 - RNA, 23 nt, Human
aaggcugggauuacaggcaugag

SEQ ID NO: 26225 - RNA, 32 nt, Human
aaggcugggauuacaggcaugagccacugcac

SEQ ID NO: 26226 - RNA, 32 nt, Human
aaggcugggauuacagguaugcaccaccacgc

SEQ ID NO: 26227 - RNA, 32 nt, Human
aaggcugggcauuguuaaaaucuagauguuac

SEQ ID NO: 26228 - RNA, 32 nt, Human
aaggcuggggguggaggguggaggagggagca

SEQ ID NO: 26229 - RNA, 32 nt, Human
aaggcuggguuuuuccccucuaaucuggaggc

SEQ ID NO: 26230 - RNA, 32 nt, Human
aaggcuggucucaaacuccugaccucagguga

SEQ ID NO: 26231 - RNA, 32 nt, Human
aaggcuggugcagacccagcugccuuagacag

SEQ ID NO: 26232 - RNA, 23 nt, Human
aaggcugguggaucaccugaggu

SEQ ID NO: 26233 - RNA, 32 nt, Human
aaggcuguagugagcugugauugagccacugc

SEQ ID NO: 26234 - RNA, 23 nt, Human
aaggcuguccaaggcaggcagug

SEQ ID NO: 26235 - RNA, 17 nt, Human
aaggcugucuggagggg

SEQ ID NO: 26236 - RNA, 32 nt, Human
aaggcugucuucaggccgggcacagugggagg

SEQ ID NO: 26237 - RNA, 31 nt, Human
aaggcugugacuggggaaaaagauugagcuu

SEQ ID NO: 26238 - RNA, 32 nt, Human
aaggcugugagaagcaguugggaguuugguug

SEQ ID NO: 26239 - RNA, 32 nt, Human
aaggcugugagagaggggguuguuguggagaa

SEQ ID NO: 26240 - RNA, 32 nt, Human
aaggcugugcguuccugagggccaggucgggg

SEQ ID NO: 26241 - RNA, 32 nt, Human
aaggcuguggaagagguuggagugggcgcauc

SEQ ID NO: 26242 - RNA, 32 nt, Human
aaggcuguggaccccagagaagguggcaggug

SEQ ID NO: 26243 - RNA, 32 nt, Human
aaggcuguggugagggaagacgccuuucuccu

SEQ ID NO: 26244 - RNA, 32 nt, Human
aaggcuguguauaguccauuucccaggucuga

SEQ ID NO: 26245 - RNA, 32 nt, Human
aaggcuguguucuggaauuuucugccucacag

SEQ ID NO: 26246 - RNA, 32 nt, Human
aaggcuguuagguugugugagccuugaagugu

SEQ ID NO: 26247 - RNA, 32 nt, Human
aaggcuguugaguugcucacaggcucugaggg

SEQ ID NO: 26248 - RNA, 19 nt, Human
aaggcuguugcagaggcgg

SEQ ID NO: 26249 - RNA, 17 nt, Human
aaggcuguugcaugggc

SEQ ID NO: 26250 - RNA, 32 nt, Human
aaggcuguuuaucacuguuguggaaauuuccu

SEQ ID NO: 26251 - RNA, 24 nt, Human
aaggcuguuuuaccccaaaacuca

SEQ ID NO: 26252 - RNA, 32 nt, Human
aaggcuguuuucccccugauucccacuuugca

SEQ ID NO: 26253 - RNA, 32 nt, Human
aaggcuuaaagagccagacugcgcagccagga

SEQ ID NO: 26254 - RNA, 32 nt, Human
aaggcuuacugaggcugguggagggagccacu

SEQ ID NO: 26255 - RNA, 32 nt, Human
aaggcuuaggcuugaaaggugaagagcaggaa

SEQ ID NO: 26256 - RNA, 32 nt, Human
aaggcuuaggggccaacaaggcuuccagcugg

SEQ ID NO: 26257 - RNA, 32 nt, Human
aaggcuucacagccccagaggauuccauauaa

SEQ ID NO: 26258 - RNA, 32 nt, Human
aaggcuucaccauacuguaagcauuuuaggua

SEQ ID NO: 26259 - RNA, 32 nt, Human
aaggcuucagugagccaugaucaugccacugc

SEQ ID NO: 26260 - RNA, 32 nt, Human
aaggcuucagugagccaugauggugccacugc

SEQ ID NO: 26261 - RNA, 32 nt, Human
aaggcuuccacguugggggacugaggccaacu

SEQ ID NO: 26262 - RNA, 32 nt, Human
aaggcuuccuggaagcggugacccuugagccg

SEQ ID NO: 26263 - RNA, 32 nt, Human
aaggcuuccuggaggagaugacauuuaacuga

SEQ ID NO: 26264 - RNA, 32 nt, Human
aaggcuuccuguugucucagaugcaggagcca

SEQ ID NO: 26265 - RNA, 32 nt, Human
aaggcuuccuucuaggagaccccacaugcagg

SEQ ID NO: 26266 - RNA, 32 nt, Human
aaggcuuccuuguggguaccacaggacaacuc

SEQ ID NO: 26267 - RNA, 32 nt, Human
aaggcuucucaaaugacagagcucaaugaaua

SEQ ID NO: 26268 - RNA, 32 nt, Human
aaggcuucuccggaucaguacaugcaugucac

SEQ ID NO: 26269 - RNA, 32 nt, Human
aaggcuucuccuuccuucuuccucugcucagg

SEQ ID NO: 26270 - RNA, 32 nt, Human
aaggcuucucugcagaaugucaaacaaagauc

SEQ ID NO: 26271 - RNA, 32 nt, Human
aaggcuucuuggaggaggagaugauugagcug

SEQ ID NO: 26272 - RNA, 32 nt, Human
aaggcuugauagcagagguuuggugguucaga

SEQ ID NO: 26273 - RNA, 32 nt, Human
aaggcuugccagagccaacaggaagugagccc

SEQ ID NO: 26274 - RNA, 32 nt, Human
aaggcuugcuuagcaaccacagagucagugac

SEQ ID NO: 26275 - RNA, 32 nt, Human
aaggcuuggaaagaggcaugugaagagcuuua

SEQ ID NO: 26276 - RNA, 32 nt, Human
aaggcuuggacagacuguucucccucuuguua

SEQ ID NO: 26277 - RNA, 32 nt, Human
aaggcuuggaguagacaaaaggaaaggucuca

SEQ ID NO: 26278 - RNA, 32 nt, Human
aaggcuuggcagcgcuagaggcugaaggacaa

SEQ ID NO: 26279 - RNA, 32 nt, Human
aaggcuuggcuucauuuucuacaugugagcuc

SEQ ID NO: 26280 - RNA, 32 nt, Human
aaggcuugggagccaggaugagugucgggcuc

SEQ ID NO: 26281 - RNA, 32 nt, Human
aaggcuugggaggcggggcccugcaggacguc

SEQ ID NO: 26282 - RNA, 32 nt, Human
aaggcuugggugcucaucuaaagcucagccaa

SEQ ID NO: 26283 - RNA, 32 nt, Human
aaggcuuguaacuugguuccucccuuucuuaa

SEQ ID NO: 26284 - RNA, 22 nt, Human
aaggcuuuagcccuggacccag

SEQ ID NO: 26285 - RNA, 32 nt, Human
aaggcuuucauaaugugacuucugcucagcuc

SEQ ID NO: 26286 - RNA, 32 nt, Human
aaggcuuucgggagugugaggcugcaucugcu

SEQ ID NO: 26287 - RNA, 32 nt, Human
aaggcuuucugugggcccccaagugguaggag

SEQ ID NO: 26288 - RNA, 32 nt, Human
aaggcuuugcaaacugugaagugcagugccua

SEQ ID NO: 26289 - RNA, 32 nt, Human
aaggcuuugccauguugcccaggcuggucuug

SEQ ID NO: 26290 - RNA, 32 nt, Human
aaggcuuugccuccucguaccugccgaggccc

SEQ ID NO: 26291 - RNA, 32 nt, Human
aaggcuuugcuacugguggcagagaugguugu

SEQ ID NO: 26292 - RNA, 32 nt, Human
aaggcuuuggacaaaauuuugagacccuaauc

SEQ ID NO: 26293 - RNA, 32 nt, Human
aaggcuuuuaaggauuuucugaaagugcugau

SEQ ID NO: 26294 - RNA, 32 nt, Human
aaggcuuuugcuuagagaauucagcaagagaa

SEQ ID NO: 26295 - RNA, 32 nt, Human
aaggcuuuuguugaauccuaugcuacugauag

SEQ ID NO: 26296 - RNA, 32 nt, Human
aagggaaaaacagugcaagaugagaacaacaa

SEQ ID NO: 26297 - RNA, 32 nt, Human
aagggaaaaccagcuucuguugccguggcaac

SEQ ID NO: 26298 - RNA, 32 nt, Human
aagggaaaaguagauccgauaacuuaaaaacg

SEQ ID NO: 26299 - RNA, 32 nt, Human
aagggaaagaggaggaaguccuaagcagagaa

SEQ ID NO: 26300 - RNA, 32 nt, Human
aagggaaagcuaagggcgucuuagaccggggg

SEQ ID NO: 26301 - RNA, 32 nt, Human
aagggaaaggaaagaaaaagaaguaccuagua

SEQ ID NO: 26302 - RNA, 32 nt, Human
aagggaaaggaggaugggagaccccuagccug

SEQ ID NO: 26303 - RNA, 32 nt, Human
aagggaaaggcagagggugugauuauggugac

SEQ ID NO: 26304 - RNA, 32 nt, Human
aagggaaaggggaggaagauggagggagaagc

SEQ ID NO: 26305 - RNA, 32 nt, Human
aagggaaagguaugagggaaagagagucugag

SEQ ID NO: 26306 - RNA, 32 nt, Human
aagggaacaaauuauguggcagagagggauaa

SEQ ID NO: 26307 - RNA, 32 nt, Human
aagggaacaacaauaucugccucauagggugu

SEQ ID NO: 26308 - RNA, 32 nt, Human
aagggaacaggaacaaauuuccccagcaccac

SEQ ID NO: 26309 - RNA, 32 nt, Human
aagggaacaugcugguucuggaaaagccacaa

SEQ ID NO: 26310 - RNA, 32 nt, Human
aagggaaccaacaaaacacuauaacuuaaaag

SEQ ID NO: 26311 - RNA, 32 nt, Human
aagggaacccuuguuuccucagguaaacuuga

SEQ ID NO: 26312 - RNA, 32 nt, Human
aagggaaccugggaacccuucuccccucaccu

SEQ ID NO: 26313 - RNA, 32 nt, Human
aagggaacucggcuucgucuuuggacacaggu

SEQ ID NO: 26314 - RNA, 32 nt, Human
aagggaacuguacauucuuucuuucuuggcua

SEQ ID NO: 26315 - RNA, 32 nt, Human
aagggaagaagggaaaaagagauuauuauguc

SEQ ID NO: 26316 - RNA, 32 nt, Human
aagggaagacaaaacuggauguucuuucuugu

SEQ ID NO: 26317 - RNA, 32 nt, Human
aagggaagagaagcauuggugaaauggauuuc

SEQ ID NO: 26318 - RNA, 32 nt, Human
aagggaagagcucuuggcucccuugagguucu

SEQ ID NO: 26319 - RNA, 32 nt, Human
aagggaagagguggaggucaggcacgguggcu

SEQ ID NO: 26320 - RNA, 32 nt, Human
aagggaagcaccaucguccaggaucugcaaau

SEQ ID NO: 26321 - RNA, 32 nt, Human
aagggaagcaggaagaccaagaagaaaaacca

SEQ ID NO: 26322 - RNA, 21 nt, Human
aagggaagcaggccucugaug

SEQ ID NO: 26323 - RNA, 32 nt, Human
aagggaagccuagugggccuagaccccuccuc

SEQ ID NO: 26324 - RNA, 32 nt, Human
aagggaagcugggucugaggggagacugaccu

SEQ ID NO: 26325 - RNA, 32 nt, Human
aagggaaggaagaggaagagugcaaaacauug

SEQ ID NO: 26326 - RNA, 32 nt, Human
aagggaaggaagggcagugcugacuuuuggua

SEQ ID NO: 26327 - RNA, 32 nt, Human
aagggaaggaaguuuggcagggccaagagucc

SEQ ID NO: 26328 - RNA, 32 nt, Human
aagggaaggccccacagacaagguagcccugg

SEQ ID NO: 26329 - RNA, 22 nt, Human
aagggaaggcuaagaauugccc

SEQ ID NO: 26330 - RNA, 32 nt, Human
aagggaaguaggcauuaccauagacgacuccu

SEQ ID NO: 26331 - RNA, 32 nt, Human
aagggaagucggcucaggaggaccgagugagg

SEQ ID NO: 26332 - RNA, 32 nt, Human
aagggaauagagaagagaugggacuauuucua

SEQ ID NO: 26333 - RNA, 32 nt, Human
aagggaauaugggcugggcaugguggcucaug

SEQ ID NO: 26334 - RNA, 32 nt, Human
aagggaaucauuguuuacacauggggaucaga

SEQ ID NO: 26335 - RNA, 32 nt, Human
aagggaauccacuguuuucucacuuucauccc

SEQ ID NO: 26336 - RNA, 32 nt, Human
aagggaaugccaccucuucucagaccccgccu

SEQ ID NO: 26337 - RNA, 32 nt, Human
aagggaauuggagguggaaccauccagucuug

SEQ ID NO: 26338 - RNA, 32 nt, Human
aagggaauuggugcccagaaaaugggacugga

SEQ ID NO: 26339 - RNA, 32 nt, Human
aagggaauuuugcuacuacuagacucuugauu

SEQ ID NO: 26340 - RNA, 32 nt, Human
aagggacaagaggaacucuuggaguuggcugg

SEQ ID NO: 26341 - RNA, 32 nt, Human
aagggacacuuaugcagaaccaugaguggcca

SEQ ID NO: 26342 - RNA, 32 nt, Human
aagggacaggagaagagaggaaauaacagaga

SEQ ID NO: 26343 - RNA, 32 nt, Human
aagggacaggcaggaucuggacagcgaagaac

SEQ ID NO: 26344 - RNA, 32 nt, Human
aagggacagggucagggcagcccagggcuccu

SEQ ID NO: 26345 - RNA, 32 nt, Human
aagggacaugauguaagggaaaaggccucaaa

SEQ ID NO: 26346 - RNA, 32 nt, Human
aagggaccagggaacuggugaccuaagcaacc

SEQ ID NO: 26347 - RNA, 32 nt, Human
aagggacccccaggaccuggauaugguggugu

SEQ ID NO: 26348 - RNA, 32 nt, Human
aagggacccugagcucugcaagcugugaucug

SEQ ID NO: 26349 - RNA, 32 nt, Human
aagggacccuggcagauuaaaacccucagacu

SEQ ID NO: 26350 - RNA, 32 nt, Human
aagggaccggccaugccuccaagccuugccca

SEQ ID NO: 26351 - RNA, 32 nt, Human
aagggaccgggugggagggaggacguggaaug

SEQ ID NO: 26352 - RNA, 32 nt, Human
aagggaccuccacgacaggugggcugggugcg

SEQ ID NO: 26353 - RNA, 32 nt, Human
aagggaccucucauggugcaccaccugagcga

SEQ ID NO: 26354 - RNA, 32 nt, Human
aagggaccugggaggaggagcugcaauugaug

SEQ ID NO: 26355 - RNA, 32 nt, Human
aagggacgaaggaggaguaggugaaagcgggg

SEQ ID NO: 26356 - RNA, 32 nt, Human
aagggacgagacaaccaugcugugcuguauga

SEQ ID NO: 26357 - RNA, 32 nt, Human
aagggacgccuccaccaucauuaaggagagga

SEQ ID NO: 26358 - RNA, 32 nt, Human
aagggacgcugaggcaggaggaucauuugagc

SEQ ID NO: 26359 - RNA, 32 nt, Human
aagggacggccucuccccuccuaccugccacc

SEQ ID NO: 26360 - RNA, 32 nt, Human
aagggacgucuucuccacgccgcuccgacucc

SEQ ID NO: 26361 - RNA, 32 nt, Human
aagggacucccaggacccugugcccagcuucc

SEQ ID NO: 26362 - RNA, 32 nt, Human
aagggacucuuccauggccauggcaguccuga

SEQ ID NO: 26363 - RNA, 32 nt, Human
aagggacugaaccacugcccuaaguuucuuua

SEQ ID NO: 26364 - RNA, 32 nt, Human
aagggacugagcaaaggcucccaggggaaggg

SEQ ID NO: 26365 - RNA, 32 nt, Human
aagggacugcugggagguuaaaaagaaaaguu

SEQ ID NO: 26366 - RNA, 32 nt, Human
aagggacugggcugucuaucuuagcaguuggc

SEQ ID NO: 26367 - RNA, 32 nt, Human
aagggagaaagccuggcagaggguugggggcu

SEQ ID NO: 26368 - RNA, 32 nt, Human
aagggagaaaggcagugggaaaagaggugagc

SEQ ID NO: 26369 - RNA, 32 nt, Human
aagggagaaccagcucaagacauuuuggagga

SEQ ID NO: 26370 - RNA, 32 nt, Human
aagggagaagacagaggagaaugccagaugaa

SEQ ID NO: 26371 - RNA, 32 nt, Human
aagggagaagucagaggcugauucuuguagaa

SEQ ID NO: 26372 - RNA, 32 nt, Human
aagggagaagugacauugcaucaaagcaucuu

SEQ ID NO: 26373 - RNA, 32 nt, Human
aagggagaagugagagggacaauuggguucau

SEQ ID NO: 26374 - RNA, 32 nt, Human
aagggagacaucucagggcaaagcuuucguga

SEQ ID NO: 26375 - RNA, 32 nt, Human
aagggagagagaagaaaagaaaaaugaagaaa

SEQ ID NO: 26376 - RNA, 32 nt, Human
aagggagagagggagggagagagagugaaaga

SEQ ID NO: 26377 - RNA, 32 nt, Human
aagggagagagggagggcgcaaggggaggggg

SEQ ID NO: 26378 - RNA, 32 nt, Human
aagggagagagggaggggcagcuaugcucagu

SEQ ID NO: 26379 - RNA, 32 nt, Human
aagggagagagggagggggagggcgggcgaag

SEQ ID NO: 26380 - RNA, 32 nt, Human
aagggagagcacaugaagcuuugcuaauuaua

SEQ ID NO: 26381 - RNA, 32 nt, Human
aagggagaggacuuggggguugggggugguca

SEQ ID NO: 26382 - RNA, 32 nt, Human
aagggagaggagaggauugauagaguguugca

SEQ ID NO: 26383 - RNA, 32 nt, Human
aagggagaggcagcagucuccucccagguggg

SEQ ID NO: 26384 - RNA, 32 nt, Human
aagggagagggaaucggagggagcagcggaau

SEQ ID NO: 26385 - RNA, 32 nt, Human
aagggagagggagggagccgggagccguagag

SEQ ID NO: 26386 - RNA, 32 nt, Human
aagggagaggggacaggagggaagggugggcc

SEQ ID NO: 26387 - RNA, 32 nt, Human
aagggagaguagaagagauagggggucuuuag

SEQ ID NO: 26388 - RNA, 32 nt, Human
aagggagcacaauggaggccgcucaugcuaaa

SEQ ID NO: 26389 - RNA, 32 nt, Human
aagggagcacagcauuuccagcuuugaacuug

SEQ ID NO: 26390 - RNA, 32 nt, Human
aagggagccacuggccgcgguggcagggccag

SEQ ID NO: 26391 - RNA, 32 nt, Human
aagggagccacugugaaccucuuggcuccaaa

SEQ ID NO: 26392 - RNA, 32 nt, Human
aagggagccagccugucccaugccugccuggg

SEQ ID NO: 26393 - RNA, 32 nt, Human
aagggagccaugagccagaaggaggccccuuu

SEQ ID NO: 26394 - RNA, 32 nt, Human
aagggagccccaggcuggagcagcaugaggcc

SEQ ID NO: 26395 - RNA, 19 nt, Human
aagggagcccccaugcaca

SEQ ID NO: 26396 - RNA, 32 nt, Human
aagggagccugcaucccucccuuccuuucucu

SEQ ID NO: 26397 - RNA, 32 nt, Human
aagggagcgauguugaucucaggaagcacaaa

SEQ ID NO: 26398 - RNA, 32 nt, Human
aagggagcggcagcccagccaggccuggccca

SEQ ID NO: 26399 - RNA, 32 nt, Human
aagggagcucuuucuuacauuucccuuggagg

SEQ ID NO: 26400 - RNA, 32 nt, Human
aagggagcuggaggcagaggaagagaaaaugu

SEQ ID NO: 26401 - RNA, 32 nt, Human
aagggagcuggcuccagccuggaaaccugucu

SEQ ID NO: 26402 - RNA, 32 nt, Human
aagggagcuggggcggugagggcaugggguga

SEQ ID NO: 26403 - RNA, 32 nt, Human
aagggagcuucucauuuaauucagcggaugug

SEQ ID NO: 26404 - RNA, 32 nt, Human
aagggagcuuggguaggggccaggcuagccug

SEQ ID NO: 26405 - RNA, 32 nt, Human
aagggaggaaacugugaggagguggagaacgu

SEQ ID NO: 26406 - RNA, 32 nt, Human
aagggaggaaggccuuucuucuguguuaauug

SEQ ID NO: 26407 - RNA, 32 nt, Human
aagggaggaagugggggcuggauaugcccacc

SEQ ID NO: 26408 - RNA, 32 nt, Human
aagggaggacaguggaugacagggaagacgag

SEQ ID NO: 26409 - RNA, 32 nt, Human
aagggaggagacacaggcaagccucaacuccc

SEQ ID NO: 26410 - RNA, 32 nt, Human
aagggaggagccgcucauucacccaacaaaac

SEQ ID NO: 26411 - RNA, 32 nt, Human
aagggaggaggaagaagggagcggggucggag

SEQ ID NO: 26412 - RNA, 32 nt, Human
aagggaggcgugccugagaagguagccugugc

SEQ ID NO: 26413 - RNA, 32 nt, Human
aagggagggaaagagagaagggggaaacacaa

SEQ ID NO: 26414 - RNA, 32 nt, Human
aagggagggaaagcaagccuggcagaggcacc

SEQ ID NO: 26415 - RNA, 32 nt, Human
aagggagggaaaggggaggguagcgggagggu

SEQ ID NO: 26416 - RNA, 32 nt, Human
aagggagggaagggaagucagcucugggagca

SEQ ID NO: 26417 - RNA, 32 nt, Human
aagggagggagggagaaaggagaaguugguuu

SEQ ID NO: 26418 - RNA, 32 nt, Human
aagggagggcccugggcugggugcagggcgcg

SEQ ID NO: 26419 - RNA, 32 nt, Human
aagggaggggagcaagaaagaaggcgagagag

SEQ ID NO: 26420 - RNA, 32 nt, Human
aagggaggggcacagcuacacacucaccaaag

SEQ ID NO: 26421 - RNA, 32 nt, Human
aagggaggguggcagagacagugggcacuaag

SEQ ID NO: 26422 - RNA, 32 nt, Human
aagggaggguuccuaaucuaaaaggaaacaug

SEQ ID NO: 26423 - RNA, 32 nt, Human
aagggagguccccacagagccagagugccuga

SEQ ID NO: 26424 - RNA, 32 nt, Human
aagggagguguucccaucugagcccagagaua

SEQ ID NO: 26425 - RNA, 32 nt, Human
aagggaguaaccaaagagaguauggaccagag

SEQ ID NO: 26426 - RNA, 32 nt, Human
aagggaguaaguagagguggcuucagaaaugg

SEQ ID NO: 26427 - RNA, 32 nt, Human
aagggagugaugggccaguacaacaccccuuc

SEQ ID NO: 26428 - RNA, 22 nt, Human
aagggaguggaucaccugaggu

SEQ ID NO: 26429 - RNA, 32 nt, Human
aagggagugggugggcagggguagaggagggg

SEQ ID NO: 26430 - RNA, 32 nt, Human
aagggaguucucuguccugccuugaagggaag

SEQ ID NO: 26431 - RNA, 32 nt, Human
aagggaguuuaaguuugcaguuacaggccagu

SEQ ID NO: 26432 - RNA, 32 nt, Human
aagggauaaaccuggggugggcuggggcugag

SEQ ID NO: 26433 - RNA, 32 nt, Human
aagggauaaaggccuuuuacagaagcuaaacc

SEQ ID NO: 26434 - RNA, 32 nt, Human
aagggauaauacaaauccuaugaucucuaugc

SEQ ID NO: 26435 - RNA, 32 nt, Human
aagggauauaaaucuaguccauuuuucuuuuc

SEQ ID NO: 26436 - RNA, 32 nt, Human
aagggauauauuuucuugcacaguuguucaaa

SEQ ID NO: 26437 - RNA, 32 nt, Human
aagggaucagagucugacugucacucagaauc

SEQ ID NO: 26438 - RNA, 32 nt, Human
aagggaucaucucugcaacaaaggacacaaua

SEQ ID NO: 26439 - RNA, 28 nt, Human
aagggauccaaggcugccucuuccucuu

SEQ ID NO: 26440 - RNA, 32 nt, Human
aagggauccagggcugugcaggaugugccuug

SEQ ID NO: 26441 - RNA, 32 nt, Human
aagggauccuaaaagaggcgguggaagugaaa

SEQ ID NO: 26442 - RNA, 32 nt, Human
aagggauccuccugccucggccugccaaguag

SEQ ID NO: 26443 - RNA, 32 nt, Human
aagggaugagccaccgcgccuggcccauuucu

SEQ ID NO: 26444 - RNA, 32 nt, Human
aagggauggcggcagaccaggggccaggccaa

SEQ ID NO: 26445 - RNA, 24 nt, Human
aagggauggugaaggagggaaaag

SEQ ID NO: 26446 - RNA, 32 nt, Human
aagggaugugugacuguggguggggacgugug

SEQ ID NO: 26447 - RNA, 32 nt, Human
aagggauguuacagaguagcugagaugacuga

SEQ ID NO: 26448 - RNA, 32 nt, Human
aagggauucuaccaguaugugcuacuacuaac

SEQ ID NO: 26449 - RNA, 32 nt, Human
aagggauuucaaccucugaccaccuggagaca

SEQ ID NO: 26450 - RNA, 18 nt, Human
aagggcaaaauaggcuga

SEQ ID NO: 26451 - RNA, 32 nt, Human
aagggcaacagacuacacgauuggacgugugu

SEQ ID NO: 26452 - RNA, 32 nt, Human
aagggcaacauaguacuucuccuucacccaua

SEQ ID NO: 26453 - RNA, 20 nt, Human
aagggcaaccccaugacuga

SEQ ID NO: 26454 - RNA, 32 nt, Human
aagggcaaccucccuuucacugcuccaguggc

SEQ ID NO: 26455 - RNA, 32 nt, Human
aagggcaagagaacccagagcaaugacaccag

SEQ ID NO: 26456 - RNA, 32 nt, Human
aagggcaaggagcaggcuuggagccagggacc

SEQ ID NO: 26457 - RNA, 32 nt, Human
aagggcaauuuuaaaaguaggacugugauuaa

SEQ ID NO: 26458 - RNA, 22 nt, Human
aagggcacaaagacagccaugg

SEQ ID NO: 26459 - RNA, 18 nt, Human
aagggcacaagaggcgga

SEQ ID NO: 26460 - RNA, 32 nt, Human
aagggcacaaggaaaucuccucuaucaaaaca

SEQ ID NO: 26461 - RNA, 22 nt, Human
aagggcacaagguggcgccagg

SEQ ID NO: 26462 - RNA, 32 nt, Human
aagggcacaaguccuggauguuguguguaucg

SEQ ID NO: 26463 - RNA, 31 nt, Human
aagggcacacaaguucacacagcagagucag

SEQ ID NO: 26464 - RNA, 32 nt, Human
aagggcacagagaggaagggaagaauuggggg

SEQ ID NO: 26465 - RNA, 32 nt, Human
aagggcacagcaucuguagucagccgacaacu

SEQ ID NO: 26466 - RNA, 32 nt, Human
aagggcacagccaagauucagagccaggcugu

SEQ ID NO: 26467 - RNA, 32 nt, Human
aagggcacagccaggcuggagucagugucugc

SEQ ID NO: 26468 - RNA, 32 nt, Human
aagggcacagccucaagcccacugccuguguu

SEQ ID NO: 26469 - RNA, 32 nt, Human
aagggcacagucagguucaccagcagaaacgc

SEQ ID NO: 26470 - RNA, 32 nt, Human
aagggcacaucuugcuuugaacacuugauuuc

SEQ ID NO: 26471 - RNA, 32 nt, Human
aagggcacauggaguauggaagggggcauguu

SEQ ID NO: 26472 - RNA, 32 nt, Human
aagggcaccagcagcauuccacacccagcucu

SEQ ID NO: 26473 - RNA, 32 nt, Human
aagggcacugaacuguugggugaaaguuaguu

SEQ ID NO: 26474 - RNA, 32 nt, Human
aagggcacugccuuuucugcuuugcuucgugg

SEQ ID NO: 26475 - RNA, 32 nt, Human
aagggcacugguuggcauucuccuuaaugugu

SEQ ID NO: 26476 - RNA, 32 nt, Human
aagggcacugguuggcguucuccuuaauguau

SEQ ID NO: 26477 - RNA, 20 nt, Human
aagggcacuuaggagaagga

SEQ ID NO: 26478 - RNA, 32 nt, Human
aagggcacuugaguuucccugcagucucccac

SEQ ID NO: 26479 - RNA, 32 nt, Human
aagggcagaaaacucuguguguguacaugugu

SEQ ID NO: 26480 - RNA, 32 nt, Human
aagggcagaagcuuccuacuuggcugacagcc

SEQ ID NO: 26481 - RNA, 32 nt, Human
aagggcagagccagaagcaagccgugccaggc

SEQ ID NO: 26482 - RNA, 32 nt, Human
aagggcagaguaagagaaaagauggaaugagu

SEQ ID NO: 26483 - RNA, 32 nt, Human
aagggcagagucccaggugucagcuggugggu

SEQ ID NO: 26484 - RNA, 32 nt, Human
aagggcagagugagaaugugggaggacauucc

SEQ ID NO: 26485 - RNA, 32 nt, Human
aagggcagccaugcacucccccugggugucgc

SEQ ID NO: 26486 - RNA, 32 nt, Human
aagggcagccccaccccauccagccugggcuc

SEQ ID NO: 26487 - RNA, 32 nt, Human
aagggcagcccuccuuaccacuguggaagucc

SEQ ID NO: 26488 - RNA, 32 nt, Human
aagggcagccuggaggaaagagguguggugug

SEQ ID NO: 26489 - RNA, 32 nt, Human
aagggcagccugggggacagacuguuguggga

SEQ ID NO: 26490 - RNA, 32 nt, Human
aagggcagcuccgggggaaagaggguggcguc

SEQ ID NO: 26491 - RNA, 22 nt, Human
aagggcagcuggaagggacaca

SEQ ID NO: 26492 - RNA, 24 nt, Human
aagggcagcuucagucucugcagu

SEQ ID NO: 26493 - RNA, 32 nt, Human
aagggcaggaggcagcaggugcaccaggagca

SEQ ID NO: 26494 - RNA, 32 nt, Human
aagggcaggccuguucccugaggaccugcgca

SEQ ID NO: 26495 - RNA, 19 nt, Human
aagggcagggcaaggcuga

SEQ ID NO: 26496 - RNA, 19 nt, Human
aagggcagggcugggguga

SEQ ID NO: 26497 - RNA, 32 nt, Human
aagggcaggguggccucugcugcuagggccuc

SEQ ID NO: 26498 - RNA, 32 nt, Human
aagggcaguccggcggcguucgccaagguggc

SEQ ID NO: 26499 - RNA, 32 nt, Human
aagggcagugagaggaagggagggaugaggag

SEQ ID NO: 26500 - RNA, 32 nt, Human
aagggcagugccuggacggacccggagccccc

SEQ ID NO: 26501 - RNA, 32 nt, Human
aagggcagugccuguaauaccccacacaaguu

SEQ ID NO: 26502 - RNA, 19 nt, Human
aagggcaguuccgggccgg

SEQ ID NO: 26503 - RNA, 32 nt, Human
aagggcaguuuacuagaauuucuaucaaaaau

SEQ ID NO: 26504 - RNA, 32 nt, Human
aagggcauauuuugacucccucugugccucuu

SEQ ID NO: 26505 - RNA, 32 nt, Human
aagggcaucacugggucugcuggcuucuacac

SEQ ID NO: 26506 - RNA, 32 nt, Human
aagggcaucuccagccucaggccggcaggucc

SEQ ID NO: 26507 - RNA, 32 nt, Human
aagggcaucuuugaugguacaagcagaggcuc

SEQ ID NO: 26508 - RNA, 32 nt, Human
aagggcaugagacccaggcagagugagcucuc

SEQ ID NO: 26509 - RNA, 32 nt, Human
aagggcaugcacgggccaugcacacggcuggu

SEQ ID NO: 26510 - RNA, 32 nt, Human
aagggccaaaggaccaucaugaggcuaaguug

SEQ ID NO: 26511 - RNA, 32 nt, Human
aagggccacagaguucugccacccugaacauu

SEQ ID NO: 26512 - RNA, 32 nt, Human
aagggccacagcucuucucuccuucucucuuc

SEQ ID NO: 26513 - RNA, 32 nt, Human
aagggccacaggcuaggggaauaacgaggcca

SEQ ID NO: 26514 - RNA, 22 nt, Human
aagggccacuuaauucugcagu

SEQ ID NO: 26515 - RNA, 32 nt, Human
aagggccagaaauguggagacaugguuuuugu

SEQ ID NO: 26516 - RNA, 32 nt, Human
aagggccagaggaggugggagcagagggagcu

SEQ ID NO: 26517 - RNA, 32 nt, Human
aagggccagguggcacaugccgguggucccag

SEQ ID NO: 26518 - RNA, 32 nt, Human
aagggccauucuuaaguucucuccuuaaacuu

SEQ ID NO: 26519 - RNA, 32 nt, Human
aagggcccagccuugggcugaauggcagcacc

SEQ ID NO: 26520 - RNA, 32 nt, Human
aagggcccauuuccuccccucucuaccugcag

SEQ ID NO: 26521 - RNA, 32 nt, Human
aagggccccacuguggaaccuaagucugggag

SEQ ID NO: 26522 - RNA, 32 nt, Human
aagggccccucuguaucuagccuggaaccaag

SEQ ID NO: 26523 - RNA, 32 nt, Human
aagggccccuguguccccgcauggcccaccuc

SEQ ID NO: 26524 - RNA, 32 nt, Human
aagggcccuacccagaggacagaaagaaagcc

SEQ ID NO: 26525 - RNA, 32 nt, Human
aagggcccuccccaggcaucucauucauuacu

SEQ ID NO: 26526 - RNA, 32 nt, Human
aagggcccugcucaccccaagguaggcuggga

SEQ ID NO: 26527 - RNA, 32 nt, Human
aagggcccuguauucaccuccacugcccccag

SEQ ID NO: 26528 - RNA, 32 nt, Human
aagggccggagccgccuuucugcucccggaau

SEQ ID NO: 26529 - RNA, 32 nt, Human
aagggccuacagcccauuucuccauacgcacu

SEQ ID NO: 26530 - RNA, 32 nt, Human
aagggccuaccuggccccucgccuguggagcu

SEQ ID NO: 26531 - RNA, 32 nt, Human
aagggccuccuuccucccuggccugcagcugg

SEQ ID NO: 26532 - RNA, 32 nt, Human
aagggccucugccuucauuucuccugucaccu

SEQ ID NO: 26533 - RNA, 32 nt, Human
aagggccugaaggacgggauuaucuuaugcac

SEQ ID NO: 26534 - RNA, 32 nt, Human
aagggccugaggcagauccagaggacaagccu

SEQ ID NO: 26535 - RNA, 32 nt, Human
aagggccugaggggcucggcugccucaucccc

SEQ ID NO: 26536 - RNA, 32 nt, Human
aagggccugccucugaccugccguguccuuug

SEQ ID NO: 26537 - RNA, 32 nt, Human
aagggccugccuggccccucgccuguggagcu

SEQ ID NO: 26538 - RNA, 32 nt, Human
aagggccugcugaggucacacagcuguuggug

SEQ ID NO: 26539 - RNA, 32 nt, Human
aagggccuggacacucacagaggcccccucug

SEQ ID NO: 26540 - RNA, 32 nt, Human
aagggccuggcauggcagaggccaggcagccg

SEQ ID NO: 26541 - RNA, 32 nt, Human
aagggccuggcugccuuggauuucuugguccu

SEQ ID NO: 26542 - RNA, 32 nt, Human
aagggccuguaaucccguccaacaggcuggag

SEQ ID NO: 26543 - RNA, 32 nt, Human
aagggcgcuagugccuaaccucacuggucccu

SEQ ID NO: 26544 - RNA, 32 nt, Human
aagggcggagcgccgggcuggggaugagcuaa

SEQ ID NO: 26545 - RNA, 32 nt, Human
aagggcggcacuggagagaugggcccaucauu

SEQ ID NO: 26546 - RNA, 32 nt, Human
aagggcggcccaggcagagacagcacugccaa

SEQ ID NO: 26547 - RNA, 32 nt, Human
aagggcggcggaaggguguccaggcagaggaa

SEQ ID NO: 26548 - RNA, 32 nt, Human
aagggcgggccuguuuggugaggaccugcggc

SEQ ID NO: 26549 - RNA, 32 nt, Human
aagggcgggggcggaggaggagcgagccgggc

SEQ ID NO: 26550 - RNA, 32 nt, Human
aagggcggggucaagacacgggaugacgggaa

SEQ ID NO: 26551 - RNA, 32 nt, Human
aagggcggggugagggaagaaagacccuuuag

SEQ ID NO: 26552 - RNA, 18 nt, Human
aagggcuaaaguuggaga

SEQ ID NO: 26553 - RNA, 32 nt, Human
aagggcuaagacgacucuuccacacacagguc

SEQ ID NO: 26554 - RNA, 32 nt, Human
aagggcuaaggagaagaggaagguaaugguaa

SEQ ID NO: 26555 - RNA, 32 nt, Human
aagggcuacuggagggacaggugaagugauuu

SEQ ID NO: 26556 - RNA, 32 nt, Human
aagggcuacuugguuaaaugcagagaagaaug

SEQ ID NO: 26557 - RNA, 24 nt, Human
aagggcuagaauuacaggugugag

SEQ ID NO: 26558 - RNA, 32 nt, Human
aagggcuaucagaaacaauuuuaagucccugc

SEQ ID NO: 26559 - RNA, 32 nt, Human
aagggcuaucucuggcaccucugagaucccua

SEQ ID NO: 26560 - RNA, 31 nt, Human
aagggcucaauaaauguuagcugaaugaaaa

SEQ ID NO: 26561 - RNA, 32 nt, Human
aagggcucagccacaucuuggggucugggagg

SEQ ID NO: 26562 - RNA, 32 nt, Human
aagggcucagccuccucuccugggguccagcu

SEQ ID NO: 26563 - RNA, 32 nt, Human
aagggcucagccugugauaggcauucaauaaa

SEQ ID NO: 26564 - RNA, 32 nt, Human
aagggcuccaaucagggauuugcaggagcuug

SEQ ID NO: 26565 - RNA, 32 nt, Human
aagggcucccacauccgugagccuguguccgc

SEQ ID NO: 26566 - RNA, 32 nt, Human
aagggcuccggcuggcaccugaggagcggcgu

SEQ ID NO: 26567 - RNA, 32 nt, Human
aagggcuccucacggggguggagggagccgga

SEQ ID NO: 26568 - RNA, 32 nt, Human
aagggcuccuugcccaaugccaagugcugggg

SEQ ID NO: 26569 - RNA, 32 nt, Human
aagggcucucucuaggcagagagagcaacaug

SEQ ID NO: 26570 - RNA, 32 nt, Human
aagggcucuggacagcucaggcuggccggcca

SEQ ID NO: 26571 - RNA, 32 nt, Human
aagggcucuggcucagguugcagacagcugag

SEQ ID NO: 26572 - RNA, 32 nt, Human
aagggcucugugguaucucuggccacauuugu

SEQ ID NO: 26573 - RNA, 32 nt, Human
aagggcugaccuucucccagggucugccgagg

SEQ ID NO: 26574 - RNA, 31 nt, Human
aagggcugacuucuccaggaccuagucgggg

SEQ ID NO: 26575 - RNA, 32 nt, Human
aagggcugcagucaccccuugugcucacccau

SEQ ID NO: 26576 - RNA, 32 nt, Human
aagggcugccacugcacuuagcacuuucaggc

SEQ ID NO: 26577 - RNA, 32 nt, Human
aagggcugcuuugucaggagguuguggaauuu

SEQ ID NO: 26578 - RNA, 32 nt, Human
aagggcuggccuucagggaccccugguggguc

SEQ ID NO: 26579 - RNA, 32 nt, Human
aagggcugggauuacaggaaugagccagcgcu

SEQ ID NO: 26580 - RNA, 24 nt, Human
aagggcugggauuacaggugugag

SEQ ID NO: 26581 - RNA, 32 nt, Human
aagggcugggccaggccaggcuccagcaggcc

SEQ ID NO: 26582 - RNA, 32 nt, Human
aagggcuguaggaauggaagcuucagggccuu

SEQ ID NO: 26583 - RNA, 32 nt, Human
aagggcuguuaaaaauguaaaacuugguugca

SEQ ID NO: 26584 - RNA, 32 nt, Human
aagggcuucaggcugggggcaguggacaggga

SEQ ID NO: 26585 - RNA, 22 nt, Human
aagggcuucucucccucugccu

SEQ ID NO: 26586 - RNA, 32 nt, Human
aagggcuugacuuaggguugggccaggaaaag

SEQ ID NO: 26587 - RNA, 32 nt, Human
aagggcuuggcuugccagaggaauuuuccaag

SEQ ID NO: 26588 - RNA, 32 nt, Human
aagggcuugggcccccagccccagaagaugcu

SEQ ID NO: 26589 - RNA, 32 nt, Human
aagggcuugugucuucaggggcagcucagcuu

SEQ ID NO: 26590 - RNA, 32 nt, Human
aagggcuuugaacaaccuccuccagggacuuu

SEQ ID NO: 26591 - RNA, 21 nt, Human
aaggggaaagaaagggaaaag

SEQ ID NO: 26592 - RNA, 21 nt, Human
aaggggaaagacacagacuca

SEQ ID NO: 26593 - RNA, 24 nt, Human
aaggggaaauggggaggggaaaag

SEQ ID NO: 26594 - RNA, 32 nt, Human
aaggggaacagaucaggcaaaggaguuagaua

SEQ ID NO: 26595 - RNA, 21 nt, Human
aaggggaagccucugggcuga

SEQ ID NO: 26596 - RNA, 32 nt, Human
aaggggaagcucacaacaggaacucacacaaa

SEQ ID NO: 26597 - RNA, 32 nt, Human
aaggggaaggaagagagagggagcaggcggag

SEQ ID NO: 26598 - RNA, 32 nt, Human
aaggggaaggagaagagggagaauggagcagg

SEQ ID NO: 26599 - RNA, 32 nt, Human
aaggggaaggagaggggagagcagcgacaggc

SEQ ID NO: 26600 - RNA, 21 nt, Human
aaggggaauggaagagaaaag

SEQ ID NO: 26601 - RNA, 32 nt, Human
aaggggacaagaaaaucccucuuccuccaugg

SEQ ID NO: 26602 - RNA, 21 nt, Human
aaggggacaaggaaggaaaag

SEQ ID NO: 26603 - RNA, 32 nt, Human
aaggggacaccaacugcccaguccacuggcca

SEQ ID NO: 26604 - RNA, 32 nt, Human
aaggggacagcgccaccucuugucagugcucg

SEQ ID NO: 26605 - RNA, 17 nt, Human
aaggggacagcucaggg

SEQ ID NO: 26606 - RNA, 32 nt, Human
aaggggacaugcugggaacaggcccuaagccu

SEQ ID NO: 26607 - RNA, 23 nt, Human
aaggggacauggagaugagccag

SEQ ID NO: 26608 - RNA, 24 nt, Human
aaggggacauuaccaccaacccca

SEQ ID NO: 26609 - RNA, 32 nt, Human
aaggggacccacaaguauugcccuuuaacaag

SEQ ID NO: 26610 - RNA, 32 nt, Human
aaggggacccccaggugggaggggcaggaagc

SEQ ID NO: 26611 - RNA, 32 nt, Human
aaggggacccuccaugcuugauggccagaggu

SEQ ID NO: 26612 - RNA, 32 nt, Human
aaggggaccuggaagggaggugggccguggcc

SEQ ID NO: 26613 - RNA, 32 nt, Human
aaggggacggcaacuccuccccgcgcccgccg

SEQ ID NO: 26614 - RNA, 32 nt, Human
aaggggacuaacagcagaaucuaccucccaac

SEQ ID NO: 26615 - RNA, 32 nt, Human
aaggggagaaacaggauggaagggugguuuaa

SEQ ID NO: 26616 - RNA, 32 nt, Human
aaggggagaacgucuccagacagaauucuaca

SEQ ID NO: 26617 - RNA, 32 nt, Human
aaggggagaauggauuuaucaggagugaaaaa

SEQ ID NO: 26618 - RNA, 32 nt, Human
aaggggagagagaaggaauggggagugaauau

SEQ ID NO: 26619 - RNA, 17 nt, Human
aaggggagaugguccca

SEQ ID NO: 26620 - RNA, 32 nt, Human
aaggggagcaaaagagaaaaggagccaggcug

SEQ ID NO: 26621 - RNA, 32 nt, Human
aaggggagcagcggcugggagugagcagggca

SEQ ID NO: 26622 - RNA, 32 nt, Human
aaggggagcaggaggagagggaaguaguggca

SEQ ID NO: 26623 - RNA, 32 nt, Human
aaggggagcuccggaagaaccuggaggagcua

SEQ ID NO: 26624 - RNA, 23 nt, Human
aaggggagcugaaaaggggaaag

SEQ ID NO: 26625 - RNA, 32 nt, Human
aaggggagcugagaagccaaccccuagcccag

SEQ ID NO: 26626 - RNA, 32 nt, Human
aaggggagcugggugugaguguuuacacugug

SEQ ID NO: 26627 - RNA, 32 nt, Human
aaggggaggaaaggaaaaggauggacaaccac

SEQ ID NO: 26628 - RNA, 32 nt, Human
aaggggaggaagaaaggaaugaaggcagaaaa

SEQ ID NO: 26629 - RNA, 32 nt, Human
aaggggaggagagaaaucagagguggcgcgcg

SEQ ID NO: 26630 - RNA, 32 nt, Human
aaggggaggagggcgaggcgggaggugcagga

SEQ ID NO: 26631 - RNA, 32 nt, Human
aaggggaggcagaucucaaacuccaggcucag

SEQ ID NO: 26632 - RNA, 32 nt, Human
aaggggaggcaugauucuucugacccuagaaa

SEQ ID NO: 26633 - RNA, 32 nt, Human
aaggggagggaaagaucauuacauuugucagg

SEQ ID NO: 26634 - RNA, 32 nt, Human
aaggggagggagaagggaggaagcucccaugu

SEQ ID NO: 26635 - RNA, 32 nt, Human
aaggggagggcugugcgugggggagaugagga

SEQ ID NO: 26636 - RNA, 32 nt, Human
aaggggagggggaaggcaagaaucacugaaaa

SEQ ID NO: 26637 - RNA, 32 nt, Human
aaggggaggggguggagacugggacaugggaa

SEQ ID NO: 26638 - RNA, 32 nt, Human
aaggggaggguacugaggggcagauggcucca

SEQ ID NO: 26639 - RNA, 32 nt, Human
aaggggaggugcccagugaaauggagccuguc

SEQ ID NO: 26640 - RNA, 32 nt, Human
aaggggagguuagggagguuugaagagugaga

SEQ ID NO: 26641 - RNA, 32 nt, Human
aaggggauauaggaagacaggacucuauuaga

SEQ ID NO: 26642 - RNA, 32 nt, Human
aaggggaucugcaggguagagggcaaauuauu

SEQ ID NO: 26643 - RNA, 31 nt, Human
aaggggaugacguagcuuugccaaagacuua

SEQ ID NO: 26644 - RNA, 32 nt, Human
aaggggaugaggaaggcaugccuggacaaacc

SEQ ID NO: 26645 - RNA, 21 nt, Human
aaggggaugcuucccucugcc

SEQ ID NO: 26646 - RNA, 32 nt, Human
aaggggauggaagcagccucuuguacacauug

SEQ ID NO: 26647 - RNA, 32 nt, Human
aaggggaugggaagacuagggagccagugcca

SEQ ID NO: 26648 - RNA, 32 nt, Human
aaggggauuucucacuucaauuauagaucaua

SEQ ID NO: 26649 - RNA, 32 nt, Human
aaggggcaacaccaggugacaugugaauggau

SEQ ID NO: 26650 - RNA, 32 nt, Human
aaggggcaacccaaggcaucacaguucacagg

SEQ ID NO: 26651 - RNA, 32 nt, Human
aaggggcagagcuggcagagaggggccuccaa

SEQ ID NO: 26652 - RNA, 32 nt, Human
aaggggcaggagugccugggcaugugucugug

SEQ ID NO: 26653 - RNA, 32 nt, Human
aaggggcaggaguuggaauuaguuggucccua

SEQ ID NO: 26654 - RNA, 32 nt, Human
aaggggcaggcugaggcugggggaggggcuca

SEQ ID NO: 26655 - RNA, 32 nt, Human
aaggggcagggaggggacaucugagggcuuca

SEQ ID NO: 26656 - RNA, 32 nt, Human
aaggggcaggguggaaguggcugcaggcaaca

SEQ ID NO: 26657 - RNA, 32 nt, Human
aaggggcaggugcagagguggcagggauggcu

SEQ ID NO: 26658 - RNA, 32 nt, Human
aaggggccaaccagcuacuggagcucuuugac

SEQ ID NO: 26659 - RNA, 32 nt, Human
aaggggccaauagcaagguugcauggggauaa

SEQ ID NO: 26660 - RNA, 18 nt, Human
aaggggccacagcugcuc

SEQ ID NO: 26661 - RNA, 32 nt, Human
aaggggccagaguggaggguaggagugccacu

SEQ ID NO: 26662 - RNA, 21 nt, Human
aaggggccaggacacagcuca

SEQ ID NO: 26663 - RNA, 17 nt, Human
aaggggcccaacccugc

SEQ ID NO: 26664 - RNA, 23 nt, Human
aaggggcccacaaaggggagaag

SEQ ID NO: 26665 - RNA, 21 nt, Human
aaggggcccaccaccacugcc

SEQ ID NO: 26666 - RNA, 18 nt, Human
aaggggcccagaaaucug

SEQ ID NO: 26667 - RNA, 32 nt, Human
aaggggcccagccugaggaacccuggcucuuu

SEQ ID NO: 26668 - RNA, 28 nt, Human
aaggggcccaucauuuggaaagggaaaa

SEQ ID NO: 26669 - RNA, 32 nt, Human
aaggggccgaagaaagaggagugaggcagggg

SEQ ID NO: 26670 - RNA, 32 nt, Human
aaggggccucauccacugucugcuagcaaaga

SEQ ID NO: 26671 - RNA, 32 nt, Human
aaggggccucgaggacucucugcgucucugga

SEQ ID NO: 26672 - RNA, 32 nt, Human
aaggggccucuacccacaccuggaccuccgug

SEQ ID NO: 26673 - RNA, 32 nt, Human
aaggggccucuccuggacaugucuccugcagc

SEQ ID NO: 26674 - RNA, 32 nt, Human
aaggggccuggacugcaggccugaccugcucc

SEQ ID NO: 26675 - RNA, 32 nt, Human
aaggggccuggaggaggagggggaccagccag

SEQ ID NO: 26676 - RNA, 32 nt, Human
aaggggcgccucacacccucuucccacgacug

SEQ ID NO: 26677 - RNA, 32 nt, Human
aaggggcggcuccggcgggcggacucggagcg

SEQ ID NO: 26678 - RNA, 32 nt, Human
aaggggcuacuuccugcgcggaguaggagagu

SEQ ID NO: 26679 - RNA, 21 nt, Human
aaggggcuaggcaaggggaaa

SEQ ID NO: 26680 - RNA, 24 nt, Human
aaggggcuauauugaagggcaaag

SEQ ID NO: 26681 - RNA, 32 nt, Human
aaggggcuccagccuggcaguuucugcguguu

SEQ ID NO: 26682 - RNA, 32 nt, Human
aaggggcucuccccauuuuauggacaagaaga

SEQ ID NO: 26683 - RNA, 32 nt, Human
aaggggcucugcccucccuccuuccuucuugc

SEQ ID NO: 26684 - RNA, 32 nt, Human
aaggggcugaaccauacacuccuuuuucuaca

SEQ ID NO: 26685 - RNA, 19 nt, Human
aaggggcugaacuucaggg

SEQ ID NO: 26686 - RNA, 32 nt, Human
aaggggcugcaccagcccugagaccucaaaga

SEQ ID NO: 26687 - RNA, 32 nt, Human
aaggggcugcaggagacuccagggcagggaga

SEQ ID NO: 26688 - RNA, 32 nt, Human
aaggggcugccugggcucagcuaccugcccaa

SEQ ID NO: 26689 - RNA, 32 nt, Human
aaggggcuggauugauggaggcuggcaaggga

SEQ ID NO: 26690 - RNA, 32 nt, Human
aaggggcuggugcccccaugcccacccuccug

SEQ ID NO: 26691 - RNA, 32 nt, Human
aaggggcuguggggugaaauguugacuggaag

SEQ ID NO: 26692 - RNA, 32 nt, Human
aaggggcuuccagagguggccgcuucucuauu

SEQ ID NO: 26693 - RNA, 32 nt, Human
aaggggcuuugagaggcaaagaugaugggaua

SEQ ID NO: 26694 - RNA, 32 nt, Human
aagggggacacaugaaaggcaucagucccccu

SEQ ID NO: 26695 - RNA, 32 nt, Human
aagggggacugaggcaggagagagagcagcuc

SEQ ID NO: 26696 - RNA, 19 nt, Human
aagggggacugcaagggac

SEQ ID NO: 26697 - RNA, 32 nt, Human
aagggggaggaaaaugauguccccagccuaag

SEQ ID NO: 26698 - RNA, 32 nt, Human
aagggggaggggagacgaaggagaagcaaaca

SEQ ID NO: 26699 - RNA, 32 nt, Human
aagggggaggggccaugacuacgaggcccugg

SEQ ID NO: 26700 - RNA, 32 nt, Human
aagggggcaaaggcagggugaaucacuuucuu

SEQ ID NO: 26701 - RNA, 32 nt, Human
aagggggcaggggugagagagcaggagagcag

SEQ ID NO: 26702 - RNA, 32 nt, Human
aagggggcccuugcugauguucaucagauaug

SEQ ID NO: 26703 - RNA, 32 nt, Human
aagggggccuggcugagggugcuucuugacca

SEQ ID NO: 26704 - RNA, 32 nt, Human
aagggggcucuugggcaaacagucccaaaggc

SEQ ID NO: 26705 - RNA, 32 nt, Human
aagggggcugggacaugggaaaggggaaguug

SEQ ID NO: 26706 - RNA, 32 nt, Human
aagggggcugggcagaggguggaggagguccu

SEQ ID NO: 26707 - RNA, 32 nt, Human
aagggggcuguggacgucuuuggaauuuguua

SEQ ID NO: 26708 - RNA, 32 nt, Human
aagggggcuguugcugcagcucugacuugcuu

SEQ ID NO: 26709 - RNA, 21 nt, Human
aagggggucggcccaggggug

SEQ ID NO: 26710 - RNA, 32 nt, Human
aagggggugaagggaagugucugaugcacggc

SEQ ID NO: 26711 - RNA, 32 nt, Human
aagggggugggagaguggcgggcagagaccuc

SEQ ID NO: 26712 - RNA, 32 nt, Human
aagggggugguugucccaggaggcagcugcug

SEQ ID NO: 26713 - RNA, 20 nt, Human
aaggggguuaagaagggaaa

SEQ ID NO: 26714 - RNA, 32 nt, Human
aaggggguuagacucuagauguguguugucca

SEQ ID NO: 26715 - RNA, 32 nt, Human
aaggggguuagccaugaccucugccuugugug

SEQ ID NO: 26716 - RNA, 32 nt, Human
aagggguagggagagggaggagguugcaaaaa

SEQ ID NO: 26717 - RNA, 31 nt, Human
aagggguauggugccaucacaagcagaugug

SEQ ID NO: 26718 - RNA, 32 nt, Human
aaggggucaggaggaaaaagcuugcauuucug

SEQ ID NO: 26719 - RNA, 20 nt, Human
aaggggucuacccagaaagc

SEQ ID NO: 26720 - RNA, 32 nt, Human
aaggggucucagacuccccugaggguggagga

SEQ ID NO: 26721 - RNA, 22 nt, Human
aaggggugaacuuucacaguca

SEQ ID NO: 26722 - RNA, 32 nt, Human
aaggggugcaucugcacugucaccaugugccc

SEQ ID NO: 26723 - RNA, 32 nt, Human
aaggggugccugagcuguggagagggugcaca

SEQ ID NO: 26724 - RNA, 32 nt, Human
aagggguggagaaacaggaugggaaccggauu

SEQ ID NO: 26725 - RNA, 24 nt, Human
aagggguggcgaaggcacagcuca

SEQ ID NO: 26726 - RNA, 32 nt, Human
aagggguggcuagaguaacuaaccucagcagg

SEQ ID NO: 26727 - RNA, 32 nt, Human
aagggguggcucugcuguuuuucgcuggacuu

SEQ ID NO: 26728 - RNA, 32 nt, Human
aagggguggggcccuggguggagcucagcagg

SEQ ID NO: 26729 - RNA, 32 nt, Human
aagggguggggugaggggauggagagggaggg

SEQ ID NO: 26730 - RNA, 32 nt, Human
aaggggugucaaggcaggauggaaaaggggac

SEQ ID NO: 26731 - RNA, 32 nt, Human
aagggguuacagagagccuccucagaucuguu

SEQ ID NO: 26732 - RNA, 32 nt, Human
aagggguucccuuuuugguaccuuguaaccuu

SEQ ID NO: 26733 - RNA, 32 nt, Human
aagggguugcagcuguucugggcuguguuugg

SEQ ID NO: 26734 - RNA, 31 nt, Human
aagggguuuaauaaauaacccuugaaaacug

SEQ ID NO: 26735 - RNA, 32 nt, Human
aagggguuuccgcuuuggcuucucucucaucc

SEQ ID NO: 26736 - RNA, 32 nt, Human
aaggguaaccgauugggguagguggugguagu

SEQ ID NO: 26737 - RNA, 32 nt, Human
aaggguaacuucuuuacucaggagcuacucca

SEQ ID NO: 26738 - RNA, 32 nt, Human
aaggguaagcuggccugcugagcccagggcga

SEQ ID NO: 26739 - RNA, 32 nt, Human
aaggguaagggacuguucugaagaaccuuucc

SEQ ID NO: 26740 - RNA, 32 nt, Human
aaggguaagggagagggagggagccgggagcc

SEQ ID NO: 26741 - RNA, 32 nt, Human
aaggguaagggugagaugcuugggaugagagu

SEQ ID NO: 26742 - RNA, 31 nt, Human
aaggguaauuguuuuuccaugccaaaugagg

SEQ ID NO: 26743 - RNA, 20 nt, Human
aaggguacugaggcacucua

SEQ ID NO: 26744 - RNA, 32 nt, Human
aaggguagagagccacaguccccaaauccuau

SEQ ID NO: 26745 - RNA, 32 nt, Human
aaggguagccaagaauaggucucaccuguauu

SEQ ID NO: 26746 - RNA, 32 nt, Human
aaggguaggagguaggugagggauaaaagacu

SEQ ID NO: 26747 - RNA, 32 nt, Human
aaggguagggggaggggcuggggaagaucugu

SEQ ID NO: 26748 - RNA, 32 nt, Human
aaggguagggguauaagucuguuccaugcagu

SEQ ID NO: 26749 - RNA, 21 nt, Human
aaggguaucaccaagaagcca

SEQ ID NO: 26750 - RNA, 32 nt, Human
aaggguaucugcccuucuugccaggcagcucc

SEQ ID NO: 26751 - RNA, 32 nt, Human
aaggguauuugugcuuaaauguuaauauacaa

SEQ ID NO: 26752 - RNA, 32 nt, Human
aagggucaauuaugcauuccugugagucaggu

SEQ ID NO: 26753 - RNA, 32 nt, Human
aagggucacugcaccuccacccagagccucuu

SEQ ID NO: 26754 - RNA, 32 nt, Human
aagggucagccagcucacaaagguggccauuc

SEQ ID NO: 26755 - RNA, 21 nt, Human
aagggucagcuggcuucuccu

SEQ ID NO: 26756 - RNA, 32 nt, Human
aagggucaggggcaaggcggguucuagcugca

SEQ ID NO: 26757 - RNA, 32 nt, Human
aagggucaguuguuucugacccuuucugucgg

SEQ ID NO: 26758 - RNA, 32 nt, Human
aagggucaucccuaaaggcaaaaacagaacuu

SEQ ID NO: 26759 - RNA, 32 nt, Human
aagggucaugguccucaucacacacaugucau

SEQ ID NO: 26760 - RNA, 20 nt, Human
aaggguccccucucucugcc

SEQ ID NO: 26761 - RNA, 32 nt, Human
aagggucccugauuugugugcugguauguugg

SEQ ID NO: 26762 - RNA, 32 nt, Human
aagggucccuggaacguagggaggggcugggg

SEQ ID NO: 26763 - RNA, 32 nt, Human
aaggguccgugagcauggagagggggcaaaaa

SEQ ID NO: 26764 - RNA, 32 nt, Human
aaggguccucaccucuccccuaguacacuucu

SEQ ID NO: 26765 - RNA, 32 nt, Human
aaggguccugauugcuuguauuuuaagacauu

SEQ ID NO: 26766 - RNA, 32 nt, Human
aagggucuaguuuuccccuuguuucuaaagau

SEQ ID NO: 26767 - RNA, 32 nt, Human
aagggucucccaggcggcguaguagggcuucc

SEQ ID NO: 26768 - RNA, 32 nt, Human
aagggucugcagguuccaugggugacagccug

SEQ ID NO: 26769 - RNA, 32 nt, Human
aagggucugcaugccuguccucugccuuaucu

SEQ ID NO: 26770 - RNA, 32 nt, Human
aagggucuguucuguggcugagcuaggugaac

SEQ ID NO: 26771 - RNA, 18 nt, Human
aagggucuuugcuucuga

SEQ ID NO: 26772 - RNA, 32 nt, Human
aagggugaauuugaagaauuucagaaccacug

SEQ ID NO: 26773 - RNA, 32 nt, Human
aagggugaggagguggaaggagccggguggau

SEQ ID NO: 26774 - RNA, 29 nt, Human
aagggugaucuguguguucuuagacaaac

SEQ ID NO: 26775 - RNA, 32 nt, Human
aagggugauuauguauuacuuauccauuucug

SEQ ID NO: 26776 - RNA, 32 nt, Human
aagggugauuuucacacuucacauuuggcguu

SEQ ID NO: 26777 - RNA, 32 nt, Human
aagggugcagcccucaugaauggguuuagugc

SEQ ID NO: 26778 - RNA, 32 nt, Human
aagggugcagugagcuaugauugcaccauugc

SEQ ID NO: 26779 - RNA, 32 nt, Human
aagggugccacuggcaccacuggguggauggu

SEQ ID NO: 26780 - RNA, 20 nt, Human
aagggugccuggcuucugcu

SEQ ID NO: 26781 - RNA, 32 nt, Human
aagggugcugacauaaaguauuacaaaaaucu

SEQ ID NO: 26782 - RNA, 32 nt, Human
aaggguggacuuuaagcauggugacagauggu

SEQ ID NO: 26783 - RNA, 32 nt, Human
aaggguggaugugcuggagggguggcccagag

SEQ ID NO: 26784 - RNA, 31 nt, Human
aaggguggcaagagagaaguaaaaguugguu

SEQ ID NO: 26785 - RNA, 32 nt, Human
aaggguggcccaggcugugauuugccaucuac

SEQ ID NO: 26786 - RNA, 32 nt, Human
aaggguggcuuagugggugaccagccccugcg

SEQ ID NO: 26787 - RNA, 32 nt, Human
aagggugggccuggaugugggcuuccagagac

SEQ ID NO: 26788 - RNA, 30 nt, Human
aaggguggggauaucagggcacagucucca

SEQ ID NO: 26789 - RNA, 32 nt, Human
aagggugguaguuuucccuaaaauacuuauua

SEQ ID NO: 26790 - RNA, 32 nt, Human
aaggguggugggaggagauaagagauacaaac

SEQ ID NO: 26791 - RNA, 32 nt, Human
aaggguguaaguaauuaucgggaacaguguuu

SEQ ID NO: 26792 - RNA, 32 nt, Human
aagggugucuccuuagccuggagggagggaca

SEQ ID NO: 26793 - RNA, 32 nt, Human
aagggugugcaggaguucgccagcaaagccag

SEQ ID NO: 26794 - RNA, 32 nt, Human
aaggguguggagggaggaagggggucuaaggu

SEQ ID NO: 26795 - RNA, 32 nt, Human
aagggugugucucguccugcccgcacugccuc

SEQ ID NO: 26796 - RNA, 32 nt, Human
aaggguguguuuugugaaagaaaggaauuuug

SEQ ID NO: 26797 - RNA, 32 nt, Human
aaggguguuaaggggcaccaguggagguuuuc

SEQ ID NO: 26798 - RNA, 22 nt, Human
aaggguguugacccagaaucca

SEQ ID NO: 26799 - RNA, 32 nt, Human
aaggguuaggauuacaggcgugagccaccagg

SEQ ID NO: 26800 - RNA, 32 nt, Human
aaggguuagggcaccaggaggggccagguggc

SEQ ID NO: 26801 - RNA, 32 nt, Human
aaggguuauuccaggggcuacugaagaucuaa

SEQ ID NO: 26802 - RNA, 32 nt, Human
aaggguucacagagccagccuguggcucugac

SEQ ID NO: 26803 - RNA, 32 nt, Human
aaggguucucucuccugcuugcgcuuaguguc

SEQ ID NO: 26804 - RNA, 32 nt, Human
aaggguucuggcugccccaaccugcugaaggg

SEQ ID NO: 26805 - RNA, 21 nt, Human
aaggguugagaagaacucaaa

SEQ ID NO: 26806 - RNA, 32 nt, Human
aaggguugcagcugaauggcucuaaaagaguu

SEQ ID NO: 26807 - RNA, 32 nt, Human
aaggguugcugucccagcaggccagguccagg

SEQ ID NO: 26808 - RNA, 21 nt, Human
aaggguugggauuacaggugu

SEQ ID NO: 26809 - RNA, 32 nt, Human
aaggguugggauuacagguguaagccacugcu

SEQ ID NO: 26810 - RNA, 24 nt, Human
aaggguugggauuaccggcaugag

SEQ ID NO: 26811 - RNA, 32 nt, Human
aaggguuggggugagaacugagcccgagucga

SEQ ID NO: 26812 - RNA, 21 nt, Human
aaggguuggguagaugagcaa

SEQ ID NO: 26813 - RNA, 32 nt, Human
aaggguuggucuucugccagggucccuaagaa

SEQ ID NO: 26814 - RNA, 32 nt, Human
aaggguuguaggaccuuggcagagggggccug

SEQ ID NO: 26815 - RNA, 32 nt, Human
aaggguugugugugugcucaaccgugggcucc

SEQ ID NO: 26816 - RNA, 32 nt, Human
aaggguuuccaagagaucaccccaccagaaaa

SEQ ID NO: 26817 - RNA, 21 nt, Human
aaggguuugaguaaauacaaa

SEQ ID NO: 26818 - RNA, 32 nt, Human
aaggguuuuccagguguagcuaacaguugcca

SEQ ID NO: 26819 - RNA, 32 nt, Human
aagguaaaaugaugcgguguguccgcugcccc

SEQ ID NO: 26820 - RNA, 32 nt, Human
aagguaaaaugguacagccacuauggaaaaug

SEQ ID NO: 26821 - RNA, 23 nt, Human
aagguaacagugucuugcuucau

SEQ ID NO: 26822 - RNA, 32 nt, Human
aagguaacuguacaaaauaaguacaaugcaac

SEQ ID NO: 26823 - RNA, 32 nt, Human
aagguaagaaaaucaugugcucuuaaacuuga

SEQ ID NO: 26824 - RNA, 32 nt, Human
aagguaagaacugagaagggaggcaugaggcg

SEQ ID NO: 26825 - RNA, 31 nt, Human
aagguaagaaguaaauauguaaaagagauaa

SEQ ID NO: 26826 - RNA, 32 nt, Human
aagguaaggagacaggaggaguaggaggaggc

SEQ ID NO: 26827 - RNA, 32 nt, Human
aagguaaggaggaagagaguggaauggaaaaa

SEQ ID NO: 26828 - RNA, 32 nt, Human
aagguaaugacuuaaaauagcauuucaaaaac

SEQ ID NO: 26829 - RNA, 32 nt, Human
aagguaauguuuuuauaggucuuccuugugaa

SEQ ID NO: 26830 - RNA, 32 nt, Human
aagguaauucauacuggagaaaagccauacaa

SEQ ID NO: 26831 - RNA, 32 nt, Human
aagguacaccacuacacuccagccugggcaac

SEQ ID NO: 26832 - RNA, 32 nt, Human
aagguacaggcaggaugauccagggauugggc

SEQ ID NO: 26833 - RNA, 25 nt, Human
aagguacaguguguauguguguaug

SEQ ID NO: 26834 - RNA, 32 nt, Human
aagguaccauguaucucccaggguaaccugaa

SEQ ID NO: 26835 - RNA, 32 nt, Human
aagguaccugcaggauccacuugugucuauug

SEQ ID NO: 26836 - RNA, 32 nt, Human
aagguaccuuugggggcaacagcacccuaguu

SEQ ID NO: 26837 - RNA, 32 nt, Human
aagguacuaauuacugcccagccuggggagau

SEQ ID NO: 26838 - RNA, 32 nt, Human
aagguacuaugaguucucaggggucaaguuca

SEQ ID NO: 26839 - RNA, 32 nt, Human
aagguacuuucccucuucucucaggccaugca

SEQ ID NO: 26840 - RNA, 32 nt, Human
aagguagaaauguucaagcuuaugcacaggcu

SEQ ID NO: 26841 - RNA, 32 nt, Human
aagguagaagcgaguucccuucaugguugauu

SEQ ID NO: 26842 - RNA, 32 nt, Human
aagguagacaguguggcgacuggagaggucgg

SEQ ID NO: 26843 - RNA, 32 nt, Human
aagguagagcagcuacaagaugagaccaacca

SEQ ID NO: 26844 - RNA, 32 nt, Human
aagguagauagaagaaugucuagccaauaggu

SEQ ID NO: 26845 - RNA, 32 nt, Human
aagguagaugagagacagggcagggaaucugc

SEQ ID NO: 26846 - RNA, 32 nt, Human
aagguagauuuggaaucaugcauuuuagcaag

SEQ ID NO: 26847 - RNA, 32 nt, Human
aagguagcagcaagccagguaugguggcucac

SEQ ID NO: 26848 - RNA, 26 nt, Human
aagguagcgugggcccgaacaugcac

SEQ ID NO: 26849 - RNA, 32 nt, Human
aagguaggacucuagacaaaaccuucuauuuu

SEQ ID NO: 26850 - RNA, 32 nt, Human
aagguaggaggcacaucaauaaagaggaaacc

SEQ ID NO: 26851 - RNA, 32 nt, Human
aagguaggauaagacgacacagcagcaauaaa

SEQ ID NO: 26852 - RNA, 32 nt, Human
aagguagggaaagugggagagggacuuggagg

SEQ ID NO: 26853 - RNA, 23 nt, Human
aagguagguggaucaccuaaggu

SEQ ID NO: 26854 - RNA, 25 nt, Human
aagguaguagugagacgugaagcca

SEQ ID NO: 26855 - RNA, 32 nt, Human
aagguagucugccccuuccuuccucucucuuu

SEQ ID NO: 26856 - RNA, 32 nt, Human
aagguaguucuugcgaaugccaccccacuaag

SEQ ID NO: 26857 - RNA, 32 nt, Human
aagguauaacaugauggguauaagaggaaaag

SEQ ID NO: 26858 - RNA, 32 nt, Human
aagguauagcagcaguuagaauucuuugcaaa

SEQ ID NO: 26859 - RNA, 32 nt, Human
aagguauccuacccuggugaagcagcugcuuu

SEQ ID NO: 26860 - RNA, 32 nt, Human
aagguaucuuuuuauucauugcccucaggaaa

SEQ ID NO: 26861 - RNA, 32 nt, Human
aagguauggaagccaagggaaaacuuccccuu

SEQ ID NO: 26862 - RNA, 32 nt, Human
aagguauggggugggagccacaauugaggaua

SEQ ID NO: 26863 - RNA, 32 nt, Human
aagguauguugucuaacaggggaccaacagaa

SEQ ID NO: 26864 - RNA, 32 nt, Human
aagguauuaggauggugcaaaaguaacuugca

SEQ ID NO: 26865 - RNA, 32 nt, Human
aagguauucugaccuugugaacaucagaaggu

SEQ ID NO: 26866 - RNA, 19 nt, Human
aagguauugagacauauua

SEQ ID NO: 26867 - RNA, 32 nt, Human
aagguauuuuccucaaaaaccuuaaaugcaaa

SEQ ID NO: 26868 - RNA, 32 nt, Human
aaggucaaacaucagugagcaagcuguguaca

SEQ ID NO: 26869 - RNA, 32 nt, Human
aaggucaagccacuccugaauguggcucggca

SEQ ID NO: 26870 - RNA, 32 nt, Human
aaggucaaggggugcagccaggagggcagggg

SEQ ID NO: 26871 - RNA, 32 nt, Human
aaggucacaaguuugagaccagucuggccaac

SEQ ID NO: 26872 - RNA, 21 nt, Human
aaggucacacagugucgucca

SEQ ID NO: 26873 - RNA, 32 nt, Human
aaggucacaccacugcacuccagccugggcua

SEQ ID NO: 26874 - RNA, 32 nt, Human
aaggucacaccauugcacuccaaccugggcga

SEQ ID NO: 26875 - RNA, 32 nt, Human
aaggucacagccacacugaaaaugggaugugc

SEQ ID NO: 26876 - RNA, 32 nt, Human
aaggucacaggcuagaucaauauacagaaaau

SEQ ID NO: 26877 - RNA, 32 nt, Human
aaggucaccccacugaggaugcugcuggcagc

SEQ ID NO: 26878 - RNA, 32 nt, Human
aaggucaccugcacucccagccaaguggugau

SEQ ID NO: 26879 - RNA, 32 nt, Human
aaggucacgucacugcacucuagccugggcaa

SEQ ID NO: 26880 - RNA, 32 nt, Human
aaggucacuagaaaugggccagcugggucaau

SEQ ID NO: 26881 - RNA, 32 nt, Human
aaggucagacacacuucugaucuugggggcca

SEQ ID NO: 26882 - RNA, 32 nt, Human
aaggucagcaagauaagcagggccagucucag

SEQ ID NO: 26883 - RNA, 32 nt, Human
aaggucagcugcccccugcccucucucugggg

SEQ ID NO: 26884 - RNA, 32 nt, Human
aaggucaggaguucgagagcagccuggucaac

SEQ ID NO: 26885 - RNA, 32 nt, Human
aaggucaggaguugaagaccagccuggccaac

SEQ ID NO: 26886 - RNA, 32 nt, Human
aaggucaggaguuugagaccagccuggccaaa

SEQ ID NO: 26887 - RNA, 32 nt, Human
aaggucaggaguuugagaccagccuggccaac

SEQ ID NO: 26888 - RNA, 32 nt, Human
aaggucaggaguuugagaccagccuggccaag

SEQ ID NO: 26889 - RNA, 32 nt, Human
aaggucaggaguuugagaucagccuggccaau

SEQ ID NO: 26890 - RNA, 32 nt, Human
aaggucaggcauuugagaccagccuggccaac

SEQ ID NO: 26891 - RNA, 32 nt, Human
aaggucauauaauacauuguggagauugcuua

SEQ ID NO: 26892 - RNA, 21 nt, Human
aaggucaucaaacauuugcca

SEQ ID NO: 26893 - RNA, 32 nt, Human
aaggucaucuuggaugauuggaggacaacauc

SEQ ID NO: 26894 - RNA, 22 nt, Human
aaggucaugagcauucgugcua

SEQ ID NO: 26895 - RNA, 32 nt, Human
aaggucaugccacugcacuccagccugggaga

SEQ ID NO: 26896 - RNA, 32 nt, Human
aaggucaugccacugcacucuagccuggguga

SEQ ID NO: 26897 - RNA, 32 nt, Human
aaggucauuaggauuugcaccuuuguuuucuu

SEQ ID NO: 26898 - RNA, 32 nt, Human
aagguccaagccccaaccaaggggauucuucg

SEQ ID NO: 26899 - RNA, 32 nt, Human
aagguccacagcuucauuuuugaagucagcaa

SEQ ID NO: 26900 - RNA, 32 nt, Human
aagguccacagcuuuauucuugaagucagcga

SEQ ID NO: 26901 - RNA, 22 nt, Human
aagguccacuggacaguuggga

SEQ ID NO: 26902 - RNA, 32 nt, Human
aagguccagaguucaagagcagccuggccaac

SEQ ID NO: 26903 - RNA, 32 nt, Human
aaggucccagccccaggcagcccugucacagu

SEQ ID NO: 26904 - RNA, 32 nt, Human
aaggucccaguggaugagaugcuguccucugg

SEQ ID NO: 26905 - RNA, 32 nt, Human
aagguccccuggcaguggcccauccugucuuc

SEQ ID NO: 26906 - RNA, 32 nt, Human
aagguccggggcgacucucuguucauccuguc

SEQ ID NO: 26907 - RNA, 32 nt, Human
aagguccguagugcuaucuacauccagacggu

SEQ ID NO: 26908 - RNA, 32 nt, Human
aagguccguccucugugggcccaaaccuauuu

SEQ ID NO: 26909 - RNA, 32 nt, Human
aagguccuaaaagacaguuuugccaguggggc

SEQ ID NO: 26910 - RNA, 32 nt, Human
aagguccucacaauaacuaacugugugcuuuu

SEQ ID NO: 26911 - RNA, 32 nt, Human
aagguccuccacuccugaaccccugcagugac

SEQ ID NO: 26912 - RNA, 32 nt, Human
aagguccuccagggggccucggucugacacug

SEQ ID NO: 26913 - RNA, 32 nt, Human
aagguccugcagcccccuuccccugggugugu

SEQ ID NO: 26914 - RNA, 32 nt, Human
aagguccugccucuguccuguccccugagcca

SEQ ID NO: 26915 - RNA, 32 nt, Human
aagguccuguucuugccuugucugaacuugcc

SEQ ID NO: 26916 - RNA, 32 nt, Human
aagguccuugugcaucuuaccuuucccuuacc

SEQ ID NO: 26917 - RNA, 32 nt, Human
aaggucgcaccgcuacacuccagccuggguga

SEQ ID NO: 26918 - RNA, 32 nt, Human
aaggucgccaugaagaagacuugcuucaccaa

SEQ ID NO: 26919 - RNA, 32 nt, Human
aaggucgcgccacugcacuccagccugggcag

SEQ ID NO: 26920 - RNA, 32 nt, Human
aaggucgcgccacugcacuccagccugggcga

SEQ ID NO: 26921 - RNA, 32 nt, Human
aaggucgcgccacugcgcuccagccuggacaa

SEQ ID NO: 26922 - RNA, 32 nt, Human
aaggucgcgccauugcacuccagccugggcga

SEQ ID NO: 26923 - RNA, 32 nt, Human
aaggucgguggagucucccacagagcaucgcu

SEQ ID NO: 26924 - RNA, 32 nt, Human
aaggucguggacaaccaggcugggacccaggg

SEQ ID NO: 26925 - RNA, 24 nt, Human
aaggucgugugcauuugcuuucac

SEQ ID NO: 26926 - RNA, 32 nt, Human
aaggucguugcgggcagugccugcucccagcc

SEQ ID NO: 26927 - RNA, 32 nt, Human
aaggucuaaaugcccacuugaaugaagcugag

SEQ ID NO: 26928 - RNA, 24 nt, Human
aaggucuacuuccccagcaggaca

SEQ ID NO: 26929 - RNA, 32 nt, Human
aaggucuagauaggguuugcuauaggguuugc

SEQ ID NO: 26930 - RNA, 32 nt, Human
aaggucuagccaggcuccagacuggcuucaca

SEQ ID NO: 26931 - RNA, 32 nt, Human
aaggucucagcagagcccccaggagaguugga

SEQ ID NO: 26932 - RNA, 32 nt, Human
aaggucucagcuuuaagacacugaggcugguu

SEQ ID NO: 26933 - RNA, 32 nt, Human
aaggucucagggacgggcugcagccauguccu

SEQ ID NO: 26934 - RNA, 32 nt, Human
aaggucucaugcagggaaguggcaaaacacuu

SEQ ID NO: 26935 - RNA, 32 nt, Human
aaggucuccaagggagggugcagcccucuugc

SEQ ID NO: 26936 - RNA, 32 nt, Human
aaggucuccagccagggcuucugagaugcaaa

SEQ ID NO: 26937 - RNA, 32 nt, Human
aaggucuccagccucaucgaauucuugaagca

SEQ ID NO: 26938 - RNA, 32 nt, Human
aaggucuccauggcugagccugggggcucuua

SEQ ID NO: 26939 - RNA, 32 nt, Human
aaggucuccgugugggaaagcccuugggggau

SEQ ID NO: 26940 - RNA, 32 nt, Human
aaggucucugcagguuuaucugccuggagcga

SEQ ID NO: 26941 - RNA, 32 nt, Human
aaggucugagggaggaaggagcacaaggagug

SEQ ID NO: 26942 - RNA, 32 nt, Human
aaggucugagucuucauccagcccugccuguc

SEQ ID NO: 26943 - RNA, 32 nt, Human
aaggucugaucacaccugacugcacuccagcc

SEQ ID NO: 26944 - RNA, 32 nt, Human
aaggucugcaacuucacuccuggggccagcaa

SEQ ID NO: 26945 - RNA, 32 nt, Human
aaggucugcaggugccuguugucuggguuugg

SEQ ID NO: 26946 - RNA, 32 nt, Human
aaggucugcccagccagguggaucuaccuugc

SEQ ID NO: 26947 - RNA, 32 nt, Human
aaggucugcucuguucuaaucuuauggggcca

SEQ ID NO: 26948 - RNA, 32 nt, Human
aaggucuggaguucgagaccagccuggccaac

SEQ ID NO: 26949 - RNA, 32 nt, Human
aaggucugugaccuuuugcccuccaguugggg

SEQ ID NO: 26950 - RNA, 24 nt, Human
aaggucugugcaagcuggcuccug

SEQ ID NO: 26951 - RNA, 32 nt, Human
aaggucuuacugccauggugcuuuucaggggc

SEQ ID NO: 26952 - RNA, 32 nt, Human
aaggucuucaaggaguugguccagguagcaau

SEQ ID NO: 26953 - RNA, 32 nt, Human
aaggucuugcucugucccucaggcuggagugc

SEQ ID NO: 26954 - RNA, 32 nt, Human
aaggucuugcugucucaguauccugagucuua

SEQ ID NO: 26955 - RNA, 32 nt, Human
aaggucuuggggguaaagccacaggucauccu

SEQ ID NO: 26956 - RNA, 32 nt, Human
aaggucuugguuacacauguccaugcauucca

SEQ ID NO: 26957 - RNA, 32 nt, Human
aaggucuugucuucaaccuccccgucccguug

SEQ ID NO: 26958 - RNA, 32 nt, Human
aaggugaaagaauuugccucuaggaagcagga

SEQ ID NO: 26959 - RNA, 32 nt, Human
aaggugaaauccagcagccgcgccagcugguu

SEQ ID NO: 26960 - RNA, 32 nt, Human
aaggugaaccccuguccugaccaaaauugggc

SEQ ID NO: 26961 - RNA, 32 nt, Human
aaggugaaugagguaagggagaucagaaccau

SEQ ID NO: 26962 - RNA, 32 nt, Human
aaggugaauggcauguucagcaggugcagaaa

SEQ ID NO: 26963 - RNA, 32 nt, Human
aaggugacacuccaccaaccagagugagaggg

SEQ ID NO: 26964 - RNA, 32 nt, Human
aaggugacagggacuggagccauggcucagag

SEQ ID NO: 26965 - RNA, 32 nt, Human
aaggugaccagccuaacggccugccuagugga

SEQ ID NO: 26966 - RNA, 32 nt, Human
aaggugacucuuagcaaccucauuucgacagu

SEQ ID NO: 26967 - RNA, 32 nt, Human
aaggugacugacacaaagugacuuucagggcu

SEQ ID NO: 26968 - RNA, 32 nt, Human
aaggugagcuccagaagggaagggaguucuuu

SEQ ID NO: 26969 - RNA, 32 nt, Human
aaggugaggggaggggaggcuuuuucuaccug

SEQ ID NO: 26970 - RNA, 32 nt, Human
aaggugaggguaagggguugugaguugugucc

SEQ ID NO: 26971 - RNA, 23 nt, Human
aaggugaguggaucaccugaggu

SEQ ID NO: 26972 - RNA, 32 nt, Human
aaggugauaagaauacagggaaauggaauaag

SEQ ID NO: 26973 - RNA, 32 nt, Human
aaggugaugcagaugugaccuaggaugaugga

SEQ ID NO: 26974 - RNA, 32 nt, Human
aaggugauggacaguucacacuggacucccac

SEQ ID NO: 26975 - RNA, 32 nt, Human
aaggugauggugacggucacagcugcugguua

SEQ ID NO: 26976 - RNA, 31 nt, Human
aaggugauggugcuggggugugaguugucug

SEQ ID NO: 26977 - RNA, 32 nt, Human
aaggugauucucuucuaugccucucuccaacg

SEQ ID NO: 26978 - RNA, 32 nt, Human
aaggugauugaaaaggaaaagagugagugaac

SEQ ID NO: 26979 - RNA, 32 nt, Human
aaggugauuguaugcauaaaacaggugaugag

SEQ ID NO: 26980 - RNA, 32 nt, Human
aaggugauuucagacugcagaggggaaagacu

SEQ ID NO: 26981 - RNA, 32 nt, Human
aaggugcaaaaauauauacaauagucucauug

SEQ ID NO: 26982 - RNA, 32 nt, Human
aaggugcaaagucaguagagaagggaauguau

SEQ ID NO: 26983 - RNA, 32 nt, Human
aaggugcacauauuugggggaggcucauggac

SEQ ID NO: 26984 - RNA, 32 nt, Human
aaggugcaccguugccccagccccuuucuggc

SEQ ID NO: 26985 - RNA, 32 nt, Human
aaggugcagccuguguauaaggccugaagagg

SEQ ID NO: 26986 - RNA, 32 nt, Human
aaggugcagguguggagagagaggcuucaauc

SEQ ID NO: 26987 - RNA, 32 nt, Human
aaggugcaguauuacacaucaccagcugccuu

SEQ ID NO: 26988 - RNA, 32 nt, Human
aaggugcagucuagauuucagugagaacccug

SEQ ID NO: 26989 - RNA, 32 nt, Human
aaggugccacuagaagcgccaggcuggggccg

SEQ ID NO: 26990 - RNA, 32 nt, Human
aaggugccagcagccugcaggggaaaggcaaa

SEQ ID NO: 26991 - RNA, 32 nt, Human
aaggugcccagcugccagcccagcuccgcugc

SEQ ID NO: 26992 - RNA, 32 nt, Human
aaggugcccggcuugguaggggauaccagaca

SEQ ID NO: 26993 - RNA, 32 nt, Human
aaggugcccuccagcaugccuggcugauuuuu

SEQ ID NO: 26994 - RNA, 32 nt, Human
aaggugcccugagagguggcagcaucuuuugu

SEQ ID NO: 26995 - RNA, 32 nt, Human
aaggugccgcccucaucacaggcugggcaugg

SEQ ID NO: 26996 - RNA, 32 nt, Human
aaggugccuccuccucuccuuagcuggcccgu

SEQ ID NO: 26997 - RNA, 32 nt, Human
aaggugccuuucuuccccuucgccuucugcca

SEQ ID NO: 26998 - RNA, 32 nt, Human
aaggugccuuuguaccucagguguuuuaggug

SEQ ID NO: 26999 - RNA, 32 nt, Human
aaggugcggcaucuugcuguuguacuucugaa

SEQ ID NO: 27000 - RNA, 32 nt, Human
aaggugcguccucaccaugcuggauggugucc

SEQ ID NO: 27001 - RNA, 32 nt, Human
aaggugcuagaagccaggcccaggaagguucc

SEQ ID NO: 27002 - RNA, 32 nt, Human
aaggugcuagcacuuccguaaauuacuccaaa

SEQ ID NO: 27003 - RNA, 32 nt, Human
aaggugcucaaggaggacuugguuucaagggc

SEQ ID NO: 27004 - RNA, 32 nt, Human
aaggugcuccagaaagcaggaguugaagaccu

SEQ ID NO: 27005 - RNA, 32 nt, Human
aaggugcucccacuccagggcccagcacaucu

SEQ ID NO: 27006 - RNA, 32 nt, Human
aaggugcucugugccaaguuccucacucauuc

SEQ ID NO: 27007 - RNA, 25 nt, Human
aaggugcugagggggcccugaggca

SEQ ID NO: 27008 - RNA, 32 nt, Human
aaggugcugauccuaagaauuuuucauucuca

SEQ ID NO: 27009 - RNA, 32 nt, Human
aaggugcugcagagcccaggugcacuguguga

SEQ ID NO: 27010 - RNA, 32 nt, Human
aaggugcugccuucauccuccccaccuaaugc

SEQ ID NO: 27011 - RNA, 32 nt, Human
aaggugcuggauuacaggcaugagccaccucg

SEQ ID NO: 27012 - RNA, 32 nt, Human
aaggugcuggauuacagguguaagccaucaca

SEQ ID NO: 27013 - RNA, 32 nt, Human
aaggugcugucaccccucugcuggcgagcaug

SEQ ID NO: 27014 - RNA, 32 nt, Human
aaggugcuuccgagcugggaugagaggaagga

SEQ ID NO: 27015 - RNA, 32 nt, Human
aaggugcuuccgagcugggaugagaggaaggg

SEQ ID NO: 27016 - RNA, 32 nt, Human
aaggugcuugacaugcaagaggcuccacaaau

SEQ ID NO: 27017 - RNA, 32 nt, Human
aagguggaaagaggagaacguagcaaucuggc

SEQ ID NO: 27018 - RNA, 32 nt, Human
aagguggaagugaaaaagaacaacacugacac

SEQ ID NO: 27019 - RNA, 31 nt, Human
aagguggacuugucucccagucgaggcuggu

SEQ ID NO: 27020 - RNA, 32 nt, Human
aagguggagaaaagguuccuguggagccucag

SEQ ID NO: 27021 - RNA, 32 nt, Human
aagguggagagggaggagaagccugaauuggg

SEQ ID NO: 27022 - RNA, 32 nt, Human
aagguggaggcagaguuugagcugcugacugu

SEQ ID NO: 27023 - RNA, 32 nt, Human
aagguggaggguggggcuuggccaggagugac

SEQ ID NO: 27024 - RNA, 32 nt, Human
aagguggagggugugaaaugaugccccaguag

SEQ ID NO: 27025 - RNA, 32 nt, Human
aagguggaguagucgugugcucugccugaaga

SEQ ID NO: 27026 - RNA, 31 nt, Human
aagguggcaaugugugucaggugacuaucag

SEQ ID NO: 27027 - RNA, 32 nt, Human
aagguggcacuuccguucagauucauuuugcu

SEQ ID NO: 27028 - RNA, 32 nt, Human
aagguggcagugagcuauucaucgugccugua

SEQ ID NO: 27029 - RNA, 32 nt, Human
aagguggcaguggcuacaucugccuguuggac

SEQ ID NO: 27030 - RNA, 32 nt, Human
aagguggcaucuggagccuccuuuccccuucu

SEQ ID NO: 27031 - RNA, 32 nt, Human
aagguggccaagacccagggauaacuguggug

SEQ ID NO: 27032 - RNA, 32 nt, Human
aagguggccauggauggaugggcuguaucugu

SEQ ID NO: 27033 - RNA, 32 nt, Human
aagguggcccaagguucucuccccugcagcua

SEQ ID NO: 27034 - RNA, 32 nt, Human
aagguggcccuugagcacauuccuccgguaga

SEQ ID NO: 27035 - RNA, 32 nt, Human
aagguggcccuugucugugucuccugguuuuc

SEQ ID NO: 27036 - RNA, 32 nt, Human
aagguggccuauuccucuguguguucucugga

SEQ ID NO: 27037 - RNA, 22 nt, Human
aagguggccugacacugugcca

SEQ ID NO: 27038 - RNA, 32 nt, Human
aagguggccugggacuagacagccccucugag

SEQ ID NO: 27039 - RNA, 32 nt, Human
aagguggcgcuguggaggaggcagagaucaga

SEQ ID NO: 27040 - RNA, 32 nt, Human
aagguggcggugaccgaggggguggggacuga

SEQ ID NO: 27041 - RNA, 32 nt, Human
aagguggcggugguggagaaacagguggaaga

SEQ ID NO: 27042 - RNA, 32 nt, Human
aagguggcuaaggcagaggcugagggggcugg

SEQ ID NO: 27043 - RNA, 32 nt, Human
aagguggcugcauccaggaaaccacguacccu

SEQ ID NO: 27044 - RNA, 32 nt, Human
aaggugggaacacaguuaaugccuguaacacg

SEQ ID NO: 27045 - RNA, 32 nt, Human
aaggugggaagauugccugagcucaggaguuu

SEQ ID NO: 27046 - RNA, 32 nt, Human
aaggugggagaaggggguaucuuuagcagagg

SEQ ID NO: 27047 - RNA, 32 nt, Human
aaggugggagagagaguuugagacagcuccgu

SEQ ID NO: 27048 - RNA, 32 nt, Human
aaggugggaugaggacaugaacagaacauggc

SEQ ID NO: 27049 - RNA, 32 nt, Human
aaggugggauuacgccuguaaucccagcacuu

SEQ ID NO: 27050 - RNA, 23 nt, Human
aaggugggcagaucaccuaaggu

SEQ ID NO: 27051 - RNA, 23 nt, Human
aaggugggcagaucaccugaggu

SEQ ID NO: 27052 - RNA, 32 nt, Human
aaggugggcagauccccugagcucaggagucc

SEQ ID NO: 27053 - RNA, 32 nt, Human
aaggugggcagauugccugagcucaggaguuc

SEQ ID NO: 27054 - RNA, 32 nt, Human
aaggugggcagauugccugagcucaggaguuu

SEQ ID NO: 27055 - RNA, 32 nt, Human
aaggugggcaguuugccugagcucaggaguuu

SEQ ID NO: 27056 - RNA, 32 nt, Human
aaggugggcggaucaccugagaucgagaguuc

SEQ ID NO: 27057 - RNA, 22 nt, Human
aaggugggcggaucaccugagc

SEQ ID NO: 27058 - RNA, 32 nt, Human
aaggugggcggaucaccugagcucaggaguuu

SEQ ID NO: 27059 - RNA, 23 nt, Human
aaggugggcggaucaccugaggu

SEQ ID NO: 27060 - RNA, 32 nt, Human
aaggugggcggaucacuugagaucaggaguuc

SEQ ID NO: 27061 - RNA, 23 nt, Human
aaggugggcggaucaucugaggc

SEQ ID NO: 27062 - RNA, 32 nt, Human
aaggugggcgggucacuugagaucaggaguuc

SEQ ID NO: 27063 - RNA, 32 nt, Human
aagguggggaaacuguaagugaaccccugugg

SEQ ID NO: 27064 - RNA, 32 nt, Human
aaggugggguuggcagggggaggguaggagca

SEQ ID NO: 27065 - RNA, 23 nt, Human
aagguggguagaucaccugaggu

SEQ ID NO: 27066 - RNA, 23 nt, Human
aaggugggugaaucaccugaagu

SEQ ID NO: 27067 - RNA, 32 nt, Human
aaggugggugagccacugcccucaaacccggg

SEQ ID NO: 27068 - RNA, 23 nt, Human
aagguggguggaucaccugaggg

SEQ ID NO: 27069 - RNA, 23 nt, Human
aagguggguggaucaccugaggu

SEQ ID NO: 27070 - RNA, 23 nt, Human
aagguggguggaucacuugaagc

SEQ ID NO: 27071 - RNA, 23 nt, Human
aagguggguggaucacuugaggc

SEQ ID NO: 27072 - RNA, 23 nt, Human
aagguggguggaucaucuaaggc

SEQ ID NO: 27073 - RNA, 32 nt, Human
aagguggguggaucgcuugagcucaggaguuc

SEQ ID NO: 27074 - RNA, 32 nt, Human
aagguggguggcaggagggaacaggugccacc

SEQ ID NO: 27075 - RNA, 32 nt, Human
aagguggguggguugcuugagcucaggaguuu

SEQ ID NO: 27076 - RNA, 32 nt, Human
aagguggguuccagggacuguaccuguaggaa

SEQ ID NO: 27077 - RNA, 32 nt, Human
aaggugguaagaaagcagacuggccagggacu

SEQ ID NO: 27078 - RNA, 32 nt, Human
aaggugguacccccuucucuccccagccccau

SEQ ID NO: 27079 - RNA, 32 nt, Human
aaggugguccugccaggacacagccaucuaaa

SEQ ID NO: 27080 - RNA, 32 nt, Human
aagguggugucaggaacauacuugccuauggg

SEQ ID NO: 27081 - RNA, 32 nt, Human
aaggugguucauuggaggccaggaguuggaga

SEQ ID NO: 27082 - RNA, 32 nt, Human
aaggugguuccccagccgcucaaauuuccgga

SEQ ID NO: 27083 - RNA, 32 nt, Human
aaggugguucuguggccuuuucccucuuugcu

SEQ ID NO: 27084 - RNA, 32 nt, Human
aagguguagcaaguguacccacacagauagca

SEQ ID NO: 27085 - RNA, 32 nt, Human
aagguguauggaaaugccuagauauccaggca

SEQ ID NO: 27086 - RNA, 32 nt, Human
aaggugucacgaggaagaucagcucacugaga

SEQ ID NO: 27087 - RNA, 18 nt, Human
aaggugucaucagugggg

SEQ ID NO: 27088 - RNA, 32 nt, Human
aagguguccaugaucccuccccacugaccuuu

SEQ ID NO: 27089 - RNA, 32 nt, Human
aaggugucccacccuccccuccugacccuccu

SEQ ID NO: 27090 - RNA, 32 nt, Human
aaggugucucagacauuuggccaguaugucuu

SEQ ID NO: 27091 - RNA, 32 nt, Human
aaggugucugugcagauuuucccacugauuua

SEQ ID NO: 27092 - RNA, 32 nt, Human
aaggugugaaggagcaacuucaguugacacaa

SEQ ID NO: 27093 - RNA, 32 nt, Human
aaggugugagacugggaaggcuugggauuugc

SEQ ID NO: 27094 - RNA, 32 nt, Human
aaggugugagccaccaugccuggcccuaugug

SEQ ID NO: 27095 - RNA, 32 nt, Human
aaggugugagccacugugcccagccuauuauu

SEQ ID NO: 27096 - RNA, 32 nt, Human
aaggugugagcugggagguugcuggacaggau

SEQ ID NO: 27097 - RNA, 32 nt, Human
aagguguggaggaggaggggagggaggaagaa

SEQ ID NO: 27098 - RNA, 32 nt, Human
aagguguggccagaacaacuugggcuccugcu

SEQ ID NO: 27099 - RNA, 32 nt, Human
aaggugugggcugugauaggagagggcagagc

SEQ ID NO: 27100 - RNA, 20 nt, Human
aaggugugugcugacuugau

SEQ ID NO: 27101 - RNA, 32 nt, Human
aaggugugugucauacacagggccuaguacau

SEQ ID NO: 27102 - RNA, 32 nt, Human
aagguguugucaggaacauacuugccuauggg

SEQ ID NO: 27103 - RNA, 32 nt, Human
aagguguuuaaaacaugucaaccuuauguaag

SEQ ID NO: 27104 - RNA, 32 nt, Human
aagguguuuaacauggagcaggagugacaaaa

SEQ ID NO: 27105 - RNA, 32 nt, Human
aagguguuucucuucugcucccugaaccucuu

SEQ ID NO: 27106 - RNA, 32 nt, Human
aagguuaaauccuaaucaucacaacagucucu

SEQ ID NO: 27107 - RNA, 32 nt, Human
aagguuaaccaaaaugauuacuacucuugaca

SEQ ID NO: 27108 - RNA, 22 nt, Human
aagguuacauuuuucuuggcca

SEQ ID NO: 27109 - RNA, 32 nt, Human
aagguuacccuugagcugugugccacagucug

SEQ ID NO: 27110 - RNA, 21 nt, Human
aagguuaccucuauuuugcca

SEQ ID NO: 27111 - RNA, 32 nt, Human
aagguuacggaggcagugaccacccacccugg

SEQ ID NO: 27112 - RNA, 32 nt, Human
aagguuacugauuuuccucuucccucuuaguu

SEQ ID NO: 27113 - RNA, 32 nt, Human
aagguuagacuguauuuugccugagggacaug

SEQ ID NO: 27114 - RNA, 32 nt, Human
aagguuagcagcugggcuggggagcagaaaac

SEQ ID NO: 27115 - RNA, 32 nt, Human
aagguuaggaguuugagaccagccuggccaac

SEQ ID NO: 27116 - RNA, 32 nt, Human
aagguuauacagccauaucuucaucacuuucu

SEQ ID NO: 27117 - RNA, 32 nt, Human
aagguuauacugccuuuucuuuguuuguuugu

SEQ ID NO: 27118 - RNA, 32 nt, Human
aagguuauagugaacuaugaucuuaccacuac

SEQ ID NO: 27119 - RNA, 32 nt, Human
aagguuauucaaccagggcaaaggacagccuu

SEQ ID NO: 27120 - RNA, 32 nt, Human
aagguuauuuuccaccaagggauuucccaggu

SEQ ID NO: 27121 - RNA, 32 nt, Human
aagguucaagagugaauggaaaaagagcagua

SEQ ID NO: 27122 - RNA, 32 nt, Human
aagguucaaucagcagaugacccccaggccuu

SEQ ID NO: 27123 - RNA, 32 nt, Human
aagguucauaugcaucacacaccacuuugaca

SEQ ID NO: 27124 - RNA, 20 nt, Human
aagguucauccugaauggga

SEQ ID NO: 27125 - RNA, 32 nt, Human
aagguuccaacuuuaccacauccagccaacag

SEQ ID NO: 27126 - RNA, 32 nt, Human
aagguuccaagaaucaguaaauaagggaguuu

SEQ ID NO: 27127 - RNA, 32 nt, Human
aagguuccaagagugaggagagaaugcauggg

SEQ ID NO: 27128 - RNA, 32 nt, Human
aagguucgcccuggugcugagcuccaugaacc

SEQ ID NO: 27129 - RNA, 32 nt, Human
aagguucuacagcauaagccuuauccugccag

SEQ ID NO: 27130 - RNA, 32 nt, Human
aagguucucaaaggucucagaccuacaaagag

SEQ ID NO: 27131 - RNA, 32 nt, Human
aagguucuccacccugugccccacccucccca

SEQ ID NO: 27132 - RNA, 32 nt, Human
aagguucuggugcuucagcuggcuccugcaga

SEQ ID NO: 27133 - RNA, 32 nt, Human
aagguucuucauugcuuuucuguucacaguug

SEQ ID NO: 27134 - RNA, 32 nt, Human
aagguucuuggacucugcaugguucccuuuag

SEQ ID NO: 27135 - RNA, 32 nt, Human
aagguugaacaacauggcucagagucuuguuc

SEQ ID NO: 27136 - RNA, 32 nt, Human
aagguugaaucucuuccugagggcagagcucu

SEQ ID NO: 27137 - RNA, 32 nt, Human
aagguugaggcugaagagugaggacucuucag

SEQ ID NO: 27138 - RNA, 32 nt, Human
aagguugaggggcuccccagaggucacacagc

SEQ ID NO: 27139 - RNA, 32 nt, Human
aagguugcaaacaagguccuggaagauaagau

SEQ ID NO: 27140 - RNA, 32 nt, Human
aagguugcacuggccagcaugggccuguccca

SEQ ID NO: 27141 - RNA, 32 nt, Human
aagguugcaguaaaccaagaucacgccacuac

SEQ ID NO: 27142 - RNA, 32 nt, Human
aagguugcagugagccaaaaucaugccacugc

SEQ ID NO: 27143 - RNA, 32 nt, Human
aagguugcagugagccaagaucacaccacucc

SEQ ID NO: 27144 - RNA, 32 nt, Human
aagguugcagugagccaagaucacgccacugc

SEQ ID NO: 27145 - RNA, 32 nt, Human
aagguugcagugagccaagaucgcaacacugc

SEQ ID NO: 27146 - RNA, 32 nt, Human
aagguugcagugagccaaggucgugcugcugc

SEQ ID NO: 27147 - RNA, 32 nt, Human
aagguugcagugagccacgaucacaccacagu

SEQ ID NO: 27148 - RNA, 32 nt, Human
aagguugcagugagccauaaucgugccacugc

SEQ ID NO: 27149 - RNA, 32 nt, Human
aagguugcagugagccgagaccacgccacugc

SEQ ID NO: 27150 - RNA, 32 nt, Human
aagguugcagugagccgagaucacaccacugc

SEQ ID NO: 27151 - RNA, 32 nt, Human
aagguugcagugagccgagaucaugccacugc

SEQ ID NO: 27152 - RNA, 32 nt, Human
aagguugcagugagccgagauugcgccacugc

SEQ ID NO: 27153 - RNA, 32 nt, Human
aagguugcagugagccgagauugugccacugc

SEQ ID NO: 27154 - RNA, 32 nt, Human
aagguugcagugagccgagauuucaccagugc

SEQ ID NO: 27155 - RNA, 32 nt, Human
aagguugcagugagccgugaucaugccacugc

SEQ ID NO: 27156 - RNA, 32 nt, Human
aagguugcagugagcuaugauugcacccacug

SEQ ID NO: 27157 - RNA, 32 nt, Human
aagguugcagugagcuaugauuguguggccac

SEQ ID NO: 27158 - RNA, 32 nt, Human
aagguugcagugagcugagaucacaccacugc

SEQ ID NO: 27159 - RNA, 32 nt, Human
aagguugcagugagcugagaucgcgccacugc

SEQ ID NO: 27160 - RNA, 32 nt, Human
aagguugcagugagcugagauggugccacugc

SEQ ID NO: 27161 - RNA, 32 nt, Human
aagguugcagugagcugagauugcgcugcugc

SEQ ID NO: 27162 - RNA, 32 nt, Human
aagguugcagugagcugagauugugcugcugc

SEQ ID NO: 27163 - RNA, 32 nt, Human
aagguugcagugagcugaggucgugcuacugc

SEQ ID NO: 27164 - RNA, 32 nt, Human
aagguugcagugagcuggaaucgugccacucc

SEQ ID NO: 27165 - RNA, 32 nt, Human
aagguugcagugagcugucauugcgccacugc

SEQ ID NO: 27166 - RNA, 32 nt, Human
aagguugcagugagucaugauggugccacugc

SEQ ID NO: 27167 - RNA, 15 nt, Human
aagguugccugcaaa

SEQ ID NO: 27168 - RNA, 32 nt, Human
aagguugcgccacugcacuccagccugggcaa

SEQ ID NO: 27169 - RNA, 32 nt, Human
aagguugcgccacuguacuccagccuggguga

SEQ ID NO: 27170 - RNA, 32 nt, Human
aagguugcucacugcaaauauaaaucucagca

SEQ ID NO: 27171 - RNA, 32 nt, Human
aagguugcuggaaaaugccuuugguggcuuua

SEQ ID NO: 27172 - RNA, 24 nt, Human
aagguuggaauuaacaggcgugag

SEQ ID NO: 27173 - RNA, 32 nt, Human
aagguuggagcagugcuuuucacuacuuugua

SEQ ID NO: 27174 - RNA, 32 nt, Human
aagguuggcugcagagaauuccugccaucuug

SEQ ID NO: 27175 - RNA, 32 nt, Human
aagguugggcuggugcucacagcuguaauccc

SEQ ID NO: 27176 - RNA, 32 nt, Human
aagguuggggaggggaacaggagagaggcaau

SEQ ID NO: 27177 - RNA, 32 nt, Human
aagguuguagugagccaagaucguaccacugc

SEQ ID NO: 27178 - RNA, 32 nt, Human
aagguugucacaucuucccaagccaggccagc

SEQ ID NO: 27179 - RNA, 32 nt, Human
aagguugugaaaccuuuuaacucuccacagug

SEQ ID NO: 27180 - RNA, 32 nt, Human
aagguugugaugugugcacgguauggcacagg

SEQ ID NO: 27181 - RNA, 19 nt, Human
aagguugugccacugcacu

SEQ ID NO: 27182 - RNA, 32 nt, Human
aagguugugccacugcacuccagccugggcaa

SEQ ID NO: 27183 - RNA, 32 nt, Human
aagguugugcugguaagacaucucugacgaag

SEQ ID NO: 27184 - RNA, 22 nt, Human
aagguuguguagcugugucaug

SEQ ID NO: 27185 - RNA, 32 nt, Human
aagguuuaagaaagaaaacaaaaccaacaguu

SEQ ID NO: 27186 - RNA, 32 nt, Human
aagguuuauggauuugacagggugcaugucac

SEQ ID NO: 27187 - RNA, 32 nt, Human
aagguuucaagugauccucccgccucagccug

SEQ ID NO: 27188 - RNA, 32 nt, Human
aagguuucagcgacaaucuccaugcagacgaa

SEQ ID NO: 27189 - RNA, 32 nt, Human
aagguuucauggagcagggagggagacggcua

SEQ ID NO: 27190 - RNA, 32 nt, Human
aagguuucaugggacugaguucugucccugcu

SEQ ID NO: 27191 - RNA, 32 nt, Human
aagguuucccuacauuucccaggcuggucuug

SEQ ID NO: 27192 - RNA, 32 nt, Human
aagguuucccuaugggcaccagacuccaugua

SEQ ID NO: 27193 - RNA, 32 nt, Human
aagguuuccuugcccauuaucagaaggaaaaa

SEQ ID NO: 27194 - RNA, 32 nt, Human
aagguuucgagagcauuccuacucacauaagu

SEQ ID NO: 27195 - RNA, 32 nt, Human
aagguuucugaggacuucucccaggagaagac

SEQ ID NO: 27196 - RNA, 32 nt, Human
aagguuucuguuuaaugcaucuugccuuaucu

SEQ ID NO: 27197 - RNA, 32 nt, Human
aagguuugugaugaugucuguacuaguuagcu

SEQ ID NO: 27198 - RNA, 32 nt, Human
aagguuuuauagaugucuuugccuucccuucu

SEQ ID NO: 27199 - RNA, 32 nt, Human
aagguuuuccaaaauuaagaguacuugaguag

SEQ ID NO: 27200 - RNA, 32 nt, Human
aagguuuuccccucaacaauuuugaagcugug

SEQ ID NO: 27201 - RNA, 32 nt, Human
aagguuuugcagaggagaugaaguuucaguug

SEQ ID NO: 27202 - RNA, 32 nt, Human
aagguuuuuaucuguguagaauggguguuuga

SEQ ID NO: 27203 - RNA, 32 nt, Human
aagguuuuugcaaauaagaauaugaaaaauac

SEQ ID NO: 27204 - RNA, 32 nt, Human
aaguaaaaagucagauuucauuuccauuuacc

SEQ ID NO: 27205 - RNA, 32 nt, Human
aaguaaaaauuagcugggcgugguggcacaug

SEQ ID NO: 27206 - RNA, 32 nt, Human
aaguaaaagaaaaagaaaagaaaauaacuccc

SEQ ID NO: 27207 - RNA, 32 nt, Human
aaguaaaagaccgaagaaggaggcuggagaga

SEQ ID NO: 27208 - RNA, 32 nt, Human
aaguaaaagcaucacagcuuaccauuuuucuu

SEQ ID NO: 27209 - RNA, 32 nt, Human
aaguaaaagcuucguuauacauuugacuaaga

SEQ ID NO: 27210 - RNA, 32 nt, Human
aaguaaaaguccccuagugauagccacuauuc

SEQ ID NO: 27211 - RNA, 32 nt, Human
aaguaaaauggcaggggcagagugcagcuuaa

SEQ ID NO: 27212 - RNA, 32 nt, Human
aaguaaacaaaggucucugguuuuccuaggca

SEQ ID NO: 27213 - RNA, 19 nt, Human
aaguaaacaccagcagcuc

SEQ ID NO: 27214 - RNA, 32 nt, Human
aaguaaacagauuugauugugaggcuucuaau

SEQ ID NO: 27215 - RNA, 32 nt, Human
aaguaaaccaaaauguuaacagugaucaucuc

SEQ ID NO: 27216 - RNA, 32 nt, Human
aaguaaaccaacauacugcauguaaguaucaa

SEQ ID NO: 27217 - RNA, 32 nt, Human
aaguaaaccauugcuaucuuucaccuuaaaua

SEQ ID NO: 27218 - RNA, 32 nt, Human
aaguaaacgauaaaauguggauuaaagugccc

SEQ ID NO: 27219 - RNA, 32 nt, Human
aaguaaacucuaaguacaugguaaguggcagu

SEQ ID NO: 27220 - RNA, 32 nt, Human
aaguaaagaacagccaaguggccaggugcggu

SEQ ID NO: 27221 - RNA, 32 nt, Human
aaguaaagaagcaggcugggcuuggugcccac

SEQ ID NO: 27222 - RNA, 32 nt, Human
aaguaaagaauaugaugaguacagcaccuaca

SEQ ID NO: 27223 - RNA, 32 nt, Human
aaguaaagauguuugaauacuuaaacacuauc

SEQ ID NO: 27224 - RNA, 32 nt, Human
aaguaaagcccaaguguucuuuagcuuuuuau

SEQ ID NO: 27225 - RNA, 31 nt, Human
aaguaaaggaagagagaaaugacugguggcc

SEQ ID NO: 27226 - RNA, 32 nt, Human
aaguaaaggagagugaugagguggugugggga

SEQ ID NO: 27227 - RNA, 32 nt, Human
aaguaaaggggcccugagccugccugcccggc

SEQ ID NO: 27228 - RNA, 32 nt, Human
aaguaaauaacaaaagcccccauacucuucug

SEQ ID NO: 27229 - RNA, 32 nt, Human
aaguaaauacaguuccagauggguuauugcag

SEQ ID NO: 27230 - RNA, 32 nt, Human
aaguaaauaugggaaguuauugccaaaugaga

SEQ ID NO: 27231 - RNA, 32 nt, Human
aaguaaaucugcaacccuggggaggaccccaa

SEQ ID NO: 27232 - RNA, 32 nt, Human
aaguaaaucuuuggcuuuuuguucuguuggug

SEQ ID NO: 27233 - RNA, 32 nt, Human
aaguaaaugucaguaaaacuauuuuuccugaa

SEQ ID NO: 27234 - RNA, 32 nt, Human
aaguaaauuggcugggugugguggcucaugca

SEQ ID NO: 27235 - RNA, 32 nt, Human
aaguaaauuuuaauuuucaucauuccauggag

SEQ ID NO: 27236 - RNA, 32 nt, Human
aaguaacaaagugauggcuuggaacacugucu

SEQ ID NO: 27237 - RNA, 32 nt, Human
aaguaacacacagaggaggauguguguguaug

SEQ ID NO: 27238 - RNA, 32 nt, Human
aaguaacacacuuauuuuugccuguguaugga

SEQ ID NO: 27239 - RNA, 32 nt, Human
aaguaacacauaaagaugucaccagaagacaa

SEQ ID NO: 27240 - RNA, 32 nt, Human
aaguaacacauacauguuuaauugauucuguu

SEQ ID NO: 27241 - RNA, 32 nt, Human
aaguaacagugcauaaaaguuuggaaaauaug

SEQ ID NO: 27242 - RNA, 32 nt, Human
aaguaacauuuacuagcgcaauacugcacuug

SEQ ID NO: 27243 - RNA, 32 nt, Human
aaguaaccaagcuguugacuuucuuacuacuu

SEQ ID NO: 27244 - RNA, 32 nt, Human
aaguaaccauuuuacagaaggaugaggaucag

SEQ ID NO: 27245 - RNA, 32 nt, Human
aaguaacccugccucuaccuuacgagagagcu

SEQ ID NO: 27246 - RNA, 32 nt, Human
aaguaacucgcacuggucacacaucuguaagu

SEQ ID NO: 27247 - RNA, 32 nt, Human
aaguaacugcaggaguuggaggucaggaggca

SEQ ID NO: 27248 - RNA, 32 nt, Human
aaguaacuggaaaagaucuuguagauguggcc

SEQ ID NO: 27249 - RNA, 19 nt, Human
aaguaacugggacugcagg

SEQ ID NO: 27250 - RNA, 32 nt, Human
aaguaacugggacugcaggcacaugccaccac

SEQ ID NO: 27251 - RNA, 32 nt, Human
aaguaagaaaaugcaaguucuaaaaauagacu

SEQ ID NO: 27252 - RNA, 32 nt, Human
aaguaagaaauuuugcuuguuguuuugcaaac

SEQ ID NO: 27253 - RNA, 32 nt, Human
aaguaagaacaaggaggaauuuguuucuaaaa

SEQ ID NO: 27254 - RNA, 32 nt, Human
aaguaagaagagcaggaagaagaagagcgcca

SEQ ID NO: 27255 - RNA, 32 nt, Human
aaguaagaggagcuucaucucagccugcuagc

SEQ ID NO: 27256 - RNA, 32 nt, Human
aaguaagaggcaacugcccuguuuuuguuugu

SEQ ID NO: 27257 - RNA, 32 nt, Human
aaguaagaggguggguuccaaggguggcccaa

SEQ ID NO: 27258 - RNA, 32 nt, Human
aaguaagauaaauagcuagacgaccuuggcac

SEQ ID NO: 27259 - RNA, 32 nt, Human
aaguaagcaagaagagggccugggagaagagu

SEQ ID NO: 27260 - RNA, 32 nt, Human
aaguaagccagcugcuggauuuggcucugggc

SEQ ID NO: 27261 - RNA, 32 nt, Human
aaguaagccuaaaaggaaucuuugaggaaaaa

SEQ ID NO: 27262 - RNA, 32 nt, Human
aaguaaggagagggacuggacccccuggaagc

SEQ ID NO: 27263 - RNA, 32 nt, Human
aaguaaggagcugguaccuaccuacacagcug

SEQ ID NO: 27264 - RNA, 32 nt, Human
aaguaaggcucagagagaagcaaccaacugga

SEQ ID NO: 27265 - RNA, 32 nt, Human
aaguaagggggaacuccugcuuugggcuggga

SEQ ID NO: 27266 - RNA, 32 nt, Human
aaguaaguauccccacuuucaggguagcaucc

SEQ ID NO: 27267 - RNA, 32 nt, Human
aaguaaguauuccucgggauguuuuuauauaa

SEQ ID NO: 27268 - RNA, 32 nt, Human
aaguaagugagaaaggaaagacuuuccaacaa

SEQ ID NO: 27269 - RNA, 32 nt, Human
aaguaagugguaccagccacaacugaauaucc

SEQ ID NO: 27270 - RNA, 32 nt, Human
aaguaaguucaucacgauaucagggaagaugu

SEQ ID NO: 27271 - RNA, 32 nt, Human
aaguaaguugcagaaaucagacacuuuauaug

SEQ ID NO: 27272 - RNA, 32 nt, Human
aaguaaguugcuuugcaccgccuacuuaauuc

SEQ ID NO: 27273 - RNA, 32 nt, Human
aaguaaguuuuuaaaacuuuuuauuuauuuau

SEQ ID NO: 27274 - RNA, 32 nt, Human
aaguaauauuuuauacuuaauuuuaggaguuu

SEQ ID NO: 27275 - RNA, 32 nt, Human
aaguaaucccugauucuauaccgaaguuuuau

SEQ ID NO: 27276 - RNA, 32 nt, Human
aaguaauccuccugccucagccuaccaaguag

SEQ ID NO: 27277 - RNA, 32 nt, Human
aaguaauccuccugccuuagcauuccagagug

SEQ ID NO: 27278 - RNA, 32 nt, Human
aaguaaucucagaauguuggccgggcauggug

SEQ ID NO: 27279 - RNA, 32 nt, Human
aaguaaucuccuguccuuuggcagaagcuccu

SEQ ID NO: 27280 - RNA, 32 nt, Human
aaguaaucucugaagcccagauuuccuaagga

SEQ ID NO: 27281 - RNA, 32 nt, Human
aaguaaucugccgcauccagaaugaacagaac

SEQ ID NO: 27282 - RNA, 32 nt, Human
aaguaaucuuuguucccaagggcugauggcuu

SEQ ID NO: 27283 - RNA, 32 nt, Human
aaguaaugaauucuggccagguacaguggcuc

SEQ ID NO: 27284 - RNA, 32 nt, Human
aaguaauggaaagcaaaagcgaaggacagacc

SEQ ID NO: 27285 - RNA, 32 nt, Human
aaguaaugguugauccugauguacaugaugau

SEQ ID NO: 27286 - RNA, 32 nt, Human
aaguaauuaugauauugcaaaagugauacuua

SEQ ID NO: 27287 - RNA, 32 nt, Human
aaguaauuauugauggcucugccugcuuagga

SEQ ID NO: 27288 - RNA, 32 nt, Human
aaguaauucuuggcugggcaugguggcucacg

SEQ ID NO: 27289 - RNA, 32 nt, Human
aaguaauugugugguuaucugccauuuaaaag

SEQ ID NO: 27290 - RNA, 32 nt, Human
aaguaauuuuaugaggaugaaacucauagcuu

SEQ ID NO: 27291 - RNA, 32 nt, Human
aaguacaaacaugcaucucgugauaguccugc

SEQ ID NO: 27292 - RNA, 32 nt, Human
aaguacaaauacaaugcagagcucauuuucag

SEQ ID NO: 27293 - RNA, 32 nt, Human
aaguacaacuccauuagaaaaauucagacagc

SEQ ID NO: 27294 - RNA, 32 nt, Human
aaguacaaguuuaggcugggcgugguggcuca

SEQ ID NO: 27295 - RNA, 32 nt, Human
aaguacacgauccgcuggcauccaggaggcug

SEQ ID NO: 27296 - RNA, 32 nt, Human
aaguacacuaaauauauuacuacuucacuggg

SEQ ID NO: 27297 - RNA, 32 nt, Human
aaguacacuguacacaacaucgcuaaugaggg

SEQ ID NO: 27298 - RNA, 32 nt, Human
aaguacagguauaucucggagauauugugggu

SEQ ID NO: 27299 - RNA, 32 nt, Human
aaguacagugaauuuugcuuuauugcaaagcu

SEQ ID NO: 27300 - RNA, 32 nt, Human
aaguacagugcuguuacguggcacuguacagu

SEQ ID NO: 27301 - RNA, 32 nt, Human
aaguacauccacccucuuaaucccaaaagaac

SEQ ID NO: 27302 - RNA, 32 nt, Human
aaguacaugguacuuuuacaguaccauguacu

SEQ ID NO: 27303 - RNA, 32 nt, Human
aaguaccaacucuauggacccaggacagagca

SEQ ID NO: 27304 - RNA, 32 nt, Human
aaguaccacuccauccagccuugggcaagaug

SEQ ID NO: 27305 - RNA, 32 nt, Human
aaguaccacuugucuuuucugugaauuaugac

SEQ ID NO: 27306 - RNA, 32 nt, Human
aaguaccagagaugucuccaagagcaccagca

SEQ ID NO: 27307 - RNA, 24 nt, Human
aaguaccaggauuauaggcaugag

SEQ ID NO: 27308 - RNA, 32 nt, Human
aaguaccauuagcuacagugaucuuagcuucc

SEQ ID NO: 27309 - RNA, 32 nt, Human
aaguaccccaguuucacacauaccaaaccaag

SEQ ID NO: 27310 - RNA, 32 nt, Human
aaguaccggaacucagauuuugcccaucucau

SEQ ID NO: 27311 - RNA, 32 nt, Human
aaguaccuccaugccaagucccugcacuguug

SEQ ID NO: 27312 - RNA, 32 nt, Human
aaguaccugaugcugauugauuccacuaauag

SEQ ID NO: 27313 - RNA, 32 nt, Human
aaguaccugccugcggccaacaugauggcugg

SEQ ID NO: 27314 - RNA, 32 nt, Human
aaguaccugccugcggccaacauguggcuggg

SEQ ID NO: 27315 - RNA, 25 nt, Human
aaguaccugggacuacaggcgugag

SEQ ID NO: 27316 - RNA, 32 nt, Human
aaguaccugggauuacaggagcucccaccaag

SEQ ID NO: 27317 - RNA, 23 nt, Human
aaguaccuucuguggacaaggua

SEQ ID NO: 27318 - RNA, 32 nt, Human
aaguaccuuggaggaggagagguuggugacau

SEQ ID NO: 27319 - RNA, 32 nt, Human
aaguacggugucauuuucacagucuccagggu

SEQ ID NO: 27320 - RNA, 32 nt, Human
aaguacuaaggccgcagacuccuguccgcagc

SEQ ID NO: 27321 - RNA, 32 nt, Human
aaguacuacagcccugggggugucacaccgcu

SEQ ID NO: 27322 - RNA, 32 nt, Human
aaguacucggauuacaggugugagucaccgcg

SEQ ID NO: 27323 - RNA, 32 nt, Human
aaguacucucucuccuaaagacaccaccuucc

SEQ ID NO: 27324 - RNA, 32 nt, Human
aaguacucuguacaacaaacccgugacaagag

SEQ ID NO: 27325 - RNA, 32 nt, Human
aaguacugaauuagaaaccaggaaguuuuagu

SEQ ID NO: 27326 - RNA, 32 nt, Human
aaguacugaccagcaaaauggagaagaucaga

SEQ ID NO: 27327 - RNA, 32 nt, Human
aaguacugcccuuuuguguguuagcagucaaa

SEQ ID NO: 27328 - RNA, 32 nt, Human
aaguacugcugaacugugagugcaguauucua

SEQ ID NO: 27329 - RNA, 24 nt, Human
aaguacugggacuacaggcgugag

SEQ ID NO: 27330 - RNA, 32 nt, Human
aaguacugggauuacaggcaugaaccaccgug

SEQ ID NO: 27331 - RNA, 24 nt, Human
aaguacugggauuacaggcaugag

SEQ ID NO: 27332 - RNA, 32 nt, Human
aaguacugggauuacaggcaugagccaccaca

SEQ ID NO: 27333 - RNA, 32 nt, Human
aaguacugggauuacaggcaugagccacugca

SEQ ID NO: 27334 - RNA, 24 nt, Human
aaguacugggauuacaggccugag

SEQ ID NO: 27335 - RNA, 32 nt, Human
aaguacugggauuacaggccugagccaccgcg

SEQ ID NO: 27336 - RNA, 32 nt, Human
aaguacugggauuacaggcgugaaccacugcc

SEQ ID NO: 27337 - RNA, 24 nt, Human
aaguacugggauuacaggcgugag

SEQ ID NO: 27338 - RNA, 32 nt, Human
aaguacugggauuacaggcgugagccaccacg

SEQ ID NO: 27339 - RNA, 32 nt, Human
aaguacugggauuacaggcgugagccaccacu

SEQ ID NO: 27340 - RNA, 32 nt, Human
aaguacugggauuacaggcgugagccaccaug

SEQ ID NO: 27341 - RNA, 32 nt, Human
aaguacugggauuacaggcgugagccaccgug

SEQ ID NO: 27342 - RNA, 32 nt, Human
aaguacugggauuacaggcgugagccaccucg

SEQ ID NO: 27343 - RNA, 32 nt, Human
aaguacugggauuacaggcgugagccacggca

SEQ ID NO: 27344 - RNA, 32 nt, Human
aaguacugggauuacaggcgugagccacugca

SEQ ID NO: 27345 - RNA, 32 nt, Human
aaguacugggauuacaggcgugagccacugug

SEQ ID NO: 27346 - RNA, 32 nt, Human
aaguacugggauuacaggcgugagcccccacg

SEQ ID NO: 27347 - RNA, 24 nt, Human
aaguacugggauuacaggugagag

SEQ ID NO: 27348 - RNA, 32 nt, Human
aaguacugggauuacaggugagagucacugcu

SEQ ID NO: 27349 - RNA, 32 nt, Human
aaguacugggauuacaggugcccaccaccacc

SEQ ID NO: 27350 - RNA, 24 nt, Human
aaguacugggauuauaggcuugag

SEQ ID NO: 27351 - RNA, 24 nt, Human
aaguacugggauuauaggugugag

SEQ ID NO: 27352 - RNA, 23 nt, Human
aaguacugggauucuguguagag

SEQ ID NO: 27353 - RNA, 32 nt, Human
aaguacugggauuuaggcaugagccaccacau

SEQ ID NO: 27354 - RNA, 32 nt, Human
aaguacuggguuuacaggugugagccacugug

SEQ ID NO: 27355 - RNA, 32 nt, Human
aaguacuuagucauuuuccugaaagugugguc

SEQ ID NO: 27356 - RNA, 32 nt, Human
aaguacuucaggcugggcacaguggcucaugc

SEQ ID NO: 27357 - RNA, 32 nt, Human
aaguacuuuuuauuccagcugcugaaaauggu

SEQ ID NO: 27358 - RNA, 32 nt, Human
aaguacuuuuuccagcucugcaagucaccuau

SEQ ID NO: 27359 - RNA, 32 nt, Human
aaguagaaaaugcagaggcucgggcuuguuug

SEQ ID NO: 27360 - RNA, 32 nt, Human
aaguagaaacuuucuauaaccuaaaugauguu

SEQ ID NO: 27361 - RNA, 32 nt, Human
aaguagaacccugggagccagaggugaauaca

SEQ ID NO: 27362 - RNA, 32 nt, Human
aaguagaagaggaggagggauucuggucuuca

SEQ ID NO: 27363 - RNA, 23 nt, Human
aaguagaauauaaaguaucaaca

SEQ ID NO: 27364 - RNA, 32 nt, Human
aaguagacaugacaagugaacagcagagcugg

SEQ ID NO: 27365 - RNA, 32 nt, Human
aaguagaccuuuuucauucaugagauuccuau

SEQ ID NO: 27366 - RNA, 32 nt, Human
aaguagagaagaacauaagaagaaaaacccag

SEQ ID NO: 27367 - RNA, 31 nt, Human
aaguagagaccaagagaaaaacucauugauu

SEQ ID NO: 27368 - RNA, 32 nt, Human
aaguagagacgggguuucaccuguuagccagg

SEQ ID NO: 27369 - RNA, 32 nt, Human
aaguagagagcaccggccccucaaggaccaug

SEQ ID NO: 27370 - RNA, 32 nt, Human
aaguagagaggggguuucuccauguuggucag

SEQ ID NO: 27371 - RNA, 32 nt, Human
aaguagagaugagguuucuccauguuggucag

SEQ ID NO: 27372 - RNA, 32 nt, Human
aaguagagauggggucucacccuguuggccag

SEQ ID NO: 27373 - RNA, 32 nt, Human
aaguagagaugggguuucaccauguugcccag

SEQ ID NO: 27374 - RNA, 32 nt, Human
aaguagagaugggguuucaccauguuggucag

SEQ ID NO: 27375 - RNA, 32 nt, Human
aaguagagcuguuauguuuuucuugaacuuua

SEQ ID NO: 27376 - RNA, 21 nt, Human
aaguagaggaaauacauugag

SEQ ID NO: 27377 - RNA, 32 nt, Human
aaguagaggaugccgaggagaaaacagcaggc

SEQ ID NO: 27378 - RNA, 32 nt, Human
aaguagagucugaaagagcagugggaugggag

SEQ ID NO: 27379 - RNA, 32 nt, Human
aaguagaugcuggcuuaaacaaaugauaaauc

SEQ ID NO: 27380 - RNA, 32 nt, Human
aaguagauuagugguugcuucgggaugggagg

SEQ ID NO: 27381 - RNA, 32 nt, Human
aaguagauuucaggcuaggugcgguggcucac

SEQ ID NO: 27382 - RNA, 32 nt, Human
aaguagcaaagcagcucucaagggcuugucag

SEQ ID NO: 27383 - RNA, 32 nt, Human
aaguagcaaauugccagcaaaaugucuuguac

SEQ ID NO: 27384 - RNA, 32 nt, Human
aaguagcaagaauagagcaaaauaucaaaucc

SEQ ID NO: 27385 - RNA, 32 nt, Human
aaguagcagagugaugggagcaaaauaggcac

SEQ ID NO: 27386 - RNA, 22 nt, Human
aaguagcagcccugaugucauu

SEQ ID NO: 27387 - RNA, 32 nt, Human
aaguagcagcuucucuauccaggaugaugagu

SEQ ID NO: 27388 - RNA, 32 nt, Human
aaguagcaggguggucagggugggagacacaa

SEQ ID NO: 27389 - RNA, 32 nt, Human
aaguagcagugagccgagaucgcgccacugca

SEQ ID NO: 27390 - RNA, 32 nt, Human
aaguagcauuccuccaccucaggccuugggua

SEQ ID NO: 27391 - RNA, 32 nt, Human
aaguagccaagaaaagaugagaaaaaucaaga

SEQ ID NO: 27392 - RNA, 18 nt, Human
aaguagccaccugaguuc

SEQ ID NO: 27393 - RNA, 32 nt, Human
aaguagccucaaguucuaaagaccauggcccc

SEQ ID NO: 27394 - RNA, 32 nt, Human
aaguagccucacucuuauuccucaagaauuaa

SEQ ID NO: 27395 - RNA, 32 nt, Human
aaguagcgagagaagagagaaaaugaagucgg

SEQ ID NO: 27396 - RNA, 23 nt, Human
aaguagcuaggacuacaggcgug

SEQ ID NO: 27397 - RNA, 19 nt, Human
aaguagcuaggacugcagg

SEQ ID NO: 27398 - RNA, 32 nt, Human
aaguagcugaaggucucuuacagauauaucaa

SEQ ID NO: 27399 - RNA, 19 nt, Human
aaguagcugagacugcagg

SEQ ID NO: 27400 - RNA, 21 nt, Human
aaguagcugagauuacaggcg

SEQ ID NO: 27401 - RNA, 23 nt, Human
aaguagcuggaauuacaggcgug

SEQ ID NO: 27402 - RNA, 32 nt, Human
aaguagcuggauuacaggcacgugccaucacg

SEQ ID NO: 27403 - RNA, 32 nt, Human
aaguagcuggauuacaggugcaugccacgaca

SEQ ID NO: 27404 - RNA, 25 nt, Human
aaguagcugggaccacaggcgugag

SEQ ID NO: 27405 - RNA, 32 nt, Human
aaguagcugggaccaccaugcccagcuaauuu

SEQ ID NO: 27406 - RNA, 19 nt, Human
aaguagcugggaccgcagg

SEQ ID NO: 27407 - RNA, 19 nt, Human
aaguagcugggacuacagg

SEQ ID NO: 27408 - RNA, 21 nt, Human
aaguagcugggacuacaggcg

SEQ ID NO: 27409 - RNA, 22 nt, Human
aaguagcugggacuacaggcgu

SEQ ID NO: 27410 - RNA, 23 nt, Human
aaguagcugggacuacaggcgug

SEQ ID NO: 27411 - RNA, 19 nt, Human
aaguagcugggacugcagg

SEQ ID NO: 27412 - RNA, 19 nt, Human
aaguagcugggacugcggg

SEQ ID NO: 27413 - RNA, 32 nt, Human
aaguagcugggacuucagagauggcuggagcc

SEQ ID NO: 27414 - RNA, 23 nt, Human
aaguagcugggaucacaggcgug

SEQ ID NO: 27415 - RNA, 20 nt, Human
aaguagcugggauuacaggc

SEQ ID NO: 27416 - RNA, 21 nt, Human
aaguagcugggauuacaggcg

SEQ ID NO: 27417 - RNA, 32 nt, Human
aaguagcuggggagguggauuuagcagaaggc

SEQ ID NO: 27418 - RNA, 32 nt, Human
aaguagcugugaaucagugagaaacugugacu

SEQ ID NO: 27419 - RNA, 32 nt, Human
aaguagcuuaagguauugugcaauggccuagc

SEQ ID NO: 27420 - RNA, 32 nt, Human
aaguagcuuacauugauuauuauaggggagga

SEQ ID NO: 27421 - RNA, 29 nt, Human
aaguagcuuccagaccagauacuaccugu

SEQ ID NO: 27422 - RNA, 24 nt, Human
aaguagcuugggacuacaggcgug

SEQ ID NO: 27423 - RNA, 32 nt, Human
aaguagcuuucauuuaaccaagcuaaauuauu

SEQ ID NO: 27424 - RNA, 32 nt, Human
aaguagcuuuuucuuuccuuccuuccuuccuc

SEQ ID NO: 27425 - RNA, 32 nt, Human
aaguaggaacaccccagccucagacagacaca

SEQ ID NO: 27426 - RNA, 32 nt, Human
aaguaggacacagagcagggcuuuucuuacca

SEQ ID NO: 27427 - RNA, 32 nt, Human
aaguaggagaagaaauggggaggacucgggug

SEQ ID NO: 27428 - RNA, 32 nt, Human
aaguaggagagggcugcugggaggcgagaggg

SEQ ID NO: 27429 - RNA, 32 nt, Human
aaguaggagggguggaggugagaaggagagag

SEQ ID NO: 27430 - RNA, 32 nt, Human
aaguaggcaaacugaggcucugggagauguag

SEQ ID NO: 27431 - RNA, 32 nt, Human
aaguaggcagggcuguguuccuuuguguagcc

SEQ ID NO: 27432 - RNA, 32 nt, Human
aaguaggccauggcuaggcagacaguggggac

SEQ ID NO: 27433 - RNA, 32 nt, Human
aaguaggcccaucuuggcucugaggcugagag

SEQ ID NO: 27434 - RNA, 32 nt, Human
aaguagggagcagggaaagaagagugagccug

SEQ ID NO: 27435 - RNA, 26 nt, Human
aaguagggaggaggagguugcaguga

SEQ ID NO: 27436 - RNA, 32 nt, Human
aaguagggaggaggagguugcagugagcugag

SEQ ID NO: 27437 - RNA, 32 nt, Human
aaguagggagggggaagcaggagaaugagacu

SEQ ID NO: 27438 - RNA, 32 nt, Human
aaguagggcagggcuuuucucucacuuacauu

SEQ ID NO: 27439 - RNA, 32 nt, Human
aaguaggggagaagggacaggccccagcgcuu

SEQ ID NO: 27440 - RNA, 32 nt, Human
aaguaggggauugcguucccuccagucgcaga

SEQ ID NO: 27441 - RNA, 32 nt, Human
aaguaggggcuggaaccauaagaagaauguuu

SEQ ID NO: 27442 - RNA, 32 nt, Human
aaguaggggugcaauaugucagguguggggcc

SEQ ID NO: 27443 - RNA, 32 nt, Human
aaguagggucuugaggaugcagggguuagaca

SEQ ID NO: 27444 - RNA, 32 nt, Human
aaguagguuaccauuuugaggcaguuggauau

SEQ ID NO: 27445 - RNA, 32 nt, Human
aaguagguuguuuguuuuauaaucagauaaaa

SEQ ID NO: 27446 - RNA, 31 nt, Human
aaguaguacagcuagagcccagggucccugc

SEQ ID NO: 27447 - RNA, 32 nt, Human
aaguaguaguguccuccuaguauauuaguuug

SEQ ID NO: 27448 - RNA, 32 nt, Human
aaguagucagggaaugggggagguggggaguu

SEQ ID NO: 27449 - RNA, 32 nt, Human
aaguagucaguggaagagaguagagcucaaaa

SEQ ID NO: 27450 - RNA, 32 nt, Human
aaguagucauggcaaguccuguuuuuaagacc

SEQ ID NO: 27451 - RNA, 22 nt, Human
aaguaguccaggggcgguggcu

SEQ ID NO: 27452 - RNA, 32 nt, Human
aaguagucccccauaggugaaauuuaaaagga

SEQ ID NO: 27453 - RNA, 19 nt, Human
aaguagucucggguaugcu

SEQ ID NO: 27454 - RNA, 32 nt, Human
aaguagugagagaaggaaggggauaggcagcu

SEQ ID NO: 27455 - RNA, 32 nt, Human
aaguagugcuaagaaaauuaaaagaauaaaac

SEQ ID NO: 27456 - RNA, 32 nt, Human
aaguagugguauuuugguaugugcaaauauuu

SEQ ID NO: 27457 - RNA, 32 nt, Human
aaguaguuccccaggcugcccucgguggugag

SEQ ID NO: 27458 - RNA, 32 nt, Human
aaguaguugcccaagggccagcucaguuuauc

SEQ ID NO: 27459 - RNA, 32 nt, Human
aaguaguugcuuaagaaauacuuguugaagga

SEQ ID NO: 27460 - RNA, 32 nt, Human
aaguauaacugaucuuugcagaaaguggggaa

SEQ ID NO: 27461 - RNA, 32 nt, Human
aaguauaagugaauauauacacacacauacag

SEQ ID NO: 27462 - RNA, 32 nt, Human
aaguauacaaagcaaccacaugcuaaaugguu

SEQ ID NO: 27463 - RNA, 32 nt, Human
aaguauacacaaaaaucagauuuaguaacuaa

SEQ ID NO: 27464 - RNA, 32 nt, Human
aaguauacauguggcuucacauuuauuaaaca

SEQ ID NO: 27465 - RNA, 32 nt, Human
aaguauacauuuaguuaacacacauauaucug

SEQ ID NO: 27466 - RNA, 32 nt, Human
aaguauagaugaagaugaagaggcagaauuga

SEQ ID NO: 27467 - RNA, 32 nt, Human
aaguauaucugugcuucacuggaagaguugaa

SEQ ID NO: 27468 - RNA, 32 nt, Human
aaguauaugauccaccaugcuaaugacacuug

SEQ ID NO: 27469 - RNA, 32 nt, Human
aaguauaugggguaggccgggugcaguggcuc

SEQ ID NO: 27470 - RNA, 32 nt, Human
aaguauauugaauaguucuuugacagaauuug

SEQ ID NO: 27471 - RNA, 32 nt, Human
aaguauauugauagcuuuguagguacaggaaa

SEQ ID NO: 27472 - RNA, 32 nt, Human
aaguaucacuagcucgcuuucuugcuguccaa

SEQ ID NO: 27473 - RNA, 32 nt, Human
aaguaucacucaguugauagucuggaaugcau

SEQ ID NO: 27474 - RNA, 32 nt, Human
aaguauccagagaguuuccaggggguuucuca

SEQ ID NO: 27475 - RNA, 32 nt, Human
aaguauccaguauuugaucacauuauuauaaa

SEQ ID NO: 27476 - RNA, 32 nt, Human
aaguaucuacuucuaaaauuaccuaguugaaa

SEQ ID NO: 27477 - RNA, 32 nt, Human
aaguaucuccaggcuccagcacuugcuuagcu

SEQ ID NO: 27478 - RNA, 23 nt, Human
aaguaucugggaccacaggcgug

SEQ ID NO: 27479 - RNA, 32 nt, Human
aaguaucugugagaacagccugggagaagaau

SEQ ID NO: 27480 - RNA, 32 nt, Human
aaguaugaaagccguguguaggcccuucugug

SEQ ID NO: 27481 - RNA, 24 nt, Human
aaguaugaaauacaguuuuuacca

SEQ ID NO: 27482 - RNA, 29 nt, Human
aaguaugaauaccacagacaacgguguca

SEQ ID NO: 27483 - RNA, 32 nt, Human
aaguaugacaggcaggugaacuuuagucaagu

SEQ ID NO: 27484 - RNA, 32 nt, Human
aaguaugagccuguggcuuccuuugugcauuu

SEQ ID NO: 27485 - RNA, 32 nt, Human
aaguaugagugcugauucaaaccaaagcugcc

SEQ ID NO: 27486 - RNA, 32 nt, Human
aaguaugaucuuauguuagaaaccagauuuaa

SEQ ID NO: 27487 - RNA, 32 nt, Human
aaguaugcaagguuucugaaucucucugguag

SEQ ID NO: 27488 - RNA, 32 nt, Human
aaguaugcagagccccaugaguagccaggaua

SEQ ID NO: 27489 - RNA, 32 nt, Human
aaguaugcagagccgugaacgucauggcaugu

SEQ ID NO: 27490 - RNA, 32 nt, Human
aaguaugcugagcuagaguugaaggaagcuuc

SEQ ID NO: 27491 - RNA, 32 nt, Human
aaguaugcuugaaagaaugucacuaacugguc

SEQ ID NO: 27492 - RNA, 32 nt, Human
aaguaugcuuugccuuauuuccacauuuaaac

SEQ ID NO: 27493 - RNA, 32 nt, Human
aaguauggcgugugccucaucgggcugaagcg

SEQ ID NO: 27494 - RNA, 32 nt, Human
aaguaugguggaaacucaauucaacuccaguu

SEQ ID NO: 27495 - RNA, 32 nt, Human
aaguaugucccgcugccuggagagauggccca

SEQ ID NO: 27496 - RNA, 32 nt, Human
aaguauguccuguuuucugcuauaauucuuuc

SEQ ID NO: 27497 - RNA, 32 nt, Human
aaguaugugggaggggacgggcgggacgagcu

SEQ ID NO: 27498 - RNA, 32 nt, Human
aaguauguguagcuggaaacaaaaaugagcgu

SEQ ID NO: 27499 - RNA, 32 nt, Human
aaguauguugcugaaauugaaaaagaaaaaga

SEQ ID NO: 27500 - RNA, 32 nt, Human
aaguauuaccauuuaaagagugccuccugugu

SEQ ID NO: 27501 - RNA, 32 nt, Human
aaguauuaggcugcugucagggagaggauggc

SEQ ID NO: 27502 - RNA, 32 nt, Human
aaguauuauuuauuaggaaucuaaauugugga

SEQ ID NO: 27503 - RNA, 31 nt, Human
aaguauucaaauaaauaugguuugaauaugu

SEQ ID NO: 27504 - RNA, 32 nt, Human
aaguauucaaugcuuagaauacuaaaagguuu

SEQ ID NO: 27505 - RNA, 32 nt, Human
aaguauucaguaggaauuacaauaugauguua

SEQ ID NO: 27506 - RNA, 32 nt, Human
aaguauucagugguaccuggaggucuggacag

SEQ ID NO: 27507 - RNA, 32 nt, Human
aaguauuccuaugccagagcagugccaacucu

SEQ ID NO: 27508 - RNA, 32 nt, Human
aaguauuccuucauugggcuucauccuuuuag

SEQ ID NO: 27509 - RNA, 32 nt, Human
aaguauucuuaauuauaacuugccuuucagcg

SEQ ID NO: 27510 - RNA, 32 nt, Human
aaguauugagaaggggaaggggauuucucacu

SEQ ID NO: 27511 - RNA, 24 nt, Human
aaguauugagauuacaggcaugag

SEQ ID NO: 27512 - RNA, 32 nt, Human
aaguauugagauuacaggcaugagccacugca

SEQ ID NO: 27513 - RNA, 32 nt, Human
aaguauugcuugaacccaggaggcagagguug

SEQ ID NO: 27514 - RNA, 24 nt, Human
aaguauugggacuacaggcgugag

SEQ ID NO: 27515 - RNA, 32 nt, Human
aaguauugggguggagguugcagugagcagag

SEQ ID NO: 27516 - RNA, 32 nt, Human
aaguauugggguggagguugcagugagcggag

SEQ ID NO: 27517 - RNA, 32 nt, Human
aaguauuguuugcagcucuuuccaauaucuag

SEQ ID NO: 27518 - RNA, 32 nt, Human
aaguauuuccuuccccacaccauugcuacuca

SEQ ID NO: 27519 - RNA, 32 nt, Human
aaguauuuguuuaaucuugcuuugucuuuuca

SEQ ID NO: 27520 - RNA, 32 nt, Human
aaguauuuuagucuagaauuuucuccauuaca

SEQ ID NO: 27521 - RNA, 22 nt, Human
aaguauuuucauagucuuuacc

SEQ ID NO: 27522 - RNA, 32 nt, Human
aaguauuuucauauucuccugucuuuaaguuu

SEQ ID NO: 27523 - RNA, 32 nt, Human
aagucaaaaaccaaagguaagagaugcuaacu

SEQ ID NO: 27524 - RNA, 32 nt, Human
aagucaaacgcuaggaaguuugaauaaaacca

SEQ ID NO: 27525 - RNA, 32 nt, Human
aagucaaaggcugauguccuguuucucuuucc

SEQ ID NO: 27526 - RNA, 32 nt, Human
aagucaaaguaaaacuugcugccugaagaaca

SEQ ID NO: 27527 - RNA, 32 nt, Human
aagucaacacagacucauuuucuacuccgugu

SEQ ID NO: 27528 - RNA, 32 nt, Human
aagucaacacaugggaccuuugugucacauga

SEQ ID NO: 27529 - RNA, 32 nt, Human
aagucaacaggggcauguaggggaagagccuc

SEQ ID NO: 27530 - RNA, 32 nt, Human
aagucaacugugcaccugagcugcaguguaac

SEQ ID NO: 27531 - RNA, 32 nt, Human
aagucaagagugagagaagagaagaaaauuag

SEQ ID NO: 27532 - RNA, 32 nt, Human
aagucaagaguuugagaucagccuggagaaca

SEQ ID NO: 27533 - RNA, 32 nt, Human
aagucaagccaguuuccagaagggcuggggug

SEQ ID NO: 27534 - RNA, 32 nt, Human
aagucaagcuugugaaaugacauuuguguauu

SEQ ID NO: 27535 - RNA, 32 nt, Human
aagucaaggcugcugguuacauagacauggua

SEQ ID NO: 27536 - RNA, 32 nt, Human
aagucaagguaacagaacaaaagggaauccug

SEQ ID NO: 27537 - RNA, 32 nt, Human
aagucaauagaaagcucugccuugccagucuc

SEQ ID NO: 27538 - RNA, 32 nt, Human
aagucaaucauagaaagguugcaggaaacaag

SEQ ID NO: 27539 - RNA, 32 nt, Human
aagucaaucuuacuauauguaacuucagacaa

SEQ ID NO: 27540 - RNA, 32 nt, Human
aagucaauugaaaguccugccugcugcuuucc

SEQ ID NO: 27541 - RNA, 32 nt, Human
aagucacaagggggccugagugcaguggcuca

SEQ ID NO: 27542 - RNA, 32 nt, Human
aagucacacagcuaagaagcagugaugggaua

SEQ ID NO: 27543 - RNA, 31 nt, Human
aagucacacagcuaaucaauggcaaaguuag

SEQ ID NO: 27544 - RNA, 31 nt, Human
aagucacacagcuacugaguggcagagccag

SEQ ID NO: 27545 - RNA, 31 nt, Human
aagucacacagcuagugaagaccagagcagu

SEQ ID NO: 27546 - RNA, 32 nt, Human
aagucacacaucugcgcgccugugcggccccu

SEQ ID NO: 27547 - RNA, 32 nt, Human
aagucacacgcacacaugcacgcacacacaca

SEQ ID NO: 27548 - RNA, 32 nt, Human
aagucacagaagcuugcugggcuuuguacccu

SEQ ID NO: 27549 - RNA, 32 nt, Human
aagucaccaaaaacuuaaaggcauuaaaauaa

SEQ ID NO: 27550 - RNA, 32 nt, Human
aagucaccaccaugaaguuguucggcuucagg

SEQ ID NO: 27551 - RNA, 32 nt, Human
aagucaccaggccuccccuccuggcccaggug

SEQ ID NO: 27552 - RNA, 32 nt, Human
aagucaccagggugguccauucaagcugcaga

SEQ ID NO: 27553 - RNA, 32 nt, Human
aagucacccagcuguuucucagucccagaggc

SEQ ID NO: 27554 - RNA, 32 nt, Human
aagucaccccacuccuuagugccugcaccuca

SEQ ID NO: 27555 - RNA, 32 nt, Human
aagucacccccaacgcguccucucacaccguc

SEQ ID NO: 27556 - RNA, 32 nt, Human
aagucacccuuacaaagaagcuaauauggaaa

SEQ ID NO: 27557 - RNA, 32 nt, Human
aagucaccuucaaauuuccagagccauacaug

SEQ ID NO: 27558 - RNA, 32 nt, Human
aagucacgggcaggccgcagugguucuugcgu

SEQ ID NO: 27559 - RNA, 32 nt, Human
aagucacgucuuauguggaugguggcaggcaa

SEQ ID NO: 27560 - RNA, 32 nt, Human
aagucacuaaagauucauuuuuguugaguccu

SEQ ID NO: 27561 - RNA, 32 nt, Human
aagucacucauuaccacaacagugccacuuau

SEQ ID NO: 27562 - RNA, 32 nt, Human
aagucacugaggcuggaguacaguggcaugau

SEQ ID NO: 27563 - RNA, 32 nt, Human
aagucacugucccacuaugggucuccacuacc

SEQ ID NO: 27564 - RNA, 23 nt, Human
aagucacuuaaucucucuacaug

SEQ ID NO: 27565 - RNA, 32 nt, Human
aagucacuucaagaagucuggugguccccaga

SEQ ID NO: 27566 - RNA, 32 nt, Human
aagucacuucaccucucugugccuugguuucc

SEQ ID NO: 27567 - RNA, 32 nt, Human
aagucacuucauguggguugcugaagcaccau

SEQ ID NO: 27568 - RNA, 32 nt, Human
aagucacuucauucuaacuagaugcgcccacu

SEQ ID NO: 27569 - RNA, 32 nt, Human
aagucacuugacuugcuggcggccaccccguu

SEQ ID NO: 27570 - RNA, 32 nt, Human
aagucacuugagcucaggaguuugagaacaac

SEQ ID NO: 27571 - RNA, 32 nt, Human
aagucacuugugaauagaugugcaaggggagc

SEQ ID NO: 27572 - RNA, 32 nt, Human
aagucagaaauuagacaaagagaugaaaugcu

SEQ ID NO: 27573 - RNA, 32 nt, Human
aagucagaaggaaaaggaaaguagacaaguuu

SEQ ID NO: 27574 - RNA, 32 nt, Human
aagucagaaugcauuaauggacagcauuuaaa

SEQ ID NO: 27575 - RNA, 32 nt, Human
aagucagacugcugggacuggccagguuucug

SEQ ID NO: 27576 - RNA, 32 nt, Human
aagucagagacaacauccuuguccauauccaa

SEQ ID NO: 27577 - RNA, 32 nt, Human
aagucagagacaccuuugacugugucuaguga

SEQ ID NO: 27578 - RNA, 32 nt, Human
aagucagagagguggggugagggugagcuuac

SEQ ID NO: 27579 - RNA, 32 nt, Human
aagucagagccgagugccugcucucggcaccu

SEQ ID NO: 27580 - RNA, 32 nt, Human
aagucagagcuaguuccccaacagaaagauca

SEQ ID NO: 27581 - RNA, 32 nt, Human
aagucagaucagauuugcuaacaggaagcauu

SEQ ID NO: 27582 - RNA, 32 nt, Human
aagucagaugugccacugaacuugacagacac

SEQ ID NO: 27583 - RNA, 32 nt, Human
aagucagauucaggaaucaguccugguucuac

SEQ ID NO: 27584 - RNA, 32 nt, Human
aagucagcacagagcagugcccuggcuguguc

SEQ ID NO: 27585 - RNA, 32 nt, Human
aagucagcauuuucuuagaccucuucagcuga

SEQ ID NO: 27586 - RNA, 32 nt, Human
aagucagcccucucuauuucaugugccaacuc

SEQ ID NO: 27587 - RNA, 32 nt, Human
aagucagcccuugaguguauuuguucucaguc

SEQ ID NO: 27588 - RNA, 32 nt, Human
aagucagccugaggauuuagcccagaggugau

SEQ ID NO: 27589 - RNA, 32 nt, Human
aagucagcgagaucacgaaucugccagaagga

SEQ ID NO: 27590 - RNA, 32 nt, Human
aagucagcgaggacacagcauguuuguucuag

SEQ ID NO: 27591 - RNA, 32 nt, Human
aagucagcugaggggcugagggguggggcucc

SEQ ID NO: 27592 - RNA, 32 nt, Human
aagucagcugugccucacacaaggcucucuuu

SEQ ID NO: 27593 - RNA, 32 nt, Human
aagucagcuguggguggaggaugacccaggug

SEQ ID NO: 27594 - RNA, 32 nt, Human
aagucaggaacugccuugguuuccccuuuuau

SEQ ID NO: 27595 - RNA, 32 nt, Human
aagucaggacaucagucugauuaaagguggug

SEQ ID NO: 27596 - RNA, 32 nt, Human
aagucaggacucugcauuuccaacaagcuccc

SEQ ID NO: 27597 - RNA, 32 nt, Human
aagucaggaggcggaggcugcuuuucugagug

SEQ ID NO: 27598 - RNA, 32 nt, Human
aagucaggaguucaggagcaucagaguucucu

SEQ ID NO: 27599 - RNA, 32 nt, Human
aagucaggauguuguuugaucuucucaaacau

SEQ ID NO: 27600 - RNA, 32 nt, Human
aagucaggcauggcucucacccagggacaggu

SEQ ID NO: 27601 - RNA, 32 nt, Human
aagucaggcccugguucucuucugucuuguuu

SEQ ID NO: 27602 - RNA, 31 nt, Human
aagucaggccucucugggaaggucacaaggc

SEQ ID NO: 27603 - RNA, 32 nt, Human
aagucaggcgugccuccuacaagcuuccuaac

SEQ ID NO: 27604 - RNA, 32 nt, Human
aagucagggaaaggggagaagaaagaaaaaca

SEQ ID NO: 27605 - RNA, 32 nt, Human
aagucagggcaccacaacacgccaccgggaga

SEQ ID NO: 27606 - RNA, 32 nt, Human
aagucagggcgaagacgccagguucagcaugg

SEQ ID NO: 27607 - RNA, 32 nt, Human
aagucagggucuggggcccaaagaacgggcac

SEQ ID NO: 27608 - RNA, 32 nt, Human
aagucaggucaagugaugcuuuugagcuuaca

SEQ ID NO: 27609 - RNA, 32 nt, Human
aagucaggugcugcaaauuggaaagaagacuu

SEQ ID NO: 27610 - RNA, 32 nt, Human
aagucagguucaggaaucaguccugguucuac

SEQ ID NO: 27611 - RNA, 32 nt, Human
aagucaguaagaaagugugaaaugcuaguaua

SEQ ID NO: 27612 - RNA, 32 nt, Human
aagucaguaagccuuagggaaggugagugugg

SEQ ID NO: 27613 - RNA, 32 nt, Human
aagucagucaguuaggggaggagaaggagagg

SEQ ID NO: 27614 - RNA, 32 nt, Human
aagucagucauuuauugaaguuuuagcuacua

SEQ ID NO: 27615 - RNA, 18 nt, Human
aagucaguugucaaugga

SEQ ID NO: 27616 - RNA, 32 nt, Human
aagucauaagccucagggaggccauuuuugcc

SEQ ID NO: 27617 - RNA, 21 nt, Human
aagucauaaguucuuuacaua

SEQ ID NO: 27618 - RNA, 32 nt, Human
aagucauauguauguuucuacugaucggccag

SEQ ID NO: 27619 - RNA, 32 nt, Human
aagucaucaacugccaaccaaggggacgggga

SEQ ID NO: 27620 - RNA, 32 nt, Human
aagucaucaaggccucuugaaagagaaucaua

SEQ ID NO: 27621 - RNA, 23 nt, Human
aagucaucaauauuucucuacau

SEQ ID NO: 27622 - RNA, 32 nt, Human
aagucaucaccacucccuaaucucaaguaccc

SEQ ID NO: 27623 - RNA, 32 nt, Human
aagucauccuuccuacugucaugguuuguuau

SEQ ID NO: 27624 - RNA, 32 nt, Human
aagucaucgccacuccccagucucaauaaauc

SEQ ID NO: 27625 - RNA, 32 nt, Human
aagucaugagaugcuuaacccaugaaugcccc

SEQ ID NO: 27626 - RNA, 32 nt, Human
aagucaugccacugcacucaaaccuggcggac

SEQ ID NO: 27627 - RNA, 32 nt, Human
aagucaugccccagaagcaagguguaagcaug

SEQ ID NO: 27628 - RNA, 22 nt, Human
aagucauggacauucaugcuca

SEQ ID NO: 27629 - RNA, 32 nt, Human
aagucauggcucugcuguugcuuccagaacca

SEQ ID NO: 27630 - RNA, 32 nt, Human
aagucaugggcagugcccuggccugaggccca

SEQ ID NO: 27631 - RNA, 32 nt, Human
aagucauggguccucagagugggggcuccuua

SEQ ID NO: 27632 - RNA, 32 nt, Human
aagucaugucugcuuccucugccuccagcuca

SEQ ID NO: 27633 - RNA, 32 nt, Human
aagucauuaaacggaucaugucuguacauugu

SEQ ID NO: 27634 - RNA, 32 nt, Human
aagucauuaacaaacaacaguuccagagaaaa

SEQ ID NO: 27635 - RNA, 32 nt, Human
aagucauuuucacauccucuugagguucagag

SEQ ID NO: 27636 - RNA, 32 nt, Human
aagucauuuuucauucaucuaacucuguuaau

SEQ ID NO: 27637 - RNA, 32 nt, Human
aaguccaaagaguaugucuagcucuuuacugg

SEQ ID NO: 27638 - RNA, 32 nt, Human
aaguccaaagggugugcgcacacacaauggug

SEQ ID NO: 27639 - RNA, 23 nt, Human
aaguccaaauggcaccaccugua

SEQ ID NO: 27640 - RNA, 32 nt, Human
aaguccaacuuaaccaacuuuccuucaaaguc

SEQ ID NO: 27641 - RNA, 32 nt, Human
aaguccacacaggggaggugauagcauugcuu

SEQ ID NO: 27642 - RNA, 32 nt, Human
aaguccacaggcugguggaguuccgaugacaa

SEQ ID NO: 27643 - RNA, 32 nt, Human
aaguccacugccuuugccccagcacagaagag

SEQ ID NO: 27644 - RNA, 32 nt, Human
aaguccagaaggaggugcuuuuaaugugcuga

SEQ ID NO: 27645 - RNA, 32 nt, Human
aaguccagcaaccugcacuccagccuggguga

SEQ ID NO: 27646 - RNA, 32 nt, Human
aaguccagccugggcuacauagugagaccgug

SEQ ID NO: 27647 - RNA, 32 nt, Human
aaguccaggaagagaaauguaggguuuuacag

SEQ ID NO: 27648 - RNA, 32 nt, Human
aaguccaggacccacuagguugccucagaagc

SEQ ID NO: 27649 - RNA, 32 nt, Human
aauagcugggauuacaguugccugccaccacg

SEQ ID NO: 27650 - RNA, 32 nt, Human
aauagcugucagccguuccacccuuuugaccu

SEQ ID NO: 27651 - RNA, 32 nt, Human
aauagcuguuuaauggaaaccugcugggcugg

SEQ ID NO: 27652 - RNA, 32 nt, Human
aauagcuucuccuacagugauucaugucccag

SEQ ID NO: 27653 - RNA, 32 nt, Human
aauagcuuucagaaacaaacaguuauaugaga

SEQ ID NO: 27654 - RNA, 32 nt, Human
aauagcuuuguuuuugcuaugcuaaugucuag

SEQ ID NO: 27655 - RNA, 32 nt, Human
aauaggaaaaauugucauggauucaaguuauu

SEQ ID NO: 27656 - RNA, 32 nt, Human
aauaggaacaggagauauuucucaauuguaaa

SEQ ID NO: 27657 - RNA, 32 nt, Human
aauaggaagaacaguacauuuuugucuuuauc

SEQ ID NO: 27658 - RNA, 32 nt, Human
aauaggaagcgcucucaugcaggaucugaggg

SEQ ID NO: 27659 - RNA, 32 nt, Human
aauaggacaucuggcucccagcauccaaauua

SEQ ID NO: 27660 - RNA, 32 nt, Human
aauaggacucgacuuggagaaauugcuauucu

SEQ ID NO: 27661 - RNA, 32 nt, Human
aauaggacuugccuucucccugggcagggaga

SEQ ID NO: 27662 - RNA, 32 nt, Human
aauaggagcgauugacaugacaagaacugaga

SEQ ID NO: 27663 - RNA, 32 nt, Human
aauaggaggauagaauuuggauccaaaucuag

SEQ ID NO: 27664 - RNA, 32 nt, Human
aauaggaguagagguuuaccacucuuagguga

SEQ ID NO: 27665 - RNA, 31 nt, Human
aauaggagugaagagagaaaagacuaacagg

SEQ ID NO: 27666 - RNA, 32 nt, Human
aauaggauuaaacacacacaaaaugcucaagg

SEQ ID NO: 27667 - RNA, 32 nt, Human
aauaggauuugugcuccuaugagaaucuaaca

SEQ ID NO: 27668 - RNA, 32 nt, Human
aauaggccaaggcagagauccaugccugcaug

SEQ ID NO: 27669 - RNA, 32 nt, Human
aauaggccacagaaggugaacuuugugcuuca

SEQ ID NO: 27670 - RNA, 32 nt, Human
aauaggcccugagaugugaggucugcugcuuc

SEQ ID NO: 27671 - RNA, 32 nt, Human
aauaggccgguggcucaugccuguaaucucag

SEQ ID NO: 27672 - RNA, 32 nt, Human
aauaggccucucccccagucccauuuagaauc

SEQ ID NO: 27673 - RNA, 32 nt, Human
aauaggccugacuuagucaucauugauauaag

SEQ ID NO: 27674 - RNA, 32 nt, Human
aauaggccugggaaagucgcacuuucauccac

SEQ ID NO: 27675 - RNA, 32 nt, Human
aauaggcugcaaucaaguucacuuccaaaggc

SEQ ID NO: 27676 - RNA, 32 nt, Human
aauaggcugggccacauguuggaaauaagcua

SEQ ID NO: 27677 - RNA, 32 nt, Human
aauaggcuuuugacugggcaugguggcucacg

SEQ ID NO: 27678 - RNA, 32 nt, Human
aauagggagaugcaggaagugggggcccaugg

SEQ ID NO: 27679 - RNA, 32 nt, Human
aauagggaggaggugagaggcuggggugcccc

SEQ ID NO: 27680 - RNA, 32 nt, Human
aauagggaggggaggagaggagaggagaggga

SEQ ID NO: 27681 - RNA, 32 nt, Human
aauagggauggggagagcaagccccgcauguc

SEQ ID NO: 27682 - RNA, 32 nt, Human
aauagggauuugggaugaaacagcugcaguua

SEQ ID NO: 27683 - RNA, 32 nt, Human
aauagggcauaagagagaagaagauguacuua

SEQ ID NO: 27684 - RNA, 32 nt, Human
aauagggccaaagagaaaaauaacaggacucu

SEQ ID NO: 27685 - RNA, 32 nt, Human
aauagggcggacacuccucucuuuuccuguag

SEQ ID NO: 27686 - RNA, 32 nt, Human
aauaggggcauggugacccuugacucaccauc

SEQ ID NO: 27687 - RNA, 32 nt, Human
aauaggggucucaagugacuucacccuagaag

SEQ ID NO: 27688 - RNA, 32 nt, Human
aauaggguauucugccccuuguuuccacagcu

SEQ ID NO: 27689 - RNA, 32 nt, Human
aauaggguugucuuuccuaugaaaaugccauc

SEQ ID NO: 27690 - RNA, 32 nt, Human
aauaggguuuauguuaaccuaacuuucagggc

SEQ ID NO: 27691 - RNA, 32 nt, Human
aauaggucaccaacugugugccauggaagccc

SEQ ID NO: 27692 - RNA, 32 nt, Human
aauagguccugagacuguugauagccccagac

SEQ ID NO: 27693 - RNA, 32 nt, Human
aauaggucuuucucucaaccugcaagagcuaa

SEQ ID NO: 27694 - RNA, 32 nt, Human
aauaggugcucaauaaauauuuauaugaguga

SEQ ID NO: 27695 - RNA, 32 nt, Human
aauaggugcuuccccugaggugcaggggaaga

SEQ ID NO: 27696 - RNA, 32 nt, Human
aauagguggaaaacauggaauuucuuuuaggu

SEQ ID NO: 27697 - RNA, 32 nt, Human
aauagguggaaagagaaaugaugugaaagaua

SEQ ID NO: 27698 - RNA, 32 nt, Human
aauagguugggcuaguuaacugcagcaggagc

SEQ ID NO: 27699 - RNA, 32 nt, Human
aauaguaagaagguggaggaagacuuaaaggc

SEQ ID NO: 27700 - RNA, 32 nt, Human
aauaguaaugagugguaggucauuucaaaauc

SEQ ID NO: 27701 - RNA, 32 nt, Human
aauaguacacuugugaggcaugugggaaacaa

SEQ ID NO: 27702 - RNA, 22 nt, Human
aauaguacuccagaaagacaaa

SEQ ID NO: 27703 - RNA, 32 nt, Human
aauaguacugcagcuucuuguggccuacagug

SEQ ID NO: 27704 - RNA, 32 nt, Human
aauaguagaggaggggagagaggcaccuggca

SEQ ID NO: 27705 - RNA, 32 nt, Human
aauaguagcucccuccaagauggaggcaggag

SEQ ID NO: 27706 - RNA, 32 nt, Human
aauaguaggaguuuccccagaagucauuuuca

SEQ ID NO: 27707 - RNA, 32 nt, Human
aauaguaguaccauaugccaaagugauagaga

SEQ ID NO: 27708 - RNA, 32 nt, Human
aauaguaugggggagcaucucuucagaauggg

SEQ ID NO: 27709 - RNA, 32 nt, Human
aauagucaaauggggaaauuaaacauucaaug

SEQ ID NO: 27710 - RNA, 32 nt, Human
aauagucagcugacuaaagacuguguguguug

SEQ ID NO: 27711 - RNA, 32 nt, Human
aauagucaggcagcuugugagugguuuuuaga

SEQ ID NO: 27712 - RNA, 32 nt, Human
aauagucauccaggaaaaucggaaagaagcac

SEQ ID NO: 27713 - RNA, 32 nt, Human
aauagucccucucucugcuccuccauucgcaa

SEQ ID NO: 27714 - RNA, 32 nt, Human
aauagucccucugcucccaagaucccagccag

SEQ ID NO: 27715 - RNA, 32 nt, Human
aauaguccuaggcuggacagcaaugggcugca

SEQ ID NO: 27716 - RNA, 32 nt, Human
aauagucguggcagugcugcugaauuugcagu

SEQ ID NO: 27717 - RNA, 32 nt, Human
aauagucucagucacauaugaagaggaaaauu

SEQ ID NO: 27718 - RNA, 32 nt, Human
aauagucuggaaaauuuuuggaaagaauccac

SEQ ID NO: 27719 - RNA, 32 nt, Human
aauagucuuauucaaggaauaagaacuaugua

SEQ ID NO: 27720 - RNA, 32 nt, Human
aauagucuugugcuaugcagcagguguaaaaa

SEQ ID NO: 27721 - RNA, 32 nt, Human
aauagugaaauggaucccacuaauuaugacag

SEQ ID NO: 27722 - RNA, 32 nt, Human
aauagugacucugugcuugucuguuuaguucu

SEQ ID NO: 27723 - RNA, 32 nt, Human
aauagugcagacagaaaacugcagugaacaca

SEQ ID NO: 27724 - RNA, 32 nt, Human
aauagugccaaaguugagagacccugggguag

SEQ ID NO: 27725 - RNA, 32 nt, Human
aauagugccaucauccacugcccugacaccuc

SEQ ID NO: 27726 - RNA, 32 nt, Human
aauaguggaaaucgcuuauauguccuuggguu

SEQ ID NO: 27727 - RNA, 32 nt, Human
aauagugggagauggagaagagugaaugaguu

SEQ ID NO: 27728 - RNA, 32 nt, Human
aauaguggggagggaaaaacuccuccuugaag

SEQ ID NO: 27729 - RNA, 32 nt, Human
aauagugucauccucacagugaacacucagug

SEQ ID NO: 27730 - RNA, 32 nt, Human
aauaguguccugguucugaccugcacuugagu

SEQ ID NO: 27731 - RNA, 32 nt, Human
aauagugucuacuaucucaacccuccaaaauu

SEQ ID NO: 27732 - RNA, 32 nt, Human
aauaguguuuguaaucuacacguuuauuugag

SEQ ID NO: 27733 - RNA, 32 nt, Human
aauaguguuuucuuccucuggguucuuauaau

SEQ ID NO: 27734 - RNA, 32 nt, Human
aauaguucagguaacaggcagauacaggaaaa

SEQ ID NO: 27735 - RNA, 32 nt, Human
aauaguuccacaccugaagacccuccaacagc

SEQ ID NO: 27736 - RNA, 32 nt, Human
aauaguucgagaccagccuggccaacaaggug

SEQ ID NO: 27737 - RNA, 32 nt, Human
aauaguucgagaucagccugaccaacaugaug

SEQ ID NO: 27738 - RNA, 32 nt, Human
aauaguucuaaaacaugcuaaccugaccuuuu

SEQ ID NO: 27739 - RNA, 32 nt, Human
aauaguucugguauguuagccauucacauuuu

SEQ ID NO: 27740 - RNA, 32 nt, Human
aauaguucuuucuccugcuucuccguuuaucu

SEQ ID NO: 27741 - RNA, 32 nt, Human
aauaguugaauagauucaccagaauaauucau

SEQ ID NO: 27742 - RNA, 32 nt, Human
aauaguugcauaugggaauuuaaaccaacaug

SEQ ID NO: 27743 - RNA, 32 nt, Human
aauaguugcuugaauuaugaucaucuaccacc

SEQ ID NO: 27744 - RNA, 32 nt, Human
aauaguugucauuuccucagugaugguguguc

SEQ ID NO: 27745 - RNA, 32 nt, Human
aauaguuuauucagccacuguucccagccaca

SEQ ID NO: 27746 - RNA, 32 nt, Human
aauaguuucacccugcacuacccuguucugua

SEQ ID NO: 27747 - RNA, 32 nt, Human
aauaguuuccagcacauggauugaucugagag

SEQ ID NO: 27748 - RNA, 32 nt, Human
aauaguuuccucuccccucccuucuacuucca

SEQ ID NO: 27749 - RNA, 32 nt, Human
aauaguuucuguacuuuagcagaacaggaagg

SEQ ID NO: 27750 - RNA, 32 nt, Human
aauaguuugccuccagccaccauugcucucca

SEQ ID NO: 27751 - RNA, 32 nt, Human
aauaguuuggaccuugugccuccugugggagg

SEQ ID NO: 27752 - RNA, 32 nt, Human
aauaguuuuaucuguacaguugugcaagauau

SEQ ID NO: 27753 - RNA, 32 nt, Human
aauaguuuucuuccucuucuccuugggccagu

SEQ ID NO: 27754 - RNA, 32 nt, Human
aauauaaaaaccaaaaacuacugugugcaaau

SEQ ID NO: 27755 - RNA, 32 nt, Human
aauauaaaaaccaccuaggaaccugcuguugc

SEQ ID NO: 27756 - RNA, 32 nt, Human
aauauaaaauuggccaugcaugguggcacaug

SEQ ID NO: 27757 - RNA, 32 nt, Human
aauauaaaauuugaucuucuaaucugugacga

SEQ ID NO: 27758 - RNA, 32 nt, Human
aauauaaacuaguacagccacuaugaaaaacu

SEQ ID NO: 27759 - RNA, 32 nt, Human
aauauaaacucuccucuuaaucauuuucugga

SEQ ID NO: 27760 - RNA, 32 nt, Human
aauauaacagaaguguuaacuauuguauuccc

SEQ ID NO: 27761 - RNA, 24 nt, Human
aauauaacauaugcaguaauaaac

SEQ ID NO: 27762 - RNA, 32 nt, Human
aauauaaccauaguuaccuaagcacacaguga

SEQ ID NO: 27763 - RNA, 32 nt, Human
aauauaaccccuucuuugagcucugaaccagu

SEQ ID NO: 27764 - RNA, 32 nt, Human
aauauaacuguuuccccucucugcugcuuuag

SEQ ID NO: 27765 - RNA, 32 nt, Human
aauauaagacaagucugaguaguuaugaaucg

SEQ ID NO: 27766 - RNA, 32 nt, Human
aauauaagaguuuguacugaaaccauuuauuu

SEQ ID NO: 27767 - RNA, 32 nt, Human
aauauaagauuagccgggcaugguggcacgug

SEQ ID NO: 27768 - RNA, 32 nt, Human
aauauaagcauguagaugaggauguggcugua

SEQ ID NO: 27769 - RNA, 32 nt, Human
aauauaagcugcuggggaagcugugaaaaccc

SEQ ID NO: 27770 - RNA, 32 nt, Human
aauauaaggaaggcuuugcagcagcauugaaa

SEQ ID NO: 27771 - RNA, 32 nt, Human
aauauaaggcauuccuauuuugcaguucagaa

SEQ ID NO: 27772 - RNA, 32 nt, Human
aauauaauucacaugccauacacuucacccau

SEQ ID NO: 27773 - RNA, 32 nt, Human
aauauacaaucuguaacaacacacagccugac

SEQ ID NO: 27774 - RNA, 32 nt, Human
aauauacaaugauccuggaaauugcaguaaca

SEQ ID NO: 27775 - RNA, 32 nt, Human
aauauacacaaggccggggaagccacagccaa

SEQ ID NO: 27776 - RNA, 32 nt, Human
aauauacacacguauauguaacagcacuuugc

SEQ ID NO: 27777 - RNA, 32 nt, Human
aauauacaguacauugcaggaacugccucagg

SEQ ID NO: 27778 - RNA, 32 nt, Human
aauauacauggaaaacagcuuuuuacaauuaa

SEQ ID NO: 27779 - RNA, 32 nt, Human
aauauaccaucuuucuacaguauuuccuacag

SEQ ID NO: 27780 - RNA, 32 nt, Human
aauauacccaacaacuggaauuguuuacacau

SEQ ID NO: 27781 - RNA, 32 nt, Human
aauauaccuuagaguucacacuguacaguagg

SEQ ID NO: 27782 - RNA, 32 nt, Human
aauauacguagcuagguccuaaccucggagau

SEQ ID NO: 27783 - RNA, 32 nt, Human
aauauacuaagcugaauaacagcucuuuggcc

SEQ ID NO: 27784 - RNA, 32 nt, Human
aauauacucauguaacaagccugcacauguac

SEQ ID NO: 27785 - RNA, 32 nt, Human
aauauacuuacauaugugauaugcauagugua

SEQ ID NO: 27786 - RNA, 32 nt, Human
aauauacuuacucugugcuuguguaugugaau

SEQ ID NO: 27787 - RNA, 32 nt, Human
aauauacuugaauauugcuuaaagaauugugu

SEQ ID NO: 27788 - RNA, 32 nt, Human
aauauagaaguuaaggaaguaguaagucagug

SEQ ID NO: 27789 - RNA, 32 nt, Human
aauauagacuuuacugaauuaguucagaauag

SEQ ID NO: 27790 - RNA, 32 nt, Human
aauauagagacaggugucucacuguguugucc

SEQ ID NO: 27791 - RNA, 32 nt, Human
aauauagauggaaaaggaggcccuuaugugaa

SEQ ID NO: 27792 - RNA, 32 nt, Human
aauauagcacagcugucaucucauuuuggaca

SEQ ID NO: 27793 - RNA, 32 nt, Human
aauauagcacugcggagcaggcugaagagguc

SEQ ID NO: 27794 - RNA, 32 nt, Human
aauauagcgaaaucucuccacugccuucuguc

SEQ ID NO: 27795 - RNA, 32 nt, Human
aauauagcuaauagaauuuucuaaauuuuacc

SEQ ID NO: 27796 - RNA, 32 nt, Human
aauauagcucuuaggcuuccagccucuaccau

SEQ ID NO: 27797 - RNA, 32 nt, Human
aauauaggaggcagagguugcagugagccgag

SEQ ID NO: 27798 - RNA, 32 nt, Human
aauauagggaagagaagcugccagcaauggcc

SEQ ID NO: 27799 - RNA, 32 nt, Human
aauauaggguaugaaugguuuaaucaaggcuu

SEQ ID NO: 27800 - RNA, 31 nt, Human
aauauaggugagagacaagauugucucauau

SEQ ID NO: 27801 - RNA, 32 nt, Human
aauauaggugugagccaccacgccuggcuaau

SEQ ID NO: 27802 - RNA, 32 nt, Human
aauauaguaagacagaaguauuggacauguug

SEQ ID NO: 27803 - RNA, 32 nt, Human
aauauaguaucugggggagaagacuuacuucc

SEQ ID NO: 27804 - RNA, 32 nt, Human
aauauaguuagagacaucagguuuaagccagu

SEQ ID NO: 27805 - RNA, 32 nt, Human
aauauaguucauacugugucugugaguauauu

SEQ ID NO: 27806 - RNA, 32 nt, Human
aauauaguuccacauuauccugggcuugaagg

SEQ ID NO: 27807 - RNA, 32 nt, Human
aauauauaaauguauugcucuaaaaauaaacc

SEQ ID NO: 27808 - RNA, 32 nt, Human
aauauauaaucaaaugauucauuuuucuguua

SEQ ID NO: 27809 - RNA, 32 nt, Human
aauauauaauuuacuggaccucagcccaaauc

SEQ ID NO: 27810 - RNA, 32 nt, Human
aauauauacagcccugcucugggacacaccuc

SEQ ID NO: 27811 - RNA, 32 nt, Human
aauauaucacugcauauuuuuacccuuauuuu

SEQ ID NO: 27812 - RNA, 32 nt, Human
aauauaucagccagagggggaagaaggguggc

SEQ ID NO: 27813 - RNA, 32 nt, Human
aauauauccauguaacaaaaccgcacuuguac

SEQ ID NO: 27814 - RNA, 32 nt, Human
aauauauccguagaauggagagggaccggauc

SEQ ID NO: 27815 - RNA, 32 nt, Human
aauauaucucuuucuuuuucuuccgacauuag

SEQ ID NO: 27816 - RNA, 32 nt, Human
aauauaucuuaagcagguuuguuuucagcacu

SEQ ID NO: 27817 - RNA, 32 nt, Human
aauauaugaaggagaggaggguaaaggagaau

SEQ ID NO: 27818 - RNA, 32 nt, Human
aauauaugcagaccaacaggucuuugcauucc

SEQ ID NO: 27819 - RNA, 32 nt, Human
aauauauggaagucaaagugaggaacagagau

SEQ ID NO: 27820 - RNA, 32 nt, Human
aauauauguaaagcacuuuaacacagcaccag

SEQ ID NO: 27821 - RNA, 32 nt, Human
aauauauguauauguggggacagggaguaugu

SEQ ID NO: 27822 - RNA, 32 nt, Human
aauauauguaugaaauaaaauuaguuccauuu

SEQ ID NO: 27823 - RNA, 32 nt, Human
aauauaugugagaguacuuaguugaaacaaaa

SEQ ID NO: 27824 - RNA, 32 nt, Human
aauauaugugguuugggggaaaggacaagaaa

SEQ ID NO: 27825 - RNA, 32 nt, Human
aauauauguuauagccacggugguuaguuuaa

SEQ ID NO: 27826 - RNA, 32 nt, Human
aauauauuauauaauauguuacacucuuaaua

SEQ ID NO: 27827 - RNA, 32 nt, Human
aauauauucauaauuuacuuuaugaccuagaa

SEQ ID NO: 27828 - RNA, 32 nt, Human
aauauauucucaaaaauauauuaaaacaaacu

SEQ ID NO: 27829 - RNA, 32 nt, Human
aauauauucuuccucuuuuuguccucaucacu

SEQ ID NO: 27830 - RNA, 32 nt, Human
aauauauugagccauguuaaccugccaaugag

SEQ ID NO: 27831 - RNA, 32 nt, Human
aauauauugccaccaucuuggagcucagugcc

SEQ ID NO: 27832 - RNA, 32 nt, Human
aauauauuucaucacugguuacaguuuuaaau

SEQ ID NO: 27833 - RNA, 32 nt, Human
aauauauuuugaagaggugugggaggaaggaa

SEQ ID NO: 27834 - RNA, 32 nt, Human
aauauauuuuugcaaaugcagcaguaaauaug

SEQ ID NO: 27835 - RNA, 32 nt, Human
aauaucaaaauggugggccaggcgugguagcu

SEQ ID NO: 27836 - RNA, 32 nt, Human
aauaucaaacacacaaagucauaaaaugaaaa

SEQ ID NO: 27837 - RNA, 32 nt, Human
aauaucaacucucacuccugaauucaguugcu

SEQ ID NO: 27838 - RNA, 32 nt, Human
aauaucaagcacccucccucuagguccaggga

SEQ ID NO: 27839 - RNA, 32 nt, Human
aauaucaaugcccaacagggcaaccaauaaaa

SEQ ID NO: 27840 - RNA, 32 nt, Human
aauaucaauggacugagucugauucagaaaau

SEQ ID NO: 27841 - RNA, 32 nt, Human
aauaucaauuguuuagacacaccuacaaugau

SEQ ID NO: 27842 - RNA, 32 nt, Human
aauaucaccaucaaugaaacauaaauguaauu

SEQ ID NO: 27843 - RNA, 32 nt, Human
aauaucacugacacuccagacuaaagcagagu

SEQ ID NO: 27844 - RNA, 32 nt, Human
aauaucacuucccuagaaauugcucucaucug

SEQ ID NO: 27845 - RNA, 32 nt, Human
aauaucagaacugagccaggaggcaggugcac

SEQ ID NO: 27846 - RNA, 23 nt, Human
aauaucagagaauuuaugguaga

SEQ ID NO: 27847 - RNA, 32 nt, Human
aauaucagcacuggccucucccucaccaccau

SEQ ID NO: 27848 - RNA, 32 nt, Human
aauaucagccacuccuacggugugagagaauu

SEQ ID NO: 27849 - RNA, 32 nt, Human
aauaucagcggauucggaaggagaagccucaa

SEQ ID NO: 27850 - RNA, 32 nt, Human
aauaucagcuacucaggaggcugaggcaggag

SEQ ID NO: 27851 - RNA, 32 nt, Human
aauaucagcuacuugggagacugaggcaggag

SEQ ID NO: 27852 - RNA, 32 nt, Human
aauaucagguucuagaagaaacuggcgcuuaa

SEQ ID NO: 27853 - RNA, 32 nt, Human
aauaucaguuuuacuuuucagaggauuuguaa

SEQ ID NO: 27854 - RNA, 21 nt, Human
aauaucauacugugguuucug

SEQ ID NO: 27855 - RNA, 32 nt, Human
aauaucauaugcuugaggcucacuguugaugu

SEQ ID NO: 27856 - RNA, 32 nt, Human
aauaucaucauuuucuaguugacauuugaauc

SEQ ID NO: 27857 - RNA, 32 nt, Human
aauaucaugccacugcacuccagccuggguga

SEQ ID NO: 27858 - RNA, 32 nt, Human
aauaucauguaggaauuuaaaaagccaaaaua

SEQ ID NO: 27859 - RNA, 32 nt, Human
aauaucauuacagcacguuaacuuuuccauuc

SEQ ID NO: 27860 - RNA, 32 nt, Human
aauaucauuucgauaaccucacugaaaaacau

SEQ ID NO: 27861 - RNA, 32 nt, Human
aauaucauuuggagaaagugucauggaaguuc

SEQ ID NO: 27862 - RNA, 21 nt, Human
aauaucauuuuugaggcuuug

SEQ ID NO: 27863 - RNA, 32 nt, Human
aauauccacaaagcuucgccuuugcuuuugca

SEQ ID NO: 27864 - RNA, 32 nt, Human
aauauccacaauucaaaagcaccuaaaaagaa

SEQ ID NO: 27865 - RNA, 32 nt, Human
aauauccaccucuccuuuuugccauuucacuu

SEQ ID NO: 27866 - RNA, 32 nt, Human
aauauccagccacuggugcacagccauugcca

SEQ ID NO: 27867 - RNA, 32 nt, Human
aauauccauucccucacucuacucuccucacu

SEQ ID NO: 27868 - RNA, 32 nt, Human
aauaucccaagugccuggcuuugauaguuaaa

SEQ ID NO: 27869 - RNA, 32 nt, Human
aauauccccaaagcuuuuggguccucaaguca

SEQ ID NO: 27870 - RNA, 32 nt, Human
aauauccccuaaaaacuugaggaaggaagaug

SEQ ID NO: 27871 - RNA, 32 nt, Human
aauaucccuacugacaguaacuaccugucaca

SEQ ID NO: 27872 - RNA, 32 nt, Human
aauaucccuccccauucuucucuuccccucuc

SEQ ID NO: 27873 - RNA, 32 nt, Human
aauaucccuccccucucucccugguccccucc

SEQ ID NO: 27874 - RNA, 32 nt, Human
aauauccuaaaaggaaugccaauuaaguuuug

SEQ ID NO: 27875 - RNA, 32 nt, Human
aauauccuaaagucaugcacuucccagaugau

SEQ ID NO: 27876 - RNA, 32 nt, Human
aauauccuauguuugcaucacauaucucuggc

SEQ ID NO: 27877 - RNA, 32 nt, Human
aauauccuccaaaaggagagugcaucugagac

SEQ ID NO: 27878 - RNA, 32 nt, Human
aauauccuguauccugaagcauguuuauuaac

SEQ ID NO: 27879 - RNA, 32 nt, Human
aauauccuucaaguuccacuucccagggagcu

SEQ ID NO: 27880 - RNA, 32 nt, Human
aauauccuuuguccugccccaggauuuagauc

SEQ ID NO: 27881 - RNA, 32 nt, Human
aauaucgcaccacugcacuccagccugggcaa

SEQ ID NO: 27882 - RNA, 32 nt, Human
aauaucggaccugacaacuucucuccaggaaa

SEQ ID NO: 27883 - RNA, 32 nt, Human
aauaucgggagaaaauacaaacucccuguguu

SEQ ID NO: 27884 - RNA, 32 nt, Human
aauaucgugccacugcauuccagccuggguga

SEQ ID NO: 27885 - RNA, 21 nt, Human
aauaucuacauggggcugcug

SEQ ID NO: 27886 - RNA, 32 nt, Human
aauaucuacuaucagcugauuacuagacacau

SEQ ID NO: 27887 - RNA, 32 nt, Human
aauaucuauccuguauucucuuugccaucuag

SEQ ID NO: 27888 - RNA, 32 nt, Human
aauaucucuuucuguguucaagaaggugaaau

SEQ ID NO: 27889 - RNA, 32 nt, Human
aauaucugaaagucaacaugaugcuucuugca

SEQ ID NO: 27890 - RNA, 32 nt, Human
aauaucugaacaaacagcagcugcagacaaaa

SEQ ID NO: 27891 - RNA, 32 nt, Human
aauaucugccuugcccgucagcagaaagcugu

SEQ ID NO: 27892 - RNA, 32 nt, Human
aauaucuggagacaaauacaaugcaauugcaa

SEQ ID NO: 27893 - RNA, 32 nt, Human
aauaucugggauuacaggugcccaccaccaug

SEQ ID NO: 27894 - RNA, 32 nt, Human
aauaucugggauuacaggugcccgcuaccaug

SEQ ID NO: 27895 - RNA, 32 nt, Human
aauaucugucugcaggcaugcagcagucuaca

SEQ ID NO: 27896 - RNA, 32 nt, Human
aauaucugucugcaggcaugcagcagucuacc

SEQ ID NO: 27897 - RNA, 32 nt, Human
aauaucuguggcuaaaaaguuugagauuugug

SEQ ID NO: 27898 - RNA, 32 nt, Human
aauaucuuaguuugcuaccagcauccagcaug

SEQ ID NO: 27899 - RNA, 32 nt, Human
aauaucuucauacuuccucauccccucauugg

SEQ ID NO: 27900 - RNA, 32 nt, Human
aauaucuucucacgccuguaaucccagcacuu

SEQ ID NO: 27901 - RNA, 32 nt, Human
aauaucuucuuugaagcuucugaagaccuggu

SEQ ID NO: 27902 - RNA, 32 nt, Human
aauaucuugguauccaggauaaggguaugugg

SEQ ID NO: 27903 - RNA, 32 nt, Human
aauaucuuguguuguccuuuugucuucucugu

SEQ ID NO: 27904 - RNA, 32 nt, Human
aauaucuuucuagcccucagccacuacaaaug

SEQ ID NO: 27905 - RNA, 32 nt, Human
aauaucuuuucagaugcagucuauauuuuaug

SEQ ID NO: 27906 - RNA, 32 nt, Human
aauaucuuuuugaguaauuguuuuguuucuua

SEQ ID NO: 27907 - RNA, 32 nt, Human
aauaugaauacagggcaugcauuuugcagcag

SEQ ID NO: 27908 - RNA, 32 nt, Human
aauaugaccaaaagccauaaaugacugugaga

SEQ ID NO: 27909 - RNA, 32 nt, Human
aauaugaccacacuccagccaaggacaaaaug

SEQ ID NO: 27910 - RNA, 31 nt, Human
aauaugacccuaccagagguuggagaacaaa

SEQ ID NO: 27911 - RNA, 32 nt, Human
aauaugagagucagagagguuaaguuauuuuc

SEQ ID NO: 27912 - RNA, 32 nt, Human
aauaugagauucuuuuauagcagcuaugacau

SEQ ID NO: 27913 - RNA, 32 nt, Human
aauaugaggcucagagagguuaggugaucuac

SEQ ID NO: 27914 - RNA, 32 nt, Human
aauaugagugauaucacauucaauuuuauguc

SEQ ID NO: 27915 - RNA, 32 nt, Human
aauaugaguuucauuuccucugugucuuuggg

SEQ ID NO: 27916 - RNA, 32 nt, Human
aauaugaugcucuucugcuuuguuuuauucua

SEQ ID NO: 27917 - RNA, 25 nt, Human
aauaugauuuacagaauaauaaaca

SEQ ID NO: 27918 - RNA, 28 nt, Human
aauaugcaagaaucacaggaaacccaca

SEQ ID NO: 27919 - RNA, 32 nt, Human
aauaugcaaucaggcacagugccucaugccua

SEQ ID NO: 27920 - RNA, 32 nt, Human
aauaugcagauuuuaaacagcauuucacauuu

SEQ ID NO: 27921 - RNA, 32 nt, Human
aauaugcagcguucacaaaacagcugccagug

SEQ ID NO: 27922 - RNA, 32 nt, Human
aauaugcauuucuuagagcaguagcuugcagu

SEQ ID NO: 27923 - RNA, 32 nt, Human
aauaugcccaucauccuuccugagacacuaaa

SEQ ID NO: 27924 - RNA, 32 nt, Human
aauaugcucucauuucuuuguaaucuagauuu

SEQ ID NO: 27925 - RNA, 32 nt, Human
aauaugcugagugucuggagucagccugaaga

SEQ ID NO: 27926 - RNA, 32 nt, Human
aauaugcugugcauucacugccugcagugggu

SEQ ID NO: 27927 - RNA, 32 nt, Human
aauaugcuuagaggugcugcuguauuuaccug

SEQ ID NO: 27928 - RNA, 32 nt, Human
aauaugcuuugaugcauaguuuugaacuaaug

SEQ ID NO: 27929 - RNA, 32 nt, Human
aauauggaaaaaggauucucuaaaaauaaaug

SEQ ID NO: 27930 - RNA, 32 nt, Human
aauauggaaaacaaacacugcagacuugagau

SEQ ID NO: 27931 - RNA, 32 nt, Human
aauauggaaagaaaauuaaaaugugucaauaa

SEQ ID NO: 27932 - RNA, 32 nt, Human
aauauggagacaccuuugacuagcuagcaaga

SEQ ID NO: 27933 - RNA, 32 nt, Human
aauauggagagagguguuagcucacuagcuuu

SEQ ID NO: 27934 - RNA, 32 nt, Human
aauauggagcuuucauaaaaaugggaugcauu

SEQ ID NO: 27935 - RNA, 32 nt, Human
aauauggagucucugcccugagaucuucccca

SEQ ID NO: 27936 - RNA, 32 nt, Human
aauauggaucaucacagauccaaacagaaaaa

SEQ ID NO: 27937 - RNA, 32 nt, Human
aauauggcaaauauuuguauauucccaagggg

SEQ ID NO: 27938 - RNA, 32 nt, Human
aauauggcauauggacacagauucucaugcca

SEQ ID NO: 27939 - RNA, 32 nt, Human
aauauggccuggcaaggcacuguuacugaucu

SEQ ID NO: 27940 - RNA, 32 nt, Human
aauauggcucacugcagccucgacaccugggu

SEQ ID NO: 27941 - RNA, 32 nt, Human
aauauggcucagaaaggcacugagaaaaccua

SEQ ID NO: 27942 - RNA, 32 nt, Human
aauauggcucccuaguguuggaaagggcagug

SEQ ID NO: 27943 - RNA, 32 nt, Human
aauauggcuucuccuuuuuccacacacaagag

SEQ ID NO: 27944 - RNA, 32 nt, Human
aauaugggucuauuugaaauaugcaaaaggua

SEQ ID NO: 27945 - RNA, 32 nt, Human
aauaugguauaccuccugaccccucucucccu

SEQ ID NO: 27946 - RNA, 23 nt, Human
aauauggucauuguacuuacgga

SEQ ID NO: 27947 - RNA, 20 nt, Human
aauauggucgcuauuuacag

SEQ ID NO: 27948 - RNA, 32 nt, Human
aauauggucucgaucuccugaccucgugaucc

SEQ ID NO: 27949 - RNA, 20 nt, Human
aauauggugauauauuuaca

SEQ ID NO: 27950 - RNA, 32 nt, Human
aauauggugcuaaaagaacuccuuaccuuucu

SEQ ID NO: 27951 - RNA, 32 nt, Human
aauauguaacuccuguucuuuccuucauuauu

SEQ ID NO: 27952 - RNA, 32 nt, Human
aauauguacucagauucuuucauuaggcaugu

SEQ ID NO: 27953 - RNA, 32 nt, Human
aauauguagauauagcaaaaagaaugagcugg

SEQ ID NO: 27954 - RNA, 32 nt, Human
aauauguauaaauaaaguuacauuuuagucug

SEQ ID NO: 27955 - RNA, 32 nt, Human
aauauguauauguauauguauguaagaugugu

SEQ ID NO: 27956 - RNA, 32 nt, Human
aauauguaucuaagaauguucuagggcacucu

SEQ ID NO: 27957 - RNA, 32 nt, Human
aauauguauuucucccauuucucccucuccuu

SEQ ID NO: 27958 - RNA, 32 nt, Human
aauaugucaucuuuacucagaauccuagggau

SEQ ID NO: 27959 - RNA, 32 nt, Human
aauaugucgcuucaaauauaacuaauauccug

SEQ ID NO: 27960 - RNA, 32 nt, Human
aauaugucuucacuccugauggaagcugcaac

SEQ ID NO: 27961 - RNA, 32 nt, Human
aauaugugaaauggaugauguacuggaucguc

SEQ ID NO: 27962 - RNA, 32 nt, Human
aauaugugaaguuuacaaaggaaccaaaauga

SEQ ID NO: 27963 - RNA, 32 nt, Human
aauaugugaugccacccccgguggcccagcug

SEQ ID NO: 27964 - RNA, 32 nt, Human
aauauguguugagcuucaugcagagggugguu

SEQ ID NO: 27965 - RNA, 32 nt, Human
aauauguuaguaacaaucuugcagccuuccuu

SEQ ID NO: 27966 - RNA, 32 nt, Human
aauauguuagucacccuuucagucuucuguau

SEQ ID NO: 27967 - RNA, 32 nt, Human
aauauguuaugccacauuccaaaagaauuuug

SEQ ID NO: 27968 - RNA, 32 nt, Human
aauauguucacaucuugguauguggccauauu

SEQ ID NO: 27969 - RNA, 32 nt, Human
aauauguucucccauuccauaaguugccuuuu

SEQ ID NO: 27970 - RNA, 32 nt, Human
aauauguuuauucgggaaaacugaggccagau

SEQ ID NO: 27971 - RNA, 32 nt, Human
aauauguuuccuuggccaggugcaauggcuca

SEQ ID NO: 27972 - RNA, 32 nt, Human
aauauguuucguuugcucaacaugguuuacua

SEQ ID NO: 27973 - RNA, 32 nt, Human
aauauguuuugguggggaugggacgguggacu

SEQ ID NO: 27974 - RNA, 32 nt, Human
aauauuaaaauacuucaauccuggauucacag

SEQ ID NO: 27975 - RNA, 32 nt, Human
aauauuaagcuauucugagggagaggccacag

SEQ ID NO: 27976 - RNA, 32 nt, Human
aauauuaaguuagaaaagaaguugcugcccag

SEQ ID NO: 27977 - RNA, 32 nt, Human
aauauuacaaaugcauuaccaguccuagauac

SEQ ID NO: 27978 - RNA, 32 nt, Human
aauauuacaaccaauccuuaacuuuccacuau

SEQ ID NO: 27979 - RNA, 32 nt, Human
aauauuaccuccaggguucaauagaaauccuc

SEQ ID NO: 27980 - RNA, 32 nt, Human
aauauuacuguagcacuuacuagcauuucuga

SEQ ID NO: 27981 - RNA, 22 nt, Human
aauauuagaaacuacagaguuu

SEQ ID NO: 27982 - RNA, 32 nt, Human
aauauuaggcaaaacugcauacuauaaaagug

SEQ ID NO: 27983 - RNA, 32 nt, Human
aauauuauaaccacaggguauccagccaaauu

SEQ ID NO: 27984 - RNA, 32 nt, Human
aauauuaucuucuggucaucucugugcugguc

SEQ ID NO: 27985 - RNA, 32 nt, Human
aauauuaugugacagaauacgacucaauucac

SEQ ID NO: 27986 - RNA, 32 nt, Human
aauauucaguuuuaugucuccaugcaaacauu

SEQ ID NO: 27987 - RNA, 32 nt, Human
aauauucaguuuuaugucuccaugcaacauuc

SEQ ID NO: 27988 - RNA, 31 nt, Human
aauauucauacuucuuaccauauagaacuuc

SEQ ID NO: 27989 - RNA, 32 nt, Human
aauauuccaccaguguaucccuuguuuuccca

SEQ ID NO: 27990 - RNA, 32 nt, Human
aauauuccaguucugggucauuuagagagaua

SEQ ID NO: 27991 - RNA, 32 nt, Human
aauauucccacagauagacaaagucaagcaua

SEQ ID NO: 27992 - RNA, 32 nt, Human
aauauucccauguaacaaaucugcacaugugc

SEQ ID NO: 27993 - RNA, 32 nt, Human
aauauuccucacugcuagaaugagaccagagg

SEQ ID NO: 27994 - RNA, 32 nt, Human
aauauuccuucuuggcugggugcaguaguuua

SEQ ID NO: 27995 - RNA, 32 nt, Human
aauauucgcuugugucccuccuggggccuccg

SEQ ID NO: 27996 - RNA, 32 nt, Human
aauauucuacuguaggugaaaucuuuucaaaa

SEQ ID NO: 27997 - RNA, 32 nt, Human
aauauucuagauacaagcccuuuaucaaguau

SEQ ID NO: 27998 - RNA, 32 nt, Human
aauauucuccaccauucaagaugccuguguac

SEQ ID NO: 27999 - RNA, 32 nt, Human
aauauucucccaaggagugccaugauauugaa

SEQ ID NO: 28000 - RNA, 32 nt, Human
aauauucuggaaaugaaacaaguuauaacuga

SEQ ID NO: 28001 - RNA, 32 nt, Human
aauauucuuaccacuuaaaagagcaagcuaac

SEQ ID NO: 28002 - RNA, 32 nt, Human
aauauugaaaccccgcucuggagcugaaaagg

SEQ ID NO: 28003 - RNA, 32 nt, Human
aauauugaauuacaggcuuuggaggaguugug

SEQ ID NO: 28004 - RNA, 32 nt, Human
aauauugagcaguucccaaggacagucagcau

SEQ ID NO: 28005 - RNA, 32 nt, Human
aauauugauccuggcugugucugugagggugu

SEQ ID NO: 28006 - RNA, 32 nt, Human
aauauugcaccauugcacuccugccugggcaa

SEQ ID NO: 28007 - RNA, 32 nt, Human
aauauugccauuaugcuugacaugguuuccaa

SEQ ID NO: 28008 - RNA, 32 nt, Human
aauauugccuggguucaguuuuuauuuccauu

SEQ ID NO: 28009 - RNA, 32 nt, Human
aauauugcucugcagugcuuuuucagaaugua

SEQ ID NO: 28010 - RNA, 32 nt, Human
aauauugcugaguguggauugcucugaaaucu

SEQ ID NO: 28011 - RNA, 32 nt, Human
aauauugcuucugcucuauuucuuucuccuug

SEQ ID NO: 28012 - RNA, 32 nt, Human
aauauuggaaacgacauauccccaaaugauag

SEQ ID NO: 28013 - RNA, 32 nt, Human
aauauuggaaaguaucagauuuacagauuuuc

SEQ ID NO: 28014 - RNA, 32 nt, Human
aauauuggauuuguagguccugugccaccaaa

SEQ ID NO: 28015 - RNA, 32 nt, Human
aauauugggauuacagacaugagccaugagau

SEQ ID NO: 28016 - RNA, 32 nt, Human
aauauugucagagacuggugggaggaagccug

SEQ ID NO: 28017 - RNA, 32 nt, Human
aauauugucaucugauauacacauaaaacaac

SEQ ID NO: 28018 - RNA, 32 nt, Human
aauauugugccagggauacaaauauggccgua

SEQ ID NO: 28019 - RNA, 32 nt, Human
aauauuguguauggccgcuuugugcuacagua

SEQ ID NO: 28020 - RNA, 32 nt, Human
aauauuguguccuguggcugagccccacuuag

SEQ ID NO: 28021 - RNA, 32 nt, Human
aauauuguugcaauaaauauccuugaacacaa

SEQ ID NO: 28022 - RNA, 32 nt, Human
aauauuguuucaauuuagucuauccuggauau

SEQ ID NO: 28023 - RNA, 32 nt, Human
aauauuuacaucuguuaugaaaagcuaccuuu

SEQ ID NO: 28024 - RNA, 32 nt, Human
aauauuuacuuuguagaauaugacuuuagaca

SEQ ID NO: 28025 - RNA, 24 nt, Human
aauauuuagacauuuauagguaga

SEQ ID NO: 28026 - RNA, 20 nt, Human
aauauuuagacuauggcaga

SEQ ID NO: 28027 - RNA, 32 nt, Human
aauauuuagugcgguauugcucugugaauuca

SEQ ID NO: 28028 - RNA, 32 nt, Human
aauauuuauauguacuaaauguggaaccauua

SEQ ID NO: 28029 - RNA, 32 nt, Human
aauauuuauuuuugugggugucgacuuccuau

SEQ ID NO: 28030 - RNA, 32 nt, Human
aauauuucaaagagaucagcauuuuagaaaac

SEQ ID NO: 28031 - RNA, 32 nt, Human
aauauuucacauuugagauguuugggauuaag

SEQ ID NO: 28032 - RNA, 32 nt, Human
aauauuucagccccauaggauguguaagcuug

SEQ ID NO: 28033 - RNA, 32 nt, Human
aauauuucauucucucuuuacucccacuuuuu

SEQ ID NO: 28034 - RNA, 22 nt, Human
aauauuucauuuugagaacauu

SEQ ID NO: 28035 - RNA, 32 nt, Human
aauauuuccaacaaaagagcauagaugucuuu

SEQ ID NO: 28036 - RNA, 32 nt, Human
aauauuuccucuugacuucuuuuuguaacaag

SEQ ID NO: 28037 - RNA, 32 nt, Human
aauauuuccuucucuucuuuuuacagaaguca

SEQ ID NO: 28038 - RNA, 32 nt, Human
aauauuucucaaggaucuaucugugaggcacu

SEQ ID NO: 28039 - RNA, 32 nt, Human
aauauuucucacuuuauacuacuucuucagaa

SEQ ID NO: 28040 - RNA, 32 nt, Human
aauauuucuucccucacugcugauucuuagau

SEQ ID NO: 28041 - RNA, 32 nt, Human
aauauuucuuuguuuuuccuuuuggaaacuuu

SEQ ID NO: 28042 - RNA, 32 nt, Human
aauauuugaacaaaaauugagagcuuuauugc

SEQ ID NO: 28043 - RNA, 32 nt, Human
aauauuugaauagacaccuuagaaaucuuugc

SEQ ID NO: 28044 - RNA, 32 nt, Human
aauauuugacuauucuguaucuuucauccuug

SEQ ID NO: 28045 - RNA, 32 nt, Human
aauauuugagacaaacggccuauuggcuauuu

SEQ ID NO: 28046 - RNA, 32 nt, Human
aauauuugaguauuuuuauauugacaaauaaa

SEQ ID NO: 28047 - RNA, 32 nt, Human
aauauuugcaguaucuaagaauugaucauuuc

SEQ ID NO: 28048 - RNA, 32 nt, Human
aauauuugcauuuugcacaaugacugguauga

SEQ ID NO: 28049 - RNA, 32 nt, Human
aauauuugccauguuaagugcugguaauuaua

SEQ ID NO: 28050 - RNA, 32 nt, Human
aauauuugcuauguguaaaaugcuuauuccuu

SEQ ID NO: 28051 - RNA, 32 nt, Human
aauauuugcugugaagggagaaagggagagaa

SEQ ID NO: 28052 - RNA, 32 nt, Human
aauauuugcuugucuuugccccuagacucuag

SEQ ID NO: 28053 - RNA, 32 nt, Human
aauauuuggaaccugcauuaguuccagcaaug

SEQ ID NO: 28054 - RNA, 32 nt, Human
aauauuuggagagauuguguggauuuaagaga

SEQ ID NO: 28055 - RNA, 25 nt, Human
aauauuugguuuaauaaaaugugaa

SEQ ID NO: 28056 - RNA, 32 nt, Human
aauauuuguaccacuuccaaacuuuucagcgu

SEQ ID NO: 28057 - RNA, 32 nt, Human
aauauuuguauacacauaaugagaccuugggg

SEQ ID NO: 28058 - RNA, 32 nt, Human
aauauuuguccuuucucaagagcaccagagag

SEQ ID NO: 28059 - RNA, 32 nt, Human
aauauuuguguucauucuaucauucgugcuau

SEQ ID NO: 28060 - RNA, 32 nt, Human
aauauuuguuacuguuaucuaucugcuguaua

SEQ ID NO: 28061 - RNA, 32 nt, Human
aauauuuguucugguuuaguguucuguauuuu

SEQ ID NO: 28062 - RNA, 32 nt, Human
aauauuuguugacugaucaaauguuuuggugc

SEQ ID NO: 28063 - RNA, 32 nt, Human
aauauuuuaaaacugggcuuucccaguauuuc

SEQ ID NO: 28064 - RNA, 32 nt, Human
aauauuuuaacaacugguacaggacagaugcc

SEQ ID NO: 28065 - RNA, 32 nt, Human
aauauuuuaaguguacucaaaauaucauaauu

SEQ ID NO: 28066 - RNA, 32 nt, Human
aauauuuugaugaccaaguuuucuggaaguuu

SEQ ID NO: 28067 - RNA, 32 nt, Human
aauauuuuguuaauuccugucucuccaaccug

SEQ ID NO: 28068 - RNA, 32 nt, Human
aauauuuuuagauccauuuaaggaguuuugaa

SEQ ID NO: 28069 - RNA, 32 nt, Human
aauauuuuuccuauuggacaauggacuugcaa

SEQ ID NO: 28070 - RNA, 32 nt, Human
aauauuuuuccugacagagguuaaugccuuua

SEQ ID NO: 28071 - RNA, 32 nt, Human
aaucaaaagagagcagggugguauucuacaaa

SEQ ID NO: 28072 - RNA, 32 nt, Human
aaucaaaagucuagaacccacacggaaugcug

SEQ ID NO: 28073 - RNA, 32 nt, Human
aaucaaaaguggagagucgaaaugcugugcca

SEQ ID NO: 28074 - RNA, 21 nt, Human
aaucaaacacaacacaagaaa

SEQ ID NO: 28075 - RNA, 32 nt, Human
aaucaaaccuuacuugccucuggaacaccugc

SEQ ID NO: 28076 - RNA, 32 nt, Human
aaucaaaccuuacuugccucuggaacaccuuc

SEQ ID NO: 28077 - RNA, 19 nt, Human
aaucaaacuaaaagacaag

SEQ ID NO: 28078 - RNA, 32 nt, Human
aaucaaagagucaucauaguaggaaauaacau

SEQ ID NO: 28079 - RNA, 32 nt, Human
aaucaaagauacauggugguagggucaccaaa

SEQ ID NO: 28080 - RNA, 32 nt, Human
aaucaaaggagacaugucuccugggaagagcc

SEQ ID NO: 28081 - RNA, 32 nt, Human
aaucaaaggcugaaaucucugccugaccuggc

SEQ ID NO: 28082 - RNA, 32 nt, Human
aaucaaaguaauaucauacucuucucaguuau

SEQ ID NO: 28083 - RNA, 32 nt, Human
aaucaaaguacuugauggggaagaugaauauu

SEQ ID NO: 28084 - RNA, 32 nt, Human
aaucaaagugaaagccauguaagccaucccag

SEQ ID NO: 28085 - RNA, 32 nt, Human
aaucaaauaacgcaguuuuggaaaccuauaac

SEQ ID NO: 28086 - RNA, 32 nt, Human
aaucaaaucuggaacaaaugaaacaucuuuua

SEQ ID NO: 28087 - RNA, 32 nt, Human
aaucaaaugaaaggugacauugccagaaacuu

SEQ ID NO: 28088 - RNA, 32 nt, Human
aaucaaaugauacauauuccugagagacccag

SEQ ID NO: 28089 - RNA, 32 nt, Human
aaucaaaugaugcaaaauauauacaagcacuu

SEQ ID NO: 28090 - RNA, 32 nt, Human
aaucaaauugaauauaucuuuuaagaauucaa

SEQ ID NO: 28091 - RNA, 32 nt, Human
aaucaaauuguacacuucucagccuggguuca

SEQ ID NO: 28092 - RNA, 32 nt, Human
aaucaacaaaguaagcaugacacuucaaagaa

SEQ ID NO: 28093 - RNA, 32 nt, Human
aaucaacacagaaucucccagacacacgugac

SEQ ID NO: 28094 - RNA, 23 nt, Human
aaucaacacauuuuaaggcugaa

SEQ ID NO: 28095 - RNA, 32 nt, Human
aaucaacacauuuuucuuucucgucuugagaa

SEQ ID NO: 28096 - RNA, 32 nt, Human
aaucaacacuguucucucuguaccaugagcuc

SEQ ID NO: 28097 - RNA, 32 nt, Human
aaucaacagauguacagaucagcucucaaaau

SEQ ID NO: 28098 - RNA, 32 nt, Human
aaucaacagcauauugacacguuggagccgag

SEQ ID NO: 28099 - RNA, 32 nt, Human
aaucaaccaugcuagaggaaagaugguauucu

SEQ ID NO: 28100 - RNA, 32 nt, Human
aaucaacccugggguggcuuuaggacugggcu

SEQ ID NO: 28101 - RNA, 32 nt, Human
aaucaacucaauauaucauacauuuacacuua

SEQ ID NO: 28102 - RNA, 32 nt, Human
aaucaacuccacagaaccaccaaaaagaaaau

SEQ ID NO: 28103 - RNA, 32 nt, Human
aaucaacuucaaggagcaccuucauuaguaca

SEQ ID NO: 28104 - RNA, 32 nt, Human
aaucaacuuuuauuaauuuucuagugcuuugg

SEQ ID NO: 28105 - RNA, 32 nt, Human
aaucaagaauuugccaagacuuccuucccucc

SEQ ID NO: 28106 - RNA, 32 nt, Human
aaucaagacagagaaacaauuaucuucagaga

SEQ ID NO: 28107 - RNA, 32 nt, Human
aaucaagacuugcucugcagccacucaguagu

SEQ ID NO: 28108 - RNA, 32 nt, Human
aaucaagauguggcugaagaucagaggcucag

SEQ ID NO: 28109 - RNA, 32 nt, Human
aaucaagcaaacuggaaucaaggggaggggga

SEQ ID NO: 28110 - RNA, 32 nt, Human
aaucaagcagagccagacugaaagagacagac

SEQ ID NO: 28111 - RNA, 22 nt, Human
aaucaagcagcccucugauaga

SEQ ID NO: 28112 - RNA, 32 nt, Human
aaucaagcaggcuuaacacuguguacauauug

SEQ ID NO: 28113 - RNA, 32 nt, Human
aaucaagcaucaucuucuagucacucuuccau

SEQ ID NO: 28114 - RNA, 32 nt, Human
aaucaagcauuuucuugaaagccuucauaagu

SEQ ID NO: 28115 - RNA, 32 nt, Human
aaucaagccagccugggcuccacccacccugg

SEQ ID NO: 28116 - RNA, 32 nt, Human
aaucaagccgagaggaggcccacuaugccccc

SEQ ID NO: 28117 - RNA, 32 nt, Human
aaucaagccucauuuacaacaaaaagaacccu

SEQ ID NO: 28118 - RNA, 32 nt, Human
aaucaagcuuuggaaguccaaaaagaauaaaa

SEQ ID NO: 28119 - RNA, 32 nt, Human
aaucaaggaauuaggggucgggggaggguuua

SEQ ID NO: 28120 - RNA, 32 nt, Human
aaucaaggagaaggacaaagaaaacaaguucc

SEQ ID NO: 28121 - RNA, 32 nt, Human
aaucaagggaagaaggaggaaugcuggacugg

SEQ ID NO: 28122 - RNA, 32 nt, Human
aaucaagggucaggccuuugagcucagaaaau

SEQ ID NO: 28123 - RNA, 32 nt, Human
aaucaaguauuauaaacaagaaugaagguuuu

SEQ ID NO: 28124 - RNA, 32 nt, Human
aaucaagucaccacacuccagccugggugaca

SEQ ID NO: 28125 - RNA, 32 nt, Human
aaucaagucucacagauugcugccucagagca

SEQ ID NO: 28126 - RNA, 32 nt, Human
aaucaagugagcagaaaaacaaugggcaagcc

SEQ ID NO: 28127 - RNA, 29 nt, Human
aaucaagugauuggugugccugggucuca

SEQ ID NO: 28128 - RNA, 32 nt, Human
aaucaagugguauuuuccagcacuuuguauga

SEQ ID NO: 28129 - RNA, 32 nt, Human
aaucaaguugugaccaccuccauuggagggca

SEQ ID NO: 28130 - RNA, 32 nt, Human
aaucaauacaaaccagcaacuaauaaaaccuc

SEQ ID NO: 28131 - RNA, 32 nt, Human
aaucaauagcccagagagcuuagucaaagacg

SEQ ID NO: 28132 - RNA, 32 nt, Human
aaucaaucaauaaagaaagauggaaggaaggg

SEQ ID NO: 28133 - RNA, 32 nt, Human
aaucaaucccaaagagccugaguaaaugaaag

SEQ ID NO: 28134 - RNA, 32 nt, Human
aaucaaugcacugucuguccucuccuuuuuag

SEQ ID NO: 28135 - RNA, 32 nt, Human
aaucaauggaaagaggaagaccgccaaagaac

SEQ ID NO: 28136 - RNA, 32 nt, Human
aaucaauguaaggacugaaguugaaguagcaa

SEQ ID NO: 28137 - RNA, 31 nt, Human
aaucacaaauuuccuugccauuuaaauuaua

SEQ ID NO: 28138 - RNA, 32 nt, Human
aaucacaacauaguuccucucuccuuuccuga

SEQ ID NO: 28139 - RNA, 32 nt, Human
aaucacaaccaucuuuucauauacaggaaguc

SEQ ID NO: 28140 - RNA, 32 nt, Human
aaucacaagggcaaggagagauguuccuucag

SEQ ID NO: 28141 - RNA, 32 nt, Human
aaucacaaguacaguccuuuccaacaccccug

SEQ ID NO: 28142 - RNA, 32 nt, Human
aaucacaaugguaagaaaaaugaagacaggca

SEQ ID NO: 28143 - RNA, 32 nt, Human
aaucacacacaucacaucaccagugccaaaau

SEQ ID NO: 28144 - RNA, 32 nt, Human
aaucacacacgguuuuaguuuuaauggacaug

SEQ ID NO: 28145 - RNA, 32 nt, Human
aaucacaccacugcacuccagccugggcaacu

SEQ ID NO: 28146 - RNA, 32 nt, Human
aaucacaccacugcacuccagcuugggggaua

SEQ ID NO: 28147 - RNA, 32 nt, Human
aaucacaccacugcacucuagccugggcaaca

SEQ ID NO: 28148 - RNA, 32 nt, Human
aaucacaccacuguacuccagccuggugacag

SEQ ID NO: 28149 - RNA, 32 nt, Human
aaucacaccauugcacuccagcuugggcaaca

SEQ ID NO: 28150 - RNA, 32 nt, Human
aaucacacccugacucuuccagccuccauguc

SEQ ID NO: 28151 - RNA, 32 nt, Human
aaucacaccgagaagucacagccccucaacca

SEQ ID NO: 28152 - RNA, 32 nt, Human
aaucacaccuguaaucccagcacuuugggauu

SEQ ID NO: 28153 - RNA, 32 nt, Human
aaucacacugcacacagggucccugaaaucca

SEQ ID NO: 28154 - RNA, 32 nt, Human
aaucacacugcugcuuggauaacuggguacuu

SEQ ID NO: 28155 - RNA, 32 nt, Human
aaucacacuggcgggaaugaagauugugccag

SEQ ID NO: 28156 - RNA, 32 nt, Human
aaucacagaacaguacuuuucuuuuaguguuu

SEQ ID NO: 28157 - RNA, 32 nt, Human
aaucacagaaugaaggcggugaagagcgaacg

SEQ ID NO: 28158 - RNA, 32 nt, Human
aaucacagacacacacuuucuauuccauucca

SEQ ID NO: 28159 - RNA, 32 nt, Human
aaucacagacagagacagggaaagagagagaa

SEQ ID NO: 28160 - RNA, 32 nt, Human
aaucacagcuacucaggagacugaagcaggag

SEQ ID NO: 28161 - RNA, 32 nt, Human
aaucacagcuacucaggaggcugaggcagaag

SEQ ID NO: 28162 - RNA, 32 nt, Human
aaucacagcuacucgggaggcugaggcagaga

SEQ ID NO: 28163 - RNA, 32 nt, Human
aaucacagcuacuugggaggcugagaugggag

SEQ ID NO: 28164 - RNA, 32 nt, Human
aaucacagcuacuugggaggcugaggcaggag

SEQ ID NO: 28165 - RNA, 32 nt, Human
aaucacagcuacuugggaggcugaggcaugag

SEQ ID NO: 28166 - RNA, 32 nt, Human
aaucacagcugacugcagccuugaccuccagg

SEQ ID NO: 28167 - RNA, 32 nt, Human
aaucacagcugccccgaccuuggcuuccucug

SEQ ID NO: 28168 - RNA, 32 nt, Human
aaucacagcuggcuuaucaauauugcuguuug

SEQ ID NO: 28169 - RNA, 32 nt, Human
aaucacagcuuccuugucggaggggaaaagga

SEQ ID NO: 28170 - RNA, 32 nt, Human
aaucacaggaaaauguauccagaggaauugau

SEQ ID NO: 28171 - RNA, 32 nt, Human
aaucacaggaaaucauccaggucucuaccugg

SEQ ID NO: 28172 - RNA, 32 nt, Human
aaucacaguguucacagcucugcuucauaaca

SEQ ID NO: 28173 - RNA, 32 nt, Human
aaucacaguuuuuccuggaauugccagcugac

SEQ ID NO: 28174 - RNA, 32 nt, Human
aaucacauaguuuuaucaguguauuuagacac

SEQ ID NO: 28175 - RNA, 32 nt, Human
aaucacaucuucagaagagaagacacuaauau

SEQ ID NO: 28176 - RNA, 32 nt, Human
aaucacaugcagcugacucggacacuggccuu

SEQ ID NO: 28177 - RNA, 32 nt, Human
aaucaccagaaacaauuugcuuagauuaaaau

SEQ ID NO: 28178 - RNA, 32 nt, Human
aaucaccagaguucaagaguucaagaccagcc

SEQ ID NO: 28179 - RNA, 32 nt, Human
aaucaccagcugucugcuggguucuuuucuca

SEQ ID NO: 28180 - RNA, 32 nt, Human
aaucaccauaaauaagaaugcuaaacagaauu

SEQ ID NO: 28181 - RNA, 32 nt, Human
aaucacccaagcggccucagaagucccaggga

SEQ ID NO: 28182 - RNA, 32 nt, Human
aaucacccagauccuucggccugguggauguc

SEQ ID NO: 28183 - RNA, 32 nt, Human
aaucaccccugccugugucaguuauuauauuu

SEQ ID NO: 28184 - RNA, 32 nt, Human
aaucaccccugccuuuuguucaacucuauaaa

SEQ ID NO: 28185 - RNA, 18 nt, Human
aaucaccccuuccaggaa

SEQ ID NO: 28186 - RNA, 32 nt, Human
aaucacccucugucucuccugccuucugcuua

SEQ ID NO: 28187 - RNA, 32 nt, Human
aaucaccuauguuuacagcgacagccuccauc

SEQ ID NO: 28188 - RNA, 32 nt, Human
aaucaccucaccucucugagccuguucccucc

SEQ ID NO: 28189 - RNA, 32 nt, Human
aaucaccucagcauccuccuguccccagcugu

SEQ ID NO: 28190 - RNA, 19 nt, Human
aaucaccucccaccagccc

SEQ ID NO: 28191 - RNA, 21 nt, Human
aaucaccucccuagcaaccuu

SEQ ID NO: 28192 - RNA, 32 nt, Human
aaucaccucuagcuguucucagucccauucuc

SEQ ID NO: 28193 - RNA, 32 nt, Human
aaucaccucugaggccugggcccaggguucag

SEQ ID NO: 28194 - RNA, 32 nt, Human
aaucaccugcuacccagcugucaaugaagacu

SEQ ID NO: 28195 - RNA, 21 nt, Human
aaucaccuuaagaaggacagg

SEQ ID NO: 28196 - RNA, 32 nt, Human
aaucaccuugagugacugggcagcagcggugg

SEQ ID NO: 28197 - RNA, 32 nt, Human
aaucaccuuucgaggcccuucagacucuggcg

SEQ ID NO: 28198 - RNA, 32 nt, Human
aaucaccuuucuaagcccuggggcgcccaagu

SEQ ID NO: 28199 - RNA, 32 nt, Human
aaucacgccacuacacuccagccugggcaaca

SEQ ID NO: 28200 - RNA, 32 nt, Human
aaucacgccacugcacuccagccugggcaaca

SEQ ID NO: 28201 - RNA, 32 nt, Human
aaucacgccacugcacuccagccugggcugca

SEQ ID NO: 28202 - RNA, 32 nt, Human
aaucacgcccgguggaccuggggagaccagac

SEQ ID NO: 28203 - RNA, 17 nt, Human
aaucacgcguguccacg

SEQ ID NO: 28204 - RNA, 32 nt, Human
aaucacguaguccuuccugaaaccacuaagag

SEQ ID NO: 28205 - RNA, 32 nt, Human
aaucacgugaagauggggcgagugcugggcgu

SEQ ID NO: 28206 - RNA, 32 nt, Human
aaucacguucagccaaguggaguuuccgacgc

SEQ ID NO: 28207 - RNA, 32 nt, Human
aaucacuaaucagaaaacugugcccaauauuu

SEQ ID NO: 28208 - RNA, 32 nt, Human
aaucacuagaagccaggaggcagagguugcag

SEQ ID NO: 28209 - RNA, 32 nt, Human
aaucacucauuucuauucauuccucaggcacu

SEQ ID NO: 28210 - RNA, 32 nt, Human
aaucacuccaauaaauauucuccuacagauga

SEQ ID NO: 28211 - RNA, 32 nt, Human
aaucacucccugcucaucauaaccggcaccuc

SEQ ID NO: 28212 - RNA, 32 nt, Human
aaucacugaacaaaagaaacaggcaacauuca

SEQ ID NO: 28213 - RNA, 32 nt, Human
aaucacugcacuccaaccuggcaacagaguga

SEQ ID NO: 28214 - RNA, 32 nt, Human
aaucacugcagucagcucacaggaagccacau

SEQ ID NO: 28215 - RNA, 32 nt, Human
aaucacugcuccauauuugccaguggaggaaa

SEQ ID NO: 28216 - RNA, 32 nt, Human
aaucacuggacagaagccaugaggcagagcca

SEQ ID NO: 28217 - RNA, 32 nt, Human
aaucacugggaaauuuaaguuugcagauccca

SEQ ID NO: 28218 - RNA, 32 nt, Human
aaucacugggcugggugcaguggcucacgccu

SEQ ID NO: 28219 - RNA, 32 nt, Human
aaucacuguaaugagaaugguacuggaaaaau

SEQ ID NO: 28220 - RNA, 32 nt, Human
aaucacuguaguuagaaucacauacagaaaaa

SEQ ID NO: 28221 - RNA, 32 nt, Human
aaucacuguauguaacaaacagccauauuuaa

SEQ ID NO: 28222 - RNA, 32 nt, Human
aaucacuguuaaaaucuuacuacuucauggag

SEQ ID NO: 28223 - RNA, 32 nt, Human
aaucacuguuuaguucagaagguucuaagaca

SEQ ID NO: 28224 - RNA, 24 nt, Human
aaucacuuccuuaacaaaggaaga

SEQ ID NO: 28225 - RNA, 21 nt, Human
aaucacuuccuuuaggacuga

SEQ ID NO: 28226 - RNA, 24 nt, Human
aaucacuugaacccaaaaggcaga

SEQ ID NO: 28227 - RNA, 32 nt, Human
aaucacuugagccaggaggaggagguugcagu

SEQ ID NO: 28228 - RNA, 31 nt, Human
aaucacuugagcccaggaguuggagaccugc

SEQ ID NO: 28229 - RNA, 32 nt, Human
aaucacuuuaaugccagaacaugguaaauuug

SEQ ID NO: 28230 - RNA, 32 nt, Human
aaucagaagcaguucuuaguagaggcauuucu

SEQ ID NO: 28231 - RNA, 32 nt, Human
aaucagaauaagaaguaccugacauacuuucu

SEQ ID NO: 28232 - RNA, 32 nt, Human
aaucagacagaauauuguugaccuugggggcu

SEQ ID NO: 28233 - RNA, 32 nt, Human
aaucagacagccgccucuaggggcuggguucu

SEQ ID NO: 28234 - RNA, 32 nt, Human
aaucagacaggccacuaagguaaaagagucug

SEQ ID NO: 28235 - RNA, 22 nt, Human
aaucagaccauuucagguagaa

SEQ ID NO: 28236 - RNA, 32 nt, Human
aaucagacuauacauuuacacucccaaauugc

SEQ ID NO: 28237 - RNA, 32 nt, Human
aaucagagaaaaucgcucuaaucauugaaaag

SEQ ID NO: 28238 - RNA, 32 nt, Human
aaucagagagagcucgacucacugugggucag

SEQ ID NO: 28239 - RNA, 32 nt, Human
aaucagagagcagcagauucugaagucaagcu

SEQ ID NO: 28240 - RNA, 32 nt, Human
aaucagagaugcuguagcuccuuggggcaaag

SEQ ID NO: 28241 - RNA, 32 nt, Human
aaucagaggaccaaaguacagauggaaaccau

SEQ ID NO: 28242 - RNA, 32 nt, Human
aaucagagguaauguauuuuggcagcuuguuu

SEQ ID NO: 28243 - RNA, 32 nt, Human
aaucagaucucugacuuaagucaggguggguu

SEQ ID NO: 28244 - RNA, 32 nt, Human
aaucagaugcagcuuucuccuccgucuggucu

SEQ ID NO: 28245 - RNA, 31 nt, Human
aaucagaugccggccucagagcucaaggcuu

SEQ ID NO: 28246 - RNA, 32 nt, Human
aaucagauggcucauucucuccuuccagcucu

SEQ ID NO: 28247 - RNA, 32 nt, Human
aaucagauuauuaagggaauaagccaugacgu

SEQ ID NO: 28248 - RNA, 32 nt, Human
aaucagauuguaaucccaguacuuugggaggc

SEQ ID NO: 28249 - RNA, 32 nt, Human
aaucagcaacucuucaaucccaaccugcgcug

SEQ ID NO: 28250 - RNA, 20 nt, Human
aaucagcaaucuucaaaagc

SEQ ID NO: 28251 - RNA, 21 nt, Human
aaucagcagagcacagaagcc

SEQ ID NO: 28252 - RNA, 32 nt, Human
aaucagcaggacuccugccuuccuucggggca

SEQ ID NO: 28253 - RNA, 22 nt, Human
aaucagcauacaauaaaagacu

SEQ ID NO: 28254 - RNA, 20 nt, Human
aaucagcaugccucuagagg

SEQ ID NO: 28255 - RNA, 32 nt, Human
aaucagccauugcucugcuccuggcauagagu

SEQ ID NO: 28256 - RNA, 24 nt, Human
aaucagccgagaaguuccuggucu

SEQ ID NO: 28257 - RNA, 32 nt, Human
aaucagccugagcuuuacacagcuggggucug

SEQ ID NO: 28258 - RNA, 32 nt, Human
aaucagccuuucuccucuucucuucuugggac

SEQ ID NO: 28259 - RNA, 32 nt, Human
aaucagcggcuccuccccaucucacccccagc

SEQ ID NO: 28260 - RNA, 32 nt, Human
aaucagcucacuggauuccaucacccugagcg

SEQ ID NO: 28261 - RNA, 19 nt, Human
aaucagcuccuuucuaguc

SEQ ID NO: 28262 - RNA, 32 nt, Human
aaucagcugcagcugcuuguugucaaguauaa

SEQ ID NO: 28263 - RNA, 32 nt, Human
aaucagcugcaggucucuguuuugaaaaagca

SEQ ID NO: 28264 - RNA, 32 nt, Human
aaucagcugccauccugcccuccagggacaac

SEQ ID NO: 28265 - RNA, 32 nt, Human
aaucagcuguuauuccaagcuaucaugcuuaa

SEQ ID NO: 28266 - RNA, 32 nt, Human
aaucaggaagugacagugaugacugagaaaua

SEQ ID NO: 28267 - RNA, 32 nt, Human
aaucaggaauggguuuuggugccugaaaaauu

SEQ ID NO: 28268 - RNA, 32 nt, Human
aaucaggacaguguuaacacagaagaaaagaa

SEQ ID NO: 28269 - RNA, 32 nt, Human
aaucaggaccuccuugcagcaccagaagaacc

SEQ ID NO: 28270 - RNA, 32 nt, Human
aaucaggacuccuaaccugcuccagucagccu

SEQ ID NO: 28271 - RNA, 32 nt, Human
aaucaggagaggagggagguaggaggugcaag

SEQ ID NO: 28272 - RNA, 32 nt, Human
aaucaggagagggagauaauuaguugcuuccu

SEQ ID NO: 28273 - RNA, 32 nt, Human
aaucaggagagggauacaagagaggagauggg

SEQ ID NO: 28274 - RNA, 32 nt, Human
aaucaggaggcugaggcaagaggauugcuugg

SEQ ID NO: 28275 - RNA, 32 nt, Human
aaucaggaggcugaggcagagaaucacuugaa

SEQ ID NO: 28276 - RNA, 32 nt, Human
aaucaggaugaaagucaaacuucugcauccuc

SEQ ID NO: 28277 - RNA, 32 nt, Human
aaucaggauuuuuagugcuugccaccaccaga

SEQ ID NO: 28278 - RNA, 32 nt, Human
aaucaggcaaaaauacuuacaguuaauaauau

SEQ ID NO: 28279 - RNA, 32 nt, Human
aaucaggcaagugcuuaaaaggccaacggucc

SEQ ID NO: 28280 - RNA, 32 nt, Human
aaucaggcacuucuaacucaccccaagcucgc

SEQ ID NO: 28281 - RNA, 32 nt, Human
aaucaggcagaggcguuccuuaagcauuagag

SEQ ID NO: 28282 - RNA, 32 nt, Human
aaucaggcagcacccagcugugggggcagugg

SEQ ID NO: 28283 - RNA, 21 nt, Human
aaucaggcagccgcaaaaccu

SEQ ID NO: 28284 - RNA, 25 nt, Human
aaucaggcagccgcaaaaccuggca

SEQ ID NO: 28285 - RNA, 32 nt, Human
aaucaggcaguuccaggacacagggaagugag

SEQ ID NO: 28286 - RNA, 32 nt, Human
aaucaggccagaggacaacaggcuggcguuuu

SEQ ID NO: 28287 - RNA, 32 nt, Human
aaucaggcccagaccgccucucuggaaggugu

SEQ ID NO: 28288 - RNA, 32 nt, Human
aaucaggccgcuggcaggcugcuaauuagcuc

SEQ ID NO: 28289 - RNA, 32 nt, Human
aaucaggcuacagcacuccagccugggcaaca

SEQ ID NO: 28290 - RNA, 32 nt, Human
aaucaggcugggacugaucagaggugaaggga

SEQ ID NO: 28291 - RNA, 32 nt, Human
aaucaggcugugaaucugcagcagugauccca

SEQ ID NO: 28292 - RNA, 32 nt, Human
aaucagggaccagcuuuacuggaguugggggc

SEQ ID NO: 28293 - RNA, 32 nt, Human
aaucagggaggcggagguuguggugagccgag

SEQ ID NO: 28294 - RNA, 32 nt, Human
aaucaggggacuuccccaccuguggugggagg

SEQ ID NO: 28295 - RNA, 32 nt, Human
aaucaggggccagagagcaggggagcuuggga

SEQ ID NO: 28296 - RNA, 32 nt, Human
aaucagggucucgugcugcccuucccucccac

SEQ ID NO: 28297 - RNA, 32 nt, Human
aaucagggugguucccagcuccccaguccagg

SEQ ID NO: 28298 - RNA, 32 nt, Human
aaucaguagagaagugcuuaggguugaaaauu

SEQ ID NO: 28299 - RNA, 32 nt, Human
aaucaguaucuagaucucugcacuuggcaugg

SEQ ID NO: 28300 - RNA, 32 nt, Human
aaucaguaugaauauuauaugccuaaauaaaa

SEQ ID NO: 28301 - RNA, 32 nt, Human
aaucagucaccaggcucuccccaaaaccaugc

SEQ ID NO: 28302 - RNA, 32 nt, Human
aaucagucagcaccugugauucuuuuacuuau

SEQ ID NO: 28303 - RNA, 32 nt, Human
aaucagucauggugauuuaaaauagcuaucaa

SEQ ID NO: 28304 - RNA, 32 nt, Human
aaucaguccuuuuauagcuuucuaaguucuua

SEQ ID NO: 28305 - RNA, 32 nt, Human
aaucagugagccagaagcugauguugaguccg

SEQ ID NO: 28306 - RNA, 32 nt, Human
aaucagugaugcuccuguuacaggcaugguuu

SEQ ID NO: 28307 - RNA, 32 nt, Human
aaucagugcgagcguccugcagaggcauggcc

SEQ ID NO: 28308 - RNA, 32 nt, Human
aaucagugcuuguacuggaggcugaauuggaa

SEQ ID NO: 28309 - RNA, 32 nt, Human
aaucagugugggcuccugcagugggcgcgggu

SEQ ID NO: 28310 - RNA, 32 nt, Human
aaucaguguuaggaugccucagccugaacucu

SEQ ID NO: 28311 - RNA, 32 nt, Human
aaucaguguucuguucuaccuggcuacugcuu

SEQ ID NO: 28312 - RNA, 32 nt, Human
aaucaguguugggguugcaggagaccuaaaca

SEQ ID NO: 28313 - RNA, 32 nt, Human
aaucaguucuuaucuuucaucuguuuccuagg

SEQ ID NO: 28314 - RNA, 32 nt, Human
aaucaguucuucuucccugucaguggugguga

SEQ ID NO: 28315 - RNA, 32 nt, Human
aaucaguuguaaaaguguguuggcaauguccg

SEQ ID NO: 28316 - RNA, 32 nt, Human
aaucauaaagucaguugcucaaaaagaaauca

SEQ ID NO: 28317 - RNA, 32 nt, Human
aaucauaagugggguggcggggccagucuagg

SEQ ID NO: 28318 - RNA, 32 nt, Human
aaucauaauccuuuugcugcuuaucugauguu

SEQ ID NO: 28319 - RNA, 32 nt, Human
aaucauaauuucuucuuacuggccagauacua

SEQ ID NO: 28320 - RNA, 32 nt, Human
aaucauacaagaaaguuuuaugauuuccagag

SEQ ID NO: 28321 - RNA, 32 nt, Human
aaucauacccuugucugcuccaauucagucuc

SEQ ID NO: 28322 - RNA, 32 nt, Human
aaucauacuuccucugugagacaggccauaac

SEQ ID NO: 28323 - RNA, 32 nt, Human
aaucauagccaagaucccaucucuccauauac

SEQ ID NO: 28324 - RNA, 31 nt, Human
aaucauaggaaacugccccugagcucacaca

SEQ ID NO: 28325 - RNA, 32 nt, Human
aaucauauaagaaaacugauucucagugaaau

SEQ ID NO: 28326 - RNA, 32 nt, Human
aaucauauaguggggcucagggccagugcuca

SEQ ID NO: 28327 - RNA, 32 nt, Human
aaucauaucuauucaaaccacccacccccauc

SEQ ID NO: 28328 - RNA, 32 nt, Human
aaucauaugacuugcuuuuuccauuccaguca

SEQ ID NO: 28329 - RNA, 32 nt, Human
aaucauauugaaugauauuucuauaucgaagu

SEQ ID NO: 28330 - RNA, 32 nt, Human
aaucaucaaagaaccuguuugggauauaaaac

SEQ ID NO: 28331 - RNA, 32 nt, Human
aaucaucaacuaaaagcacuuguuucaaguuu

SEQ ID NO: 28332 - RNA, 32 nt, Human
aaucaucaagagaauuuggggcuuccaaguug

SEQ ID NO: 28333 - RNA, 32 nt, Human
aaucaucacaggucgauccaggcacagaucug

SEQ ID NO: 28334 - RNA, 32 nt, Human
aaucaucacaucuuuuccuucagaaacauccu

SEQ ID NO: 28335 - RNA, 32 nt, Human
aaucaucacucucucuuuccuccccgacgaag

SEQ ID NO: 28336 - RNA, 32 nt, Human
aaucaucagauuggcuucccagauuugggaau

SEQ ID NO: 28337 - RNA, 32 nt, Human
aaucaucagcugugggcaucaggcccaccagc

SEQ ID NO: 28338 - RNA, 32 nt, Human
aaucaucaucccucaucacccacagucgcccg

SEQ ID NO: 28339 - RNA, 32 nt, Human
aaucaucccauggauaaugaugacgaagccac

SEQ ID NO: 28340 - RNA, 32 nt, Human
aaucaucccugccucugccauucacacugacu

SEQ ID NO: 28341 - RNA, 32 nt, Human
aaucauccugacgcagaugcaccagaaguagu

SEQ ID NO: 28342 - RNA, 32 nt, Human
aaucaucguuuucccuggcaggugguacagcc

SEQ ID NO: 28343 - RNA, 32 nt, Human
aaucaucuaguucugucaucuuacugaaagga

SEQ ID NO: 28344 - RNA, 32 nt, Human
aaucaucucauguaccugacaguaagaaaaua

SEQ ID NO: 28345 - RNA, 32 nt, Human
aaucaucucuaaugcuacuauuucucugcaca

SEQ ID NO: 28346 - RNA, 32 nt, Human
aaucaucucucccuuccucuaugucaagcacu

SEQ ID NO: 28347 - RNA, 32 nt, Human
aaucaucugggcuccuguccagcuccacaugu

SEQ ID NO: 28348 - RNA, 32 nt, Human
aaucaucuuagcacccuuuccucacaauaaua

SEQ ID NO: 28349 - RNA, 32 nt, Human
aaucaucuucuccuggccaaggcucugaccau

SEQ ID NO: 28350 - RNA, 32 nt, Human
aaucaucuuguuggcccugaccucguuggaaa

SEQ ID NO: 28351 - RNA, 32 nt, Human
aaucaugaacagcucugagauccuggagugau

SEQ ID NO: 28352 - RNA, 32 nt, Human
aaucaugauuguaggcugggcacagugucgcg

SEQ ID NO: 28353 - RNA, 32 nt, Human
aaucaugccacugcacccuagcuuggguggca

SEQ ID NO: 28354 - RNA, 32 nt, Human
aaucaugccacugcacuccagccugggcaaca

SEQ ID NO: 28355 - RNA, 32 nt, Human
aaucaugccacugcauucuagcuuugauggcg

SEQ ID NO: 28356 - RNA, 32 nt, Human
aaucaugccacuguacuccagccugggugaca

SEQ ID NO: 28357 - RNA, 32 nt, Human
aaucaugccauccugccuuuccauggaauaac

SEQ ID NO: 28358 - RNA, 32 nt, Human
aaucaugccauugcacuccagccugggugaca

SEQ ID NO: 28359 - RNA, 32 nt, Human
aaucaugcccacacccccagagcccagcaugg

SEQ ID NO: 28360 - RNA, 32 nt, Human
aaucaugcccguuccccucugccuggcagaau

SEQ ID NO: 28361 - RNA, 32 nt, Human
aaucaugccucacugcagccucggcuuccugg

SEQ ID NO: 28362 - RNA, 32 nt, Human
aaucaugccuggcacacggcacuggcagagac

SEQ ID NO: 28363 - RNA, 32 nt, Human
aaucaugccuguaaagcccaaacauuuguaac

SEQ ID NO: 28364 - RNA, 20 nt, Human
aaucaugcuggagggaagcc

SEQ ID NO: 28365 - RNA, 32 nt, Human
aaucauggaaaagauaaagauucaagacggaa

SEQ ID NO: 28366 - RNA, 32 nt, Human
aaucauggacaaaggcugggugcaguggcuca

SEQ ID NO: 28367 - RNA, 32 nt, Human
aaucauggauguuagagcucaaacgggcuuuu

SEQ ID NO: 28368 - RNA, 32 nt, Human
aaucauggcucacugcagccuggagcuccugg

SEQ ID NO: 28369 - RNA, 32 nt, Human
aaucauggcugcagucuggcugcagggggccu

SEQ ID NO: 28370 - RNA, 32 nt, Human
aaucauggcuggagaauuggauagcagaguaa

SEQ ID NO: 28371 - RNA, 32 nt, Human
aaucauggggaaggaaaaugcagcacucuaaa

SEQ ID NO: 28372 - RNA, 32 nt, Human
aaucauggguuauuucagaagauguaagcauu

SEQ ID NO: 28373 - RNA, 29 nt, Human
aaucaugguggaaggcaagaaggagcaag

SEQ ID NO: 28374 - RNA, 32 nt, Human
aaucauguacuacugcacuugagcaugaaugg

SEQ ID NO: 28375 - RNA, 32 nt, Human
aaucauguauccaccacuuagacuaccaaugg

SEQ ID NO: 28376 - RNA, 32 nt, Human
aaucauguauuucccugcugucauauuugguu

SEQ ID NO: 28377 - RNA, 32 nt, Human
aaucaugucaccaagcuucaagccauggaggu

SEQ ID NO: 28378 - RNA, 32 nt, Human
aaucaugugaacagaucucccuuucccccucc

SEQ ID NO: 28379 - RNA, 32 nt, Human
aaucauguugcagaaccagcagguggauagua

SEQ ID NO: 28380 - RNA, 25 nt, Human
aaucauuaaacucuuucucugcugc

SEQ ID NO: 28381 - RNA, 32 nt, Human
aaucauuagacguauuacggauuuucagacau

SEQ ID NO: 28382 - RNA, 32 nt, Human
aaucauucaagaggaagauggaaggggcuguu

SEQ ID NO: 28383 - RNA, 32 nt, Human
aaucauucaccccauuacuucuugucaacaaa

SEQ ID NO: 28384 - RNA, 31 nt, Human
aaucauucacucaaugugugguagagucuaa

SEQ ID NO: 28385 - RNA, 32 nt, Human
aaucauucaucccuggaauccaugucuccuuc

SEQ ID NO: 28386 - RNA, 32 nt, Human
aaucauucauucauucauuccacacacauuga

SEQ ID NO: 28387 - RNA, 32 nt, Human
aaucauuccuuugacaauuacuggacccaaag

SEQ ID NO: 28388 - RNA, 32 nt, Human
aaucauucuagagguguaacaauacauuucuu

SEQ ID NO: 28389 - RNA, 32 nt, Human
aaucauugaaguauuuuccuccaggcaaaauu

SEQ ID NO: 28390 - RNA, 32 nt, Human
aaucauugagccugaaggcuucaagcccaaga

SEQ ID NO: 28391 - RNA, 32 nt, Human
aaucauuggugaggaauggccacccacugccc

SEQ ID NO: 28392 - RNA, 22 nt, Human
aaucauuguacuguaaaagccu

SEQ ID NO: 28393 - RNA, 32 nt, Human
aaucauuucugaagacaaaagcagaggaauau

SEQ ID NO: 28394 - RNA, 32 nt, Human
aaucauuucugcauuguuguuccagagaauuu

SEQ ID NO: 28395 - RNA, 32 nt, Human
aaucauuuuagacuuauuuugucuauauuaaa

SEQ ID NO: 28396 - RNA, 32 nt, Human
aaucauuuuaugaaaauaauguauuuauaagu

SEQ ID NO: 28397 - RNA, 32 nt, Human
aaucauuuucucaguucucuucuuucuuuagc

SEQ ID NO: 28398 - RNA, 32 nt, Human
aaucauuuuucuuuuguagcuaacgguugccu

SEQ ID NO: 28399 - RNA, 32 nt, Human
aauccaaaaacacaaucccauaugacagaugg

SEQ ID NO: 28400 - RNA, 32 nt, Human
aauccaaaaauguuaaaauuagccaggcauag

SEQ ID NO: 28401 - RNA, 32 nt, Human
aauccaaaacaccuuccgccucccagagcuug

SEQ ID NO: 28402 - RNA, 32 nt, Human
aauccaaauacgauuccucaggccgggcacag

SEQ ID NO: 28403 - RNA, 32 nt, Human
aauccaacaguuugugaugcucugcuugauaa

SEQ ID NO: 28404 - RNA, 32 nt, Human
aauccaaccucacuacauuguagcucagucca

SEQ ID NO: 28405 - RNA, 32 nt, Human
aauccaagagucugaugauuucuugaaaaggg

SEQ ID NO: 28406 - RNA, 32 nt, Human
aauccaaggaacugucugucucaaagaaaacu

SEQ ID NO: 28407 - RNA, 32 nt, Human
aauccaaggacuaguauagaauuaagcugagu

SEQ ID NO: 28408 - RNA, 32 nt, Human
aauccaagguacuggaaaaccuuccacaugcc

SEQ ID NO: 28409 - RNA, 22 nt, Human
aauccaaguauucuaucaucaa

SEQ ID NO: 28410 - RNA, 32 nt, Human
aauccaauauuguaauccuagcacuuugggag

SEQ ID NO: 28411 - RNA, 32 nt, Human
aauccacacaucauaucguucuuaucugcaaa

SEQ ID NO: 28412 - RNA, 32 nt, Human
aauccacacugauuuguacgucugacugagag

SEQ ID NO: 28413 - RNA, 21 nt, Human
aauccacacuggagagaagcc

SEQ ID NO: 28414 - RNA, 32 nt, Human
aauccacagcagaccuaccacucuccaggcag

SEQ ID NO: 28415 - RNA, 32 nt, Human
aauccacaggaccaccagaagggagagggaac

SEQ ID NO: 28416 - RNA, 32 nt, Human
aauccacauaaaagugcucuccugccugggca

SEQ ID NO: 28417 - RNA, 32 nt, Human
aauccacccuccucagccucccaaagugcugg

SEQ ID NO: 28418 - RNA, 32 nt, Human
aauccagaaaucuacuuucuccaucuuccacu

SEQ ID NO: 28419 - RNA, 32 nt, Human
aauccagaaauuacagugaauauuuuauggaa

SEQ ID NO: 28420 - RNA, 26 nt, Human
aauccagaaggcggagguugcaguga

SEQ ID NO: 28421 - RNA, 32 nt, Human
aauccagaaggcggagguugcagugagcugag

SEQ ID NO: 28422 - RNA, 32 nt, Human
aauccagacucugcacaagaaguuaaucugcc

SEQ ID NO: 28423 - RNA, 32 nt, Human
aauccagagggaggggagggaaggccagauag

SEQ ID NO: 28424 - RNA, 32 nt, Human
aauccagcaggcacuccuccuccacaagucag

SEQ ID NO: 28425 - RNA, 32 nt, Human
aauccagcagguggagguugcagugagccaag

SEQ ID NO: 28426 - RNA, 32 nt, Human
aauccagcaugcucuugccugcccugcauaug

SEQ ID NO: 28427 - RNA, 32 nt, Human
aauccagccucgggggucaucuggaggcauga

SEQ ID NO: 28428 - RNA, 32 nt, Human
aauccagccugccuugcauccaacacagauuc

SEQ ID NO: 28429 - RNA, 32 nt, Human
aauccagcggcagaggagugagaggacugugc

SEQ ID NO: 28430 - RNA, 32 nt, Human
aauccagcugugcacuuugcccaaguggugaa

SEQ ID NO: 28431 - RNA, 32 nt, Human
aauccagcuuugauggacaucugugaugguug

SEQ ID NO: 28432 - RNA, 32 nt, Human
aauccaggaagcaagcggagguugcagugagu

SEQ ID NO: 28433 - RNA, 32 nt, Human
aauccaggaagcagagguugcggugagccgaa

SEQ ID NO: 28434 - RNA, 32 nt, Human
aauccaggaauauuguuaucccuucccauuau

SEQ ID NO: 28435 - RNA, 32 nt, Human
aauccaggagccacaggaagcagugagcuuuc

SEQ ID NO: 28436 - RNA, 26 nt, Human
aauccaggaggaggagguugcaguga

SEQ ID NO: 28437 - RNA, 32 nt, Human
aauccaggaggaggagguugcagugagccgag

SEQ ID NO: 28438 - RNA, 32 nt, Human
aauccaggaggcaaagguugcagugagccaaa

SEQ ID NO: 28439 - RNA, 32 nt, Human
aauccaggaggcagagcuugcagugagcugag

SEQ ID NO: 28440 - RNA, 32 nt, Human
aauccaggaggcagaggcuguggugagccaag

SEQ ID NO: 28441 - RNA, 32 nt, Human
aauccaggaggcagagguugcaaugagccaag

SEQ ID NO: 28442 - RNA, 26 nt, Human
aauccaggaggcagagguugcaguga

SEQ ID NO: 28443 - RNA, 32 nt, Human
aauccaggaggcagagguugcagugaguggag

SEQ ID NO: 28444 - RNA, 26 nt, Human
aauccaggaggcgaagguugcaguga

SEQ ID NO: 28445 - RNA, 32 nt, Human
aauccaggaggcgaagguugcagugagcugag

SEQ ID NO: 28446 - RNA, 26 nt, Human
aauccaggaggcggagguugcaguga

SEQ ID NO: 28447 - RNA, 32 nt, Human
aauccaggaggcggagguugcagugaaccaag

SEQ ID NO: 28448 - RNA, 32 nt, Human
aauccaggaggcggagguugcagugagccaag

SEQ ID NO: 28449 - RNA, 32 nt, Human
aauccaggaggcggagguugcagugagccgag

SEQ ID NO: 28450 - RNA, 26 nt, Human
aauccaggaggcggaguuugugguga

SEQ ID NO: 28451 - RNA, 32 nt, Human
aauccaggaggcggaguuuguggugaguugag

SEQ ID NO: 28452 - RNA, 32 nt, Human
aauccaggagguggagccugcagugagccaag

SEQ ID NO: 28453 - RNA, 32 nt, Human
aauccaggagguggagcuugcagugagccgag

SEQ ID NO: 28454 - RNA, 26 nt, Human
aauccaggagguggagguugcagcga

SEQ ID NO: 28455 - RNA, 32 nt, Human
aauccaggagguggagguugcagcgagccaag

SEQ ID NO: 28456 - RNA, 26 nt, Human
aauccaggagguggagguugcaguga

SEQ ID NO: 28457 - RNA, 32 nt, Human
aauccaggagguggagguugcagugagcugag

SEQ ID NO: 28458 - RNA, 32 nt, Human
aauccaggcauuugagaccagccuggguaaca

SEQ ID NO: 28459 - RNA, 32 nt, Human
aauccaggccaagaccagagugguggcuguag

SEQ ID NO: 28460 - RNA, 32 nt, Human
aauccaggcccuguuaacauguuuccagcacu

SEQ ID NO: 28461 - RNA, 32 nt, Human
aauccaggcuagagcaugaaacuaacagguau

SEQ ID NO: 28462 - RNA, 21 nt, Human
aauccaggcuuucucacucca

SEQ ID NO: 28463 - RNA, 32 nt, Human
aauccagggaaacugugagcccaggaguugcc

SEQ ID NO: 28464 - RNA, 17 nt, Human
aauccagggcccaccca

SEQ ID NO: 28465 - RNA, 26 nt, Human
aauccagguggcggagguugcaguga

SEQ ID NO: 28466 - RNA, 32 nt, Human
aauccagguggcggagguugcagugagccgag

SEQ ID NO: 28467 - RNA, 32 nt, Human
aauccagguucauguuugcacacaucaaaagu

SEQ ID NO: 28468 - RNA, 32 nt, Human
aauccaguagaauuuuuaucacuaucuguuau

SEQ ID NO: 28469 - RNA, 32 nt, Human
aauccaguaucacagggugauccuuugggacu

SEQ ID NO: 28470 - RNA, 32 nt, Human
aauccagucaagcugacacucagcauucacca

SEQ ID NO: 28471 - RNA, 32 nt, Human
aauccagugcuuaucagaauuccaguggcuuc

SEQ ID NO: 28472 - RNA, 32 nt, Human
aauccagugguggagguugcagugagccaaga

SEQ ID NO: 28473 - RNA, 32 nt, Human
aauccaguguauuugggauaggccaguggaac

SEQ ID NO: 28474 - RNA, 20 nt, Human
aauccaguuuaauccuuuua

SEQ ID NO: 28475 - RNA, 32 nt, Human
aauccaguuuuacaaauguggaaaaauguuua

SEQ ID NO: 28476 - RNA, 22 nt, Human
aauccauacuggagagaaaccu

SEQ ID NO: 28477 - RNA, 22 nt, Human
aauccauacuggagagaagccu

SEQ ID NO: 28478 - RNA, 31 nt, Human
aauccauaggauagagaaaaaucugcuuguu

SEQ ID NO: 28479 - RNA, 32 nt, Human
aauccauauccucacucugagucuugguaucc

SEQ ID NO: 28480 - RNA, 32 nt, Human
aauccaucaguacccuguucucaccaaagaca

SEQ ID NO: 28481 - RNA, 32 nt, Human
aauccaucauucuuuucuucauucaacaaaua

SEQ ID NO: 28482 - RNA, 32 nt, Human
aauccauccucccauuucucuguuucauucag

SEQ ID NO: 28483 - RNA, 32 nt, Human
aauccaucucagaaguugaagaugugauguug

SEQ ID NO: 28484 - RNA, 32 nt, Human
aauccaucuccuggcccugccccuuguugggg

SEQ ID NO: 28485 - RNA, 32 nt, Human
aauccaugagugagagggaaagucuaguauca

SEQ ID NO: 28486 - RNA, 32 nt, Human
aauccauggagagagaaaaagaagagggcuca

SEQ ID NO: 28487 - RNA, 31 nt, Human
aauccauggcccuagagcacuucuagcagag

SEQ ID NO: 28488 - RNA, 32 nt, Human
aauccaugugacuguuuccaccaucuugggca

SEQ ID NO: 28489 - RNA, 18 nt, Human
aauccauguuuuagcaaa

SEQ ID NO: 28490 - RNA, 32 nt, Human
aauccauucacaagccuccuguaccucagugg

SEQ ID NO: 28491 - RNA, 32 nt, Human
aauccauucacugcaaaccucguuccccauuu

SEQ ID NO: 28492 - RNA, 32 nt, Human
aauccauuccacagugaaacagguggccucgu

SEQ ID NO: 28493 - RNA, 32 nt, Human
aauccauuuagcaccuccucagccuggcucag

SEQ ID NO: 28494 - RNA, 32 nt, Human
aauccauuucacagaugaggaaaucaaggucu

SEQ ID NO: 28495 - RNA, 32 nt, Human
aaucccaaaagcuuacugucuccaggaccaca

SEQ ID NO: 28496 - RNA, 32 nt, Human
aaucccaaagugcugggauuacaggcgugagc

SEQ ID NO: 28497 - RNA, 32 nt, Human
aaucccaaagugcugggauuacaggugugagc

SEQ ID NO: 28498 - RNA, 32 nt, Human
aaucccaaauacucgggaggcugaggcaggag

SEQ ID NO: 28499 - RNA, 32 nt, Human
aaucccaaauuugaaaauccaaucccaagucc

SEQ ID NO: 28500 - RNA, 32 nt, Human
aaucccaacaagcaagggucuccuucaagauu

SEQ ID NO: 28501 - RNA, 32 nt, Human
aaucccaagcagcugggauuacaggcacacac

SEQ ID NO: 28502 - RNA, 32 nt, Human
aaucccaagggacuagagggcugcaauggacu

SEQ ID NO: 28503 - RNA, 32 nt, Human
aaucccacacuccaggucugugcucaagagac

SEQ ID NO: 28504 - RNA, 32 nt, Human
aaucccacaugguaacaacuagcugaacauga

SEQ ID NO: 28505 - RNA, 32 nt, Human
aaucccaccacugcacuccagccugggugaca

SEQ ID NO: 28506 - RNA, 32 nt, Human
aaucccacccccagaguggggagggucaggug

SEQ ID NO: 28507 - RNA, 32 nt, Human
aaucccaccuacucagaagacugaggccggag

SEQ ID NO: 28508 - RNA, 32 nt, Human
aaucccaccuacucgggaggcugaggcaggag

SEQ ID NO: 28509 - RNA, 32 nt, Human
aaucccaccucgggguccacgcugcagcagag

SEQ ID NO: 28510 - RNA, 32 nt, Human
aaucccacuacugcauuccagccuggguggac

SEQ ID NO: 28511 - RNA, 32 nt, Human
aaucccacugaaauugcuggcauucucaaagg

SEQ ID NO: 28512 - RNA, 32 nt, Human
aaucccacugcauuccagccugggcaacagcg

SEQ ID NO: 28513 - RNA, 32 nt, Human
aaucccagaaacuuccaucucagguccuucca

SEQ ID NO: 28514 - RNA, 32 nt, Human
aaucccagaacacauuucaaagagcacguauc

SEQ ID NO: 28515 - RNA, 32 nt, Human
aaucccagagcuucgggaggccaaggugggag

SEQ ID NO: 28516 - RNA, 32 nt, Human
aaucccagaggaagaccaggcaugguggcuca

SEQ ID NO: 28517 - RNA, 32 nt, Human
aaucccagauacucgggaggcugaggcaugag

SEQ ID NO: 28518 - RNA, 32 nt, Human
aaucccagcacuaggaggccgaggugggugaa

SEQ ID NO: 28519 - RNA, 32 nt, Human
aaucccagcacuaugggaggccagggagggag

SEQ ID NO: 28520 - RNA, 32 nt, Human
aaucccagcacuaugggaggcccaggugagca

SEQ ID NO: 28521 - RNA, 32 nt, Human
aaucccagcacuaugggaggccgagacgggcg

SEQ ID NO: 28522 - RNA, 32 nt, Human
aaucccagcacuaugggaggcugaggcaagca

SEQ ID NO: 28523 - RNA, 32 nt, Human
aaucccagcacuaugggaggcugaggugagag

SEQ ID NO: 28524 - RNA, 32 nt, Human
aaucccagcacuaugggaggcugaggugggca

SEQ ID NO: 28525 - RNA, 32 nt, Human
aaucccagcacuuugggagacuaaggcaggcg

SEQ ID NO: 28526 - RNA, 32 nt, Human
aaucccagcacuuugggagacugagaugggag

SEQ ID NO: 28527 - RNA, 32 nt, Human
aaucccagcacuuugggagacugaggagggag

SEQ ID NO: 28528 - RNA, 32 nt, Human
aaucccagcacuuugggagacugaggaggggu

SEQ ID NO: 28529 - RNA, 32 nt, Human
aaucccagcacuuugggagacugaggcgggcg

SEQ ID NO: 28530 - RNA, 32 nt, Human
aaucccagcacuuugggagacugaggcgggug

SEQ ID NO: 28531 - RNA, 32 nt, Human
aaucccagcacuuugggagacugaggugggca

SEQ ID NO: 28532 - RNA, 32 nt, Human
aaucccagcacuuugggagacugaggugggug

SEQ ID NO: 28533 - RNA, 32 nt, Human
aaucccagcacuuuugggaggcugagguuggg

SEQ ID NO: 28534 - RNA, 32 nt, Human
aaucccagcaugcauccugcucagggacaacg

SEQ ID NO: 28535 - RNA, 32 nt, Human
aaucccagccaaggcuggcagaucacuugagg

SEQ ID NO: 28536 - RNA, 32 nt, Human
aaucccagccacucgggaggcugaggcaagag

SEQ ID NO: 28537 - RNA, 32 nt, Human
aaucccagcccacuuugcugugucucuggcgg

SEQ ID NO: 28538 - RNA, 32 nt, Human
aaucccagcccuuugggagacugaggccagca

SEQ ID NO: 28539 - RNA, 32 nt, Human
aaucccagccuggaaugcaguggugcaaucac

SEQ ID NO: 28540 - RNA, 32 nt, Human
aaucccagccugggcaggaauguggcuccccg

SEQ ID NO: 28541 - RNA, 32 nt, Human
aaucccagcuacccaggaaggcugaggcggca

SEQ ID NO: 28542 - RNA, 32 nt, Human
aaucccagcuacccggggaggcugaggcagga

SEQ ID NO: 28543 - RNA, 32 nt, Human
aaucccagcuacgucaggaggcugaggcacag

SEQ ID NO: 28544 - RNA, 32 nt, Human
aaucccagcuacuaaggaggcugaggcaggag

SEQ ID NO: 28545 - RNA, 32 nt, Human
aaucccagcuacuagagaggcugaggcaggag

SEQ ID NO: 28546 - RNA, 32 nt, Human
aaucccagcuacuagggagacugaggcaggag

SEQ ID NO: 28547 - RNA, 32 nt, Human
aaucccagcuacuagggaggaugaggcagaag

SEQ ID NO: 28548 - RNA, 32 nt, Human
aaucccagcuacuagggaggaugaggcaggag

SEQ ID NO: 28549 - RNA, 32 nt, Human
aaucccagcuacuagggaggcggaggaagaag

SEQ ID NO: 28550 - RNA, 32 nt, Human
aaucccagcuacuagggaggcugagacacacg

SEQ ID NO: 28551 - RNA, 32 nt, Human
aaucccagcuacuagggaggcugaggcaagag

SEQ ID NO: 28552 - RNA, 32 nt, Human
aaucccagcuacuagggaggcugaggcaggag

SEQ ID NO: 28553 - RNA, 32 nt, Human
aaucccagcuacuagggaggcugcggcaggag

SEQ ID NO: 28554 - RNA, 32 nt, Human
aaucccagcuacucaagaggcugaggcaagag

SEQ ID NO: 28555 - RNA, 32 nt, Human
aaucccagcuacucaagaggcugaggcacgag

SEQ ID NO: 28556 - RNA, 32 nt, Human
aaucccagcuacucaagaggcugaggcaggag

SEQ ID NO: 28557 - RNA, 32 nt, Human
aaucccagcuacucaagaggcugagguaggag

SEQ ID NO: 28558 - RNA, 32 nt, Human
aaucccagcuacucaagagguugcagugagcu

SEQ ID NO: 28559 - RNA, 32 nt, Human
aaucccagcuacucaaggcugaggcaggagaa

SEQ ID NO: 28560 - RNA, 32 nt, Human
aaucccagcuacucagaaggccgaggugggag

SEQ ID NO: 28561 - RNA, 32 nt, Human
aaucccagcuacucagaaggcugaggcaggag

SEQ ID NO: 28562 - RNA, 32 nt, Human
aaucccagcuacucagaaggcugaggcaugag

SEQ ID NO: 28563 - RNA, 32 nt, Human
aaucccagcuacucagaaggcugagguacaag

SEQ ID NO: 28564 - RNA, 32 nt, Human
aaucccagcuacucagaaggcugaggugggag

SEQ ID NO: 28565 - RNA, 32 nt, Human
aaucccagcuacucagaagguugagacaaagg

SEQ ID NO: 28566 - RNA, 32 nt, Human
aaucccagcuacucagaggcuaaggcgggaga

SEQ ID NO: 28567 - RNA, 32 nt, Human
aaucccagcuacucagauggcugaggcaggag

SEQ ID NO: 28568 - RNA, 32 nt, Human
aaucccagcuacucagcagggugaggugagag

SEQ ID NO: 28569 - RNA, 32 nt, Human
aaucccagcuacucaggaagcugaggcaagag

SEQ ID NO: 28570 - RNA, 32 nt, Human
aaucccagcuacucaggaagcugaggcacgag

SEQ ID NO: 28571 - RNA, 32 nt, Human
aaucccagcuacucaggaagcugaggcaggaa

SEQ ID NO: 28572 - RNA, 32 nt, Human
aaucccagcuacucaggaagcugaggcgagag

SEQ ID NO: 28573 - RNA, 32 nt, Human
aaucccagcuacucaggaagcugggguggaag

SEQ ID NO: 28574 - RNA, 32 nt, Human
aaucccagcuacucaggaaggcugaggcagga

SEQ ID NO: 28575 - RNA, 32 nt, Human
aaucccagcuacucaggagaaucgcccaaacc

SEQ ID NO: 28576 - RNA, 32 nt, Human
aaucccagcuacucaggagacugaggcagaag

SEQ ID NO: 28577 - RNA, 32 nt, Human
aaucccagcuacucaggagacugaggcagaga

SEQ ID NO: 28578 - RNA, 32 nt, Human
aaucccagcuacucaggagacugaggcaggaa

SEQ ID NO: 28579 - RNA, 32 nt, Human
aaucccagcuacucaggagacugaggcaggag

SEQ ID NO: 28580 - RNA, 32 nt, Human
aaucccagcuacucaggagacugaguuaggag

SEQ ID NO: 28581 - RNA, 32 nt, Human
aaucccagcuacucaggaggaugaggcaggag

SEQ ID NO: 28582 - RNA, 32 nt, Human
aaucccagcuacucaggaggcagaggcacaag

SEQ ID NO: 28583 - RNA, 32 nt, Human
aaucccagcuacucaggaggccaaagcaggag

SEQ ID NO: 28584 - RNA, 32 nt, Human
aaucccagcuacucaggaggccgaggcaagag

SEQ ID NO: 28585 - RNA, 32 nt, Human
aaucccagcuacucaggaggccgaggcaggaa

SEQ ID NO: 28586 - RNA, 32 nt, Human
aaucccagcuacucaggaggccgaggcaggag

SEQ ID NO: 28587 - RNA, 32 nt, Human
aaucccagcuacucaggaggcuaaggcaggag

SEQ ID NO: 28588 - RNA, 32 nt, Human
aaucccagcuacucaggaggcuaaggcaggga

SEQ ID NO: 28589 - RNA, 32 nt, Human
aaucccagcuacucaggaggcuaaggcaugag

SEQ ID NO: 28590 - RNA, 32 nt, Human
aaucccagcuacucaggaggcuaaggcgggag

SEQ ID NO: 28591 - RNA, 32 nt, Human
aaucccagcuacucaggaggcuacagcaggag

SEQ ID NO: 28592 - RNA, 32 nt, Human
aaucccagcuacucaggaggcucaggcacgag

SEQ ID NO: 28593 - RNA, 32 nt, Human
aaucccagcuacucaggaggcugaaacaggag

SEQ ID NO: 28594 - RNA, 32 nt, Human
aaucccagcuacucaggaggcugaagcaagag

SEQ ID NO: 28595 - RNA, 32 nt, Human
aaucccagcuacucaggaggcugaagcagaag

SEQ ID NO: 28596 - RNA, 32 nt, Human
aaucccagcuacucaggaggcugaagcaggag

SEQ ID NO: 28597 - RNA, 32 nt, Human
aaucccagcuacucaggaggcugagacagaag

SEQ ID NO: 28598 - RNA, 32 nt, Human
aaucccagcuacucaggaggcugagacaggac

SEQ ID NO: 28599 - RNA, 32 nt, Human
aaucccagcuacucaggaggcugagacaggag

SEQ ID NO: 28600 - RNA, 32 nt, Human
aaucccagcuacucaggaggcugaggaaggag

SEQ ID NO: 28601 - RNA, 32 nt, Human
aaucccagcuacucaggaggcugaggcaagag

SEQ ID NO: 28602 - RNA, 32 nt, Human
aaucccagcuacucaggaggcugaggcacaag

SEQ ID NO: 28603 - RNA, 32 nt, Human
aaucccagcuacucaggaggcugaggcacgag

SEQ ID NO: 28604 - RNA, 32 nt, Human
aaucccagcuacucaggaggcugaggcagaag

SEQ ID NO: 28605 - RNA, 32 nt, Human
aaucccagcuacucaggaggcugaggcagaau

SEQ ID NO: 28606 - RNA, 32 nt, Human
aaucccagcuacucaggaggcugaggcaggaa

SEQ ID NO: 28607 - RNA, 32 nt, Human
aaucccagcuacucaggaggcugaggcaggag

SEQ ID NO: 28608 - RNA, 32 nt, Human
aaucccagcuacucaggaggcugaggcaggau

SEQ ID NO: 28609 - RNA, 32 nt, Human
aaucccagcuacucaggaggcugaggcagggg

SEQ ID NO: 28610 - RNA, 32 nt, Human
aaucccagcuacucaggaggcugaggcaggug

SEQ ID NO: 28611 - RNA, 32 nt, Human
aaucccagcuacucaggaggcugaggcaguag

SEQ ID NO: 28612 - RNA, 32 nt, Human
aaucccagcuacucaggaggcugaggcaugag

SEQ ID NO: 28613 - RNA, 32 nt, Human
aaucccagcuacucaggaggcugaggccggag

SEQ ID NO: 28614 - RNA, 32 nt, Human
aaucccagcuacucaggaggcugaggcggaga

SEQ ID NO: 28615 - RNA, 32 nt, Human
aaucccagcuacucaggaggcugaggcggaug

SEQ ID NO: 28616 - RNA, 32 nt, Human
aaucccagcuacucaggaggcugaggcgggag

SEQ ID NO: 28617 - RNA, 32 nt, Human
aaucccagcuacucaggaggcugaggcuggag

SEQ ID NO: 28618 - RNA, 32 nt, Human
aaucccagcuacucaggaggcugaggcuugag

SEQ ID NO: 28619 - RNA, 32 nt, Human
aaucccagcuacucaggaggcugagggaggag

SEQ ID NO: 28620 - RNA, 32 nt, Human
aaucccagcuacucaggaggcugagguaggag

SEQ ID NO: 28621 - RNA, 32 nt, Human
aaucccagcuacucaggaggcugaggugggag

SEQ ID NO: 28622 - RNA, 32 nt, Human
aaucccagcuacucaggaggcugagucaggau

SEQ ID NO: 28623 - RNA, 32 nt, Human
aaucccagcuacucaggaggcugagugaggca

SEQ ID NO: 28624 - RNA, 32 nt, Human
aaucccagcuacucaggaggcugggacaggag

SEQ ID NO: 28625 - RNA, 32 nt, Human
aaucccagcuacucaggaggcuggggcagcag

SEQ ID NO: 28626 - RNA, 32 nt, Human
aaucccagcuacucaggaggcuggggcaggag

SEQ ID NO: 28627 - RNA, 32 nt, Human
aaucccagcuacucaggaggcuguggcgagag

SEQ ID NO: 28628 - RNA, 32 nt, Human
aaucccagcuacucaggagggugaggcaggag

SEQ ID NO: 28629 - RNA, 32 nt, Human
aaucccagcuacucaggagguugaggcagcag

SEQ ID NO: 28630 - RNA, 32 nt, Human
aaucccagcuacucaggagucugaggaggaga

SEQ ID NO: 28631 - RNA, 32 nt, Human
aaucccagcuacucaggagucugaggcacgag

SEQ ID NO: 28632 - RNA, 32 nt, Human
aaucccagcuacucaggagucugaggcaggag

SEQ ID NO: 28633 - RNA, 32 nt, Human
aaucccagcuacucagggggcugaggcaggag

SEQ ID NO: 28634 - RNA, 32 nt, Human
aaucccagcuacucagggggcugaggcagggg

SEQ ID NO: 28635 - RNA, 32 nt, Human
aaucccagcuacucagguggcuaaggcaggag

SEQ ID NO: 28636 - RNA, 32 nt, Human
aaucccagcuacucagguggcugaggcaggag

SEQ ID NO: 28637 - RNA, 32 nt, Human
aaucccagcuacucauaaggcugaggugggag

SEQ ID NO: 28638 - RNA, 32 nt, Human
aaucccagcuacucaugaggcugaggcagaag

SEQ ID NO: 28639 - RNA, 32 nt, Human
aaucccagcuacucaugaggcugaggcaguag

SEQ ID NO: 28640 - RNA, 32 nt, Human
aaucccagcuacuccagaagcugaggcuggag

SEQ ID NO: 28641 - RNA, 32 nt, Human
aaucccagcuacuccagaggcugaggcaggag

SEQ ID NO: 28642 - RNA, 32 nt, Human
aaucccagcuacucccaaggcugaggcaggag

SEQ ID NO: 28643 - RNA, 32 nt, Human
aaucccagcuacuccggaagcugaggcaggag

SEQ ID NO: 28644 - RNA, 32 nt, Human
aaucccagcuacuccgggaggcugaggcagga

SEQ ID NO: 28645 - RNA, 32 nt, Human
aaucccagcuacucgagaggccaaggcaugag

SEQ ID NO: 28646 - RNA, 32 nt, Human
aaucccagcuacucgagaggcugaggcaggag

SEQ ID NO: 28647 - RNA, 32 nt, Human
aaucccagcuacucgagugccugaggcaggag

SEQ ID NO: 28648 - RNA, 32 nt, Human
aaucccagcuacucgcaaggcugaggcaggag

SEQ ID NO: 28649 - RNA, 32 nt, Human
aaucccagcuacucggaaggccaaggcaggag

SEQ ID NO: 28650 - RNA, 32 nt, Human
aaucccagcuacucggaaguuugagacgagaa

SEQ ID NO: 28651 - RNA, 32 nt, Human
aaucccagcuacucggaggcugaggcacaaga

SEQ ID NO: 28652 - RNA, 32 nt, Human
aaucccagcuacucgggaaccugaggcaggag

SEQ ID NO: 28653 - RNA, 32 nt, Human
aaucccagcuacucgggaagcugaggcagaag

SEQ ID NO: 28654 - RNA, 32 nt, Human
aaucccagcuacucgggaagcugaggcaggag

SEQ ID NO: 28655 - RNA, 32 nt, Human
aaucccagcuacucgggaagcugaggcaggug

SEQ ID NO: 28656 - RNA, 32 nt, Human
aaucccagcuacucgggagaccgaggcaugag

SEQ ID NO: 28657 - RNA, 32 nt, Human
aaucccagcuacucgggagacuaggcagagaa

SEQ ID NO: 28658 - RNA, 32 nt, Human
aaucccagcuacucgggagacugaggcagaag

SEQ ID NO: 28659 - RNA, 32 nt, Human
aaucccagcuacucgggagacugaggcagaga

SEQ ID NO: 28660 - RNA, 32 nt, Human
aaucccagcuacucgggagacugaggcaggag

SEQ ID NO: 28661 - RNA, 32 nt, Human
aaucccagcuacucgggagcugaggcaggaga

SEQ ID NO: 28662 - RNA, 32 nt, Human
aaucccagcuacucgggaggccaaggcaggag

SEQ ID NO: 28663 - RNA, 32 nt, Human
aaucccagcuacucgggaggccgaggcaggag

SEQ ID NO: 28664 - RNA, 32 nt, Human
aaucccagcuacucgggaggcggaggcaggag

SEQ ID NO: 28665 - RNA, 32 nt, Human
aaucccagcuacucgggaggcuaaagcaggag

SEQ ID NO: 28666 - RNA, 32 nt, Human
aaucccagcuacucgggaggcuaaggcaggaa

SEQ ID NO: 28667 - RNA, 32 nt, Human
aaucccagcuacucgggaggcuaaggcaggag

SEQ ID NO: 28668 - RNA, 32 nt, Human
aaucccagcuacucgggaggcuaaggugggag

SEQ ID NO: 28669 - RNA, 32 nt, Human
aaucccagcuacucgggaggcugaaccaggag

SEQ ID NO: 28670 - RNA, 32 nt, Human
aaucccagcuacucgggaggcugaagcaggag

SEQ ID NO: 28671 - RNA, 32 nt, Human
aaucccagcuacucgggaggcugacgcaggag

SEQ ID NO: 28672 - RNA, 32 nt, Human
aaucccagcuacucgggaggcugagacaggaa

SEQ ID NO: 28673 - RNA, 32 nt, Human
aaucccagcuacucgggaggcugagacaggag

SEQ ID NO: 28674 - RNA, 32 nt, Human
aaucccagcuacucgggaggcugagaugaaga

SEQ ID NO: 28675 - RNA, 32 nt, Human
aaucccagcuacucgggaggcugaggaaggag

SEQ ID NO: 28676 - RNA, 32 nt, Human
aaucccagcuacucgggaggcugaggagggag

SEQ ID NO: 28677 - RNA, 32 nt, Human
aaucccagcuacucgggaggcugaggcaagag

SEQ ID NO: 28678 - RNA, 32 nt, Human
aaucccagcuacucgggaggcugaggcacaag

SEQ ID NO: 28679 - RNA, 32 nt, Human
aaucccagcuacucgggaggcugaggcacgag

SEQ ID NO: 28680 - RNA, 32 nt, Human
aaucccagcuacucgggaggcugaggcagaag

SEQ ID NO: 28681 - RNA, 32 nt, Human
aaucccagcuacucgggaggcugaggcaggaa

SEQ ID NO: 28682 - RNA, 32 nt, Human
aaucccagcuacucgggaggcugaggcaggac

SEQ ID NO: 28683 - RNA, 32 nt, Human
aaucccagcuacucgggaggcugaggcaggag

SEQ ID NO: 28684 - RNA, 32 nt, Human
aaucccagcuacucgggaggcugaggcaggau

SEQ ID NO: 28685 - RNA, 32 nt, Human
aaucccagcuacucgggaggcugaggcaggga

SEQ ID NO: 28686 - RNA, 32 nt, Human
aaucccagcuacucgggaggcugaggcauaag

SEQ ID NO: 28687 - RNA, 32 nt, Human
aaucccagcuacucgggaggcugaggcaugag

SEQ ID NO: 28688 - RNA, 32 nt, Human
aaucccagcuacucgggaggcugaggcggaag

SEQ ID NO: 28689 - RNA, 32 nt, Human
aaucccagcuacucgggaggcugagggaggag

SEQ ID NO: 28690 - RNA, 32 nt, Human
aaucccagcuacucgggaggcugaggugggag

SEQ ID NO: 28691 - RNA, 32 nt, Human
aaucccagcuacucgggaggcugagucaggag

SEQ ID NO: 28692 - RNA, 32 nt, Human
aaucccagcuacucgggaggcugcggcgggag

SEQ ID NO: 28693 - RNA, 32 nt, Human
aaucccagcuacucgggaggcuguaauccuag

SEQ ID NO: 28694 - RNA, 32 nt, Human
aaucccagcuacucgggaggcuguggcaggag

SEQ ID NO: 28695 - RNA, 32 nt, Human
aaucccagcuacucgggaggcuuagacaugag

SEQ ID NO: 28696 - RNA, 32 nt, Human
aaucccagcuacucgggagggugaggcaggag

SEQ ID NO: 28697 - RNA, 32 nt, Human
aaucccagcuacucgggaggugaggcaggaga

SEQ ID NO: 28698 - RNA, 32 nt, Human
aaucccagcuacucgggagguugaggcaggag

SEQ ID NO: 28699 - RNA, 32 nt, Human
aaucccagcuacucgggagguugagggaggag

SEQ ID NO: 28700 - RNA, 32 nt, Human
aaucccagcuacucgggagguuuaggcaggag

SEQ ID NO: 28701 - RNA, 32 nt, Human
aaucccagcuacucgggagucucaggcaggag

SEQ ID NO: 28702 - RNA, 32 nt, Human
aaucccagcuacucgggcagcugagacaggag

SEQ ID NO: 28703 - RNA, 32 nt, Human
aaucccagcuacucgguaggcugaggcaggag

SEQ ID NO: 28704 - RNA, 32 nt, Human
aaucccagcuacucugaagccugaggcagaau

SEQ ID NO: 28705 - RNA, 32 nt, Human
aaucccagcuacucuggagacugaggugggag

SEQ ID NO: 28706 - RNA, 32 nt, Human
aaucccagcuacucuggaggcuaaggcaggag

SEQ ID NO: 28707 - RNA, 32 nt, Human
aaucccagcuacucuggaggcugagacagaau

SEQ ID NO: 28708 - RNA, 32 nt, Human
aaucccagcuacucuggaggcugagauaggag

SEQ ID NO: 28709 - RNA, 32 nt, Human
aaucccagcuacucuggaggcugaggcacagc

SEQ ID NO: 28710 - RNA, 32 nt, Human
aaucccagcuacucuggaggcugaggcaggag

SEQ ID NO: 28711 - RNA, 32 nt, Human
aaucccagcuacucuggaggcugggcuggaga

SEQ ID NO: 28712 - RNA, 32 nt, Human
aaucccagcuacucuggaggcuggggcaggag

SEQ ID NO: 28713 - RNA, 32 nt, Human
aaucccagcuacucuggagggugaggcaggag

SEQ ID NO: 28714 - RNA, 32 nt, Human
aaucccagcuacucugggggccaaggcaggag

SEQ ID NO: 28715 - RNA, 32 nt, Human
aaucccagcuacucuuggaggcugaggcagga

SEQ ID NO: 28716 - RNA, 32 nt, Human
aaucccagcuacugaagaggcugaggugggag

SEQ ID NO: 28717 - RNA, 32 nt, Human
aaucccagcuacugaggagacuugagguagga

SEQ ID NO: 28718 - RNA, 32 nt, Human
aaucccagcuacugagggggcugaggcaugag

SEQ ID NO: 28719 - RNA, 32 nt, Human
aaucccagcuacugggaaggcugagguaggag

SEQ ID NO: 28720 - RNA, 32 nt, Human
aaucccagcuacuggggaaagcugaggcagga

SEQ ID NO: 28721 - RNA, 32 nt, Human
aaucccagcuacuggggaagcugaggcaggag

SEQ ID NO: 28722 - RNA, 32 nt, Human
aaucccagcuacuggggaggcugaggcacgag

SEQ ID NO: 28723 - RNA, 32 nt, Human
aaucccagcuacuggggaggcugaggcaggag

SEQ ID NO: 28724 - RNA, 32 nt, Human
aaucccagcuacuggggaggcugaggcgggag

SEQ ID NO: 28725 - RNA, 32 nt, Human
aaucccagcuacuuaggaggcugaggcaggag

SEQ ID NO: 28726 - RNA, 32 nt, Human
aaucccagcuacuuaggaggcugaggugggag

SEQ ID NO: 28727 - RNA, 32 nt, Human
aaucccagcuacuuaggaggcugaugcaggag

SEQ ID NO: 28728 - RNA, 32 nt, Human
aaucccagcuacuucggagguugagucacgag

SEQ ID NO: 28729 - RNA, 32 nt, Human
aaucccagcuacuugagagacugaggcaggag

SEQ ID NO: 28730 - RNA, 32 nt, Human
aaucccagcuacuugagaggcagaggcaggag

SEQ ID NO: 28731 - RNA, 32 nt, Human
aaucccagcuacuugagaggcugaggcacgag

SEQ ID NO: 28732 - RNA, 32 nt, Human
aaucccagcuacuugagaggcugaggccggag

SEQ ID NO: 28733 - RNA, 32 nt, Human
aaucccagcuacuugagaggcuggggcaggag

SEQ ID NO: 28734 - RNA, 32 nt, Human
aaucccagcuacuugagagucugaagcaggag

SEQ ID NO: 28735 - RNA, 32 nt, Human
aaucccagcuacuuggaaggcugaggcaggag

SEQ ID NO: 28736 - RNA, 32 nt, Human
aaucccagcuacuuggaaggcugaggcauagg

SEQ ID NO: 28737 - RNA, 32 nt, Human
aaucccagcuacuuggaaggcugagguaugag

SEQ ID NO: 28738 - RNA, 32 nt, Human
aaucccagcuacuuggcaggcugaggugggag

SEQ ID NO: 28739 - RNA, 32 nt, Human
aaucccagcuacuugggaagcugaagcaggag

SEQ ID NO: 28740 - RNA, 32 nt, Human
aaucccagcuacuugggaagcugagacaggag

SEQ ID NO: 28741 - RNA, 32 nt, Human
aaucccagcuacuugggaagcugaggcgggag

SEQ ID NO: 28742 - RNA, 32 nt, Human
aaucccagcuacuugggacgcugaggugggag

SEQ ID NO: 28743 - RNA, 32 nt, Human
aaucccagcuacuugggagacugagacaugag

SEQ ID NO: 28744 - RNA, 32 nt, Human
aaucccagcuacuugggagacugaggcaagag

SEQ ID NO: 28745 - RNA, 32 nt, Human
aaucccagcuacuugggagacugaggcacgag

SEQ ID NO: 28746 - RNA, 32 nt, Human
aaucccagcuacuugggagacugaggcaggag

SEQ ID NO: 28747 - RNA, 32 nt, Human
aaucccagcuacuugggagccugaggcgggag

SEQ ID NO: 28748 - RNA, 32 nt, Human
aaucccagcuacuugggaggcagaggcaggag

SEQ ID NO: 28749 - RNA, 32 nt, Human
aaucccagcuacuugggaggccaaggcaggag

SEQ ID NO: 28750 - RNA, 32 nt, Human
aaucccagcuacuugggaggccaaggugggag

SEQ ID NO: 28751 - RNA, 32 nt, Human
aaucccagcuacuugggaggccgaggcaggag

SEQ ID NO: 28752 - RNA, 32 nt, Human
aaucccagcuacuugggaggccgaggcaugag

SEQ ID NO: 28753 - RNA, 32 nt, Human
aaucccagcuacuugggaggcuaaggcaggag

SEQ ID NO: 28754 - RNA, 32 nt, Human
aaucccagcuacuugggaggcucaggcacgag

SEQ ID NO: 28755 - RNA, 32 nt, Human
aaucccagcuacuugggaggcugaaacaggag

SEQ ID NO: 28756 - RNA, 32 nt, Human
aaucccagcuacuugggaggcugaagcaggag

SEQ ID NO: 28757 - RNA, 32 nt, Human
aaucccagcuacuugggaggcugacgcagggg

SEQ ID NO: 28758 - RNA, 32 nt, Human
aaucccagcuacuugggaggcugagacaggag

SEQ ID NO: 28759 - RNA, 32 nt, Human
aaucccagcuacuugggaggcugagagaggag

SEQ ID NO: 28760 - RNA, 32 nt, Human
aaucccagcuacuugggaggcugagaugugag

SEQ ID NO: 28761 - RNA, 32 nt, Human
aaucccagcuacuugggaggcugagccaggag

SEQ ID NO: 28762 - RNA, 32 nt, Human
aaucccagcuacuugggaggcugaggcaagag

SEQ ID NO: 28763 - RNA, 32 nt, Human
aaucccagcuacuugggaggcugaggcaagug

SEQ ID NO: 28764 - RNA, 32 nt, Human
aaucccagcuacuugggaggcugaggcacgag

SEQ ID NO: 28765 - RNA, 32 nt, Human
aaucccagcuacuugggaggcugaggcagaag

SEQ ID NO: 28766 - RNA, 32 nt, Human
aaucccagcuacuugggaggcugaggcagaau

SEQ ID NO: 28767 - RNA, 32 nt, Human
aaucccagcuacuugggaggcugaggcagaga

SEQ ID NO: 28768 - RNA, 32 nt, Human
aaucccagcuacuugggaggcugaggcagagc

SEQ ID NO: 28769 - RNA, 32 nt, Human
aaucccagcuacuugggaggcugaggcagcag

SEQ ID NO: 28770 - RNA, 32 nt, Human
aaucccagcuacuugggaggcugaggcaggaa

SEQ ID NO: 28771 - RNA, 32 nt, Human
aaucccagcuacuugggaggcugaggcaggac

SEQ ID NO: 28772 - RNA, 32 nt, Human
aaucccagcuacuugggaggcugaggcaggag

SEQ ID NO: 28773 - RNA, 32 nt, Human
aaucccagcuacuugggaggcugaggcagggg

SEQ ID NO: 28774 - RNA, 32 nt, Human
aaucccagcuacuugggaggcugaggcauaag

SEQ ID NO: 28775 - RNA, 32 nt, Human
aaucccagcuacuugggaggcugaggcaugag

SEQ ID NO: 28776 - RNA, 32 nt, Human
aaucccagcuacuugggaggcugaggcgagag

SEQ ID NO: 28777 - RNA, 32 nt, Human
aaucccagcuacuugggaggcugaggcggcag

SEQ ID NO: 28778 - RNA, 32 nt, Human
aaucccagcuacuugggaggcugaggcuggag

SEQ ID NO: 28779 - RNA, 32 nt, Human
aaucccagcuacuugggaggcugagggcagga

SEQ ID NO: 28780 - RNA, 32 nt, Human
aaucccagcuacuugggaggcugagguaggag

SEQ ID NO: 28781 - RNA, 32 nt, Human
aaucccagcuacuugggaggcugagguaggga

SEQ ID NO: 28782 - RNA, 32 nt, Human
aaucccagcuacuugggaggcugaggugggag

SEQ ID NO: 28783 - RNA, 32 nt, Human
aaucccagcuacuugggaggcugaguugggag

SEQ ID NO: 28784 - RNA, 32 nt, Human
aaucccagcuacuugggaggcuguggcaggag

SEQ ID NO: 28785 - RNA, 32 nt, Human
aaucccagcuacuugggagucugaggcaggag

SEQ ID NO: 28786 - RNA, 32 nt, Human
aaucccagcuacuuggguggccgaggcaggag

SEQ ID NO: 28787 - RNA, 32 nt, Human
aaucccagcuacuuggguggcugaggcaagag

SEQ ID NO: 28788 - RNA, 32 nt, Human
aaucccagcuacuuggguggcugaggcaggcg

SEQ ID NO: 28789 - RNA, 32 nt, Human
aaucccagcuacuuuacuugggaggcugaggc

SEQ ID NO: 28790 - RNA, 32 nt, Human
aaucccagcuacuuugguggcugaggcaugag

SEQ ID NO: 28791 - RNA, 32 nt, Human
aaucccagcuagucaggaggcugaggcaggag

SEQ ID NO: 28792 - RNA, 32 nt, Human
aaucccagcugcucaggagacugaggcaggag

SEQ ID NO: 28793 - RNA, 32 nt, Human
aaucccagcugcucgggaggcagaggcaggag

SEQ ID NO: 28794 - RNA, 32 nt, Human
aaucccagcugcucgggaggcugaggcaggag

SEQ ID NO: 28795 - RNA, 32 nt, Human
aaucccagcugugggagguugaggcaggagaa

SEQ ID NO: 28796 - RNA, 32 nt, Human
aaucccagcuucucgggaggcugaggcaggag

SEQ ID NO: 28797 - RNA, 32 nt, Human
aaucccaggagacagagguugcagugagccga

SEQ ID NO: 28798 - RNA, 32 nt, Human
aaucccaggagguagcaaccuaggcuuugguu

SEQ ID NO: 28799 - RNA, 32 nt, Human
aaucccaggccaugugcacaucccaggauuag

SEQ ID NO: 28800 - RNA, 32 nt, Human
aaucccagggcauugcccaccugggugugauc

SEQ ID NO: 28801 - RNA, 32 nt, Human
aaucccaggggguggagggggagaggagagag

SEQ ID NO: 28802 - RNA, 32 nt, Human
aaucccagggugcugagauuacaggugugagc

SEQ ID NO: 28803 - RNA, 32 nt, Human
aaucccagguacucgggaggcugaagcaggag

SEQ ID NO: 28804 - RNA, 32 nt, Human
aaucccagguacucgggaggcugaggcagaga

SEQ ID NO: 28805 - RNA, 32 nt, Human
aaucccagugauucaggagacugaggugggag

SEQ ID NO: 28806 - RNA, 32 nt, Human
aaucccagugcuuugggagacugaggcaggag

SEQ ID NO: 28807 - RNA, 32 nt, Human
aaucccaguuacucgggaggaugagucaggag

SEQ ID NO: 28808 - RNA, 32 nt, Human
aaucccaguuacucgggaggcugaggcaagag

SEQ ID NO: 28809 - RNA, 32 nt, Human
aaucccaguuacucgggaggcugaggcaggag

SEQ ID NO: 28810 - RNA, 32 nt, Human
aaucccauacccuucagccucugcuccacaga

SEQ ID NO: 28811 - RNA, 32 nt, Human
aaucccaucaucuacucaggaggcugaggcag

SEQ ID NO: 28812 - RNA, 32 nt, Human
aaucccaucuccuaagcuuaccuucacaacuc

SEQ ID NO: 28813 - RNA, 32 nt, Human
aaucccaucuuucugugugaguaaugcauucu

SEQ ID NO: 28814 - RNA, 32 nt, Human
aaucccaugcagugauuccaggauuugaaauu

SEQ ID NO: 28815 - RNA, 32 nt, Human
aaucccauuugagguauaagucacucaggaag

SEQ ID NO: 28816 - RNA, 32 nt, Human
aauccccaccaggcgccuuccuggguggauuc

SEQ ID NO: 28817 - RNA, 32 nt, Human
aauccccagaaacccugauucaggucugcagg

SEQ ID NO: 28818 - RNA, 32 nt, Human
aauccccagccugugagucucagccucuuucc

SEQ ID NO: 28819 - RNA, 32 nt, Human
aauccccagggccugugaacguggcucucuca

SEQ ID NO: 28820 - RNA, 32 nt, Human
aauccccaugugucaagggagggaccugaugg

SEQ ID NO: 28821 - RNA, 32 nt, Human
aaucccccacacaagcucauccccggccucug

SEQ ID NO: 28822 - RNA, 32 nt, Human
aaucccccaccuuucggggucucccccuccuu

SEQ ID NO: 28823 - RNA, 32 nt, Human
aaucccccuuccccaauccugucuuuuuaaaa

SEQ ID NO: 28824 - RNA, 32 nt, Human
aauccccgaggcggagguugcacugagccgag

SEQ ID NO: 28825 - RNA, 32 nt, Human
aauccccgcuggccuccgccuccccugggguu

SEQ ID NO: 28826 - RNA, 32 nt, Human
aauccccgggggccaagcuggggagggaugug

SEQ ID NO: 28827 - RNA, 32 nt, Human
aauccccuuauggucucugagcauuaaagaaa

SEQ ID NO: 28828 - RNA, 32 nt, Human
aaucccgccacugcacucuagccugggugaca

SEQ ID NO: 28829 - RNA, 32 nt, Human
aaucccgccucccgccagccauggcccacuug

SEQ ID NO: 28830 - RNA, 32 nt, Human
aaucccggagaaagguagaaccagcuucggcg

SEQ ID NO: 28831 - RNA, 32 nt, Human
aaucccggagcaccccacccccagcgaguccc

SEQ ID NO: 28832 - RNA, 32 nt, Human
aaucccggaggcagaggccaugcugaccgcag

SEQ ID NO: 28833 - RNA, 32 nt, Human
aaucccggcuacucgggaggcugaggcagcag

SEQ ID NO: 28834 - RNA, 32 nt, Human
aaucccggcuacucgggaggcugaggcaggag

SEQ ID NO: 28835 - RNA, 32 nt, Human
aaucccgggaaagaggaacaggagugccagac

SEQ ID NO: 28836 - RNA, 32 nt, Human
aaucccgggcagggcccagugggauugagggg

SEQ ID NO: 28837 - RNA, 32 nt, Human
aaucccgguauuccuaguauguggaauuauua

SEQ ID NO: 28838 - RNA, 32 nt, Human
aaucccguccaacaggcuggaguacaauggcg

SEQ ID NO: 28839 - RNA, 32 nt, Human
aaucccuaauggcccccagaucugccaaggag

SEQ ID NO: 28840 - RNA, 32 nt, Human
aaucccuaugcuaauaucuacagugucuagau

SEQ ID NO: 28841 - RNA, 32 nt, Human
aaucccucacugcugccucaacuuccugggcu

SEQ ID NO: 28842 - RNA, 32 nt, Human
aaucccuccuuucuagcugaacaaaaaugugc

SEQ ID NO: 28843 - RNA, 32 nt, Human
aaucccucuccuuucuggcauccuggccucuc

SEQ ID NO: 28844 - RNA, 21 nt, Human
aaucccucugcacuccaaaac

SEQ ID NO: 28845 - RNA, 32 nt, Human
aaucccugaagaguuggcagugugaguccaac

SEQ ID NO: 28846 - RNA, 32 nt, Human
aaucccugaaucuaaaacuccauucucagaga

SEQ ID NO: 28847 - RNA, 32 nt, Human
aaucccugacaaguacuuuucaucucauagua

SEQ ID NO: 28848 - RNA, 32 nt, Human
aaucccugaggcagagguugcagugagcugag

SEQ ID NO: 28849 - RNA, 32 nt, Human
aaucccugcagcauucaagguuaauccaucua

SEQ ID NO: 28850 - RNA, 32 nt, Human
aaucccugcccagucagcuggggucugguggg

SEQ ID NO: 28851 - RNA, 32 nt, Human
aaucccugcuacucgggaggcugaaacaggag

SEQ ID NO: 28852 - RNA, 32 nt, Human
aaucccugcuacucgggaggcugaggcaagag

SEQ ID NO: 28853 - RNA, 32 nt, Human
aaucccugcuacuugggagacugaggcaggag

SEQ ID NO: 28854 - RNA, 32 nt, Human
aaucccuggaaccugggauuccacuaggugcc

SEQ ID NO: 28855 - RNA, 32 nt, Human
aaucccugggcuuccacaaugugaacucacuc

SEQ ID NO: 28856 - RNA, 32 nt, Human
aaucccugggggagacagaaggggcaggggcc

SEQ ID NO: 28857 - RNA, 32 nt, Human
aaucccuuaccucggugccuuccucuuuuuau

SEQ ID NO: 28858 - RNA, 32 nt, Human
aaucccuuccuuguguccuuaccaaaugauag

SEQ ID NO: 28859 - RNA, 32 nt, Human
aaucccuucuucccugguucccaaaccaaaga

SEQ ID NO: 28860 - RNA, 32 nt, Human
aaucccuugcucuccccuggaguugucccagc

SEQ ID NO: 28861 - RNA, 32 nt, Human
aaucccuuuccuccagagacuuuuggcaaccu

SEQ ID NO: 28862 - RNA, 32 nt, Human
aaucccuuucuggcccucuucuuccaagggcu

SEQ ID NO: 28863 - RNA, 32 nt, Human
aaucccuuugcaccugagagccuacugaagug

SEQ ID NO: 28864 - RNA, 32 nt, Human
aaucccuuuuugcuuuaacuugcccuugcagg

SEQ ID NO: 28865 - RNA, 18 nt, Human
aauccgagaauccuuuca

SEQ ID NO: 28866 - RNA, 32 nt, Human
aauccgagaauguaaaccgcugaacagcuaug

SEQ ID NO: 28867 - RNA, 32 nt, Human
aauccgagcccuaaccgucucuccccagcccu

SEQ ID NO: 28868 - RNA, 32 nt, Human
aauccgagcuacucaggagcugaggcagaaga

SEQ ID NO: 28869 - RNA, 32 nt, Human
aauccgcagcacuucgaucacugugagagaac

SEQ ID NO: 28870 - RNA, 32 nt, Human
aauccgccaagagggggugcgaagggggcaug

SEQ ID NO: 28871 - RNA, 32 nt, Human
aauccgcgguggggguccuaagccagcggggg

SEQ ID NO: 28872 - RNA, 32 nt, Human
aauccgcucccaggccugccaugaacgcgaag

SEQ ID NO: 28873 - RNA, 32 nt, Human
aauccgcuuccgggagggcacugucuagugca

SEQ ID NO: 28874 - RNA, 32 nt, Human
aauccggagcaguaaguggagaagagcucucc

SEQ ID NO: 28875 - RNA, 32 nt, Human
aauccggaguggcaauggaguggcugccaugg

SEQ ID NO: 28876 - RNA, 32 nt, Human
aauccggcccaggauguagagcuggcagugcc

SEQ ID NO: 28877 - RNA, 31 nt, Human
aauccggcuccaggaacuggcauuccaguug

SEQ ID NO: 28878 - RNA, 32 nt, Human
aauccggcugccccugggccagucccaggacc

SEQ ID NO: 28879 - RNA, 32 nt, Human
aauccgggaagcagagguuguagugagccaag

SEQ ID NO: 28880 - RNA, 32 nt, Human
aauccgggacaccugggccgggcuguagauca

SEQ ID NO: 28881 - RNA, 32 nt, Human
aauccgggagaugcauguugcagugagcugag

SEQ ID NO: 28882 - RNA, 32 nt, Human
aauccgggaggcagagauugcagugggccuag

SEQ ID NO: 28883 - RNA, 21 nt, Human
aauccgggaggcagagguugc

SEQ ID NO: 28884 - RNA, 32 nt, Human
aauccgggaggcagagguugcaggagcugaga

SEQ ID NO: 28885 - RNA, 32 nt, Human
aauccgggaggcggagcuugcagcgagccggg

SEQ ID NO: 28886 - RNA, 26 nt, Human
aauccgggaggcggagguugcaguga

SEQ ID NO: 28887 - RNA, 32 nt, Human
aauccgggaggcggagguugcagugaaccgaa

SEQ ID NO: 28888 - RNA, 26 nt, Human
aauccgggaggcggagguugcgguga

SEQ ID NO: 28889 - RNA, 32 nt, Human
aauccgggaggcggagguugcggugagccaag

SEQ ID NO: 28890 - RNA, 32 nt, Human
aauccgggaggcgggucuugcagugagcagag

SEQ ID NO: 28891 - RNA, 32 nt, Human
aauccgggagguggagguugcagugagccaag

SEQ ID NO: 28892 - RNA, 32 nt, Human
aauccgggggacuuccacagugcuguucccga

SEQ ID NO: 28893 - RNA, 32 nt, Human
aauccguccagucucugcucgcgcaccgugac

SEQ ID NO: 28894 - RNA, 32 nt, Human
aauccgugagguggagguuguagugagucaag

SEQ ID NO: 28895 - RNA, 32 nt, Human
aauccuacagcagcaggagcuguggagauaua

SEQ ID NO: 28896 - RNA, 32 nt, Human
aauccuacuaucuccuggccuggaccucagaa

SEQ ID NO: 28897 - RNA, 32 nt, Human
aauccuacucccucagccucaggcaguggugc

SEQ ID NO: 28898 - RNA, 32 nt, Human
aauccuacuuucagcgucauucugccuuuugu

SEQ ID NO: 28899 - RNA, 32 nt, Human
aauccuagcauuuugggugacugaggcgggug

SEQ ID NO: 28900 - RNA, 32 nt, Human
aauccuagccaacauuuucauuuccacccaug

SEQ ID NO: 28901 - RNA, 32 nt, Human
aauccuagcuacucaagaggcugaggcaggag

SEQ ID NO: 28902 - RNA, 32 nt, Human
aauccuagcuacucaggagccugaggcaggag

SEQ ID NO: 28903 - RNA, 32 nt, Human
aauccuagcuacucaggaggcugaggcaagag

SEQ ID NO: 28904 - RNA, 32 nt, Human
aauccuagcuacucaggaggcugaggcaggag

SEQ ID NO: 28905 - RNA, 32 nt, Human
aauccuagcuacucaggaggcuguggcagaga

SEQ ID NO: 28906 - RNA, 32 nt, Human
aauccuagcuacucagguggcggaggugagag

SEQ ID NO: 28907 - RNA, 32 nt, Human
aauccuagcuacucgggagacugacgggagaa

SEQ ID NO: 28908 - RNA, 32 nt, Human
aauccuagcuacucgggaggcugaggcagaag

SEQ ID NO: 28909 - RNA, 32 nt, Human
aauccuagcuacucgggaggcugaggcaggag

SEQ ID NO: 28910 - RNA, 32 nt, Human
aauccuagcuacucgggaggcuguggcaggag

SEQ ID NO: 28911 - RNA, 32 nt, Human
aauccuagcugcucgggaggcuaaggcaggag

SEQ ID NO: 28912 - RNA, 32 nt, Human
aauccuaggaagcaaaacagaccacacuuacu

SEQ ID NO: 28913 - RNA, 32 nt, Human
aauccuaggcugagggaggugggcgcggggcu

SEQ ID NO: 28914 - RNA, 32 nt, Human
aauccuagggaagggugguggagccaguaaac

SEQ ID NO: 28915 - RNA, 32 nt, Human
aauccuagggcagacuaaauucagacgaccca

SEQ ID NO: 28916 - RNA, 32 nt, Human
aauccuaguggccucccagacugcaggguccc

SEQ ID NO: 28917 - RNA, 32 nt, Human
aauccuauguucugaaaguguucucucuuuaa

SEQ ID NO: 28918 - RNA, 32 nt, Human
aauccucaaaccugucacuuuggucagaugug

SEQ ID NO: 28919 - RNA, 32 nt, Human
aauccucaccagaacccaugugcugauucccu

SEQ ID NO: 28920 - RNA, 32 nt, Human
aauccucacguuaacguacacacacaaacaca

SEQ ID NO: 28921 - RNA, 32 nt, Human
aauccucacugcacuccagcagaggcuagagg

SEQ ID NO: 28922 - RNA, 32 nt, Human
aauccucagagcaauucucuguauucucauau

SEQ ID NO: 28923 - RNA, 32 nt, Human
aauccucagcacaacugcuaccaccaggacac

SEQ ID NO: 28924 - RNA, 32 nt, Human
aauccucagucagcaauuuagaacagcaaauc

SEQ ID NO: 28925 - RNA, 32 nt, Human
aauccuccaaugaggcagagguugcagugagc

SEQ ID NO: 28926 - RNA, 32 nt, Human
aauccuccagcaggagcaguggaugaaugucu

SEQ ID NO: 28927 - RNA, 32 nt, Human
aauccuccagggccuguguccucaccuccaac

SEQ ID NO: 28928 - RNA, 32 nt, Human
aauccuccccagcauggucauguucguggugu

SEQ ID NO: 28929 - RNA, 27 nt, Human
aauccucccgccucauccuucugcaua

SEQ ID NO: 28930 - RNA, 31 nt, Human
aauccucccuccagaaggguuucuaaaaaca

SEQ ID NO: 28931 - RNA, 32 nt, Human
aauccuccucaggcaggucccaccugcaggcc

SEQ ID NO: 28932 - RNA, 32 nt, Human
aauccuccuccaccaccaggggccucaaaagg

SEQ ID NO: 28933 - RNA, 32 nt, Human
aauccuccuccuccucuccaggggccuggaaa

SEQ ID NO: 28934 - RNA, 32 nt, Human
aauccuccugccucagcuccugaguagcugga

SEQ ID NO: 28935 - RNA, 32 nt, Human
aauccuccugccucagcuuccugaguagcugg

SEQ ID NO: 28936 - RNA, 32 nt, Human
aauccuccuggcagaugggaagaaugccaccu

SEQ ID NO: 28937 - RNA, 32 nt, Human
aauccucuccuuggcccugccauagggcagag

SEQ ID NO: 28938 - RNA, 32 nt, Human
aauccucucucccuccuacucugcugccagca

SEQ ID NO: 28939 - RNA, 32 nt, Human
aauccucucugccucauccccacccacugccc

SEQ ID NO: 28940 - RNA, 32 nt, Human
aauccucugcauucauguccaugugggaagac

SEQ ID NO: 28941 - RNA, 32 nt, Human
aauccucuggaacauagccaagaccaggagaa

SEQ ID NO: 28942 - RNA, 32 nt, Human
aauccucuggaaggaacuguuugcaguuguau

SEQ ID NO: 28943 - RNA, 32 nt, Human
aauccucugggagcuucuuccguuucuucccc

SEQ ID NO: 28944 - RNA, 32 nt, Human
aauccucugucuccuugcuccaauggaggcag

SEQ ID NO: 28945 - RNA, 32 nt, Human
aauccucuguuaauguggacuggagcauggua

SEQ ID NO: 28946 - RNA, 32 nt, Human
aauccucuugcuaccauguccguggagcucga

SEQ ID NO: 28947 - RNA, 32 nt, Human
aauccugaaaucaaggaucuuuggaacuauuu

SEQ ID NO: 28948 - RNA, 32 nt, Human
aauccugaccaccaccugagcacaggugcccc

SEQ ID NO: 28949 - RNA, 32 nt, Human
aauccugagcaaucuguccuuccuagugacca

SEQ ID NO: 28950 - RNA, 32 nt, Human
aauccugagcgcaggccaggguuguuugguuu

SEQ ID NO: 28951 - RNA, 32 nt, Human
aauccugauaccuuaaaacaccuagcggaggc

SEQ ID NO: 28952 - RNA, 21 nt, Human
aauccugcacuguauuaaaca

SEQ ID NO: 28953 - RNA, 32 nt, Human
aauccugccacaucagcucuggcugcgggguc

SEQ ID NO: 28954 - RNA, 32 nt, Human
aauccugccacccagggaaccccagcaggccg

SEQ ID NO: 28955 - RNA, 32 nt, Human
aauccugccacugcacaccagccugggugaca

SEQ ID NO: 28956 - RNA, 32 nt, Human
aauccugccacuuguuuccacucuucucaaau

SEQ ID NO: 28957 - RNA, 32 nt, Human
aauccugcccugugccucacagaagagguggg

SEQ ID NO: 28958 - RNA, 32 nt, Human
aauccugccgaggcccacugggccaaggcccc

SEQ ID NO: 28959 - RNA, 23 nt, Human
aauccugcuaaagcucaaaaaca

SEQ ID NO: 28960 - RNA, 32 nt, Human
aauccugcuccuccucagguccuggcaguuuc

SEQ ID NO: 28961 - RNA, 32 nt, Human
aauccugcuugaggucaucugccuugcuaaag

SEQ ID NO: 28962 - RNA, 32 nt, Human
aauccugcuugccugguaaauguucucuucuu

SEQ ID NO: 28963 - RNA, 32 nt, Human
aauccuggaagacuuccugcaggagucagcgu

SEQ ID NO: 28964 - RNA, 32 nt, Human
aauccuggacuccaguuuccucuuggggcccu

SEQ ID NO: 28965 - RNA, 26 nt, Human
aauccuggaggcagagguugcaguga

SEQ ID NO: 28966 - RNA, 32 nt, Human
aauccuggaggcagagguugcagugagcugag

SEQ ID NO: 28967 - RNA, 32 nt, Human
aauccuggaggggcagcaggaggcggagcucu

SEQ ID NO: 28968 - RNA, 32 nt, Human
aauccuggagucucacugucugcuggcaaaga

SEQ ID NO: 28969 - RNA, 32 nt, Human
aauccuggagugcagaagaagcauuaggcauu

SEQ ID NO: 28970 - RNA, 32 nt, Human
aauccuggccaacauggugaaaccccgucucu

SEQ ID NO: 28971 - RNA, 32 nt, Human
aauccuggcuacucgggaggcugaggcaggag

SEQ ID NO: 28972 - RNA, 32 nt, Human
aauccugggggacagcagggaggaggcacuuc

SEQ ID NO: 28973 - RNA, 32 nt, Human
aauccugggguuucaccugagccuucuguuug

SEQ ID NO: 28974 - RNA, 32 nt, Human
aauccuggugaccgagaagagagcagagccac

SEQ ID NO: 28975 - RNA, 32 nt, Human
aauccugugugcagaugcagaaugacaagcug

SEQ ID NO: 28976 - RNA, 32 nt, Human
aauccuguguuagaagcagcuguggggguccc

SEQ ID NO: 28977 - RNA, 32 nt, Human
aauccuguucauguuuguuuaaaguuuuuacu

SEQ ID NO: 28978 - RNA, 32 nt, Human
aauccuuaaaggcuuuuuaauagcagacuucc

SEQ ID NO: 28979 - RNA, 32 nt, Human
aauccuuacuucugccagucuguauuuccuau

SEQ ID NO: 28980 - RNA, 32 nt, Human
aauccuuauguaugaaauuaccuacaaugaau

SEQ ID NO: 28981 - RNA, 32 nt, Human
aauccuucacucucauuuccuucaagaauggc

SEQ ID NO: 28982 - RNA, 32 nt, Human
aauccuucagagaccacccuaucgguucuccu

SEQ ID NO: 28983 - RNA, 18 nt, Human
aauccuucaugacuuuca

SEQ ID NO: 28984 - RNA, 32 nt, Human
aauccuucaugucuuaaccuaccuggaagaag

SEQ ID NO: 28985 - RNA, 32 nt, Human
aauccuuccaacauccuuuugaucucaugaag

SEQ ID NO: 28986 - RNA, 23 nt, Human
aauccuuccauuucuucugcaca

SEQ ID NO: 28987 - RNA, 32 nt, Human
aauccuuccccaugccuccaucagccucaaag

SEQ ID NO: 28988 - RNA, 21 nt, Human
aauccuucccucaucccauca

SEQ ID NO: 28989 - RNA, 32 nt, Human
aauccuuccgccucugggccucaggcugccug

SEQ ID NO: 28990 - RNA, 20 nt, Human
aauccuucgaucucgcuuca

SEQ ID NO: 28991 - RNA, 20 nt, Human
aauccuucuaguuccuuuca

SEQ ID NO: 28992 - RNA, 32 nt, Human
aauccuucugggggcacuggaagcacaauacg

SEQ ID NO: 28993 - RNA, 32 nt, Human
aauccuucugucuucauggccugcugugcuga

SEQ ID NO: 28994 - RNA, 32 nt, Human
aauccuugaggccaggagguugaggcugcagu

SEQ ID NO: 28995 - RNA, 32 nt, Human
aauccuugcaggaagcagagaacagggaggca

SEQ ID NO: 28996 - RNA, 32 nt, Human
aauccuugccugcugaacccagccugggccug

SEQ ID NO: 28997 - RNA, 32 nt, Human
aauccuuggcuaacagaagauucuuccagauu

SEQ ID NO: 28998 - RNA, 32 nt, Human
aauccuuuccaguccagcaccuccuggggcag

SEQ ID NO: 28999 - RNA, 32 nt, Human
aauccuuuccaucauuuaugaaggagcuuuau

SEQ ID NO: 29000 - RNA, 32 nt, Human
aauccuuugcagaaugguacucauauaauggu

SEQ ID NO: 29001 - RNA, 32 nt, Human
aauccuuugucagaaaagaagguagcuaccac

SEQ ID NO: 29002 - RNA, 20 nt, Human
aauccuuugucuuccacuca

SEQ ID NO: 29003 - RNA, 32 nt, Human
aauccuuuuauugccaccucaggaccuggcca

SEQ ID NO: 29004 - RNA, 24 nt, Human
aauccuuuuauuuuaauccuuuua

SEQ ID NO: 29005 - RNA, 32 nt, Human
aauccuuuuccagaguagaaaaauccugcucu

SEQ ID NO: 29006 - RNA, 32 nt, Human
aaucgaaggaauuggcccaauggcgaggagag

SEQ ID NO: 29007 - RNA, 32 nt, Human
aaucgaaucucccaggaggcuuccuuccagcc

SEQ ID NO: 29008 - RNA, 32 nt, Human
aaucgacaccuugcaacugugccuucaaagag

SEQ ID NO: 29009 - RNA, 32 nt, Human
aaucgacgacuuucucaagguugaaacuuuga

SEQ ID NO: 29010 - RNA, 32 nt, Human
aaucgagggcuuuggccaaggccaggucucuc

SEQ ID NO: 29011 - RNA, 32 nt, Human
aaucgaguuguuccgggggacugaggucucuu

SEQ ID NO: 29012 - RNA, 32 nt, Human
aaucgaucuacacacauccacgcacaugcgac

SEQ ID NO: 29013 - RNA, 32 nt, Human
aaucgaucuuccugccaagguuuuggaauuac

SEQ ID NO: 29014 - RNA, 32 nt, Human
aaucgauucccaagcucccuuccgggacaagu

SEQ ID NO: 29015 - RNA, 32 nt, Human
aaucgcaccacugcacuccagccugggcgaca

SEQ ID NO: 29016 - RNA, 22 nt, Human
aaucgcaccgccccggcucccc

SEQ ID NO: 29017 - RNA, 32 nt, Human
aaucgcaccgcugcacuccagccuggcaacag

SEQ ID NO: 29018 - RNA, 32 nt, Human
aaucgcagcuacucaggaagcugaggcaggag

SEQ ID NO: 29019 - RNA, 32 nt, Human
aaucgcagcuacucaggaggcugaggcaggag

SEQ ID NO: 29020 - RNA, 32 nt, Human
aaucgcaggucaaaugacuccuuggggaagcu

SEQ ID NO: 29021 - RNA, 32 nt, Human
aaucgcaucccucccugaagguccgucugcuc

SEQ ID NO: 29022 - RNA, 32 nt, Human
aaucgcaugaguagcaagacugcugccaccag

SEQ ID NO: 29023 - RNA, 32 nt, Human
aaucgcaugguucuccuggcaggccugcugug

SEQ ID NO: 29024 - RNA, 32 nt, Human
aaucgcauuugaguccuuauuuggcacagaga

SEQ ID NO: 29025 - RNA, 32 nt, Human
aaucgccccacccguuccuaccuggugccuug

SEQ ID NO: 29026 - RNA, 32 nt, Human
aaucgcccccuucggaaaugucuccacccgug

SEQ ID NO: 29027 - RNA, 32 nt, Human
aaucgcccucaccucuggcuucagguccaugc

SEQ ID NO: 29028 - RNA, 15 nt, Human
aaucgccuccaggaa

SEQ ID NO: 29029 - RNA, 32 nt, Human
aaucgccugcauuggggagaagcuagaugaaa

SEQ ID NO: 29030 - RNA, 32 nt, Human
aaucgccugccugcgcccuuugcagcauuuca

SEQ ID NO: 29031 - RNA, 32 nt, Human
aaucgcgccacugcacuccagccugggugaca

SEQ ID NO: 29032 - RNA, 32 nt, Human
aaucgcguaccacacuccagccugggugacag

SEQ ID NO: 29033 - RNA, 32 nt, Human
aaucgcgucacugcacuccagccugagugaca

SEQ ID NO: 29034 - RNA, 32 nt, Human
aaucgcucaggaaagacacacugcagacucca

SEQ ID NO: 29035 - RNA, 32 nt, Human
aaucgcucgguggacgagagugucugacucag

SEQ ID NO: 29036 - RNA, 31 nt, Human
aaucgcugccucuggcuuucuguuuucuacu

SEQ ID NO: 29037 - RNA, 32 nt, Human
aaucgcuggaaccugggaaguggaagcugcag

SEQ ID NO: 29038 - RNA, 32 nt, Human
aaucgcuuaaacucgggagguagagguugcag

SEQ ID NO: 29039 - RNA, 32 nt, Human
aaucgcuugaacucgggagacuguaggugccg

SEQ ID NO: 29040 - RNA, 32 nt, Human
aaucgcuugaacucgggaggcagagguuguca

SEQ ID NO: 29041 - RNA, 32 nt, Human
aaucgcuugaacucgggaggcagagguuucag

SEQ ID NO: 29042 - RNA, 32 nt, Human
aaucgcuugaacucgggagguggagguggcag

SEQ ID NO: 29043 - RNA, 32 nt, Human
aaucgcuugaacucgggagguggagguugcag

SEQ ID NO: 29044 - RNA, 32 nt, Human
aaucgcuugguggacgagagugucugacucag

SEQ ID NO: 29045 - RNA, 32 nt, Human
aaucggaaaaugaggcuuauccuccagcagaa

SEQ ID NO: 29046 - RNA, 32 nt, Human
aaucggaaaugcagucguccuuccauauccau

SEQ ID NO: 29047 - RNA, 32 nt, Human
aaucggagacuuugcaaccuguucucagcucu

SEQ ID NO: 29048 - RNA, 32 nt, Human
aaucggcauuuggagcagaguuguuuguuuuu

SEQ ID NO: 29049 - RNA, 32 nt, Human
aaucggcgggcagaggagagggaggccgcgga

SEQ ID NO: 29050 - RNA, 32 nt, Human
aaucggcuccaaauccccuagaugucucagca

SEQ ID NO: 29051 - RNA, 32 nt, Human
aaucggcuuggagcgcgggagguggagucggc

SEQ ID NO: 29052 - RNA, 32 nt, Human
aaucgggcggagguggcgcugccccuucagac

SEQ ID NO: 29053 - RNA, 32 nt, Human
aaucgggcuuugcagaacacuccacuguuuuu

SEQ ID NO: 29054 - RNA, 32 nt, Human
aaucggggaggcagagcuugcagucagccgag

SEQ ID NO: 29055 - RNA, 32 nt, Human
aaucgggggaggaucacuccagugcccagguc

SEQ ID NO: 29056 - RNA, 32 nt, Human
aaucgguaaccagcagcuguuccucagguugu

SEQ ID NO: 29057 - RNA, 32 nt, Human
aaucguaacugcacugcuuucuggaccauuuc

SEQ ID NO: 29058 - RNA, 32 nt, Human
aaucguagagugugcaggaggaaagguguuau

SEQ ID NO: 29059 - RNA, 32 nt, Human
aaucguagcugaggcaggagaaucgccugaac

SEQ ID NO: 29060 - RNA, 32 nt, Human
aaucgucacccacauuggagugcagugguacg

SEQ ID NO: 29061 - RNA, 32 nt, Human
aaucgucgaaacagccugccagcagcgccuca

SEQ ID NO: 29062 - RNA, 32 nt, Human
aaucgucuuugauauuucugaagaaccgaauu

SEQ ID NO: 29063 - RNA, 32 nt, Human
aaucgugccacuccacuccagccugggcaaca

SEQ ID NO: 29064 - RNA, 32 nt, Human
aaucgugccacugcaguccagccuaggcaaca

SEQ ID NO: 29065 - RNA, 32 nt, Human
aaucguggggagacaaaaauauaccugugaaa

SEQ ID NO: 29066 - RNA, 21 nt, Human
aaucguugcugaauccuuuca

SEQ ID NO: 29067 - RNA, 32 nt, Human
aaucuaaaaguggcuagauugugguuguuuug

SEQ ID NO: 29068 - RNA, 32 nt, Human
aaucuaaagaucuuuguucuauaacuguaagu

SEQ ID NO: 29069 - RNA, 32 nt, Human
aaucuaaaugauuuuuaaacuuuucucauaga

SEQ ID NO: 29070 - RNA, 32 nt, Human
aaucuaagaagcagagguugcagugagcugag

SEQ ID NO: 29071 - RNA, 32 nt, Human
aaucuaaggguucuuggggaucuggaaaggau

SEQ ID NO: 29072 - RNA, 32 nt, Human
aaucuaaugaggaaauaucagugaagcuggac

SEQ ID NO: 29073 - RNA, 32 nt, Human
aaucuaaugccucugcugaucugccaggagga

SEQ ID NO: 29074 - RNA, 32 nt, Human
aaucuaauuguaaauaugaaacuuuuuaaauc

SEQ ID NO: 29075 - RNA, 32 nt, Human
aaucuacagcauucucucccaccuacguccug

SEQ ID NO: 29076 - RNA, 32 nt, Human
aaucuacagccaagaauaacucuggcuuccgc

SEQ ID NO: 29077 - RNA, 32 nt, Human
aaucuacaggaaacauuaaaagagagacaggc

SEQ ID NO: 29078 - RNA, 32 nt, Human
aaucuacauaaauauaccucagaaaucauuuu

SEQ ID NO: 29079 - RNA, 32 nt, Human
aaucuacaucccucuguuguauacaggaaucu

SEQ ID NO: 29080 - RNA, 32 nt, Human
aaucuacccaauaauugcaacaugguucuuug

SEQ ID NO: 29081 - RNA, 32 nt, Human
aaucuaccuagaucagcguggcugguccccuu

SEQ ID NO: 29082 - RNA, 32 nt, Human
aaucuaccugcuccucuuucuugguaauuagg

SEQ ID NO: 29083 - RNA, 32 nt, Human
aaucuacuaucuaugauccugccugcaacccc

SEQ ID NO: 29084 - RNA, 32 nt, Human
aaucuacucuuaucacagcugugugacgauuu

SEQ ID NO: 29085 - RNA, 32 nt, Human
aaucuacucuuccucuacaucuuacuguucug

SEQ ID NO: 29086 - RNA, 32 nt, Human
aaucuacuggggcucagaccacaugccccauc

SEQ ID NO: 29087 - RNA, 32 nt, Human
aaucuacuuuuagauaaaccagcgcaggccuu

SEQ ID NO: 29088 - RNA, 32 nt, Human
aaucuacuuuucuuaaacuuuguaucucuagg

SEQ ID NO: 29089 - RNA, 32 nt, Human
aaucuagaaaaugcauucauacaauuacagaa

SEQ ID NO: 29090 - RNA, 32 nt, Human
aaucuagaaguuagggguuuuguuggagaaaa

SEQ ID NO: 29091 - RNA, 32 nt, Human
aaucuagaauuagccgggcauggucgcucaug

SEQ ID NO: 29092 - RNA, 32 nt, Human
aaucuagacuguaaaguaaaacaggaagauuc

SEQ ID NO: 29093 - RNA, 32 nt, Human
aaucuagauauuuaacaaaaacugcagauuaa

SEQ ID NO: 29094 - RNA, 32 nt, Human
aaucuagccagagcccuucacugccaugauag

SEQ ID NO: 29095 - RNA, 32 nt, Human
aaucuagcgggagagacaggauaaccuguccg

SEQ ID NO: 29096 - RNA, 32 nt, Human
aaucuagcucacugcaacccugcaaccucugc

SEQ ID NO: 29097 - RNA, 32 nt, Human
aaucuagcuucuccaccucuuguuucacacuc

SEQ ID NO: 29098 - RNA, 32 nt, Human
aaucuaggaggcagagguugcagugaacugag

SEQ ID NO: 29099 - RNA, 32 nt, Human
aaucuagggcuggggaugccuccugcugaccc

SEQ ID NO: 29100 - RNA, 32 nt, Human
aaucuaguacagauuccaggugcugcuacuuc

SEQ ID NO: 29101 - RNA, 32 nt, Human
aaucuagucuuuguaauagaaguuucccagug

SEQ ID NO: 29102 - RNA, 32 nt, Human
aaucuagugccuuuuaaauguaucccacguuu

SEQ ID NO: 29103 - RNA, 32 nt, Human
aaucuaguuggggguuggagggguaaggaaca

SEQ ID NO: 29104 - RNA, 32 nt, Human
aaucuauauucaaucugaggugauguggugac

SEQ ID NO: 29105 - RNA, 32 nt, Human
aaucuauucucagcagggcauagggcacgcac

SEQ ID NO: 29106 - RNA, 32 nt, Human
aaucuauugacagaaauuggugcaguguuaac

SEQ ID NO: 29107 - RNA, 32 nt, Human
aaucuauuguaucuaccugcagucuccauugu

SEQ ID NO: 29108 - RNA, 32 nt, Human
aaucuauuuccagaggaauguuuugcuaugua

SEQ ID NO: 29109 - RNA, 32 nt, Human
aaucucaaaaugucagccacaggccauuucuu

SEQ ID NO: 29110 - RNA, 32 nt, Human
aaucucaaacuaagcaugaaacaacggcugaa

SEQ ID NO: 29111 - RNA, 32 nt, Human
aaucucaaagccuguaucguucuugaagguca

SEQ ID NO: 29112 - RNA, 32 nt, Human
aaucucaaccaaaacccacagcccugcacccc

SEQ ID NO: 29113 - RNA, 32 nt, Human
aaucucaaccuuacagucuuucccuuaguccu

SEQ ID NO: 29114 - RNA, 32 nt, Human
aaucucaacucugucacccagacuggagugca

SEQ ID NO: 29115 - RNA, 32 nt, Human
aaucucaagccacaugaauuguuaacaccucu

SEQ ID NO: 29116 - RNA, 32 nt, Human
aaucucaaguacccagggacacaaacacugcg

SEQ ID NO: 29117 - RNA, 32 nt, Human
aaucucaagucaaggccaggcacggcggcuca

SEQ ID NO: 29118 - RNA, 32 nt, Human
aaucucaauugcuuuguaagugaaaacaugac

SEQ ID NO: 29119 - RNA, 32 nt, Human
aaucucacagcauuuagugcuuccugccuggu

SEQ ID NO: 29120 - RNA, 32 nt, Human
aaucucacagggggaaugcaacugguuccugu

SEQ ID NO: 29121 - RNA, 32 nt, Human
aaucucaccuacaggcaggauucugccagugc

SEQ ID NO: 29122 - RNA, 32 nt, Human
aaucucacuauguugaccaggcuggucuugaa

SEQ ID NO: 29123 - RNA, 32 nt, Human
aaucucacugcaaccuccgccuuccaguugca

SEQ ID NO: 29124 - RNA, 32 nt, Human
aaucucacugcaagcuccacuuccuggguuca

SEQ ID NO: 29125 - RNA, 32 nt, Human
aaucucacugcaagcucugccucccagguuca

SEQ ID NO: 29126 - RNA, 32 nt, Human
aaucucacugccccuccuccaaucucacccuc

SEQ ID NO: 29127 - RNA, 32 nt, Human
aaucucacuucugcccagcugugucacuuugg

SEQ ID NO: 29128 - RNA, 32 nt, Human
aaucucagcacuaugggaggccgaggugggug

SEQ ID NO: 29129 - RNA, 32 nt, Human
aaucucagcacuuugggagacugagaugagaa

SEQ ID NO: 29130 - RNA, 32 nt, Human
aaucucagcuacuagagaggcugaggcaggag

SEQ ID NO: 29131 - RNA, 32 nt, Human
aaucucagcuacuagggacgcugaggcaggag

SEQ ID NO: 29132 - RNA, 32 nt, Human
aaucucagcuacucaagaggcugagguagaag

SEQ ID NO: 29133 - RNA, 32 nt, Human
aaucucagcuacucaggagacugagggagaga

SEQ ID NO: 29134 - RNA, 32 nt, Human
aaucucagcuacucaggaggaugaggcaggag

SEQ ID NO: 29135 - RNA, 32 nt, Human
aaucucagcuacucaggaggcugaggcaagag

SEQ ID NO: 29136 - RNA, 32 nt, Human
aaucucagcuacucaggaggcugaggcacaag

SEQ ID NO: 29137 - RNA, 32 nt, Human
aaucucagcuacucaggaggcugaggcacgag

SEQ ID NO: 29138 - RNA, 32 nt, Human
aaucucagcuacucaggaggcugaggcaggag

SEQ ID NO: 29139 - RNA, 32 nt, Human
aaucucagcuacucaggaggcugagguaguag

SEQ ID NO: 29140 - RNA, 32 nt, Human
aaucucagcuacucaggagguugaggcaggag

SEQ ID NO: 29141 - RNA, 32 nt, Human
aaucucagcuacucgggaggcugaggcaagag

SEQ ID NO: 29142 - RNA, 32 nt, Human
aaucucagcuacucgggaggcugaggcaggaa

SEQ ID NO: 29143 - RNA, 32 nt, Human
aaucucagcuacucgggaggcugaggcaggag

SEQ ID NO: 29144 - RNA, 32 nt, Human
aaucucagcuacuggagaggcugaggcaggag

SEQ ID NO: 29145 - RNA, 32 nt, Human
aaucucagcuacuugaaaggcugaggcaggag

SEQ ID NO: 29146 - RNA, 32 nt, Human
aaucucagcuacuugagaggcugaggcaggag

SEQ ID NO: 29147 - RNA, 32 nt, Human
aaucucagcuacuugggagacugaggcaggag

SEQ ID NO: 29148 - RNA, 32 nt, Human
aaucucagcuacuugggagccuggggcaggag

SEQ ID NO: 29149 - RNA, 32 nt, Human
aaucucagcuacuugggaggcugaagcaggag

SEQ ID NO: 29150 - RNA, 32 nt, Human
aaucucagcuacuugggaggcugacgcaggag

SEQ ID NO: 29151 - RNA, 32 nt, Human
aaucucagcuacuugggaggcugagacaggac

SEQ ID NO: 29152 - RNA, 32 nt, Human
aaucucagcuacuugggaggcugagacaggag

SEQ ID NO: 29153 - RNA, 32 nt, Human
aaucucagcuacuugggaggcugaggcacgag

SEQ ID NO: 29154 - RNA, 32 nt, Human
aaucucagcuacuugggaggcugaggcaggag

SEQ ID NO: 29155 - RNA, 32 nt, Human
aaucucagcuacuugggaggcugggcagaaga

SEQ ID NO: 29156 - RNA, 32 nt, Human
aaucucagcucacagcaaccuccgccucccag

SEQ ID NO: 29157 - RNA, 32 nt, Human
aaucucagcucacugcaaacuccaccucccag

SEQ ID NO: 29158 - RNA, 32 nt, Human
aaucucagcucacugcaaccuccgccucccag

SEQ ID NO: 29159 - RNA, 32 nt, Human
aaucucagcucacugcaaccuccgccuccuga

SEQ ID NO: 29160 - RNA, 32 nt, Human
aaucucagcucacugcaaccuccguuuccugg

SEQ ID NO: 29161 - RNA, 32 nt, Human
aaucucagcucagugcaaccuccgccucccga

SEQ ID NO: 29162 - RNA, 32 nt, Human
aaucucagcuuauauaauggcuccccaugcug

SEQ ID NO: 29163 - RNA, 32 nt, Human
aaucucaggauuggaagagauuuuaaaggcca

SEQ ID NO: 29164 - RNA, 32 nt, Human
aaucucagguauuccaggucacugacaugaau

SEQ ID NO: 29165 - RNA, 32 nt, Human
aaucucagugcuguuuggagcuccauuucuca

SEQ ID NO: 29166 - RNA, 32 nt, Human
aaucucaugacuauguucuucucccaaacaag

SEQ ID NO: 29167 - RNA, 32 nt, Human
aaucucauuggcccaagggagcugcaguggua

SEQ ID NO: 29168 - RNA, 32 nt, Human
aaucucauuuucuucuuucuaguacuacuauu

SEQ ID NO: 29169 - RNA, 32 nt, Human
aaucucauuuucuucuuucuuccauucccuua

SEQ ID NO: 29170 - RNA, 32 nt, Human
aaucuccaaagagaaguagagagagggccaca

SEQ ID NO: 29171 - RNA, 32 nt, Human
aaucuccaaauguuagucacauugguuugucu

SEQ ID NO: 29172 - RNA, 32 nt, Human
aaucuccagaaagugguauuccauaaaccuac

SEQ ID NO: 29173 - RNA, 32 nt, Human
aaucuccagaucucuguaaaugauaccuacau

SEQ ID NO: 29174 - RNA, 32 nt, Human
aaucuccagcgggagccgccaggccuggccug

SEQ ID NO: 29175 - RNA, 32 nt, Human
aaucuccauaggcugggccucccaggcgaucu

SEQ ID NO: 29176 - RNA, 32 nt, Human
aaucuccaucucagagcuagcuucugggaacc

SEQ ID NO: 29177 - RNA, 32 nt, Human
aaucucccacaggcgugaaccugcucugcugu

SEQ ID NO: 29178 - RNA, 19 nt, Human
aaucucccaccuccugccc

SEQ ID NO: 29179 - RNA, 32 nt, Human
aaucucccagccaggccaacauggugaaaccc

SEQ ID NO: 29180 - RNA, 32 nt, Human
aaucuccccaguaccugggauuacagguagac

SEQ ID NO: 29181 - RNA, 32 nt, Human
aaucuccccuggggaggaagcgggaagccagc

SEQ ID NO: 29182 - RNA, 32 nt, Human
aaucucccuccccucuuuuauuuuaauuaugc

SEQ ID NO: 29183 - RNA, 32 nt, Human
aaucucccugacugcaccucaggguugggcuc

SEQ ID NO: 29184 - RNA, 32 nt, Human
aaucucccuuucugcuugcucuucuguuugcg

SEQ ID NO: 29185 - RNA, 32 nt, Human
aaucuccuacccacgugguuuccucauucucu

SEQ ID NO: 29186 - RNA, 32 nt, Human
aaucuccuauugcuugucagccugugugcgug

SEQ ID NO: 29187 - RNA, 32 nt, Human
aaucuccucacaguaucauguugcaggaauuc

SEQ ID NO: 29188 - RNA, 32 nt, Human
aaucuccugcagcuagcucagugucugcccaa

SEQ ID NO: 29189 - RNA, 32 nt, Human
aaucuccugccucagccuucugaguagcuggg

SEQ ID NO: 29190 - RNA, 32 nt, Human
aaucuccugccucuccccaacugucccccucu

SEQ ID NO: 29191 - RNA, 32 nt, Human
aaucuccuggacgcagaggugacagugggagc

SEQ ID NO: 29192 - RNA, 32 nt, Human
aaucuccugugcuuguggaagcaacauaaguu

SEQ ID NO: 29193 - RNA, 32 nt, Human
aaucuccuguuuguugagugcacugacuguga

SEQ ID NO: 29194 - RNA, 32 nt, Human
aaucuccuugcaaucauguggacaccaaucac

SEQ ID NO: 29195 - RNA, 32 nt, Human
aaucucgaucuugccauaacuuuacaggguaa

SEQ ID NO: 29196 - RNA, 32 nt, Human
aaucucgcccaaacaggaaagcaaaccugaaa

SEQ ID NO: 29197 - RNA, 32 nt, Human
aaucucgcucacugcaaccuccaccucccagg

SEQ ID NO: 29198 - RNA, 32 nt, Human
aaucucgcucugcacuccagccuaggugacag

SEQ ID NO: 29199 - RNA, 32 nt, Human
aaucucggaaggcugaggcaggaggaucauuu

SEQ ID NO: 29200 - RNA, 32 nt, Human
aaucucggcacuuugggagacugaggugggag

SEQ ID NO: 29201 - RNA, 32 nt, Human
aaucucggcucacugcaaccuccgccucccag

SEQ ID NO: 29202 - RNA, 32 nt, Human
aaucucggcucacugcaaccuccgccuccuug

SEQ ID NO: 29203 - RNA, 32 nt, Human
aaucucggcucacugcaaccuccgccuugcug

SEQ ID NO: 29204 - RNA, 32 nt, Human
aaucucggcucacugcaaucucugccucccaa

SEQ ID NO: 29205 - RNA, 32 nt, Human
aaucucgggaggcagagguugcagugagccga

SEQ ID NO: 29206 - RNA, 32 nt, Human
aaucucggggaagagaaagauagguuuaauuu

SEQ ID NO: 29207 - RNA, 32 nt, Human
aaucucggucagagcuguggccucccccuugc

SEQ ID NO: 29208 - RNA, 32 nt, Human
aaucucgguggaaacuccuauccuaucauguu

SEQ ID NO: 29209 - RNA, 32 nt, Human
aaucucgguggccgcugcuccagcgcggccug

SEQ ID NO: 29210 - RNA, 32 nt, Human
aaucucguauuugggggcuuggggaagggggc

SEQ ID NO: 29211 - RNA, 32 nt, Human
aaucucguuucuccucuuuccuccugcuucau

SEQ ID NO: 29212 - RNA, 32 nt, Human
aaucucuaaacuuacccagccugguuggugcc

SEQ ID NO: 29213 - RNA, 32 nt, Human
aaucucuacccacuccagccaacucugaggcc

SEQ ID NO: 29214 - RNA, 32 nt, Human
aaucucuacuaaaaauacaaaaauuagccggg

SEQ ID NO: 29215 - RNA, 32 nt, Human
aaucucuauguuucucuccauuuucauuccuc

SEQ ID NO: 29216 - RNA, 32 nt, Human
aaucucucagaggagcucugcaagucucagcu

SEQ ID NO: 29217 - RNA, 32 nt, Human
aaucucucagcuuuuaaauggguagagaaaca

SEQ ID NO: 29218 - RNA, 32 nt, Human
aaucucucccaccaccugaauucuccaaggac

SEQ ID NO: 29219 - RNA, 31 nt, Human
aaucucucccucucugguauguuucuguuuu

SEQ ID NO: 29220 - RNA, 32 nt, Human
aaucucuccgagggagaaagggguucucugcg

SEQ ID NO: 29221 - RNA, 32 nt, Human
aaucucuccgugggggcagguggacuccaggc

SEQ ID NO: 29222 - RNA, 32 nt, Human
aaucucucugucucccugaggcucuauuucug

SEQ ID NO: 29223 - RNA, 32 nt, Human
aaucucucuuguugcuguccuuugccaaacuc

SEQ ID NO: 29224 - RNA, 32 nt, Human
aaucucugagacuccauuuucuccagggaaac

SEQ ID NO: 29225 - RNA, 32 nt, Human
aaucucugcacgggccuuggaaaacgacuguc

SEQ ID NO: 29226 - RNA, 31 nt, Human
aaucucugccucucccaggcugucccccucc

SEQ ID NO: 29227 - RNA, 32 nt, Human
aaucucugcuauuugggagacugaggcaggag

SEQ ID NO: 29228 - RNA, 31 nt, Human
aaucucuggacccuggagcacuucuaaugua

SEQ ID NO: 29229 - RNA, 32 nt, Human
aaucucuggcuguaaugaucacuuuggaagau

SEQ ID NO: 29230 - RNA, 32 nt, Human
aaucucuggggguugggacccagcaagggcac

SEQ ID NO: 29231 - RNA, 32 nt, Human
aaucucuuaauacacagagaacucccaaucuu

SEQ ID NO: 29232 - RNA, 32 nt, Human
aaucucuuccuugucccaccucauuccccacc

SEQ ID NO: 29233 - RNA, 32 nt, Human
aaucucuucucccuccccuucuugugagauuu

SEQ ID NO: 29234 - RNA, 32 nt, Human
aaucucuucucccuucucccuccaucaucgac

SEQ ID NO: 29235 - RNA, 32 nt, Human
aaucucuugaccucauuaucagccugccucgg

SEQ ID NO: 29236 - RNA, 32 nt, Human
aaucucuuguuaugcagggaguacaguucuuu

SEQ ID NO: 29237 - RNA, 32 nt, Human
aaucucuuguucugcagcuugguggcugccac

SEQ ID NO: 29238 - RNA, 32 nt, Human
aaucugaaaauaaguggucucaagagaagcau

SEQ ID NO: 29239 - RNA, 32 nt, Human
aaucugaaacucuuugagccccagugugaugc

SEQ ID NO: 29240 - RNA, 32 nt, Human
aaucugaacaaauuaucauaauggcucucuug

SEQ ID NO: 29241 - RNA, 32 nt, Human
aaucugaagauagaaagggaagaaaaguaaaa

SEQ ID NO: 29242 - RNA, 32 nt, Human
aaucugaaggggaagagggugaccucagcggc

SEQ ID NO: 29243 - RNA, 32 nt, Human
aaucugaaggucauguggcaucagggaaaggg

SEQ ID NO: 29244 - RNA, 32 nt, Human
aaucugacaagcugccuuuucaaguauuguga

SEQ ID NO: 29245 - RNA, 32 nt, Human
aaucugacagcccaggaggugggcucgcugau

SEQ ID NO: 29246 - RNA, 32 nt, Human
aaucugagacccagaguugaagcaaauugccc

SEQ ID NO: 29247 - RNA, 32 nt, Human
aaucugagagauggaggcugcagugagccgag

SEQ ID NO: 29248 - RNA, 32 nt, Human
aaucugagaggagaggaugggguaaggcagaa

SEQ ID NO: 29249 - RNA, 32 nt, Human
aaucugagaggguggguggcagaggggagcag

SEQ ID NO: 29250 - RNA, 32 nt, Human
aaucugagccaaaucaaccucuuccuuuauaa

SEQ ID NO: 29251 - RNA, 32 nt, Human
aaucugagccuccaccacauagacugaaacuc

SEQ ID NO: 29252 - RNA, 32 nt, Human
aaucugaggagaaaggagagccaguccgaguc

SEQ ID NO: 29253 - RNA, 32 nt, Human
aaucugaggaugaugcuucuuccuccaggauu

SEQ ID NO: 29254 - RNA, 32 nt, Human
aaucugaggcccagagagguuggggacuugag

SEQ ID NO: 29255 - RNA, 32 nt, Human
aaucugaggugugaguagagccugggggagag

SEQ ID NO: 29256 - RNA, 32 nt, Human
aaucugaguagagucugacugcaguuuuugcu

SEQ ID NO: 29257 - RNA, 32 nt, Human
aaucugagugcacaguaugucauuucauuccg

SEQ ID NO: 29258 - RNA, 32 nt, Human
aaucugauaguauuuuagcuucuugaauuuug

SEQ ID NO: 29259 - RNA, 32 nt, Human
aaucugaucccacaggccugagaaagucugcu

SEQ ID NO: 29260 - RNA, 23 nt, Human
aaucugauccuucugaagacaga

SEQ ID NO: 29261 - RNA, 32 nt, Human
aaucugcaaauuccuucuaaauuucaugugca

SEQ ID NO: 29262 - RNA, 32 nt, Human
aaucugcaacccuggggaggaccccaacucac

SEQ ID NO: 29263 - RNA, 32 nt, Human
aaucugcaauuauaccuucuguaacaguggca

SEQ ID NO: 29264 - RNA, 32 nt, Human
aaucugcacagcaaagugaaacacacagauaa

SEQ ID NO: 29265 - RNA, 32 nt, Human
aaucugcacauccagucuuggcacuuuuucca

SEQ ID NO: 29266 - RNA, 32 nt, Human
aaucugcacuguccagccuagcaggccgccga

SEQ ID NO: 29267 - RNA, 32 nt, Human
aaucugcacuuauccccaccaccuggggaccc

SEQ ID NO: 29268 - RNA, 32 nt, Human
aaucugcagcaucuaccugcuccacaaucucc

SEQ ID NO: 29269 - RNA, 32 nt, Human
aaucugcagcccccacaugcaucugucuaacg

SEQ ID NO: 29270 - RNA, 32 nt, Human
aaucugcagccuggaagccacagccauggcag

SEQ ID NO: 29271 - RNA, 32 nt, Human
aaucugcagccuuccuggcagugagaaagaca

SEQ ID NO: 29272 - RNA, 32 nt, Human
aaucugcaggagacagagauccccuugcaugg

SEQ ID NO: 29273 - RNA, 32 nt, Human
aaucugcaguuuacugagggcauuucaguucc

SEQ ID NO: 29274 - RNA, 32 nt, Human
aaucugcaucuucucuuauuucugaccuuuuu

SEQ ID NO: 29275 - RNA, 32 nt, Human
aaucugcauucugcagagauuugucuccuccc

SEQ ID NO: 29276 - RNA, 32 nt, Human
aaucugcauucuggccauaauggucuucucug

SEQ ID NO: 29277 - RNA, 32 nt, Human
aaucugcauugcaaugagacccccagggauuu

SEQ ID NO: 29278 - RNA, 32 nt, Human
aaucugccacuugauccgugaauuaccuauag

SEQ ID NO: 29279 - RNA, 32 nt, Human
aaucugcccagccucagacucccaaggugcug

SEQ ID NO: 29280 - RNA, 32 nt, Human
aaucugccccugggagacgagugaaggagccc

SEQ ID NO: 29281 - RNA, 32 nt, Human
aaucugcccuuaggaguccaggcugcacccug

SEQ ID NO: 29282 - RNA, 32 nt, Human
aaucugcgguccugagacuggggucuugacca

SEQ ID NO: 29283 - RNA, 32 nt, Human
aaucugcgugugucugugaccgccugucauca

SEQ ID NO: 29284 - RNA, 32 nt, Human
aaucugcuagugugaaacuugcucuacucucu

SEQ ID NO: 29285 - RNA, 32 nt, Human
aaucugcuccaaugcucuuguucuaaucucua

SEQ ID NO: 29286 - RNA, 32 nt, Human
aaucugcucgcaucgaagcauucuucuaagcg

SEQ ID NO: 29287 - RNA, 32 nt, Human
aaucugcucugacuuguugccauucuaacaau

SEQ ID NO: 29288 - RNA, 32 nt, Human
aaucugcucuuagacacggccuugccaggaga

SEQ ID NO: 29289 - RNA, 32 nt, Human
aaucugcugcagccauucucucugccuuggcc

SEQ ID NO: 29290 - RNA, 32 nt, Human
aaucugcuugaauauuuuuauauuucaccucc

SEQ ID NO: 29291 - RNA, 32 nt, Human
aaucugcuugcacuagcugugccuucauuagu

SEQ ID NO: 29292 - RNA, 24 nt, Human
aaucugcuugccuuuccugaaagu

SEQ ID NO: 29293 - RNA, 31 nt, Human
aaucuggaacaaugucccuccucuuagaaug

SEQ ID NO: 29294 - RNA, 32 nt, Human
aaucuggaagcagcuaagagaaacuuuuguuu

SEQ ID NO: 29295 - RNA, 32 nt, Human
aaucuggaaggcagagguugcagugagauugc

SEQ ID NO: 29296 - RNA, 32 nt, Human
aaucuggagaaaagccaagaccuggagcgagc

SEQ ID NO: 29297 - RNA, 32 nt, Human
aaucuggcagggagcugccccacccacaggga

SEQ ID NO: 29298 - RNA, 32 nt, Human
aaucuggcauacugaauaaguaacauuaacuu

SEQ ID NO: 29299 - RNA, 32 nt, Human
aaucuggcccaggucuccucagccucugcccc

SEQ ID NO: 29300 - RNA, 32 nt, Human
aaucuggccucaucuuguauuccaacccgaca

SEQ ID NO: 29301 - RNA, 32 nt, Human
aaucuggcucacugcagccuccgccucccggg

SEQ ID NO: 29302 - RNA, 32 nt, Human
aaucuggcucacugcauccucaacuuccuggg

SEQ ID NO: 29303 - RNA, 32 nt, Human
aaucuggcuuugccucccuuucucagacuaga

SEQ ID NO: 29304 - RNA, 32 nt, Human
aaucugggaagcggagguugcagugagcugag

SEQ ID NO: 29305 - RNA, 32 nt, Human
aaucugggagagaaggugacacagcugggccc

SEQ ID NO: 29306 - RNA, 32 nt, Human
aaucugggaggcagagguugcagugagccgag

SEQ ID NO: 29307 - RNA, 32 nt, Human
aaucugggaggcagagguugcagugagcugag

SEQ ID NO: 29308 - RNA, 32 nt, Human
aaucugggaggcagagguugcugugagccgag

SEQ ID NO: 29309 - RNA, 32 nt, Human
aaucugggaggcggagauugcagugagccgag

SEQ ID NO: 29310 - RNA, 32 nt, Human
aaucugggaggcggagguugcagugagccagg

SEQ ID NO: 29311 - RNA, 32 nt, Human
aaucugggagguggaaguugcagugagccgag

SEQ ID NO: 29312 - RNA, 32 nt, Human
aaucugggagguggagguugcagugagccaag

SEQ ID NO: 29313 - RNA, 32 nt, Human
aaucugggcacuguuaccacugggcagaauga

SEQ ID NO: 29314 - RNA, 32 nt, Human
aaucugggccaaagaauggaagacggugguuu

SEQ ID NO: 29315 - RNA, 32 nt, Human
aaucuggggaggcaggaauacaaggacagugg

SEQ ID NO: 29316 - RNA, 32 nt, Human
aaucuggggcacugagacugagaaauccaguc

SEQ ID NO: 29317 - RNA, 32 nt, Human
aaucugggggcugggugaggccacucaugccu

SEQ ID NO: 29318 - RNA, 32 nt, Human
aaucuggggguuccuagacggagccagacuuc

SEQ ID NO: 29319 - RNA, 32 nt, Human
aaucuggguucaaccagccccugccauuucuu

SEQ ID NO: 29320 - RNA, 32 nt, Human
aaucugguaacaggauuugcugugcuguuuuc

SEQ ID NO: 29321 - RNA, 32 nt, Human
aaucuggucccuuuggggaauguggcagucag

SEQ ID NO: 29322 - RNA, 32 nt, Human
aaucugguuggucauuuccaccaggaaucaga

SEQ ID NO: 29323 - RNA, 22 nt, Human
aaucugguuucuggauuuuugu

SEQ ID NO: 29324 - RNA, 32 nt, Human
aaucugguuuugcccagugugacaucaaacuc

SEQ ID NO: 29325 - RNA, 32 nt, Human
aaucuguaagagaauuuagucugaggagcaug

SEQ ID NO: 29326 - RNA, 31 nt, Human
aaucuguacaugucucccaucagaaagauuc

SEQ ID NO: 29327 - RNA, 32 nt, Human
aaucuguacugagguagaucauuugaaagggc

SEQ ID NO: 29328 - RNA, 32 nt, Human
aaucuguaugaauaauguaaacuucgauuuuu

SEQ ID NO: 29329 - RNA, 32 nt, Human
aaucuguaugguaaagcucucagcucgaauuc

SEQ ID NO: 29330 - RNA, 32 nt, Human
aaucugucacccaggcuggagcgcaguggugu

SEQ ID NO: 29331 - RNA, 32 nt, Human
aaucugucacccaggcuggagugcaguggcau

SEQ ID NO: 29332 - RNA, 32 nt, Human
aaucugucccugagagugucucugauaaaagg

SEQ ID NO: 29333 - RNA, 32 nt, Human
aaucuguccuguggaggaggugguggugguau

SEQ ID NO: 29334 - RNA, 32 nt, Human
aaucugucugacugggcuacaauccauuguuc

SEQ ID NO: 29335 - RNA, 32 nt, Human
aaucugucuuucuagcauguugcccuuuuuca

SEQ ID NO: 29336 - RNA, 32 nt, Human
aaucugucuuuguugcucugggagaggggacu

SEQ ID NO: 29337 - RNA, 32 nt, Human
aaucugugacacacaagaugugccugugcacu

SEQ ID NO: 29338 - RNA, 32 nt, Human
aaucugugaugcugaagcagagugugucacaa

SEQ ID NO: 29339 - RNA, 32 nt, Human
aaucugugcaacaacauagacugaccucagua

SEQ ID NO: 29340 - RNA, 32 nt, Human
aaucuguggggugcucugauugugggcacuau

SEQ ID NO: 29341 - RNA, 32 nt, Human
aaucugugucaguuguacauucacaggaucca

SEQ ID NO: 29342 - RNA, 32 nt, Human
aaucuguguguaucguauagcucuagcuguuu

SEQ ID NO: 29343 - RNA, 32 nt, Human
aaucuguguuaacugcauaggaggcucucgau

SEQ ID NO: 29344 - RNA, 32 nt, Human
aaucuguguuauuuucuucuaauauaacacau

SEQ ID NO: 29345 - RNA, 32 nt, Human
aaucuguuacccaggcuggagugcaguggugc

SEQ ID NO: 29346 - RNA, 32 nt, Human
aaucuguuaugguguauuagggggaggagccu

SEQ ID NO: 29347 - RNA, 32 nt, Human
aaucuguuccaaaagcagcucaggauuugaug

SEQ ID NO: 29348 - RNA, 32 nt, Human
aaucuguucgcucgcaacccuaccuaccucuc

SEQ ID NO: 29349 - RNA, 32 nt, Human
aaucuguucugggcccugauuuugccacaccu

SEQ ID NO: 29350 - RNA, 32 nt, Human
aaucuuaaaagugccuaugagacuuuuaggca

SEQ ID NO: 29351 - RNA, 32 nt, Human
aaucuuaaaauugcugaauuuacccucauauu

SEQ ID NO: 29352 - RNA, 32 nt, Human
aaucuuaaugucuaccaacugacgaacaggua

SEQ ID NO: 29353 - RNA, 32 nt, Human
aaucuuacaaguaugaauaugugccaaagccu

SEQ ID NO: 29354 - RNA, 32 nt, Human
aaucuuacagaagguccugugugacccucucu

SEQ ID NO: 29355 - RNA, 32 nt, Human
aaucuuacugggauuacagaacaaagagccuc

SEQ ID NO: 29356 - RNA, 32 nt, Human
aaucuuagcuaaaucauuguuuuuccuucugg

SEQ ID NO: 29357 - RNA, 32 nt, Human
aaucuuaucacauuaaauucacugugaaggca

SEQ ID NO: 29358 - RNA, 32 nt, Human
aaucuuauccacuccacaccuucuacagucaa

SEQ ID NO: 29359 - RNA, 32 nt, Human
aaucuucaacagacauucauuccuuuguucag

SEQ ID NO: 29360 - RNA, 32 nt, Human
aaucuucaacagcaccagaggcagcacauuac

SEQ ID NO: 29361 - RNA, 32 nt, Human
aaucuucacuugguuucagccauaguucaccu

SEQ ID NO: 29362 - RNA, 32 nt, Human
aaucuucagcuugaauuuggaggcagauucuu

SEQ ID NO: 29363 - RNA, 32 nt, Human
aaucuucagggcacugcugcugccuuuagucg

SEQ ID NO: 29364 - RNA, 32 nt, Human
aaucuucagguaaagaagcagcuuugaaucug

SEQ ID NO: 29365 - RNA, 32 nt, Human
aaucuucaguuauccccaaaugcagcuucuau

SEQ ID NO: 29366 - RNA, 31 nt, Human
aaucuuccacucaaggaaucuugugaggugu

SEQ ID NO: 29367 - RNA, 32 nt, Human
aaucuuccagcagcaauugaagaugugucugg

SEQ ID NO: 29368 - RNA, 32 nt, Human
aaucuucccagauagggaaacugaggcagaga

SEQ ID NO: 29369 - RNA, 32 nt, Human
aaucuucccuacacccuucucugccuuuauuu

SEQ ID NO: 29370 - RNA, 22 nt, Human
aaucuuccucaguuccacuucu

SEQ ID NO: 29371 - RNA, 23 nt, Human
aaucuuccugccucaaccuccca

SEQ ID NO: 29372 - RNA, 32 nt, Human
aaucuuccuuuucuauuuaugaagauucuacu

SEQ ID NO: 29373 - RNA, 32 nt, Human
aaucuucugccuggcugaccucugagcccaug

SEQ ID NO: 29374 - RNA, 32 nt, Human
aaucuucuggguaguccccuguugauuaucuu

SEQ ID NO: 29375 - RNA, 32 nt, Human
aaucuucugguccuccuguugcauugcugaau

SEQ ID NO: 29376 - RNA, 32 nt, Human
aaucuucuuccccucaacucauucucaauuuc

SEQ ID NO: 29377 - RNA, 32 nt, Human
aaucuucuucuuuuucuuggcuguggugcaug

SEQ ID NO: 29378 - RNA, 32 nt, Human
aaucuucuuuuaggagcuuguaccacagucuu

SEQ ID NO: 29379 - RNA, 32 nt, Human
aaucuugaacaaggaguccagagcaggucaag

SEQ ID NO: 29380 - RNA, 32 nt, Human
aaucuugaccacaacauggagacaggaaauca

SEQ ID NO: 29381 - RNA, 32 nt, Human
aaucuugaccaucacuaucacugccuucuuua

SEQ ID NO: 29382 - RNA, 32 nt, Human
aaucuugagcacuuaguccugcugguuuuagu

SEQ ID NO: 29383 - RNA, 32 nt, Human
aaucuugaggcugagggcgggugguacagaug

SEQ ID NO: 29384 - RNA, 32 nt, Human
aaucuugauggaaauccuuccuuuccugcucu

SEQ ID NO: 29385 - RNA, 32 nt, Human
aaucuugcaaacuggccauggauggggaagug

SEQ ID NO: 29386 - RNA, 32 nt, Human
aaucuugcaacacuauccuguuucucagaaca

SEQ ID NO: 29387 - RNA, 32 nt, Human
aaucuugcaaggcaucagcuggcuccacucau

SEQ ID NO: 29388 - RNA, 32 nt, Human
aaucuugcuguuauuuuccauggacuaaaggu

SEQ ID NO: 29389 - RNA, 32 nt, Human
aaucuuggauucaugcaggaccuggcagauuu

SEQ ID NO: 29390 - RNA, 32 nt, Human
aaucuuggccacugcaagcuccaccucccagg

SEQ ID NO: 29391 - RNA, 32 nt, Human
aaucuuggcucacugcaaccuccgucuuccgg

SEQ ID NO: 29392 - RNA, 32 nt, Human
aaucuugguaugaacaguugacuucauggugg

SEQ ID NO: 29393 - RNA, 32 nt, Human
aaucuuguaacgguucuaacagcugggugcgg

SEQ ID NO: 29394 - RNA, 32 nt, Human
aaucuugucuuguuaaacccuaaagagagugu

SEQ ID NO: 29395 - RNA, 32 nt, Human
aaucuugugccuggagaaccagagaggacccu

SEQ ID NO: 29396 - RNA, 32 nt, Human
aaucuuguuaaaugccauuaggcaccaacuua

SEQ ID NO: 29397 - RNA, 32 nt, Human
aaucuuguucucuugugucccagcuuuuagac

SEQ ID NO: 29398 - RNA, 32 nt, Human
aaucuuguuucaggagagaucucuauagugac

SEQ ID NO: 29399 - RNA, 32 nt, Human
aaucuuuaauucugaccugccauaaauaccca

SEQ ID NO: 29400 - RNA, 32 nt, Human
aaucuuuagaauauuuucaucaucucaaaaag

SEQ ID NO: 29401 - RNA, 19 nt, Human
aaucuuucacauccucuca

SEQ ID NO: 29402 - RNA, 32 nt, Human
aaucuuucacugcagccucaaacuccuggagu

SEQ ID NO: 29403 - RNA, 32 nt, Human
aaucuuucagggaucacgucaauggccuacaa

SEQ ID NO: 29404 - RNA, 32 nt, Human
aaucuuuccacuaaccaaccuaaugccgcugc

SEQ ID NO: 29405 - RNA, 32 nt, Human
aaucuuuccuccaggcuuccugagagcccugg

SEQ ID NO: 29406 - RNA, 22 nt, Human
aaucuuucuauauuuuuuaaau

SEQ ID NO: 29407 - RNA, 32 nt, Human
aaucuuucucucugacuuguuuacaucauuuc

SEQ ID NO: 29408 - RNA, 20 nt, Human
aaucuuucugcaggaaauca

SEQ ID NO: 29409 - RNA, 20 nt, Human
aaucuuucuguaucuuaaaa

SEQ ID NO: 29410 - RNA, 32 nt, Human
aaucuuucuguaucuuaaaacccaucaauaaa

SEQ ID NO: 29411 - RNA, 23 nt, Human
aaucuuucugucauuuaaagcca

SEQ ID NO: 29412 - RNA, 24 nt, Human
aaucuuucuuacacauuaaaauca

SEQ ID NO: 29413 - RNA, 32 nt, Human
aaucuuucuuuucuaaaauugaugcuaugaaa

SEQ ID NO: 29414 - RNA, 32 nt, Human
aaucuuugaccuucauuuaaauugcugacacu

SEQ ID NO: 29415 - RNA, 32 nt, Human
aaucuuugccaaaucuuccuugcuagccagaa

SEQ ID NO: 29416 - RNA, 32 nt, Human
aaucuuugcuguucugcagccucugcugguga

SEQ ID NO: 29417 - RNA, 32 nt, Human
aaucuuuggacucaggacagggccaggugcag

SEQ ID NO: 29418 - RNA, 32 nt, Human
aaucuuuggagacuucuuccagaugcuaguaa

SEQ ID NO: 29419 - RNA, 32 nt, Human
aaucuuuggcugcugcagcuagccgcuucuug

SEQ ID NO: 29420 - RNA, 32 nt, Human
aaucuuugguaaaggaacuagagaugcaugca

SEQ ID NO: 29421 - RNA, 32 nt, Human
aaucuuugugaauaaugugaggccaguucuuc

SEQ ID NO: 29422 - RNA, 32 nt, Human
aaucuuuuaagauacugacaccaaaugccuuu

SEQ ID NO: 29423 - RNA, 28 nt, Human
aaucuuuuaagugcugaacuuauuuuuc

SEQ ID NO: 29424 - RNA, 32 nt, Human
aaucuuuuacuguggagguggcuggucacgac

SEQ ID NO: 29425 - RNA, 32 nt, Human
aaucuuuuccuuaaaauuaauagauaacaaac

SEQ ID NO: 29426 - RNA, 32 nt, Human
aaucuuuucuaugccucuauuccagcaaaaag

SEQ ID NO: 29427 - RNA, 32 nt, Human
aaucuuuucucuugcuaccaagcuauugucac

SEQ ID NO: 29428 - RNA, 32 nt, Human
aaucuuuucuguuccuagaaaaucugaaguac

SEQ ID NO: 29429 - RNA, 32 nt, Human
aaucuuuugaguuguugaguauauuugagauu

SEQ ID NO: 29430 - RNA, 32 nt, Human
aaucuuuugccucucccagccaccuccuccca

SEQ ID NO: 29431 - RNA, 32 nt, Human
aaucuuuuguauuugcucacaguguuugagca

SEQ ID NO: 29432 - RNA, 32 nt, Human
aaucuuuuuguguauacacauauguacaugaa

SEQ ID NO: 29433 - RNA, 32 nt, Human
aaugaaaacauuucaaccaucuaagucaaaca

SEQ ID NO: 29434 - RNA, 32 nt, Human
aaugaaaacgggcugaaaauaccaccccagga

SEQ ID NO: 29435 - RNA, 32 nt, Human
aaugaaaagccuuguacaagaggcuucgugcc

SEQ ID NO: 29436 - RNA, 32 nt, Human
aaugaaaagcugcaugcaucuacagcaggcau

SEQ ID NO: 29437 - RNA, 31 nt, Human
aaugaaaauacuucuugcacuuaaacacugc

SEQ ID NO: 29438 - RNA, 32 nt, Human
aaugaaaauggagugaguguugccuggguauc

SEQ ID NO: 29439 - RNA, 32 nt, Human
aaugaaacacaaauggauuuguauguaacauu

SEQ ID NO: 29440 - RNA, 32 nt, Human
aaugaaacaggaggcugugcuuccauggagcu

SEQ ID NO: 29441 - RNA, 32 nt, Human
aaugaaacaugcugguagacuccacgagggca

SEQ ID NO: 29442 - RNA, 32 nt, Human
aaugaaacccagcauaggagcuggccaagagc

SEQ ID NO: 29443 - RNA, 32 nt, Human
aaugaaaccccucuuuuucuugaccaaaagag

SEQ ID NO: 29444 - RNA, 32 nt, Human
aaugaaaccugcagcaguucaggaugacuaau

SEQ ID NO: 29445 - RNA, 32 nt, Human
aaugaaaccuuuuucucugaagaaucuaggga

SEQ ID NO: 29446 - RNA, 32 nt, Human
aaugaaacuuggauuugcucagugucuggcug

SEQ ID NO: 29447 - RNA, 32 nt, Human
aaugaaacuuugccacaaccagccuuugcugu

SEQ ID NO: 29448 - RNA, 32 nt, Human
aaugaaagaaagggaaaaggcaguggugugua

SEQ ID NO: 29449 - RNA, 32 nt, Human
aaugaaagaaugacauuuaugcuuugaaagcu

SEQ ID NO: 29450 - RNA, 32 nt, Human
aaugaaagacugcuguuuaaagccacugcauu

SEQ ID NO: 29451 - RNA, 32 nt, Human
aaugaaagaggagaagaaacgcaacuaccugc

SEQ ID NO: 29452 - RNA, 32 nt, Human
aaugaaagauuaaacagaugaugagaauuucu

SEQ ID NO: 29453 - RNA, 32 nt, Human
aaugaaagcauauaagguuuucuugaaguugu

SEQ ID NO: 29454 - RNA, 32 nt, Human
aaugaaagccuaaaccucuuccuuuagcuuug

SEQ ID NO: 29455 - RNA, 32 nt, Human
aaugaaagccucucuucaggcugaaccacaaa

SEQ ID NO: 29456 - RNA, 32 nt, Human
aaugaaagcucaggaucucugaauugggcuau

SEQ ID NO: 29457 - RNA, 32 nt, Human
aaugaaaggcaucacaggaggccucugcauga

SEQ ID NO: 29458 - RNA, 32 nt, Human
aaugaaaggcuucucagcaugauaccccaacu

SEQ ID NO: 29459 - RNA, 32 nt, Human
aaugaaagucuuguaaguuuggccaacaaggu

SEQ ID NO: 29460 - RNA, 29 nt, Human
aaugaaauacaaaugcuauagaaaaauuu

SEQ ID NO: 29461 - RNA, 32 nt, Human
aaugaaaucacacuuggauauauuguuaaacc

SEQ ID NO: 29462 - RNA, 32 nt, Human
aaugaaaucauccucagaggaugaagccacca

SEQ ID NO: 29463 - RNA, 32 nt, Human
aaugaaauccaccccugccugcuagauacuug

SEQ ID NO: 29464 - RNA, 32 nt, Human
aaugaaauccucaagccaucaggauuugcuau

SEQ ID NO: 29465 - RNA, 32 nt, Human
aaugaaaugcagaagaguucauuuuucuaaga

SEQ ID NO: 29466 - RNA, 32 nt, Human
aaugaaaugccugaguuaaugugaacuuuggg

SEQ ID NO: 29467 - RNA, 32 nt, Human
aaugaaauggagugagcccaggagagcucagc

SEQ ID NO: 29468 - RNA, 32 nt, Human
aaugaaauuaaaaggcaaaagaacaugauuga

SEQ ID NO: 29469 - RNA, 32 nt, Human
aaugaaauugaucuuuugacugugccaccuuu

SEQ ID NO: 29470 - RNA, 32 nt, Human
aaugaaauuguggcacaaaaucuguucagguu

SEQ ID NO: 29471 - RNA, 32 nt, Human
aaugaacaauccucaugaugucaugggcccug

SEQ ID NO: 29472 - RNA, 23 nt, Human
aaugaacagcacaguaugggaga

SEQ ID NO: 29473 - RNA, 32 nt, Human
aaugaacagcagauugcuucccuguuggugau

SEQ ID NO: 29474 - RNA, 32 nt, Human
aaugaacaugaggaugggaucaaugugggaug

SEQ ID NO: 29475 - RNA, 32 nt, Human
aaugaacauuuucuccagccucugagacuauc

SEQ ID NO: 29476 - RNA, 32 nt, Human
aaugaaccuaugcacauuuuuauguacacaua

SEQ ID NO: 29477 - RNA, 32 nt, Human
aaugaacgaggcggccgugugguacggggucu

SEQ ID NO: 29478 - RNA, 32 nt, Human
aaugaacguuuauuauauuuugcaguuccaug

SEQ ID NO: 29479 - RNA, 32 nt, Human
aaugaacuagaaggaaugcaauuuucuguaga

SEQ ID NO: 29480 - RNA, 32 nt, Human
aaugaacuuaaaucuggacuguuccaggcaaa

SEQ ID NO: 29481 - RNA, 32 nt, Human
aaugaacuuauguacagaaaacauguauaaau

SEQ ID NO: 29482 - RNA, 32 nt, Human
aaugaacuuggcuucuuuuauuuaaacccaga

SEQ ID NO: 29483 - RNA, 31 nt, Human
aaugaacuuguguccaucccagagaucacug

SEQ ID NO: 29484 - RNA, 32 nt, Human
aaugaacuuuggagcuuguaugugagucagau

SEQ ID NO: 29485 - RNA, 32 nt, Human
aaugaagaaaggaaccuugucuuucagggcau

SEQ ID NO: 29486 - RNA, 32 nt, Human
aaugaagaaauaauauauaaacuccuuaugug

SEQ ID NO: 29487 - RNA, 32 nt, Human
aaugaagaaugagagacccauuaacagaaggc

SEQ ID NO: 29488 - RNA, 32 nt, Human
aaugaagacaaugauauugacacugucccucu

SEQ ID NO: 29489 - RNA, 32 nt, Human
aaugaagacacacguucacacccaguccauca

SEQ ID NO: 29490 - RNA, 32 nt, Human
aaugaagacagaaacauauacucacaauagau

SEQ ID NO: 29491 - RNA, 32 nt, Human
aaugaagagaauucccuuccagaagcuacgaa

SEQ ID NO: 29492 - RNA, 32 nt, Human
aaugaagagacuggcagcaccuccuggaacac

SEQ ID NO: 29493 - RNA, 32 nt, Human
aaugaagagugaaagauaaaguagucaauggc

SEQ ID NO: 29494 - RNA, 32 nt, Human
aaugaagaucuacaucgauaagaaauaugaga

SEQ ID NO: 29495 - RNA, 32 nt, Human
aaugaagaugacgcacucggaagcuugugggc

SEQ ID NO: 29496 - RNA, 32 nt, Human
aaugaagauuagcacugagauccagagaggcu

SEQ ID NO: 29497 - RNA, 32 nt, Human
aaugaagcagagccaggaaaaacagacuacau

SEQ ID NO: 29498 - RNA, 32 nt, Human
aaugaagcauucaaaaugagcaaugcuaaugg

SEQ ID NO: 29499 - RNA, 32 nt, Human
aaugaagcgaccucucgaagcaacuguagacc

SEQ ID NO: 29500 - RNA, 32 nt, Human
aaugaagcucacuaaaugaaguucucauuucu

SEQ ID NO: 29501 - RNA, 32 nt, Human
aaugaagcuggcacaacuaaggaacugaaguu

SEQ ID NO: 29502 - RNA, 32 nt, Human
aaugaaggaaaaaucauauacaggcacugaca

SEQ ID NO: 29503 - RNA, 32 nt, Human
aaugaaggaaacucuaaacuccccuuaugguc

SEQ ID NO: 29504 - RNA, 32 nt, Human
aaugaaggacuccacugugccccacuuucugc

SEQ ID NO: 29505 - RNA, 26 nt, Human
aaugaaggagagaagagccagccaga

SEQ ID NO: 29506 - RNA, 32 nt, Human
aaugaaggcagagagauugaguaacuugcaua

SEQ ID NO: 29507 - RNA, 32 nt, Human
aaugaaggcccagguuccagucaucacaggau

SEQ ID NO: 29508 - RNA, 32 nt, Human
aaugaaggcugcaggcacugguugcagacguc

SEQ ID NO: 29509 - RNA, 31 nt, Human
aaugaagggguggaaguggauguggaggagu

SEQ ID NO: 29510 - RNA, 32 nt, Human
aaugaagguagaaaacugaaaagggaguaaau

SEQ ID NO: 29511 - RNA, 32 nt, Human
aaugaaguaucuguccuuuggcccagccccug

SEQ ID NO: 29512 - RNA, 32 nt, Human
aaugaagugaugaaagcuuagagccaguauuu

SEQ ID NO: 29513 - RNA, 32 nt, Human
aaugaaguuaggugggguggggugggguuuau

SEQ ID NO: 29514 - RNA, 32 nt, Human
aaugaaguucugacacacacugcaauguguau

SEQ ID NO: 29515 - RNA, 32 nt, Human
aaugaaguugggggaugugggggaagagcuua

SEQ ID NO: 29516 - RNA, 32 nt, Human
aaugaauaaagggcacgaaggccaggccaggg

SEQ ID NO: 29517 - RNA, 32 nt, Human
aaugaauaaagugcaaacagaagugcauccug

SEQ ID NO: 29518 - RNA, 32 nt, Human
aaugaauacaguugcagaaacucucacucuuu

SEQ ID NO: 29519 - RNA, 32 nt, Human
aaugaauacucuggaugugguggcuggcuccu

SEQ ID NO: 29520 - RNA, 32 nt, Human
aaugaauagagccucagagagcuguggcacac

SEQ ID NO: 29521 - RNA, 32 nt, Human
aaugaauaggcgguacugguugugcacagugg

SEQ ID NO: 29522 - RNA, 21 nt, Human
aaugaaucaucuguucaugca

SEQ ID NO: 29523 - RNA, 32 nt, Human
aaugaaucauuucuuauaucuuauucaugaaa

SEQ ID NO: 29524 - RNA, 32 nt, Human
aaugaauccaaaguauccuagcucuuugucaa

SEQ ID NO: 29525 - RNA, 32 nt, Human
aaugaauccacagcucuacuccagguucuagc

SEQ ID NO: 29526 - RNA, 32 nt, Human
aaugaauccacucaaauguuggcaaguggagc

SEQ ID NO: 29527 - RNA, 32 nt, Human
aaugaaucccuuaccaacucagugccagcauc

SEQ ID NO: 29528 - RNA, 32 nt, Human
aaugaaucuccaaaguaucuucaaagaauaaa

SEQ ID NO: 29529 - RNA, 32 nt, Human
aaugaaucugcccaugccuaugacauuagccg

SEQ ID NO: 29530 - RNA, 32 nt, Human
aaugaaugaauggauggauguuuugcaugcuc

SEQ ID NO: 29531 - RNA, 32 nt, Human
aaugaaugaauggcuuggagugcacugagaac

SEQ ID NO: 29532 - RNA, 32 nt, Human
aaugaaugccuguagucccagcuacuccggac

SEQ ID NO: 29533 - RNA, 32 nt, Human
aaugaaugcuacaaaguguauguucaagaaaa

SEQ ID NO: 29534 - RNA, 32 nt, Human
aaugaauggcgaccccaauauuuggaaccagg

SEQ ID NO: 29535 - RNA, 32 nt, Human
aaugaauguaucagagaaugucuuuguaacug

SEQ ID NO: 29536 - RNA, 32 nt, Human
aaugaaugugguaaagccuucccucgaauugc

SEQ ID NO: 29537 - RNA, 32 nt, Human
aaugaauguuuucauguagauugcauuguauu

SEQ ID NO: 29538 - RNA, 31 nt, Human
aaugaauuauauucaaugcauuuaaaauacc

SEQ ID NO: 29539 - RNA, 32 nt, Human
aaugaauucucucuaaaaauaaaaugauguau

SEQ ID NO: 29540 - RNA, 32 nt, Human
aaugaauugcaucucaugaauguaucaggcug

SEQ ID NO: 29541 - RNA, 24 nt, Human
aaugaauugguuauacaucaugca

SEQ ID NO: 29542 - RNA, 32 nt, Human
aaugaauuguccugcagaacucccucuuaagc

SEQ ID NO: 29543 - RNA, 32 nt, Human
aaugaauuucagaaaguaaagaaacaacugag

SEQ ID NO: 29544 - RNA, 32 nt, Human
aaugaauuucucuccaacucgaccuugguaaa

SEQ ID NO: 29545 - RNA, 32 nt, Human
aaugaauuucucuuuacuucucuccaccuucu

SEQ ID NO: 29546 - RNA, 23 nt, Human
aaugaauuugucucaacuaugca

SEQ ID NO: 29547 - RNA, 32 nt, Human
aaugacaaaaagccuuuuccagaagaucugaa

SEQ ID NO: 29548 - RNA, 32 nt, Human
aaugacaaacugcuccuucacaagucugccua

SEQ ID NO: 29549 - RNA, 32 nt, Human
aaugacaaccuucugcuuucacugcccagcaa

SEQ ID NO: 29550 - RNA, 32 nt, Human
aaugacaagaggagccagaagggugggugggu

SEQ ID NO: 29551 - RNA, 32 nt, Human
aaugacaagcugguugaagcugguaaucaaug

SEQ ID NO: 29552 - RNA, 32 nt, Human
aaugacaagucaaauccagaccuauguuggau

SEQ ID NO: 29553 - RNA, 32 nt, Human
aaugacaagucacaaggguaucaaagaaagac

SEQ ID NO: 29554 - RNA, 32 nt, Human
aaugacaaucccuuucgucuccuuccuccgcu

SEQ ID NO: 29555 - RNA, 31 nt, Human
aaugacaauguccaagacacagcagaacaga

SEQ ID NO: 29556 - RNA, 32 nt, Human
aaugacacucacagcaugagagcuuccugagu

SEQ ID NO: 29557 - RNA, 32 nt, Human
aaugacacucacuggucuuugcaucgugggca

SEQ ID NO: 29558 - RNA, 32 nt, Human
aaugacagaauuuccuuccucaucaaggcuga

SEQ ID NO: 29559 - RNA, 32 nt, Human
aaugacagacugagaacccacugugauuuguc

SEQ ID NO: 29560 - RNA, 32 nt, Human
aaugacagacugagcaaaauugcuugcaaaag

SEQ ID NO: 29561 - RNA, 32 nt, Human
aaugacagcaucuccccauucaucuagaagaa

SEQ ID NO: 29562 - RNA, 32 nt, Human
aaugacagccuuguuucuccccuuugaaucag

SEQ ID NO: 29563 - RNA, 32 nt, Human
aaugacagcugaucugucggaaccaggacaca

SEQ ID NO: 29564 - RNA, 32 nt, Human
aaugacagggucuccauauguugcccaggcug

SEQ ID NO: 29565 - RNA, 32 nt, Human
aaugacaggguuucaccguguuggccaggcug

SEQ ID NO: 29566 - RNA, 32 nt, Human
aaugacagugggucuuucucucauguucacuc

SEQ ID NO: 29567 - RNA, 32 nt, Human
aaugacaguuucagagagucaaugucauuaca

SEQ ID NO: 29568 - RNA, 20 nt, Human
aaugacauaaaaagaagccu

SEQ ID NO: 29569 - RNA, 32 nt, Human
aaugacauaguuuuggguuagauuuuauaaug

SEQ ID NO: 29570 - RNA, 32 nt, Human
aaugacaucaagggguaugaaaagccacuuaa

SEQ ID NO: 29571 - RNA, 32 nt, Human
aaugacauccuccuccuccaucacuccagggg

SEQ ID NO: 29572 - RNA, 32 nt, Human
aaugacaugaauucaauaucuaaugucaacca

SEQ ID NO: 29573 - RNA, 32 nt, Human
aaugacauuccccucccaccucuccuuuugag

SEQ ID NO: 29574 - RNA, 32 nt, Human
aaugaccaagcccaguuguugcagugauuggu

SEQ ID NO: 29575 - RNA, 32 nt, Human
aaugaccacauccugaaaaggguguugcuaag

SEQ ID NO: 29576 - RNA, 32 nt, Human
aaugaccaccucacggccccaggcuggugagg

SEQ ID NO: 29577 - RNA, 26 nt, Human
aaugaccacugcagccagcgaggugc

SEQ ID NO: 29578 - RNA, 32 nt, Human
aaugaccacugcagccuccaccuccuaggcuc

SEQ ID NO: 29579 - RNA, 32 nt, Human
aaugaccagccaaggcucuugcucucagaaau

SEQ ID NO: 29580 - RNA, 32 nt, Human
aaugaccagugcaguacagaacuccacauaua

SEQ ID NO: 29581 - RNA, 32 nt, Human
aaugaccauggagcggaaagaaagaaaacagc

SEQ ID NO: 29582 - RNA, 32 nt, Human
aaugaccauucagggaucuuacuccagcuuga

SEQ ID NO: 29583 - RNA, 32 nt, Human
aaugacccaaggccaaggaagggaggacagag

SEQ ID NO: 29584 - RNA, 32 nt, Human
aaugacccaccccacaucaucuucccacaugg

SEQ ID NO: 29585 - RNA, 16 nt, Human
aaugacccacuggaaa

SEQ ID NO: 29586 - RNA, 32 nt, Human
aaugacccaguaacuaggaaaguagaaaacuu

SEQ ID NO: 29587 - RNA, 32 nt, Human
aaugacccgaguccuccacaugaccuugugau

SEQ ID NO: 29588 - RNA, 32 nt, Human
aaugacccucagaaccuccuuccugggccugc

SEQ ID NO: 29589 - RNA, 32 nt, Human
aaugacccugaaagaauagcccugaagauaga

SEQ ID NO: 29590 - RNA, 32 nt, Human
aaugaccgcccuuccaagauggcggcucccgu

SEQ ID NO: 29591 - RNA, 32 nt, Human
aaugaccucgcugcuguucccuggcaugaccc

SEQ ID NO: 29592 - RNA, 32 nt, Human
aaugaccucuguccucccucugauuuuucaua

SEQ ID NO: 29593 - RNA, 32 nt, Human
aaugaccugaguguccuaggcauucacucgga

SEQ ID NO: 29594 - RNA, 32 nt, Human
aaugaccuguucaucuguggccauuccaucag

SEQ ID NO: 29595 - RNA, 32 nt, Human
aaugaccuugagacugaugaacagucuggcca

SEQ ID NO: 29596 - RNA, 32 nt, Human
aaugaccuuuucaaggagaaccacaagccacu

SEQ ID NO: 29597 - RNA, 32 nt, Human
aaugacgaagugaaguagugcaaacauagcuc

SEQ ID NO: 29598 - RNA, 32 nt, Human
aaugacgccauugcacuccagccuaggcaaua

SEQ ID NO: 29599 - RNA, 32 nt, Human
aaugacggaggagagaaaaugccaugcagaag

SEQ ID NO: 29600 - RNA, 32 nt, Human
aaugacgggcagugucgggagcagggagccac

SEQ ID NO: 29601 - RNA, 32 nt, Human
aaugacuaaagaaaaagugguacauacacaca

SEQ ID NO: 29602 - RNA, 32 nt, Human
aaugacuaaccauacuaaaagacugguaacag

SEQ ID NO: 29603 - RNA, 32 nt, Human
aaugacuaccugaaauguuacaggcuuuuuaa

SEQ ID NO: 29604 - RNA, 32 nt, Human
aaugacuagacuguacauucccaugagccuuc

SEQ ID NO: 29605 - RNA, 32 nt, Human
aaugacuaggaauauuggaagcagcauagugu

SEQ ID NO: 29606 - RNA, 32 nt, Human
aaugacucagcuuuuauggaauuugaaugaac

SEQ ID NO: 29607 - RNA, 32 nt, Human
aaugacucaguuucaguuaccugagccacagc

SEQ ID NO: 29608 - RNA, 32 nt, Human
aaugacucccauccucuccucaucuccccuuu

SEQ ID NO: 29609 - RNA, 32 nt, Human
aaugacuccuuuccuucaccuccugcccuucu

SEQ ID NO: 29610 - RNA, 32 nt, Human
aaugacucuaauuuuaaggggaauggcuggcu

SEQ ID NO: 29611 - RNA, 32 nt, Human
aaugacucucucucuacauaccagcagcauac

SEQ ID NO: 29612 - RNA, 32 nt, Human
aaugacucuuaaaccaaagaacaguggauuag

SEQ ID NO: 29613 - RNA, 32 nt, Human
aaugacugaauacagaccuaagcacagcagug

SEQ ID NO: 29614 - RNA, 32 nt, Human
aaugacugauaagaguacaauacaggugccau

SEQ ID NO: 29615 - RNA, 32 nt, Human
aaugacugcacacccaugcuaaccuccacggg

SEQ ID NO: 29616 - RNA, 32 nt, Human
aaugacugcucaauaaauguugguuccugcug

SEQ ID NO: 29617 - RNA, 32 nt, Human
aaugacuguaucaaauaaauguuuauugauuu

SEQ ID NO: 29618 - RNA, 32 nt, Human
aaugacuguggaauaauauggaagaagaugga

SEQ ID NO: 29619 - RNA, 32 nt, Human
aaugacuguuacgacccuguucacaaaacucu

SEQ ID NO: 29620 - RNA, 32 nt, Human
aaugacuucaggaagaccucaggcuucauuau

SEQ ID NO: 29621 - RNA, 32 nt, Human
aaugacuugcccaggguaaaacaguccauggc

SEQ ID NO: 29622 - RNA, 32 nt, Human
aaugacuuggaucucccuccuggcagacugug

SEQ ID NO: 29623 - RNA, 32 nt, Human
aaugacuugugucacuucggagugacagaaaa

SEQ ID NO: 29624 - RNA, 32 nt, Human
aaugacuuucugaauaaagauggcaacacaaa

SEQ ID NO: 29625 - RNA, 32 nt, Human
aaugacuuucugaauaaagauggcaacacaau

SEQ ID NO: 29626 - RNA, 32 nt, Human
aaugacuuuguuuuucaaggugcugucauuuu

SEQ ID NO: 29627 - RNA, 32 nt, Human
aaugagaaaaacaaccccauuaaaaacugggc

SEQ ID NO: 29628 - RNA, 32 nt, Human
aaugagaaaggccagaggcugcaaagacaguc

SEQ ID NO: 29629 - RNA, 32 nt, Human
aaugagaacaaaguuagaaaucugccgauaac

SEQ ID NO: 29630 - RNA, 32 nt, Human
aaugagaagaaaucugugccacccugggaagg

SEQ ID NO: 29631 - RNA, 24 nt, Human
aaugagacaccacgagaagagagg

SEQ ID NO: 29632 - RNA, 32 nt, Human
aaugagacacucuaguugcaggaaaagaagcu

SEQ ID NO: 29633 - RNA, 32 nt, Human
aaugagacaggaagcuguucacugugaaacag

SEQ ID NO: 29634 - RNA, 32 nt, Human
aaugagacauaaaaagcaggugacaaggauac

SEQ ID NO: 29635 - RNA, 32 nt, Human
aaugagacggcuugugugugaaaagauuuugg

SEQ ID NO: 29636 - RNA, 21 nt, Human
aaugagacuuuaaaagcauuu

SEQ ID NO: 29637 - RNA, 32 nt, Human
aaugagagaaccugguuaccucagccugaaag

SEQ ID NO: 29638 - RNA, 32 nt, Human
aaugagagaaggcagaccuuguuagugacaug

SEQ ID NO: 29639 - RNA, 32 nt, Human
aaugagagaagugggaaagaagcaauggaaag

SEQ ID NO: 29640 - RNA, 32 nt, Human
aaugagagaauagaguaugguugauucccagc

SEQ ID NO: 29641 - RNA, 32 nt, Human
aaugagagauacaaaugagcuagaggaagaug

SEQ ID NO: 29642 - RNA, 32 nt, Human
aaugagagaucugugaagagagagggcugggu

SEQ ID NO: 29643 - RNA, 32 nt, Human
aaugagagcaaagacagcuaagaaaaaggaaa

SEQ ID NO: 29644 - RNA, 31 nt, Human
aaugagagcaguccuguuucauucacauggg

SEQ ID NO: 29645 - RNA, 20 nt, Human
aaugagagcucgcgggguga

SEQ ID NO: 29646 - RNA, 22 nt, Human
aaugagagcucuugaccaguga

SEQ ID NO: 29647 - RNA, 32 nt, Human
aaugagaggcaaaaccuggugcuugagcacug

SEQ ID NO: 29648 - RNA, 32 nt, Human
aaugagagugacggcuggcaugguggcucccg

SEQ ID NO: 29649 - RNA, 32 nt, Human
aaugagagugggucuuucucucauguucacuc

SEQ ID NO: 29650 - RNA, 32 nt, Human
aaugagaguuccuccauuuaccaaaauuugac

SEQ ID NO: 29651 - RNA, 32 nt, Human
aaugagauauuuugggaauaggacccgagccu

SEQ ID NO: 29652 - RNA, 32 nt, Human
aaugagauccaauccucucaccaaaauuucaa

SEQ ID NO: 29653 - RNA, 32 nt, Human
aaugagaucccccagccguguccuccagccca

SEQ ID NO: 29654 - RNA, 32 nt, Human
aaugagaucugaaugugguuucaaucuaauuu

SEQ ID NO: 29655 - RNA, 32 nt, Human
aaugagaugcaggauucaaggaagaaauuaga

SEQ ID NO: 29656 - RNA, 32 nt, Human
aaugagaugcauccucaaacacuugagauccc

SEQ ID NO: 29657 - RNA, 32 nt, Human
aaugagaugccguaccuccucuggaccaucaa

SEQ ID NO: 29658 - RNA, 32 nt, Human
aaugagaugcugggaggagcaagcgaagcaua

SEQ ID NO: 29659 - RNA, 32 nt, Human
aaugagauggaggaaggaaaaagggagaagcu

SEQ ID NO: 29660 - RNA, 32 nt, Human
aaugagauggcaugugaaagcacuuugaaaau

SEQ ID NO: 29661 - RNA, 32 nt, Human
aaugagauuuugcccagcacauggagcuguaa

SEQ ID NO: 29662 - RNA, 32 nt, Human
aaugagcaagagauugcauugcaguuuagaca

SEQ ID NO: 29663 - RNA, 32 nt, Human
aaugagcaauugcuucuccaaggccuggagcu

SEQ ID NO: 29664 - RNA, 32 nt, Human
aaugagcaccuccgggaaagagcccagccugc

SEQ ID NO: 29665 - RNA, 32 nt, Human
aaugagcagcacucagaguccuugcuccccgc

SEQ ID NO: 29666 - RNA, 32 nt, Human
aaugagcaggcaggggagacugagauggaaau

SEQ ID NO: 29667 - RNA, 32 nt, Human
aaugagcagggugggcccacgcugggaggaca

SEQ ID NO: 29668 - RNA, 32 nt, Human
aaugagcagugugagaggggagggauggguag

SEQ ID NO: 29669 - RNA, 32 nt, Human
aaugagcauaguggggaaagaaaaggaaaugg

SEQ ID NO: 29670 - RNA, 32 nt, Human
aaugagcauggaaccugagcaaagggaauagg

SEQ ID NO: 29671 - RNA, 32 nt, Human
aaugagcauugccugaaucagaguuagcuacu

SEQ ID NO: 29672 - RNA, 18 nt, Human
aaugagccaaagugcuca

SEQ ID NO: 29673 - RNA, 32 nt, Human
aaugagccagaccuguaacaccugcaugaugg

SEQ ID NO: 29674 - RNA, 32 nt, Human
aaugagccagugagcuacagcacuuuggaaaa

SEQ ID NO: 29675 - RNA, 32 nt, Human
aaugagccaucacuagaagaaaagcccauuuu

SEQ ID NO: 29676 - RNA, 32 nt, Human
aaugagccauggcauugggacagggucacuuc

SEQ ID NO: 29677 - RNA, 32 nt, Human
aaugagcccaagcacacaugcauggcauuugu

SEQ ID NO: 29678 - RNA, 32 nt, Human
aaugagcccaccuuguguucuuccuagcucca

SEQ ID NO: 29679 - RNA, 32 nt, Human
aaugagcccaucaccaucccacugacucugug

SEQ ID NO: 29680 - RNA, 32 nt, Human
aaugagcccugugaggcccacacccccaggug

SEQ ID NO: 29681 - RNA, 32 nt, Human
aaugagccgugccaaagucucccuucuguuuc

SEQ ID NO: 29682 - RNA, 32 nt, Human
aaugagccucuccugguaucaggccuagaugg

SEQ ID NO: 29683 - RNA, 32 nt, Human
aaugagccugaccuucaggaccacugacagag

SEQ ID NO: 29684 - RNA, 32 nt, Human
aaugagcgaguggaggaacggaagggagcccu

SEQ ID NO: 29685 - RNA, 32 nt, Human
aaugagcuaauaacaccgaggugguggugagg

SEQ ID NO: 29686 - RNA, 32 nt, Human
aaugagcuacaguuuuacaaagcugaucacuu

SEQ ID NO: 29687 - RNA, 32 nt, Human
aaugagcuacugcuuuccgcugccuuccacac

SEQ ID NO: 29688 - RNA, 32 nt, Human
aaugagcuagcuaugauggcaccacugcacuc

SEQ ID NO: 29689 - RNA, 32 nt, Human
aaugagcucacuggaaauucauucuaaucccc

SEQ ID NO: 29690 - RNA, 32 nt, Human
aaugagcucaguuuuacaugcaucgagcuuga

SEQ ID NO: 29691 - RNA, 32 nt, Human
aaugagcuccaaugggaucccagagugcuacg

SEQ ID NO: 29692 - RNA, 32 nt, Human
aaugagcuccacccucacuuugccugcccuga

SEQ ID NO: 29693 - RNA, 32 nt, Human
aaugagcucccaccucuccagccagccuagaa

SEQ ID NO: 29694 - RNA, 32 nt, Human
aaugaggaaacaaccacuggcccaggguagag

SEQ ID NO: 29695 - RNA, 21 nt, Human
aaugaggaaacagguuaugga

SEQ ID NO: 29696 - RNA, 24 nt, Human
aaugaggaaacuaaacucugugga

SEQ ID NO: 29697 - RNA, 24 nt, Human
aaugaggaaacugaggcucagggg

SEQ ID NO: 29698 - RNA, 23 nt, Human
aaugaggaaacugaggcuuggug

SEQ ID NO: 29699 - RNA, 32 nt, Human
aaugaggaacagaagaagcagagcagaugauu

SEQ ID NO: 29700 - RNA, 32 nt, Human
aaugaggaagggaggggagggaagggacagaa

SEQ ID NO: 29701 - RNA, 24 nt, Human
aaugaggaagugaguguucuugga

SEQ ID NO: 29702 - RNA, 32 nt, Human
aaugaggaaucauuuucaugugcccugacaug

SEQ ID NO: 29703 - RNA, 26 nt, Human
aaugaggaauguauauguuuuguggg

SEQ ID NO: 29704 - RNA, 32 nt, Human
aaugaggacauuguauaugacaucgcuaauga

SEQ ID NO: 29705 - RNA, 32 nt, Human
aaugaggagaaaaaggagaaaagggaaaagca

SEQ ID NO: 29706 - RNA, 31 nt, Human
aaugaggagagaccugcuuuugcagguggau

SEQ ID NO: 29707 - RNA, 32 nt, Human
aaugaggagcugggaaguggggugacauagcu

SEQ ID NO: 29708 - RNA, 32 nt, Human
aaugaggagcuuccucucuuccugugaaggau

SEQ ID NO: 29709 - RNA, 32 nt, Human
aaugaggaggucuucacggauggcuuugccga

SEQ ID NO: 29710 - RNA, 32 nt, Human
aaugaggauaccuuuaaggcacucuuggacuc

SEQ ID NO: 29711 - RNA, 32 nt, Human
aaugaggcaagaggacguuggaagagagaagu

SEQ ID NO: 29712 - RNA, 32 nt, Human
aaugaggcagaggcuugccccaagucacagcc

SEQ ID NO: 29713 - RNA, 32 nt, Human
aaugaggcaggcaauucuagucuuccacaaaa

SEQ ID NO: 29714 - RNA, 22 nt, Human
aaugaggcagggcucaugggau

SEQ ID NO: 29715 - RNA, 32 nt, Human
aaugaggcagggcucaugggauugcuuuugau

SEQ ID NO: 29716 - RNA, 32 nt, Human
aaugaggcauaauuguucccuccaucagcgau

SEQ ID NO: 29717 - RNA, 32 nt, Human
aaugaggccagacucagggucacggggaaugu

SEQ ID NO: 29718 - RNA, 32 nt, Human
aaugaggccaggcacagcagcucacagcugua

SEQ ID NO: 29719 - RNA, 32 nt, Human
aaugaggcugggugggagcggggagggacuag

SEQ ID NO: 29720 - RNA, 32 nt, Human
aaugaggcuguggauucaaggcucccugcccc

SEQ ID NO: 29721 - RNA, 32 nt, Human
aaugagggaagacgagaaagagagugggagag

SEQ ID NO: 29722 - RNA, 32 nt, Human
aaugagggagagaagggggcuguacaguuuga

SEQ ID NO: 29723 - RNA, 32 nt, Human
aaugagggagagagaaaggguggccacuuucc

SEQ ID NO: 29724 - RNA, 32 nt, Human
aaugagggaggaaauauuccuuucuagcauuc

SEQ ID NO: 29725 - RNA, 32 nt, Human
aaugagggaggcaggcaauaugcagugaaaac

SEQ ID NO: 29726 - RNA, 32 nt, Human
aaugagggaggucucaagagauauaauuuaga

SEQ ID NO: 29727 - RNA, 32 nt, Human
aaugagggcugaguuugcacaguggucuggaa

SEQ ID NO: 29728 - RNA, 32 nt, Human
aaugaggggaaagagccuggggaggagcuuaa

SEQ ID NO: 29729 - RNA, 32 nt, Human
aaugaggggaaaggaaaugagcucuacgagga

SEQ ID NO: 29730 - RNA, 32 nt, Human
aaugaggggaagcugggguuugcagugguuug

SEQ ID NO: 29731 - RNA, 32 nt, Human
aaugaggggccugggagggaggagcuuggugc

SEQ ID NO: 29732 - RNA, 32 nt, Human
aaugaggggugaacuccuccucccucugcugu

SEQ ID NO: 29733 - RNA, 32 nt, Human
aaugagggugaccacaacagcacugcccucug

SEQ ID NO: 29734 - RNA, 31 nt, Human
aaugagguaggcacaaauacauuccuuuuag

SEQ ID NO: 29735 - RNA, 32 nt, Human
aaugagguccuguccugcuuucacccaugacc

SEQ ID NO: 29736 - RNA, 32 nt, Human
aaugagguguuuagguggcuggaaaagcauuu

SEQ ID NO: 29737 - RNA, 32 nt, Human
aaugagguugugggguguaaagggaaggggau

SEQ ID NO: 29738 - RNA, 32 nt, Human
aaugagguuucagcuccuaugugaucugaaug

SEQ ID NO: 29739 - RNA, 32 nt, Human
aaugagguuuuuaaaauaagguuuucuaguuu

SEQ ID NO: 29740 - RNA, 31 nt, Human
aaugaguaaauucagcacugguaccuuauua

SEQ ID NO: 29741 - RNA, 32 nt, Human
aaugaguaacacccauuuuugcagaucuuugu

SEQ ID NO: 29742 - RNA, 23 nt, Human
aaugaguaaguuuagaugacugg

SEQ ID NO: 29743 - RNA, 32 nt, Human
aaugaguaauccagcaggcacuccuccuccac

SEQ ID NO: 29744 - RNA, 32 nt, Human
aaugaguacccaugaauagccaugauuccuac

SEQ ID NO: 29745 - RNA, 32 nt, Human
aaugaguaucuguaaccucccacugcaucaga

SEQ ID NO: 29746 - RNA, 22 nt, Human
aaugagucagcucugcucaugg

SEQ ID NO: 29747 - RNA, 32 nt, Human
aaugagucauuuucaguuguaccuuagauguc

SEQ ID NO: 29748 - RNA, 32 nt, Human
aaugaguccaggccaagcaaauggagcagaag

SEQ ID NO: 29749 - RNA, 26 nt, Human
aaugagucuaagugcauuuacucucu

SEQ ID NO: 29750 - RNA, 32 nt, Human
aaugagugaggacacaggucccaggggaguuc

SEQ ID NO: 29751 - RNA, 32 nt, Human
aaugagugaugcugcaacuugcaaauguacca

SEQ ID NO: 29752 - RNA, 32 nt, Human
aaugagugcucuggacuugaacuacacugaug

SEQ ID NO: 29753 - RNA, 32 nt, Human
aaugaguggcaagaacaugaugacagacacgg

SEQ ID NO: 29754 - RNA, 32 nt, Human
aaugaguggggagagagaaggggaggaguagg

SEQ ID NO: 29755 - RNA, 32 nt, Human
aaugagugggggaggagagcagcuggauaucc

SEQ ID NO: 29756 - RNA, 32 nt, Human
aaugaguguacauacauaaaagcugccauucu

SEQ ID NO: 29757 - RNA, 32 nt, Human
aaugaguguacauauauaaaagcugccauucu

SEQ ID NO: 29758 - RNA, 32 nt, Human
aaugagugucucugcuggugcuucucccaaga

SEQ ID NO: 29759 - RNA, 32 nt, Human
aaugagugugccagaguuauuagugccaaguu

SEQ ID NO: 29760 - RNA, 32 nt, Human
aaugaguguggcaagaccuacucucacaauuc

SEQ ID NO: 29761 - RNA, 32 nt, Human
aaugaguuaagggagagaauaagaacggcggu

SEQ ID NO: 29762 - RNA, 32 nt, Human
aaugaguuaccagcuauccaguuuucuccauu

SEQ ID NO: 29763 - RNA, 32 nt, Human
aaugaguugcauucugauaaugucuuaucucu

SEQ ID NO: 29764 - RNA, 32 nt, Human
aaugaguugggagggggucccagggaaggggg

SEQ ID NO: 29765 - RNA, 32 nt, Human
aaugaguugggauauguuccuuuugcuucugu

SEQ ID NO: 29766 - RNA, 32 nt, Human
aaugaguuguauugcuaaucuugaugucucuc

SEQ ID NO: 29767 - RNA, 32 nt, Human
aaugaguuugcagccaaggcuacagaggauca

SEQ ID NO: 29768 - RNA, 32 nt, Human
aaugauaaauacagccauacuuaaauagaaga

SEQ ID NO: 29769 - RNA, 32 nt, Human
aaugauaaaugcuggagggggccaucugauuu

SEQ ID NO: 29770 - RNA, 32 nt, Human
aaugauaauauauucauauauguauguuauau

SEQ ID NO: 29771 - RNA, 32 nt, Human
aaugauaauccaccacccuuugcugacuccuu

SEQ ID NO: 29772 - RNA, 32 nt, Human
aaugauacaggcaagguuucugcagaucuugg

SEQ ID NO: 29773 - RNA, 32 nt, Human
aaugauacccaaacuccuggagugggaguggg

SEQ ID NO: 29774 - RNA, 32 nt, Human
aaugauacucaucaugguuuugauuugcaauu

SEQ ID NO: 29775 - RNA, 32 nt, Human
aaugauacuguagauuguacugccuuuaucug

SEQ ID NO: 29776 - RNA, 32 nt, Human
aaugauagggcugauggcaguuuacuagauca

SEQ ID NO: 29777 - RNA, 32 nt, Human
aaugauaucccccacucauuuagccauucuua

SEQ ID NO: 29778 - RNA, 31 nt, Human
aaugauauggugcugcagaaggagccugcug

SEQ ID NO: 29779 - RNA, 32 nt, Human
aaugauauugcguucgugccucagcuuuaagc

SEQ ID NO: 29780 - RNA, 32 nt, Human
aaugauauuuugucugaaaagacuugacauug

SEQ ID NO: 29781 - RNA, 32 nt, Human
aaugaucaaguuggauuuagaugauguucccu

SEQ ID NO: 29782 - RNA, 32 nt, Human
aaugaucaugaccuucaccuguccucacaugu

SEQ ID NO: 29783 - RNA, 32 nt, Human
aaugaucauugggaauuuauuuugaaagugag

SEQ ID NO: 29784 - RNA, 32 nt, Human
aaugauccagcaaguuugggaaaugcugcguu

SEQ ID NO: 29785 - RNA, 32 nt, Human
aaugauccugccagaaccucacucuccccuuu

SEQ ID NO: 29786 - RNA, 32 nt, Human
aaugauccuucccagccggggccuuccgacca

SEQ ID NO: 29787 - RNA, 32 nt, Human
aaugaucguaccacugcacuccagccuaggug

SEQ ID NO: 29788 - RNA, 20 nt, Human
aaugaucgugcgcuuccuga

SEQ ID NO: 29789 - RNA, 32 nt, Human
aaugaucugcccaccucugccucccaaagugc

SEQ ID NO: 29790 - RNA, 32 nt, Human
aaugaugaagaaaaagaauaggcuggagaguc

SEQ ID NO: 29791 - RNA, 32 nt, Human
aaugaugaaggggauacgcuggaguugcccug

SEQ ID NO: 29792 - RNA, 32 nt, Human
aaugaugacuucugcugcuuccgucucuggag

SEQ ID NO: 29793 - RNA, 32 nt, Human
aaugaugaguccuuggaauugauaggacacgu

SEQ ID NO: 29794 - RNA, 32 nt, Human
aaugaugagugagacucaggaggcacgacaug

SEQ ID NO: 29795 - RNA, 32 nt, Human
aaugaugauaauaccacuuaucucauagcauu

SEQ ID NO: 29796 - RNA, 32 nt, Human
aaugaugauagggaagugucuaauguaugugc

SEQ ID NO: 29797 - RNA, 18 nt, Human
aaugaugauuugugcaaa

SEQ ID NO: 29798 - RNA, 32 nt, Human
aaugaugccacgaagcccugggauuuccuacc

SEQ ID NO: 29799 - RNA, 32 nt, Human
aaugaugccacucuagcauuagcugaagaucc

SEQ ID NO: 29800 - RNA, 32 nt, Human
aaugaugcuaacucugucucuuugccaauucu

SEQ ID NO: 29801 - RNA, 32 nt, Human
aaugaugcuaugcuuuuuccaaccaagccaga

SEQ ID NO: 29802 - RNA, 32 nt, Human
aaugaugcuauuugcaauuccugcuccuaggg

SEQ ID NO: 29803 - RNA, 32 nt, Human
aaugaugcuccugccucugccucccagccccu

SEQ ID NO: 29804 - RNA, 32 nt, Human
aaugauggagccagaauuuaguugcagaacuu

SEQ ID NO: 29805 - RNA, 32 nt, Human
aaugauggaggcacauucuagauggaggcaca

SEQ ID NO: 29806 - RNA, 32 nt, Human
aaugauggagggugggagagccuugagccugc

SEQ ID NO: 29807 - RNA, 32 nt, Human
aaugauggcaggagaggaaccagaagagcagg

SEQ ID NO: 29808 - RNA, 32 nt, Human
aaugauggguuuuccaugaaaugugaugcuuc

SEQ ID NO: 29809 - RNA, 32 nt, Human
aaugaugguaagguucacagggcaguccaagu

SEQ ID NO: 29810 - RNA, 32 nt, Human
aaugauggucugggugccaccuguuuuuaaac

SEQ ID NO: 29811 - RNA, 32 nt, Human
aaugauguccccagccuaaggggccuucggga

SEQ ID NO: 29812 - RNA, 32 nt, Human
aaugaugucuucauguugaguuuuauagcaug

SEQ ID NO: 29813 - RNA, 32 nt, Human
aaugauguuagcuguggccacuguggauuuuu

SEQ ID NO: 29814 - RNA, 32 nt, Human
aaugauguugagugggagauuggcuuugccuu

SEQ ID NO: 29815 - RNA, 32 nt, Human
aaugauguuggcucuguggcuuggggguuuug

SEQ ID NO: 29816 - RNA, 32 nt, Human
aaugauguuggugcugcuuccuucuaagagcu

SEQ ID NO: 29817 - RNA, 32 nt, Human
aaugauuaaauacuguuacaaucuuuauuugu

SEQ ID NO: 29818 - RNA, 32 nt, Human
aaugauuaguaggaaaggacugagaguauuau

SEQ ID NO: 29819 - RNA, 32 nt, Human
aaugauuauaaaaucacauauuuucaaaaaug

SEQ ID NO: 29820 - RNA, 32 nt, Human
aaugauuauauguauuuuauauguguguguau

SEQ ID NO: 29821 - RNA, 32 nt, Human
aaugauuaucuuuuagagaaguauacugaaaa

SEQ ID NO: 29822 - RNA, 32 nt, Human
aaugauucacagugacaaacuuuuaauaacuu

SEQ ID NO: 29823 - RNA, 20 nt, Human
aaugauuccaaaacccaggg

SEQ ID NO: 29824 - RNA, 32 nt, Human
aaugauucccacucuguucucugccuugucuc

SEQ ID NO: 29825 - RNA, 32 nt, Human
aaugauucuaccucuggggauaaggauucaca

SEQ ID NO: 29826 - RNA, 31 nt, Human
aaugauugacuucugucacugccauaguuac

SEQ ID NO: 29827 - RNA, 32 nt, Human
aaugauugaggagagaaaaggaucagauugcu

SEQ ID NO: 29828 - RNA, 32 nt, Human
aaugauugauaaccucucugccagcaaucauu

SEQ ID NO: 29829 - RNA, 32 nt, Human
aaugauugaugggcaaaaauguacaacacagu

SEQ ID NO: 29830 - RNA, 32 nt, Human
aaugauugcuuuuaauguuugcacugauuuag

SEQ ID NO: 29831 - RNA, 32 nt, Human
aaugauuggggugaagacaucccuggagugaa

SEQ ID NO: 29832 - RNA, 32 nt, Human
aaugauuggucagaugucuuugagaaguguua

SEQ ID NO: 29833 - RNA, 32 nt, Human
aaugauugugugcaugaauuugggagauugua

SEQ ID NO: 29834 - RNA, 32 nt, Human
aaugauuguucaccaagcagcaugcuguacau

SEQ ID NO: 29835 - RNA, 32 nt, Human
aaugauuuacagacugaugccagacaaaccuu

SEQ ID NO: 29836 - RNA, 32 nt, Human
aaugauuuauccaauuagaaaaggacaagaua

SEQ ID NO: 29837 - RNA, 32 nt, Human
aaugauuucaacaaugcauuaaaagaaugugc

SEQ ID NO: 29838 - RNA, 32 nt, Human
aaugauuucuaugccuuuaucuuucaaauuuu

SEQ ID NO: 29839 - RNA, 32 nt, Human
aaugauuugggaacuuuugguugccugcaguu

SEQ ID NO: 29840 - RNA, 31 nt, Human
aaugauuugucagagaaccuguugaaaugug

SEQ ID NO: 29841 - RNA, 32 nt, Human
aaugauuugugcuugagugaacaaaagaagac

SEQ ID NO: 29842 - RNA, 32 nt, Human
aaugauuuuugcuauuucuaguagaaagaaaa

SEQ ID NO: 29843 - RNA, 32 nt, Human
aaugcaaaacacaagaacaggaaagugaaugc

SEQ ID NO: 29844 - RNA, 32 nt, Human
aaugcaaaagaccauagaauuuguauuucuuu

SEQ ID NO: 29845 - RNA, 32 nt, Human
aaugcaaacacccugaggauucagagaacaau

SEQ ID NO: 29846 - RNA, 32 nt, Human
aaugcaaacuaguucagccacuguggagagaa

SEQ ID NO: 29847 - RNA, 32 nt, Human
aaugcaaagauguccacacuguuuuaaacuug

SEQ ID NO: 29848 - RNA, 32 nt, Human
aaugcaaaggaaaaguucuggaaggaaauuaa

SEQ ID NO: 29849 - RNA, 32 nt, Human
aaugcaaaugcacauaauucagagcaguaacc

SEQ ID NO: 29850 - RNA, 32 nt, Human
aaugcaacaucaccaacagauccuguuauuuc

SEQ ID NO: 29851 - RNA, 32 nt, Human
aaugcaaccucacaaccuuggcugagucuuga

SEQ ID NO: 29852 - RNA, 32 nt, Human
aaugcaacgugaggccaacugaacaauucccc

SEQ ID NO: 29853 - RNA, 32 nt, Human
aaugcaaggccuuggcuuugucuugcagggau

SEQ ID NO: 29854 - RNA, 32 nt, Human
aaugcaagucagaaaguacaagacuuagugau

SEQ ID NO: 29855 - RNA, 32 nt, Human
aaugcaagucucaaacagcuuagaugggaggc

SEQ ID NO: 29856 - RNA, 32 nt, Human
aaugcaaugaacacaagugguugcugagucuc

SEQ ID NO: 29857 - RNA, 32 nt, Human
aaugcaauuuuagacagacucuagucaagccc

SEQ ID NO: 29858 - RNA, 32 nt, Human
aaugcacaaaaugguggagcugaagaggggga

SEQ ID NO: 29859 - RNA, 32 nt, Human
aaugcacaaggugucucaucugaaaagaaacc

SEQ ID NO: 29860 - RNA, 32 nt, Human
aaugcacacaccugcuguugcuuuugauuucu

SEQ ID NO: 29861 - RNA, 32 nt, Human
aaugcacacacgugcacuggagcagcugccua

SEQ ID NO: 29862 - RNA, 32 nt, Human
aaugcacacaugcacacacgcacacacaugca

SEQ ID NO: 29863 - RNA, 23 nt, Human
aaugcacagagguuuuugaaaaa

SEQ ID NO: 29864 - RNA, 32 nt, Human
aaugcacagggcugcaacaccacgacuucugc

SEQ ID NO: 29865 - RNA, 32 nt, Human
aaugcacauauagacacacauaugccaauauc

SEQ ID NO: 29866 - RNA, 32 nt, Human
aaugcacaugaagaaacagguuuccagacgug

SEQ ID NO: 29867 - RNA, 32 nt, Human
aaugcaccacugcacuccagcaugggcaacac

SEQ ID NO: 29868 - RNA, 32 nt, Human
aaugcaccacugcaguccagccuaggcaacag

SEQ ID NO: 29869 - RNA, 32 nt, Human
aaugcaccagugcuauggaagaccaauggagu

SEQ ID NO: 29870 - RNA, 32 nt, Human
aaugcaccccugggaagcagcccgcuguccgg

SEQ ID NO: 29871 - RNA, 32 nt, Human
aaugcaccucaaggaauuagaguagcaugaac

SEQ ID NO: 29872 - RNA, 32 nt, Human
aaugcaccucauucuucccuggccucuuuccc

SEQ ID NO: 29873 - RNA, 32 nt, Human
aaugcacgucacaaccucucugagcuucguuu

SEQ ID NO: 29874 - RNA, 32 nt, Human
aaugcacuauuauguauugauucuccaugaga

SEQ ID NO: 29875 - RNA, 32 nt, Human
aaugcacucaagugcauccaccaggaauagaa

SEQ ID NO: 29876 - RNA, 32 nt, Human
aaugcacuccucccucuccuuccuuuguuuaa

SEQ ID NO: 29877 - RNA, 32 nt, Human
aaugcacugacuuucaaaaacugagguggggu

SEQ ID NO: 29878 - RNA, 32 nt, Human
aaugcacuugagcagcggucuccaaccacagg

SEQ ID NO: 29879 - RNA, 20 nt, Human
aaugcagaacugacaggagg

SEQ ID NO: 29880 - RNA, 21 nt, Human
aaugcagaaggagacaggagg

SEQ ID NO: 29881 - RNA, 32 nt, Human
aaugcagaauugcagaguguagaaugguacug

SEQ ID NO: 29882 - RNA, 32 nt, Human
aaugcagacaacaccuuccuccugcagacacu

SEQ ID NO: 29883 - RNA, 22 nt, Human
aaugcagacacgagaaggaggg

SEQ ID NO: 29884 - RNA, 20 nt, Human
aaugcagacauaagaagcag

SEQ ID NO: 29885 - RNA, 26 nt, Human
aaugcagaccuccagcucuagaucug

SEQ ID NO: 29886 - RNA, 32 nt, Human
aaugcagacucugccauguccuagugugauuc

SEQ ID NO: 29887 - RNA, 31 nt, Human
aaugcagacuuuguuacuugccaaagaagau

SEQ ID NO: 29888 - RNA, 24 nt, Human
aaugcagagcuuagaaagggaggg

SEQ ID NO: 29889 - RNA, 22 nt, Human
aaugcagagggcugagagaggg

SEQ ID NO: 29890 - RNA, 32 nt, Human
aaugcagaugcuuggacucuucucccaaaucu

SEQ ID NO: 29891 - RNA, 32 nt, Human
aaugcagauguggcauuuaggggagaaucagc

SEQ ID NO: 29892 - RNA, 32 nt, Human
aaugcagauucuuggccccaccccagaccucc

SEQ ID NO: 29893 - RNA, 32 nt, Human
aaugcagcaagggucuggaggcugaggaccag

SEQ ID NO: 29894 - RNA, 26 nt, Human
aaugcagcaauguugacuuuguuuca

SEQ ID NO: 29895 - RNA, 32 nt, Human
aaugcagcagauacucuuccugccagugguaa

SEQ ID NO: 29896 - RNA, 32 nt, Human
aaugcagcaguacugccuucaggccuggacag

SEQ ID NO: 29897 - RNA, 32 nt, Human
aaugcagcccaggcagaggacggugcagccaa

SEQ ID NO: 29898 - RNA, 32 nt, Human
aaugcagcccggucacaugcgcugcggcggug

SEQ ID NO: 29899 - RNA, 32 nt, Human
aaugcagcccucuccacccuccggccagcgag

SEQ ID NO: 29900 - RNA, 32 nt, Human
aaugcagcgguguggaccgaggaacaacuugg

SEQ ID NO: 29901 - RNA, 32 nt, Human
aaugcagcuuugccaguggcauaucugucauc

SEQ ID NO: 29902 - RNA, 32 nt, Human
aaugcagcuuuuccaggguugcuggacugggg

SEQ ID NO: 29903 - RNA, 32 nt, Human
aaugcaggagaggcacagagugcacugucauu

SEQ ID NO: 29904 - RNA, 32 nt, Human
aaugcaggaucacguuagccaauggugacugg

SEQ ID NO: 29905 - RNA, 32 nt, Human
aaugcaggcuacccauucuccccaucagcugc

SEQ ID NO: 29906 - RNA, 32 nt, Human
aaugcaggcuuugacagauggaccucugaaca

SEQ ID NO: 29907 - RNA, 32 nt, Human
aaugcagguaugcacauauacaugcucuuaau

SEQ ID NO: 29908 - RNA, 32 nt, Human
aaugcaguaagccgcaagaaugacuucugcaa

SEQ ID NO: 29909 - RNA, 26 nt, Human
aaugcaguaucccauguaccuucuga

SEQ ID NO: 29910 - RNA, 32 nt, Human
aaugcagucacuucuagaaagcauuuguaauu

SEQ ID NO: 29911 - RNA, 32 nt, Human
aaugcagucaucacccucccgccauucaaugu

SEQ ID NO: 29912 - RNA, 32 nt, Human
aaugcagucauuuugacccucccaagcaauuu

SEQ ID NO: 29913 - RNA, 23 nt, Human
aaugcagucgggagaagggaggg

SEQ ID NO: 29914 - RNA, 32 nt, Human
aaugcagugagcuuguaauugcaccacugcac

SEQ ID NO: 29915 - RNA, 32 nt, Human
aaugcagugcugggaccuuccucuuuuggagc

SEQ ID NO: 29916 - RNA, 32 nt, Human
aaugcagugguaagugaaaacauucauucacu

SEQ ID NO: 29917 - RNA, 20 nt, Human
aaugcaguguaguaugcaga

SEQ ID NO: 29918 - RNA, 32 nt, Human
aaugcaguugaaaagaguuucugcaagauaau

SEQ ID NO: 29919 - RNA, 32 nt, Human
aaugcaguuguucugauaagaaucccaguucc

SEQ ID NO: 29920 - RNA, 21 nt, Human
aaugcaguuuauuuauguaaa

SEQ ID NO: 29921 - RNA, 32 nt, Human
aaugcaguuuuuaaaaaccuguaucugaccca

SEQ ID NO: 29922 - RNA, 32 nt, Human
aaugcauacaaggaguccugagguggugauuu

SEQ ID NO: 29923 - RNA, 21 nt, Human
aaugcauaccgaagagaaacc

SEQ ID NO: 29924 - RNA, 18 nt, Human
aaugcauacuagugggcc

SEQ ID NO: 29925 - RNA, 19 nt, Human
aaugcauacugccuaggcc

SEQ ID NO: 29926 - RNA, 32 nt, Human
aaugcauauauucacauucacagaaacauugg

SEQ ID NO: 29927 - RNA, 32 nt, Human
aaugcauauccaacaugugcucagggaauaau

SEQ ID NO: 29928 - RNA, 18 nt, Human
aaugcauauguauguaaa

SEQ ID NO: 29929 - RNA, 32 nt, Human
aaugcaucaggaauuccagggaagaaacucug

SEQ ID NO: 29930 - RNA, 32 nt, Human
aaugcaucauugcacuccagccugggugacag

SEQ ID NO: 29931 - RNA, 32 nt, Human
aaugcauccacugaugaacaugcaaacuuugg

SEQ ID NO: 29932 - RNA, 32 nt, Human
aaugcauccugagcccacagcuuugaccacug

SEQ ID NO: 29933 - RNA, 18 nt, Human
aaugcaugaguuaucaaa

SEQ ID NO: 29934 - RNA, 32 nt, Human
aaugcaugcagggcuuaauaucuaggugaugg

SEQ ID NO: 29935 - RNA, 32 nt, Human
aaugcaugccgggcuuaauaccuaggugaagg

SEQ ID NO: 29936 - RNA, 19 nt, Human
aaugcaugcuuuuguagca

SEQ ID NO: 29937 - RNA, 32 nt, Human
aaugcauggggugggacagguaggaguggcuc

SEQ ID NO: 29938 - RNA, 18 nt, Human
aaugcauguauuuguaaa

SEQ ID NO: 29939 - RNA, 32 nt, Human
aaugcaugucacacuaauauguaguggccuuu

SEQ ID NO: 29940 - RNA, 32 nt, Human
aaugcaugugggguuuaauaccuaggugaugg

SEQ ID NO: 29941 - RNA, 18 nt, Human
aaugcauguuuuacagua

SEQ ID NO: 29942 - RNA, 19 nt, Human
aaugcauguuuuaugcaaa

SEQ ID NO: 29943 - RNA, 32 nt, Human
aaugcauuaaguugaagucgacugccaaagag

SEQ ID NO: 29944 - RNA, 32 nt, Human
aaugcauuacuuuuauuucaaacccucugccu

SEQ ID NO: 29945 - RNA, 32 nt, Human
aaugcauucccugaaucugugccugcacugag

SEQ ID NO: 29946 - RNA, 32 nt, Human
aaugcauuguauucagaaaaccugugucacau

SEQ ID NO: 29947 - RNA, 32 nt, Human
aaugcauuguuugguuucuuuuaccaaauuaa

SEQ ID NO: 29948 - RNA, 18 nt, Human
aaugcauuuagagaagcc

SEQ ID NO: 29949 - RNA, 32 nt, Human
aaugcauuuccagaguggccaugccuagaggg

SEQ ID NO: 29950 - RNA, 21 nt, Human
aaugcauuucugauaugcaaa

SEQ ID NO: 29951 - RNA, 32 nt, Human
aaugcauuuuccccucuccuccucccugcuac

SEQ ID NO: 29952 - RNA, 32 nt, Human
aaugcauuuuucaaaugcaauggcaacugcuu

SEQ ID NO: 29953 - RNA, 32 nt, Human
aaugccaacuggagaaagggaagaaggacaua

SEQ ID NO: 29954 - RNA, 32 nt, Human
aaugccaacuguuuaucccugcucugaacagg

SEQ ID NO: 29955 - RNA, 32 nt, Human
aaugccaagaagcagccgccaguugggaucaa

SEQ ID NO: 29956 - RNA, 32 nt, Human
aaugccaagauugacagguuggccguuugcuu

SEQ ID NO: 29957 - RNA, 32 nt, Human
aaugccaauauggucuuguaacuuuccuguac

SEQ ID NO: 29958 - RNA, 20 nt, Human
aaugccaaucuuccauauua

SEQ ID NO: 29959 - RNA, 17 nt, Human
aaugccaauugcagauu

SEQ ID NO: 29960 - RNA, 20 nt, Human
aaugccaauugcccagauug

SEQ ID NO: 29961 - RNA, 32 nt, Human
aaugccacaaaguuguggaauuuuugugauua

SEQ ID NO: 29962 - RNA, 32 nt, Human
aaugccacagaaugugcaggaagccugggagg

SEQ ID NO: 29963 - RNA, 32 nt, Human
aaugccacagcccagaauucugggcaagucac

SEQ ID NO: 29964 - RNA, 32 nt, Human
aaugccaccggccccauggacaacagccuggc

SEQ ID NO: 29965 - RNA, 32 nt, Human
aaugccaccuaaucccugccuggcuucaagcc

SEQ ID NO: 29966 - RNA, 32 nt, Human
aaugccaccucaguuuguuucuuucuguuccc

SEQ ID NO: 29967 - RNA, 32 nt, Human
aaugccacucauuccuuuuucugaggagcaaa

SEQ ID NO: 29968 - RNA, 32 nt, Human
aaugccacugcacuacagccugggcgacaaag

SEQ ID NO: 29969 - RNA, 32 nt, Human
aaugccacugcacuccagccugccuggaugac

SEQ ID NO: 29970 - RNA, 32 nt, Human
aaugccacugcucucuguccccugugcuccgu

SEQ ID NO: 29971 - RNA, 32 nt, Human
aaugccacugucaaucccggcacuuugggagg

SEQ ID NO: 29972 - RNA, 32 nt, Human
aaugccagaaagaugaucccuaaaaauguuga

SEQ ID NO: 29973 - RNA, 32 nt, Human
aaugccagaauguaagauucauucagugugcu

SEQ ID NO: 29974 - RNA, 32 nt, Human
aaugccagaguucacaaaaauagcugaucuuc

SEQ ID NO: 29975 - RNA, 32 nt, Human
aaugccagcacuucgggagaccaaggugggcg

SEQ ID NO: 29976 - RNA, 32 nt, Human
aaugccagcagcaauaaaagaaaagagugcac

SEQ ID NO: 29977 - RNA, 32 nt, Human
aaugccagcauuucaugggggcugaggcagaa

SEQ ID NO: 29978 - RNA, 26 nt, Human
aaugccagccacacuccucagagccg

SEQ ID NO: 29979 - RNA, 31 nt, Human
aaugccagccucucuugucccugguuuccuu

SEQ ID NO: 29980 - RNA, 32 nt, Human
aaugccagccuggggcucucagcaggaggacc

SEQ ID NO: 29981 - RNA, 32 nt, Human
aaugccagcuacucaggaggcugaggcaugag

SEQ ID NO: 29982 - RNA, 32 nt, Human
aaugccagcuacucgggaggcugaggcacgag

SEQ ID NO: 29983 - RNA, 32 nt, Human
aaugccagcuacucgggaggcugaggcaggaa

SEQ ID NO: 29984 - RNA, 32 nt, Human
aaugccagcuacuugggaaggcugaggcagga

SEQ ID NO: 29985 - RNA, 32 nt, Human
aaugccagcuacuugggaggcuaaagugggag

SEQ ID NO: 29986 - RNA, 32 nt, Human
aaugccagcuacuugggaggcugaggcaggag

SEQ ID NO: 29987 - RNA, 32 nt, Human
aaugccagcugcaccagggcucagugagcugg

SEQ ID NO: 29988 - RNA, 32 nt, Human
aaugccagcuuuguacaggucuuuucuauuuu

SEQ ID NO: 29989 - RNA, 32 nt, Human
aaugccagcuuuuccguucccugaugaaaaga

SEQ ID NO: 29990 - RNA, 32 nt, Human
aaugccaggaaaauaucuacagaaggaaagaa

SEQ ID NO: 29991 - RNA, 32 nt, Human
aaugccaggagaagaaccaagagguggaacca

SEQ ID NO: 29992 - RNA, 32 nt, Human
aaugccaggaucguggcucacagggacccacc

SEQ ID NO: 29993 - RNA, 32 nt, Human
aaugccaggcccaagggacaaaaagaacagag

SEQ ID NO: 29994 - RNA, 32 nt, Human
aaugccaguacaacagccacaaggggucuucc

SEQ ID NO: 29995 - RNA, 32 nt, Human
aaugccagugcugcucagcccucagcagaacu

SEQ ID NO: 29996 - RNA, 32 nt, Human
aaugccaguguuacuccagcaggcaaccaaga

SEQ ID NO: 29997 - RNA, 32 nt, Human
aaugccauaacccuuuuuaaaucauccaucug

SEQ ID NO: 29998 - RNA, 21 nt, Human
aaugccaugcauuaggcuuug

SEQ ID NO: 29999 - RNA, 32 nt, Human
aaugccauggccgggugcaguggcucacgccu

SEQ ID NO: 30000 - RNA, 21 nt, Human
aaugccauuacccccagauug

SEQ ID NO: 30001 - RNA, 32 nt, Human
aaugcccaagaaggaagggauuguagaaauag

SEQ ID NO: 30002 - RNA, 32 nt, Human
aaugcccaagggacacucauugcugaaagcaa

SEQ ID NO: 30003 - RNA, 21 nt, Human
aaugcccaccuuggggcucug

SEQ ID NO: 30004 - RNA, 32 nt, Human
aaugcccacuggcuggcggcugucaguuaccg

SEQ ID NO: 30005 - RNA, 32 nt, Human
aaugcccaggaaauugacuuugcagugucacc

SEQ ID NO: 30006 - RNA, 32 nt, Human
aaugccccacugcacuccagccugggcgacag

SEQ ID NO: 30007 - RNA, 32 nt, Human
aaugccccagcugaugcuuucagcugggaaua

SEQ ID NO: 30008 - RNA, 32 nt, Human
aaugccccaggacaggcccacccaugggacca

SEQ ID NO: 30009 - RNA, 32 nt, Human
aaugccccauggggcucucuuguguacuuauu

SEQ ID NO: 30010 - RNA, 32 nt, Human
aaugcccccaaaauaugcagaccuuugggaau

SEQ ID NO: 30011 - RNA, 32 nt, Human
aaugcccccgaaggguggaaggcauugcuuuu

SEQ ID NO: 30012 - RNA, 32 nt, Human
aaugcccccucagaccagccgaggacugugcc

SEQ ID NO: 30013 - RNA, 32 nt, Human
aaugccccucccaacuucccauucauagaauc

SEQ ID NO: 30014 - RNA, 32 nt, Human
aaugccccucccccagcugcugccuucauauu

SEQ ID NO: 30015 - RNA, 32 nt, Human
aaugcccguauuaggaggauuacuugagcccu

SEQ ID NO: 30016 - RNA, 32 nt, Human
aaugcccucagcuaaaaggaaaacaaggugac

SEQ ID NO: 30017 - RNA, 32 nt, Human
aaugcccucaguggccacaucaugcccacucc

SEQ ID NO: 30018 - RNA, 32 nt, Human
aaugcccuccugucugugucguucucugugcc

SEQ ID NO: 30019 - RNA, 32 nt, Human
aaugcccugccugccugccugccaggccaagg

SEQ ID NO: 30020 - RNA, 32 nt, Human
aaugcccugcugcugcucaucucccuuuauuc

SEQ ID NO: 30021 - RNA, 32 nt, Human
aaugcccugggcaaccuguaacucacagcccu

SEQ ID NO: 30022 - RNA, 32 nt, Human
aaugcccugugcaugccauggucccuagacac

SEQ ID NO: 30023 - RNA, 32 nt, Human
aaugcccuuagguaagguaaaauaggaauaaa

SEQ ID NO: 30024 - RNA, 32 nt, Human
aaugcccuuccagugggaccccaaaccccaca

SEQ ID NO: 30025 - RNA, 32 nt, Human
aaugccgaagacugcauuucaacuucaagaau

SEQ ID NO: 30026 - RNA, 23 nt, Human
aaugccgccgccgccgccgccgc

SEQ ID NO: 30027 - RNA, 32 nt, Human
aaugccggacuggcccacuaaguuccugcuuc

SEQ ID NO: 30028 - RNA, 32 nt, Human
aaugccgggaggcugaggcgggagaaucgcuu

SEQ ID NO: 30029 - RNA, 32 nt, Human
aaugccgggauuacaggcaugagccaccgcuc

SEQ ID NO: 30030 - RNA, 32 nt, Human
aaugccuacccacucauauaacauaccucagg

SEQ ID NO: 30031 - RNA, 32 nt, Human
aaugccucaauucacauagauuucuucucuuu

SEQ ID NO: 30032 - RNA, 32 nt, Human
aaugccuccaaacucaagccuggguggguuuu

SEQ ID NO: 30033 - RNA, 32 nt, Human
aaugccuccugcucccccuccaugggcuguac

SEQ ID NO: 30034 - RNA, 32 nt, Human
aaugccuccugcugccccagccuuagagagcu

SEQ ID NO: 30035 - RNA, 32 nt, Human
aaugccuccuuugcuaggaaagggagcuuaau

SEQ ID NO: 30036 - RNA, 32 nt, Human
aaugccucuccacguugcauaugucacacuuu

SEQ ID NO: 30037 - RNA, 32 nt, Human
aaugccucuccucuauugauucaguuguuauu

SEQ ID NO: 30038 - RNA, 22 nt, Human
aaugccucugaagaggaagccu

SEQ ID NO: 30039 - RNA, 32 nt, Human
aaugccugagccugaaccuuaauguggggccu

SEQ ID NO: 30040 - RNA, 32 nt, Human
aaugccuggacucuccccuggcugguaucaaa

SEQ ID NO: 30041 - RNA, 32 nt, Human
aaugccuggagcugcuggucccugagagaaag

SEQ ID NO: 30042 - RNA, 32 nt, Human
aaugccuggauguuaaggauuccaauuuaacu

SEQ ID NO: 30043 - RNA, 32 nt, Human
aaugccuguccugccucuggccuguguccugg

SEQ ID NO: 30044 - RNA, 32 nt, Human
aaugccuguggucccagcuacaugggaggcug

SEQ ID NO: 30045 - RNA, 32 nt, Human
aaugccuuagacuauuugcuucccacugauag

SEQ ID NO: 30046 - RNA, 21 nt, Human
aaugccuuagagagaggaggg

SEQ ID NO: 30047 - RNA, 32 nt, Human
aaugccuuccacugcuccuuuaugacugcacu

SEQ ID NO: 30048 - RNA, 32 nt, Human
aaugccuucccugggaggaagggugcuuuccc

SEQ ID NO: 30049 - RNA, 32 nt, Human
aaugccuucucggggguggccacguacaccga

SEQ ID NO: 30050 - RNA, 32 nt, Human
aaugccuucuggaaggcggaauaugugggaac

SEQ ID NO: 30051 - RNA, 32 nt, Human
aaugccuucuguaguuucagaucaguagggag

SEQ ID NO: 30052 - RNA, 32 nt, Human
aaugccuugcaggagguagaggcuggacccau

SEQ ID NO: 30053 - RNA, 32 nt, Human
aaugccuuucaucuugaaguuacacauaacuu

SEQ ID NO: 30054 - RNA, 32 nt, Human
aaugccuuucugcaaagaagguuuccagagau

SEQ ID NO: 30055 - RNA, 32 nt, Human
aaugccuuuguuggcaccucagauuaaucaua

SEQ ID NO: 30056 - RNA, 32 nt, Human
aaugccuuuucucaccugucaucucacauuuu

SEQ ID NO: 30057 - RNA, 32 nt, Human
aaugcgacggagugugcauuacauuuggaaaa

SEQ ID NO: 30058 - RNA, 20 nt, Human
aaugcgagagaggagaaggg

SEQ ID NO: 30059 - RNA, 32 nt, Human
aaugcgagggccugggaugaauuuggugccuu

SEQ ID NO: 30060 - RNA, 32 nt, Human
aaugcgaguggauaaggcaagaugcauuugga

SEQ ID NO: 30061 - RNA, 32 nt, Human
aaugcgauacaaguaccccucacuuuggagag

SEQ ID NO: 30062 - RNA, 21 nt, Human
aaugcgauggacuugugcaaa

SEQ ID NO: 30063 - RNA, 31 nt, Human
aaugcgauggagugugcauuacauuuggaaa

SEQ ID NO: 30064 - RNA, 32 nt, Human
aaugcgccaagaugggcacaugcuugcuucag

SEQ ID NO: 30065 - RNA, 32 nt, Human
aaugcgccgucaccaucuccaccucccaccaa

SEQ ID NO: 30066 - RNA, 32 nt, Human
aaugcggaggcugggcacgguggcucaugccu

SEQ ID NO: 30067 - RNA, 32 nt, Human
aaugcggagugaaagagcaggagccagacaca

SEQ ID NO: 30068 - RNA, 32 nt, Human
aaugcggaugcccaacuguuuuuaaggaagcc

SEQ ID NO: 30069 - RNA, 32 nt, Human
aaugcggcacugacgggcaagugcuucugcaa

SEQ ID NO: 30070 - RNA, 32 nt, Human
aaugcggcucucugacccucucugugcccucc

SEQ ID NO: 30071 - RNA, 32 nt, Human
aaugcgggaacuccaggagcaugugaaaaggg

SEQ ID NO: 30072 - RNA, 32 nt, Human
aaugcggguaauauuuuuccucauguuuuaaa

SEQ ID NO: 30073 - RNA, 32 nt, Human
aaugcggucauuggagucgggggcuggaacau

SEQ ID NO: 30074 - RNA, 21 nt, Human
aaugcguagauagaagaagcc

SEQ ID NO: 30075 - RNA, 19 nt, Human
aaugcgugaaacccagggg

SEQ ID NO: 30076 - RNA, 32 nt, Human
aaugcgugagccaccaugcccggccgcuauug

SEQ ID NO: 30077 - RNA, 32 nt, Human
aaugcguguacaccuugugauauuauuaguaa

SEQ ID NO: 30078 - RNA, 32 nt, Human
aaugcguguggacagucaggaacacuuucagg

SEQ ID NO: 30079 - RNA, 32 nt, Human
aaugcguuaucacaggcagccuuuauccugau

SEQ ID NO: 30080 - RNA, 32 nt, Human
aaugcguucuuccuccaucuuugccuagucca

SEQ ID NO: 30081 - RNA, 32 nt, Human
aaugcuaaguuuuauuaaucuggucaucuuau

SEQ ID NO: 30082 - RNA, 23 nt, Human
aaugcuacacguguagguugcug

SEQ ID NO: 30083 - RNA, 32 nt, Human
aaugcuacagcggugugaaacagcagagcaaa

SEQ ID NO: 30084 - RNA, 32 nt, Human
aaugcuacaugauggccagcugcuucccuccu

SEQ ID NO: 30085 - RNA, 32 nt, Human
aaugcuaccauuucuuccucuggcucaaaauu

SEQ ID NO: 30086 - RNA, 32 nt, Human
aaugcuacccuuugaucauuuccuggccacca

SEQ ID NO: 30087 - RNA, 24 nt, Human
aaugcuacucuuuugugguuuacg

SEQ ID NO: 30088 - RNA, 32 nt, Human
aaugcuaggaggcagaaggggcagagaguaaa

SEQ ID NO: 30089 - RNA, 32 nt, Human
aaugcuaggccucuguugcauggcuguacaaa

SEQ ID NO: 30090 - RNA, 32 nt, Human
aaugcuaggcuggaaaguggugccuguugucc

SEQ ID NO: 30091 - RNA, 32 nt, Human
aaugcuaguuccagcuaaaaacaaguacuuuu

SEQ ID NO: 30092 - RNA, 21 nt, Human
aaugcuauacuggauacucug

SEQ ID NO: 30093 - RNA, 32 nt, Human
aaugcuauacuggauacucugcuccggaaaga

SEQ ID NO: 30094 - RNA, 19 nt, Human
aaugcuauacuguccugcu

SEQ ID NO: 30095 - RNA, 32 nt, Human
aaugcuaucuugugguuuugauuugcauuccc

SEQ ID NO: 30096 - RNA, 23 nt, Human
aaugcuauuucuaguuucucaga

SEQ ID NO: 30097 - RNA, 32 nt, Human
aaugcucaagagccuuaucauuuggcaaacaa

SEQ ID NO: 30098 - RNA, 32 nt, Human
aaugcucaauuucuacuucuucauuacaauuc

SEQ ID NO: 30099 - RNA, 32 nt, Human
aaugcucacaaaccuuggggcugccaucccca

SEQ ID NO: 30100 - RNA, 23 nt, Human
aaugcucauaccggagagaaacc

SEQ ID NO: 30101 - RNA, 32 nt, Human
aaugcuccuagaguauauuccucugcugaaca

SEQ ID NO: 30102 - RNA, 32 nt, Human
aaugcuccuccagggagucucagcuucacccu

SEQ ID NO: 30103 - RNA, 32 nt, Human
acaaagcuguaaaccagcuaugaaucagaaug

SEQ ID NO: 30104 - RNA, 32 nt, Human
acaaagcugugggagccaagaauaagacagaa

SEQ ID NO: 30105 - RNA, 19 nt, Human
acaaagcuuggaagagccu

SEQ ID NO: 30106 - RNA, 32 nt, Human
acaaagcuuguccuugaacccaauucuguuug

SEQ ID NO: 30107 - RNA, 32 nt, Human
acaaagcuugugccuugacuggacccguagcc

SEQ ID NO: 30108 - RNA, 32 nt, Human
acaaagcuuuccgugugaaaucaaaccuugaa

SEQ ID NO: 30109 - RNA, 32 nt, Human
acaaagcuuugccugccacuucugccuccaga

SEQ ID NO: 30110 - RNA, 32 nt, Human
acaaagcuuuucccaucuccagucucaguuuc

SEQ ID NO: 30111 - RNA, 32 nt, Human
acaaaggaaugagugaaugaguaaggagugaa

SEQ ID NO: 30112 - RNA, 32 nt, Human
acaaaggaauguuucacuaaauaaaagaaaac

SEQ ID NO: 30113 - RNA, 32 nt, Human
acaaaggacauggcacuuugugcugcuggcac

SEQ ID NO: 30114 - RNA, 32 nt, Human
acaaaggaccuagacagcccaccaagucacuu

SEQ ID NO: 30115 - RNA, 32 nt, Human
acaaaggagaaaaggaagugauuggagaauua

SEQ ID NO: 30116 - RNA, 32 nt, Human
acaaaggagagaaaggagggaaaagccagucu

SEQ ID NO: 30117 - RNA, 22 nt, Human
acaaaggagcccuuugcuccug

SEQ ID NO: 30118 - RNA, 32 nt, Human
acaaaggaggugggagacugcguuggugccgc

SEQ ID NO: 30119 - RNA, 32 nt, Human
acaaaggauccaggucucccgacgggagguua

SEQ ID NO: 30120 - RNA, 32 nt, Human
acaaaggaugguauuuaaaaauguagaacaca

SEQ ID NO: 30121 - RNA, 32 nt, Human
acaaaggcaaaggcuucauuucaagagucauc

SEQ ID NO: 30122 - RNA, 32 nt, Human
acaaaggcaaggagagcuggaguuggcuccau

SEQ ID NO: 30123 - RNA, 32 nt, Human
acaaaggcauugaaagacacacacccaggcaa

SEQ ID NO: 30124 - RNA, 32 nt, Human
acaaaggccaugggaaaaauucagagaguuag

SEQ ID NO: 30125 - RNA, 32 nt, Human
acaaaggccggcugcccccaaaggucucaacu

SEQ ID NO: 30126 - RNA, 32 nt, Human
acaaaggccucgaccuguugcgcugggccguc

SEQ ID NO: 30127 - RNA, 32 nt, Human
acaaaggcugagaagcagccacaccguuguuu

SEQ ID NO: 30128 - RNA, 32 nt, Human
acaaaggcugggugagccccugcugggcacgg

SEQ ID NO: 30129 - RNA, 32 nt, Human
acaaagggaggaggaagaagggagcggggucg

SEQ ID NO: 30130 - RNA, 32 nt, Human
acaaagggaucucuugcaugugcucaugggug

SEQ ID NO: 30131 - RNA, 32 nt, Human
acaaagggcagcuugaaaggggauguggagca

SEQ ID NO: 30132 - RNA, 32 nt, Human
acaaagggcccuguuucucagcaugagcuuca

SEQ ID NO: 30133 - RNA, 21 nt, Human
acaaaggggagagccaagcug

SEQ ID NO: 30134 - RNA, 32 nt, Human
acaaaggggauuuggugauggaggcuuuguua

SEQ ID NO: 30135 - RNA, 32 nt, Human
acaaaggggugaaagagagggaauaguuucuc

SEQ ID NO: 30136 - RNA, 32 nt, Human
acaaagggguggucacccugcccucaccuuga

SEQ ID NO: 30137 - RNA, 32 nt, Human
acaaaggucccucccucccucugacucuuugc

SEQ ID NO: 30138 - RNA, 32 nt, Human
acaaaggugacgggugguguagguacacaccc

SEQ ID NO: 30139 - RNA, 32 nt, Human
acaaaggugcagcuuuggccacuaucugccac

SEQ ID NO: 30140 - RNA, 31 nt, Human
acaaagguggaccugagaucacuggagccaa

SEQ ID NO: 30141 - RNA, 32 nt, Human
acaaagguuaaaaagaccaaaucaagcugagg

SEQ ID NO: 30142 - RNA, 32 nt, Human
acaaagguuugacugaaacuguggcagauguc

SEQ ID NO: 30143 - RNA, 20 nt, Human
acaaaguaaaagugagcagg

SEQ ID NO: 30144 - RNA, 32 nt, Human
acaaaguaagagggaaaggaaaagagguauca

SEQ ID NO: 30145 - RNA, 17 nt, Human
acaaaguacugagacaa

SEQ ID NO: 30146 - RNA, 32 nt, Human
acaaaguagcagaaauaggaugauguuuguga

SEQ ID NO: 30147 - RNA, 32 nt, Human
acaaagucaagucaauaugucauuucaauuuu

SEQ ID NO: 30148 - RNA, 32 nt, Human
acaaagucaccucacagcaucuugcuccacuc

SEQ ID NO: 30149 - RNA, 32 nt, Human
acaaagucagaguggcugggccaaguguccug

SEQ ID NO: 30150 - RNA, 32 nt, Human
acaaagucaggaguucaagaccagccgggcca

SEQ ID NO: 30151 - RNA, 32 nt, Human
acaaagucaggaguucaagaccagccuggcca

SEQ ID NO: 30152 - RNA, 32 nt, Human
acaaagucaggaguucgagaccagccuggcca

SEQ ID NO: 30153 - RNA, 32 nt, Human
acaaagucauaguaaaggucaggaguucaaga

SEQ ID NO: 30154 - RNA, 32 nt, Human
acaaagucccuccagcuuaucucccacaacaa

SEQ ID NO: 30155 - RNA, 32 nt, Human
acaaaguccuccucacagugccuggugugugg

SEQ ID NO: 30156 - RNA, 32 nt, Human
acaaagucgggagaucaagaccauccuggcua

SEQ ID NO: 30157 - RNA, 32 nt, Human
acaaagucucuuccucauucccguugaguucu

SEQ ID NO: 30158 - RNA, 32 nt, Human
acaaagucuuguguggucugggccacauccug

SEQ ID NO: 30159 - RNA, 32 nt, Human
acaaagugaaucagagaagagcagagggagug

SEQ ID NO: 30160 - RNA, 32 nt, Human
acaaagugacccuggagcguggaaaagcagac

SEQ ID NO: 30161 - RNA, 32 nt, Human
acaaagugagaguuacugccacucuguucuua

SEQ ID NO: 30162 - RNA, 32 nt, Human
acaaagugcugguccuuacaucaugccgagcc

SEQ ID NO: 30163 - RNA, 32 nt, Human
acaaagugggcggaucaccugaggucaggagu

SEQ ID NO: 30164 - RNA, 32 nt, Human
acaaaguggugauuuuugguuagggugaucgc

SEQ ID NO: 30165 - RNA, 32 nt, Human
acaaaguguucuccaucuccuuccccauuccu

SEQ ID NO: 30166 - RNA, 32 nt, Human
acaaaguguugacuguauggcauucaaaggga

SEQ ID NO: 30167 - RNA, 32 nt, Human
acaaaguucugcaugagaacaaaucugcauga

SEQ ID NO: 30168 - RNA, 32 nt, Human
acaaaguugccaagaugcuccuuguugacuuc

SEQ ID NO: 30169 - RNA, 32 nt, Human
acaaaguuggaccugggcuugagcuuacagac

SEQ ID NO: 30170 - RNA, 32 nt, Human
acaaaguuuucagucgcaaaucaagccuugaa

SEQ ID NO: 30171 - RNA, 32 nt, Human
acaaaguuuugggaaucaauucauacauauuu

SEQ ID NO: 30172 - RNA, 32 nt, Human
acaaauaaagaguuccugaucaccugaacaau

SEQ ID NO: 30173 - RNA, 32 nt, Human
acaaauaagcauugauuccugcauuucugaag

SEQ ID NO: 30174 - RNA, 32 nt, Human
acaaauaaugucuuccuuuucccccuucccgc

SEQ ID NO: 30175 - RNA, 32 nt, Human
acaaauaauuuuuaaaaauuagccaggcaugg

SEQ ID NO: 30176 - RNA, 32 nt, Human
acaaauacaaaugauauuuaacaaagauagag

SEQ ID NO: 30177 - RNA, 32 nt, Human
acaaauacaaggaauguggaaaagccauuauu

SEQ ID NO: 30178 - RNA, 32 nt, Human
acaaauacaauucagucuucucuuugggguuu

SEQ ID NO: 30179 - RNA, 32 nt, Human
acaaauacagcuuucugcuucuuucuuuuugg

SEQ ID NO: 30180 - RNA, 32 nt, Human
acaaauacaggauauuuauccagaagucuggc

SEQ ID NO: 30181 - RNA, 32 nt, Human
acaaauaccaacauccauccaaaaugaaaaag

SEQ ID NO: 30182 - RNA, 19 nt, Human
acaaauacuggaaaagcaa

SEQ ID NO: 30183 - RNA, 24 nt, Human
acaaauagaagcuucuugcuccug

SEQ ID NO: 30184 - RNA, 30 nt, Human
acaaauagaagcuucuugcuccuguuuaac

SEQ ID NO: 30185 - RNA, 32 nt, Human
acaaauagcagagugagccaggcggugccaaa

SEQ ID NO: 30186 - RNA, 32 nt, Human
acaaauagcagauuagucacauguacaagcau

SEQ ID NO: 30187 - RNA, 32 nt, Human
acaaauagcaugagugaaguggucagaagcag

SEQ ID NO: 30188 - RNA, 32 nt, Human
acaaauagguagauuucauguccguugagggg

SEQ ID NO: 30189 - RNA, 32 nt, Human
acaaauagguccugcauuuuauaagacuuuuu

SEQ ID NO: 30190 - RNA, 32 nt, Human
acaaauaucaaauuaagcaaguaaagaaaaag

SEQ ID NO: 30191 - RNA, 32 nt, Human
acaaauaugcgucccccucucuuccaauaucc

SEQ ID NO: 30192 - RNA, 32 nt, Human
acaaauaugcuuguggcauccuguaauucauu

SEQ ID NO: 30193 - RNA, 32 nt, Human
acaaauauggugguacagauaugucuucaagu

SEQ ID NO: 30194 - RNA, 20 nt, Human
acaaauauuaaagcacuuga

SEQ ID NO: 30195 - RNA, 32 nt, Human
acaaauauugaacauuuguaugugccuuguac

SEQ ID NO: 30196 - RNA, 32 nt, Human
acaaaucaauggauucaagacaggguauugaa

SEQ ID NO: 30197 - RNA, 31 nt, Human
acaaaucacagcugauagacagcgaagccuu

SEQ ID NO: 30198 - RNA, 32 nt, Human
acaaaucacucccaugaugagacccuggagga

SEQ ID NO: 30199 - RNA, 32 nt, Human
acaaaucagaagcagaugcugauugggaccca

SEQ ID NO: 30200 - RNA, 32 nt, Human
acaaaucagagcugaguggggaggugcuucag

SEQ ID NO: 30201 - RNA, 32 nt, Human
acaaaucagcaucuuuuuccccuucccugcuu

SEQ ID NO: 30202 - RNA, 32 nt, Human
acaaaucagcguaguuacaaaggggucagucu

SEQ ID NO: 30203 - RNA, 32 nt, Human
acaaauccaagguccaacagccuggauuaucu

SEQ ID NO: 30204 - RNA, 32 nt, Human
acaaauccagaagcaaagagauaguaggaccc

SEQ ID NO: 30205 - RNA, 32 nt, Human
acaaauccagagugcagacuucacaggugggg

SEQ ID NO: 30206 - RNA, 32 nt, Human
acaaauccaugagugagagggaaagucuagua

SEQ ID NO: 30207 - RNA, 32 nt, Human
acaaauccucagauuuagugggaagcuggaaa

SEQ ID NO: 30208 - RNA, 32 nt, Human
acaaauccugcucuggucucuggccccacaga

SEQ ID NO: 30209 - RNA, 32 nt, Human
acaaauccuggugaccugcucucccaagaaca

SEQ ID NO: 30210 - RNA, 32 nt, Human
acaaaucgagggagggagggagaagagucaca

SEQ ID NO: 30211 - RNA, 32 nt, Human
acaaaucuauacagcauguugcuguacugaau

SEQ ID NO: 30212 - RNA, 32 nt, Human
acaaaucucaccccuucucuccugcaaauuag

SEQ ID NO: 30213 - RNA, 32 nt, Human
acaaaucuccagccugccuggaaaugcugugg

SEQ ID NO: 30214 - RNA, 32 nt, Human
acaaaucucuaggagauucugccaaaggauuu

SEQ ID NO: 30215 - RNA, 32 nt, Human
acaaaucucuccucugccuucuccuuaucaga

SEQ ID NO: 30216 - RNA, 32 nt, Human
acaaaucuuagcaaucucucaaugccuuuuca

SEQ ID NO: 30217 - RNA, 31 nt, Human
acaaaucuuaugugaagaaaagacugguaug

SEQ ID NO: 30218 - RNA, 32 nt, Human
acaaaucuuucucuuccuuaucuuaugauggu

SEQ ID NO: 30219 - RNA, 32 nt, Human
acaaaucuuucuuuuccucugugaaagaaucc

SEQ ID NO: 30220 - RNA, 32 nt, Human
acaaaugaacacuuauuuguauuugaauugca

SEQ ID NO: 30221 - RNA, 32 nt, Human
acaaaugacaacaucauuacccucagcuuuua

SEQ ID NO: 30222 - RNA, 17 nt, Human
acaaaugacauauguug

SEQ ID NO: 30223 - RNA, 32 nt, Human
acaaaugagauggacuuaaagagcacauccug

SEQ ID NO: 30224 - RNA, 32 nt, Human
acaaaugaggguguaauugaguuucgcuccua

SEQ ID NO: 30225 - RNA, 31 nt, Human
acaaaugauaaaggaacucauuuaucaauag

SEQ ID NO: 30226 - RNA, 32 nt, Human
acaaaugcacacacaugcacacacacauuuca

SEQ ID NO: 30227 - RNA, 32 nt, Human
acaaaugcaucauugcacuccagccuggguga

SEQ ID NO: 30228 - RNA, 32 nt, Human
acaaaugccaguuccaggugauuagaaaggcc

SEQ ID NO: 30229 - RNA, 32 nt, Human
acaaaugccuccaaacucaagccugggugggu

SEQ ID NO: 30230 - RNA, 32 nt, Human
acaaaugccuccuuugcuaggaaagggagcuu

SEQ ID NO: 30231 - RNA, 32 nt, Human
acaaaugcuccuccuccaugcucccuuaaucc

SEQ ID NO: 30232 - RNA, 32 nt, Human
acaaaugcugagccguucuugcucugaaacug

SEQ ID NO: 30233 - RNA, 32 nt, Human
acaaaugcuuauuuuuauuguugcuauuuuca

SEQ ID NO: 30234 - RNA, 20 nt, Human
acaaauggacuucccugaug

SEQ ID NO: 30235 - RNA, 32 nt, Human
acaaauggccaacaggcaucugaagaggagcu

SEQ ID NO: 30236 - RNA, 32 nt, Human
acaaauggcccuacuucucucauucaacuaac

SEQ ID NO: 30237 - RNA, 32 nt, Human
acaaauggccucuaacguugcaaagaauaaug

SEQ ID NO: 30238 - RNA, 32 nt, Human
acaaauggcugccauggaaagucgugcuuccc

SEQ ID NO: 30239 - RNA, 32 nt, Human
acaaauggcuguagaggucuuagauaacaccu

SEQ ID NO: 30240 - RNA, 32 nt, Human
acaaauggcuguggguacauggggagggaccu

SEQ ID NO: 30241 - RNA, 32 nt, Human
acaaaugggauuucuacugccaguggcucagc

SEQ ID NO: 30242 - RNA, 31 nt, Human
acaaauggugagagagaaggcaucugacauu

SEQ ID NO: 30243 - RNA, 32 nt, Human
acaaauggugagagagaaggcaucugacauuu

SEQ ID NO: 30244 - RNA, 24 nt, Human
acaaaugguucccaaugugacuga

SEQ ID NO: 30245 - RNA, 32 nt, Human
acaaauguacauuguuacagggcugcuuccua

SEQ ID NO: 30246 - RNA, 32 nt, Human
acaaauguauguuuuuauugauuuuuacuuua

SEQ ID NO: 30247 - RNA, 32 nt, Human
acaaaugucaacucuguuauaauuaauacaga

SEQ ID NO: 30248 - RNA, 32 nt, Human
acaaaugucauugucuacuccuagaagaacca

SEQ ID NO: 30249 - RNA, 32 nt, Human
acaaaugucuguucccuggaggccaguccagu

SEQ ID NO: 30250 - RNA, 32 nt, Human
acaaauguguaugagaaacaaugaggaggauu

SEQ ID NO: 30251 - RNA, 32 nt, Human
acaaauguucagaauucucaccaccuucuggu

SEQ ID NO: 30252 - RNA, 32 nt, Human
acaaauguuuuuauacaaaugaauuuucuaca

SEQ ID NO: 30253 - RNA, 32 nt, Human
acaaauuaggggguagaaaggagcaguggugu

SEQ ID NO: 30254 - RNA, 32 nt, Human
acaaauuauagcauaacauacagacuuuugca

SEQ ID NO: 30255 - RNA, 32 nt, Human
acaaauuaucuuacagacacaaaaagaaauac

SEQ ID NO: 30256 - RNA, 22 nt, Human
acaaauucaaauguuuaugcca

SEQ ID NO: 30257 - RNA, 32 nt, Human
acaaauucauucccuucucucagccuccacuc

SEQ ID NO: 30258 - RNA, 32 nt, Human
acaaauucugguucugcaacuuccuagcguga

SEQ ID NO: 30259 - RNA, 32 nt, Human
acaaauugaaaacuuccccaaagcuuucacag

SEQ ID NO: 30260 - RNA, 32 nt, Human
acaaauugaacucucucuuagacuggauuugg

SEQ ID NO: 30261 - RNA, 32 nt, Human
acaaauugaucagaagaagauugauuauuucc

SEQ ID NO: 30262 - RNA, 32 nt, Human
acaaauuggguuagcuacaucucugcuaaaca

SEQ ID NO: 30263 - RNA, 22 nt, Human
acaaauuuauuggcauuuaaua

SEQ ID NO: 30264 - RNA, 32 nt, Human
acaaauuucauuuccauuuaagcaauuuguaa

SEQ ID NO: 30265 - RNA, 32 nt, Human
acaaauuuggaauucacuggcuucacuuaauc

SEQ ID NO: 30266 - RNA, 32 nt, Human
acaaauuuggaggugagagcuuugccagaccc

SEQ ID NO: 30267 - RNA, 24 nt, Human
acaaauuuuaaggcuagcucuuca

SEQ ID NO: 30268 - RNA, 32 nt, Human
acaaauuuuaaugccagacauuuaaggagagg

SEQ ID NO: 30269 - RNA, 32 nt, Human
acaaauuuucauuuugcaguuccagagcugcu

SEQ ID NO: 30270 - RNA, 32 nt, Human
acaacaaaauuagcugggcaugauggugggug

SEQ ID NO: 30271 - RNA, 32 nt, Human
acaacaaacugccccucacuacuggcuugguu

SEQ ID NO: 30272 - RNA, 32 nt, Human
acaacaaaugagccacugcgcccggccauaaa

SEQ ID NO: 30273 - RNA, 32 nt, Human
acaacaacaacaaaaacccuauuccuugccuu

SEQ ID NO: 30274 - RNA, 32 nt, Human
acaacaacaacaaaaagcuuccccaacuaaag

SEQ ID NO: 30275 - RNA, 32 nt, Human
acaacaacaacaaaacaacacauuggucuggc

SEQ ID NO: 30276 - RNA, 32 nt, Human
acaacaacaacaaaacaccucugucaauguaa

SEQ ID NO: 30277 - RNA, 32 nt, Human
acaacaacaacaaaacggcaguauauuugucc

SEQ ID NO: 30278 - RNA, 32 nt, Human
acaacaacaacaacaaaaacccuauuccuugc

SEQ ID NO: 30279 - RNA, 32 nt, Human
acaacaacaacaacaaaacuuccuaggccaga

SEQ ID NO: 30280 - RNA, 32 nt, Human
acaacaacacaaaccacacacacucgcacaca

SEQ ID NO: 30281 - RNA, 32 nt, Human
acaacaaccacaaaaucuaaaaauuagcuggg

SEQ ID NO: 30282 - RNA, 32 nt, Human
acaacaaccagcuccaacugacucuggucuug

SEQ ID NO: 30283 - RNA, 32 nt, Human
acaacaaccuagacauguggggugcuccaugg

SEQ ID NO: 30284 - RNA, 32 nt, Human
acaacaaccugcaugcucacaauacccagaca

SEQ ID NO: 30285 - RNA, 32 nt, Human
acaacaacuccuagggccacugaagauauaac

SEQ ID NO: 30286 - RNA, 32 nt, Human
acaacaagaauagaguugaugagcccucuucu

SEQ ID NO: 30287 - RNA, 32 nt, Human
acaacaagacuacaaugcuucucuccaagcaa

SEQ ID NO: 30288 - RNA, 32 nt, Human
acaacaaguccuugaacccaggccaugugguu

SEQ ID NO: 30289 - RNA, 32 nt, Human
acaacaaucacugcagucagcucacaggaagc

SEQ ID NO: 30290 - RNA, 32 nt, Human
acaacaauuagccuggcgugguggugugcacc

SEQ ID NO: 30291 - RNA, 32 nt, Human
acaacaauuuggaacaugaaaaugaaaggcaa

SEQ ID NO: 30292 - RNA, 23 nt, Human
acaacacacacgcugcuguaucu

SEQ ID NO: 30293 - RNA, 31 nt, Human
acaacacacaucugggacaggagggaauccg

SEQ ID NO: 30294 - RNA, 31 nt, Human
acaacacacaucugggacaggagggaaugcg

SEQ ID NO: 30295 - RNA, 32 nt, Human
acaacacacaucugggacaggagggaaugcgg

SEQ ID NO: 30296 - RNA, 32 nt, Human
acaacacaccucaccucacaccacagcacacc

SEQ ID NO: 30297 - RNA, 32 nt, Human
acaacacagaugcucacccgcacacagaggca

SEQ ID NO: 30298 - RNA, 32 nt, Human
acaacacagcugccguuucuucugccugcuua

SEQ ID NO: 30299 - RNA, 32 nt, Human
acaacacaguauccgggccuccuggccuggaa

SEQ ID NO: 30300 - RNA, 32 nt, Human
acaacacauggccaugccugaccucugugggg

SEQ ID NO: 30301 - RNA, 32 nt, Human
acaacaccagccugaccaacauggugaaaccc

SEQ ID NO: 30302 - RNA, 32 nt, Human
acaacaccauguggucuggaggucccagcccc

SEQ ID NO: 30303 - RNA, 22 nt, Human
acaacaccauuugagaaagagg

SEQ ID NO: 30304 - RNA, 32 nt, Human
acaacacccaacaacaggaagaaaucucaaaa

SEQ ID NO: 30305 - RNA, 32 nt, Human
acaacacccagccuuuaacgugccuuucugac

SEQ ID NO: 30306 - RNA, 25 nt, Human
acaacaccgacgucuccaucggcca

SEQ ID NO: 30307 - RNA, 32 nt, Human
acaacaccgcuugagcaacuggaauauguuug

SEQ ID NO: 30308 - RNA, 32 nt, Human
acaacaccucauucuuaacuguguggccaaug

SEQ ID NO: 30309 - RNA, 32 nt, Human
acaacacgcuuggcucuccauucucccagucg

SEQ ID NO: 30310 - RNA, 32 nt, Human
acaacacguuugucaggaaauggaguugaaga

SEQ ID NO: 30311 - RNA, 32 nt, Human
acaacacuauauuuuuaugcuacuuuccuguu

SEQ ID NO: 30312 - RNA, 32 nt, Human
acaacacugcuggacugcuccuggcucuguca

SEQ ID NO: 30313 - RNA, 32 nt, Human
acaacacuucauuuucaggaaaucuacuuccu

SEQ ID NO: 30314 - RNA, 32 nt, Human
acaacagaaaauuuggacagacuucaauuugc

SEQ ID NO: 30315 - RNA, 32 nt, Human
acaacagaagauacaggaagggagaggugucu

SEQ ID NO: 30316 - RNA, 32 nt, Human
acaacagagacggaugguguuucugagaggaa

SEQ ID NO: 30317 - RNA, 32 nt, Human
acaacagagaugguugaucugaucuuagcuca

SEQ ID NO: 30318 - RNA, 18 nt, Human
acaacagagucucaggga

SEQ ID NO: 30319 - RNA, 32 nt, Human
acaacagaguggcugaaagucacaccucucca

SEQ ID NO: 30320 - RNA, 32 nt, Human
acaacagaucaagaaguauggcagugacaacu

SEQ ID NO: 30321 - RNA, 32 nt, Human
acaacagaugcuggagagaauguggagaaaua

SEQ ID NO: 30322 - RNA, 32 nt, Human
acaacagcaagaaaaucucauuuaucuuuaua

SEQ ID NO: 30323 - RNA, 32 nt, Human
acaacagcacccgccucacaggcuaagaggcu

SEQ ID NO: 30324 - RNA, 32 nt, Human
acaacagcagaggcucaucuacaguggcaaac

SEQ ID NO: 30325 - RNA, 32 nt, Human
acaacagccacaaccucccugcuggucuccca

SEQ ID NO: 30326 - RNA, 32 nt, Human
acaacagccuccacaggcacagcuccaucguu

SEQ ID NO: 30327 - RNA, 32 nt, Human
acaacagcgaugaagagaacugugagaauaca

SEQ ID NO: 30328 - RNA, 32 nt, Human
acaacagcguuccccaugaucaagcacccuac

SEQ ID NO: 30329 - RNA, 32 nt, Human
acaacaggagaaacacccaaagagggccagag

SEQ ID NO: 30330 - RNA, 32 nt, Human
acaacaggcgcccgucaccacgcccagcuaau

SEQ ID NO: 30331 - RNA, 32 nt, Human
acaacaggguggggugggaggggaggagacau

SEQ ID NO: 30332 - RNA, 32 nt, Human
acaacagguugcgaacuggcugccugugucuu

SEQ ID NO: 30333 - RNA, 32 nt, Human
acaacagguuucaugcucuugugcacauccaa

SEQ ID NO: 30334 - RNA, 32 nt, Human
acaacaguguguuagcucugucuuagcaaccu

SEQ ID NO: 30335 - RNA, 32 nt, Human
acaacaguucuuguuagaaucaugggaugugu

SEQ ID NO: 30336 - RNA, 32 nt, Human
acaacauaaccagcgccccucccuucaccagu

SEQ ID NO: 30337 - RNA, 32 nt, Human
acaacauaagcauagugcaaggagcuccauuu

SEQ ID NO: 30338 - RNA, 32 nt, Human
acaacauaauacauguucauauacaaacauuu

SEQ ID NO: 30339 - RNA, 32 nt, Human
acaacauaggccagggccaacaaaguggagag

SEQ ID NO: 30340 - RNA, 32 nt, Human
acaacauaugaagcuuaggagugaagagacuu

SEQ ID NO: 30341 - RNA, 32 nt, Human
acaacaucaagaaaacagcaagggagagaauc

SEQ ID NO: 30342 - RNA, 32 nt, Human
acaacauccugggauugggacccacuuucugg

SEQ ID NO: 30343 - RNA, 32 nt, Human
acaacaucugcugacacuauugcacaguguuu

SEQ ID NO: 30344 - RNA, 32 nt, Human
acaacaugcaaucuuugucuuugcuucuggcc

SEQ ID NO: 30345 - RNA, 32 nt, Human
acaacauggaaagagccaaaaugucacaguuc

SEQ ID NO: 30346 - RNA, 20 nt, Human
acaacauggaaaugguccaa

SEQ ID NO: 30347 - RNA, 32 nt, Human
acaacauguaaacuggugagccuggcugugug

SEQ ID NO: 30348 - RNA, 32 nt, Human
acaacaugugggcuuccuguagcuccagggac

SEQ ID NO: 30349 - RNA, 32 nt, Human
acaacauuacaaaggaaggaggagggaagaga

SEQ ID NO: 30350 - RNA, 32 nt, Human
acaacauucucccucucccuguuuucacuuuc

SEQ ID NO: 30351 - RNA, 32 nt, Human
acaacauuggggaacccaggagcuuccagucc

SEQ ID NO: 30352 - RNA, 32 nt, Human
acaacauuuaugucacuccccaccuccucaua

SEQ ID NO: 30353 - RNA, 19 nt, Human
acaaccaagaaaauccauu

SEQ ID NO: 30354 - RNA, 20 nt, Human
acaaccaauuuacauggaaa

SEQ ID NO: 30355 - RNA, 32 nt, Human
acaaccacaaaaucuaaaaauuagcugggugu

SEQ ID NO: 30356 - RNA, 32 nt, Human
acaaccacaaccaacaccacaaaccuuucagc

SEQ ID NO: 30357 - RNA, 32 nt, Human
acaaccacacacugcaugcacacacauacacc

SEQ ID NO: 30358 - RNA, 32 nt, Human
acaaccacaggccgaaccacagaucuggaggc

SEQ ID NO: 30359 - RNA, 32 nt, Human
acaaccaccuccagccugggagauagccuugc

SEQ ID NO: 30360 - RNA, 32 nt, Human
acaaccaccuggcaauaugacucacuugaccc

SEQ ID NO: 30361 - RNA, 17 nt, Human
acaaccaccuucaccug

SEQ ID NO: 30362 - RNA, 32 nt, Human
acaaccaccuuucacauauccugcugggauca

SEQ ID NO: 30363 - RNA, 18 nt, Human
acaaccacucaggccuuu

SEQ ID NO: 30364 - RNA, 32 nt, Human
acaaccacucaggccuuucuggcccaccugga

SEQ ID NO: 30365 - RNA, 32 nt, Human
acaaccagaggaggaggaggacagagggagag

SEQ ID NO: 30366 - RNA, 32 nt, Human
acaaccagagguggcaggagaauuucuacuga

SEQ ID NO: 30367 - RNA, 32 nt, Human
acaaccagaucaaagcuagaaaauggauuccu

SEQ ID NO: 30368 - RNA, 32 nt, Human
acaaccagcaagucccugccccucucugaagc

SEQ ID NO: 30369 - RNA, 32 nt, Human
acaaccagcuuuuaaagaaggugaauuccaau

SEQ ID NO: 30370 - RNA, 32 nt, Human
acaaccaggaggagcuuggaggcugaacaccc

SEQ ID NO: 30371 - RNA, 32 nt, Human
acaaccaggccuagccccagacagccccagcc

SEQ ID NO: 30372 - RNA, 32 nt, Human
acaaccaguucugccggagacuuccauuuggc

SEQ ID NO: 30373 - RNA, 32 nt, Human
acaaccauaagcaagacaugcccaggguuugc

SEQ ID NO: 30374 - RNA, 32 nt, Human
acaaccaucuggguugcucaaguagaugccca

SEQ ID NO: 30375 - RNA, 31 nt, Human
acaaccauggacacaaagcugaacaugcuga

SEQ ID NO: 30376 - RNA, 32 nt, Human
acaaccauuccagagaucuccuuggagccacc

SEQ ID NO: 30377 - RNA, 32 nt, Human
acaaccauuuuucucuucuuccuuccuaggga

SEQ ID NO: 30378 - RNA, 31 nt, Human
acaacccaaauguccauccacagaugaauua

SEQ ID NO: 30379 - RNA, 32 nt, Human
acaacccaacaagcuuaacacccaccauccag

SEQ ID NO: 30380 - RNA, 32 nt, Human
acaacccaagauuaagaggccaggaagagguu

SEQ ID NO: 30381 - RNA, 31 nt, Human
acaacccaaguguccagcuacagaugaacgg

SEQ ID NO: 30382 - RNA, 31 nt, Human
acaacccaaguguccauggauggaugaaugg

SEQ ID NO: 30383 - RNA, 32 nt, Human
acaacccacacacaccaccaucucacuggguc

SEQ ID NO: 30384 - RNA, 32 nt, Human
acaacccacaguuaagaacaucaaguuauaag

SEQ ID NO: 30385 - RNA, 32 nt, Human
acaacccacauccuccauccugacugcagcau

SEQ ID NO: 30386 - RNA, 32 nt, Human
acaacccagccaaacaccacagccuucuccag

SEQ ID NO: 30387 - RNA, 32 nt, Human
acaaccccaccagcaaggaggucuuuuaguuc

SEQ ID NO: 30388 - RNA, 32 nt, Human
acaaccccagaggaugagauaaaugggaacug

SEQ ID NO: 30389 - RNA, 32 nt, Human
acaacccccagccucagcuucccugacagggc

SEQ ID NO: 30390 - RNA, 32 nt, Human
acaacccccaggcucacagcaguggcuucuag

SEQ ID NO: 30391 - RNA, 22 nt, Human
acaacccccgaauguuuuuaua

SEQ ID NO: 30392 - RNA, 32 nt, Human
acaacccccugccaacuauaucuggcugcaau

SEQ ID NO: 30393 - RNA, 32 nt, Human
acaaccccugaacaauggaggccuuucuuucc

SEQ ID NO: 30394 - RNA, 32 nt, Human
acaaccccuguugcccguagaggagccaacag

SEQ ID NO: 30395 - RNA, 32 nt, Human
acaacccggaaagaaccaucacugugaagggc

SEQ ID NO: 30396 - RNA, 32 nt, Human
acaacccucaacuugaggaaguugagagcucc

SEQ ID NO: 30397 - RNA, 24 nt, Human
acaacccugaagacaacaaggaaa

SEQ ID NO: 30398 - RNA, 32 nt, Human
acaacccugacgggagcauggagcugcugucc

SEQ ID NO: 30399 - RNA, 32 nt, Human
acaacccugccucccacaguuccuccccuaau

SEQ ID NO: 30400 - RNA, 22 nt, Human
acaacccuggcuccaauugcca

SEQ ID NO: 30401 - RNA, 32 nt, Human
acaacccugggcaaguaaugugcaaaagaugg

SEQ ID NO: 30402 - RNA, 32 nt, Human
acaacccuuccagagcagggcugacagcccug

SEQ ID NO: 30403 - RNA, 32 nt, Human
acaaccgcugacaaggagagugagugauguuu

SEQ ID NO: 30404 - RNA, 21 nt, Human
acaaccuaauaauuucuuaua

SEQ ID NO: 30405 - RNA, 32 nt, Human
acaaccucaaggugccaaaaaguuaaugagua

SEQ ID NO: 30406 - RNA, 32 nt, Human
acaaccucagcagcuucucccugucuuccucu

SEQ ID NO: 30407 - RNA, 32 nt, Human
acaaccucccaagauugaaccaggaagaaacu

SEQ ID NO: 30408 - RNA, 32 nt, Human
acaaccuccuuugguccaacuccugcugagcu

SEQ ID NO: 30409 - RNA, 32 nt, Human
acaaccucuccaccaucuacccgggcacuuuc

SEQ ID NO: 30410 - RNA, 32 nt, Human
acaaccugaaaugcugagggcagcaggaggaa

SEQ ID NO: 30411 - RNA, 32 nt, Human
acaaccugaagucugcagucugccacacagaa

SEQ ID NO: 30412 - RNA, 32 nt, Human
acaaccugcaccugacuagcuuuuuggccauu

SEQ ID NO: 30413 - RNA, 32 nt, Human
acaaccugcacuggggccggagggcagccagc

SEQ ID NO: 30414 - RNA, 21 nt, Human
acaaccugcucuugcggaagg

SEQ ID NO: 30415 - RNA, 32 nt, Human
acaaccugcuugucuguggcccaccugucaca

SEQ ID NO: 30416 - RNA, 32 nt, Human
acaaccugggcaacauggcgaaacccugucuc

SEQ ID NO: 30417 - RNA, 32 nt, Human
acaaccugggcaacauggugaaacccugucuu

SEQ ID NO: 30418 - RNA, 32 nt, Human
acaaccugguaugggagccaggaguccuggca

SEQ ID NO: 30419 - RNA, 32 nt, Human
acaaccugguguaugacaccucggacagcgau

SEQ ID NO: 30420 - RNA, 32 nt, Human
acaaccuucccuccccuucccacuccuuccgg

SEQ ID NO: 30421 - RNA, 32 nt, Human
acaaccuuggacuccagcuggcagcugaaaug

SEQ ID NO: 30422 - RNA, 32 nt, Human
acaaccuuugccggcccugcuucugccccucc

SEQ ID NO: 30423 - RNA, 23 nt, Human
acaaccuuugcucugaaauucca

SEQ ID NO: 30424 - RNA, 32 nt, Human
acaacgaacagcuggcuagacuggagaagagg

SEQ ID NO: 30425 - RNA, 32 nt, Human
acaacgagcuugccauugaucugcaacaaacg

SEQ ID NO: 30426 - RNA, 32 nt, Human
acaacgaggagaaagaugaggaccacugcagc

SEQ ID NO: 30427 - RNA, 32 nt, Human
acaacgaggagucuguuccuccccgcaccucc

SEQ ID NO: 30428 - RNA, 32 nt, Human
acaacgaggaucaugggagaccaccuggaccu

SEQ ID NO: 30429 - RNA, 32 nt, Human
acaacgauggguggaaauggcugugggagaag

SEQ ID NO: 30430 - RNA, 32 nt, Human
acaacgcaauagugacaugagcacuugacucg

SEQ ID NO: 30431 - RNA, 32 nt, Human
acaacgcagggugcgcuggguugggacguggg

SEQ ID NO: 30432 - RNA, 32 nt, Human
acaacgccaacagaagcacauuugucuuccag

SEQ ID NO: 30433 - RNA, 32 nt, Human
acaacgccuggcuaaguuuuuguauuuuuagu

SEQ ID NO: 30434 - RNA, 32 nt, Human
acaacgcugaggccacgagcuccuggguagcu

SEQ ID NO: 30435 - RNA, 32 nt, Human
acaacggaagagaccucccgcuggggccgggc

SEQ ID NO: 30436 - RNA, 32 nt, Human
acaacggccagaaccauacaccagagacacac

SEQ ID NO: 30437 - RNA, 32 nt, Human
acaacgguggugggagggagagcggccuccuc

SEQ ID NO: 30438 - RNA, 32 nt, Human
acaacguaggccuaaucacagcacuuugggag

SEQ ID NO: 30439 - RNA, 32 nt, Human
acaacgucagccaccccugcgccucggccccg

SEQ ID NO: 30440 - RNA, 32 nt, Human
acaacgucugcgucccccacaggacggcucug

SEQ ID NO: 30441 - RNA, 32 nt, Human
acaacgugggcuguggcuucagagggugcaag

SEQ ID NO: 30442 - RNA, 32 nt, Human
acaacguuuaugaaccugccguuugcuuugua

SEQ ID NO: 30443 - RNA, 32 nt, Human
acaacuaaagcuuugucauagacuucaaaaua

SEQ ID NO: 30444 - RNA, 32 nt, Human
acaacuaagauccuaaauguuuuaauuagugu

SEQ ID NO: 30445 - RNA, 32 nt, Human
acaacuaauaaacacuguauguguacauauuc

SEQ ID NO: 30446 - RNA, 32 nt, Human
acaacuaauuccugccuuucguccaguaccaa

SEQ ID NO: 30447 - RNA, 32 nt, Human
acaacuacaaaugaccuauacagagaagaaaa

SEQ ID NO: 30448 - RNA, 32 nt, Human
acaacuacagucuggccaagugugguggcuca

SEQ ID NO: 30449 - RNA, 21 nt, Human
acaacuacgugagcuuggaag

SEQ ID NO: 30450 - RNA, 23 nt, Human
acaacuacuaucuagguuugaag

SEQ ID NO: 30451 - RNA, 32 nt, Human
acaacuagaagcugcaacgacuguguggcucu

SEQ ID NO: 30452 - RNA, 32 nt, Human
acaacucaguggccugaacacacaccuucagc

SEQ ID NO: 30453 - RNA, 32 nt, Human
acaacucaucacaugugauagauugcagugga

SEQ ID NO: 30454 - RNA, 32 nt, Human
acaacucaugaaaucugcucugggacauuuug

SEQ ID NO: 30455 - RNA, 32 nt, Human
acaacucaugccacaguaugucgucuucaugu

SEQ ID NO: 30456 - RNA, 20 nt, Human
acaacuccaucuucugcugc

SEQ ID NO: 30457 - RNA, 32 nt, Human
acaacucccugaggccucuccgcaccaccuca

SEQ ID NO: 30458 - RNA, 32 nt, Human
acaacucccuuccccaugcacacaucuggaag

SEQ ID NO: 30459 - RNA, 32 nt, Human
acaacuccuccuccuccuccuccucuccugcu

SEQ ID NO: 30460 - RNA, 32 nt, Human
acaacucuagauggagugggccagcaguagcu

SEQ ID NO: 30461 - RNA, 32 nt, Human
acaacucugaugcugagcagggaauacucuaa

SEQ ID NO: 30462 - RNA, 32 nt, Human
acaacucuggaagcagaaacaggugugugcuu

SEQ ID NO: 30463 - RNA, 32 nt, Human
acaacucuuagagguagguguauucccguuuu

SEQ ID NO: 30464 - RNA, 32 nt, Human
acaacugaaagagagauuggaggcuuuuacaa

SEQ ID NO: 30465 - RNA, 32 nt, Human
acaacugaagugaugguguggacauagagaga

SEQ ID NO: 30466 - RNA, 32 nt, Human
acaacugacaacauugguuuucugcagcuagg

SEQ ID NO: 30467 - RNA, 32 nt, Human
acaacugacuugugugggugaggcuugcagaa

SEQ ID NO: 30468 - RNA, 32 nt, Human
acaacugaggcagaguagagugcuggccaauu

SEQ ID NO: 30469 - RNA, 23 nt, Human
acaacugcacuccagcuugggca

SEQ ID NO: 30470 - RNA, 31 nt, Human
acaacugcacuuuagaauaccagcagugaaa

SEQ ID NO: 30471 - RNA, 32 nt, Human
acaacugccuguuuccuccaccuccaccccca

SEQ ID NO: 30472 - RNA, 32 nt, Human
acaacugcguucuggcuaacacuguuggaccu

SEQ ID NO: 30473 - RNA, 32 nt, Human
acaacugcuuguucccagaggauucugauuuu

SEQ ID NO: 30474 - RNA, 32 nt, Human
acaacuggaaacagcaggaagugcuagaaaau

SEQ ID NO: 30475 - RNA, 32 nt, Human
acaacuggacugcgguugauugccaguuugug

SEQ ID NO: 30476 - RNA, 32 nt, Human
acaacuggccagccucugcccacuugaccccg

SEQ ID NO: 30477 - RNA, 32 nt, Human
acaacuggcccuugguucccaccacacugagg

SEQ ID NO: 30478 - RNA, 32 nt, Human
acaacuggggaccugggcagcaagcuucacac

SEQ ID NO: 30479 - RNA, 32 nt, Human
acaacuggggucccccaaaacucaguccuggc

SEQ ID NO: 30480 - RNA, 32 nt, Human
acaacugguacaaggcccagcugcaguguccc

SEQ ID NO: 30481 - RNA, 32 nt, Human
acaacugguagugaaauucagagcagaaugca

SEQ ID NO: 30482 - RNA, 32 nt, Human
acaacugucaucugaaggacucuucuagaagc

SEQ ID NO: 30483 - RNA, 22 nt, Human
acaacugucuuuagcuuugaag

SEQ ID NO: 30484 - RNA, 32 nt, Human
acaacugugaagccacccugggcuacagaaac

SEQ ID NO: 30485 - RNA, 32 nt, Human
acaacugugugggcauugucauagcuguuggu

SEQ ID NO: 30486 - RNA, 32 nt, Human
acaacuuaaagagacgggaggugcuaggaauc

SEQ ID NO: 30487 - RNA, 32 nt, Human
acaacuuaguguaauauaccagcuuguaugca

SEQ ID NO: 30488 - RNA, 32 nt, Human
acaacuucaacauuguuguuucccucugaggc

SEQ ID NO: 30489 - RNA, 32 nt, Human
acaacuucaagcauuuuuccagcguuaccauc

SEQ ID NO: 30490 - RNA, 24 nt, Human
acaacuucaaggaaacuucaggga

SEQ ID NO: 30491 - RNA, 32 nt, Human
acaacuucaguguggagaaaucucaaguuacu

SEQ ID NO: 30492 - RNA, 32 nt, Human
acaacuucauuucauacaccuucugcccuuac

SEQ ID NO: 30493 - RNA, 32 nt, Human
acaacuucauuuucacauguuacucaguuccc

SEQ ID NO: 30494 - RNA, 32 nt, Human
acaacuuccagcugcuaucaugguauucucau

SEQ ID NO: 30495 - RNA, 32 nt, Human
acaacuuccgcuuaaaacaauuaaguuguuaa

SEQ ID NO: 30496 - RNA, 32 nt, Human
acaacuuccuuuccuuucaguucugccaaaug

SEQ ID NO: 30497 - RNA, 32 nt, Human
acaacuucuggcugucagacacuugcugccuu

SEQ ID NO: 30498 - RNA, 17 nt, Human
acaacuugggauccuga

SEQ ID NO: 30499 - RNA, 19 nt, Human
acaacuuguccugguccaa

SEQ ID NO: 30500 - RNA, 32 nt, Human
acaacuuugaccugaugaccucaucccagccc

SEQ ID NO: 30501 - RNA, 32 nt, Human
acaacuuugcaagcucugccuuggguucagcc

SEQ ID NO: 30502 - RNA, 19 nt, Human
acaacuuuggacuguccaa

SEQ ID NO: 30503 - RNA, 22 nt, Human
acaacuuuucaauuugauccaa

SEQ ID NO: 30504 - RNA, 19 nt, Human
acaacuuuuguguggccaa

SEQ ID NO: 30505 - RNA, 20 nt, Human
acaacuuuuguuaguaccaa

SEQ ID NO: 30506 - RNA, 24 nt, Human
acaagaaaaaagcugaaaccugaa

SEQ ID NO: 30507 - RNA, 32 nt, Human
acaagaaaaacacauuucuuauaccaaaauuu

SEQ ID NO: 30508 - RNA, 32 nt, Human
acaagaaaaauaguuuuuacaaacuucuaguu

SEQ ID NO: 30509 - RNA, 32 nt, Human
acaagaaaagaacauggucuagacugaaguac

SEQ ID NO: 30510 - RNA, 22 nt, Human
acaagaaacucaaugcacaaca

SEQ ID NO: 30511 - RNA, 32 nt, Human
acaagaaagcuuccaucucaaaccuuuucucu

SEQ ID NO: 30512 - RNA, 32 nt, Human
acaagaaaggcagacacaccgcggccaggcac

SEQ ID NO: 30513 - RNA, 32 nt, Human
acaagaaaguuagccgggcaugguggugugca

SEQ ID NO: 30514 - RNA, 32 nt, Human
acaagaaauaccaauaacacacacagaacaaa

SEQ ID NO: 30515 - RNA, 32 nt, Human
acaagaaauuagcugggacuacaggcaugcgc

SEQ ID NO: 30516 - RNA, 32 nt, Human
acaagaaauuucaacggaauuuugccaaacua

SEQ ID NO: 30517 - RNA, 32 nt, Human
acaagaacauuuccucccuccccuccuuugaa

SEQ ID NO: 30518 - RNA, 32 nt, Human
acaagaaccccucccugcccuccuugggcacc

SEQ ID NO: 30519 - RNA, 32 nt, Human
acaagaacucaacuggcaaggcugcuuuucug

SEQ ID NO: 30520 - RNA, 32 nt, Human
acaagaacuccacaguucccaggcuggggaug

SEQ ID NO: 30521 - RNA, 32 nt, Human
acaagaacuucccagccagcacugacccugga

SEQ ID NO: 30522 - RNA, 32 nt, Human
acaagaagaagcaggaccccuacuugcugaag

SEQ ID NO: 30523 - RNA, 22 nt, Human
acaagaagagggagaguccuca

SEQ ID NO: 30524 - RNA, 23 nt, Human
acaagaagagggccagcgccuca

SEQ ID NO: 30525 - RNA, 32 nt, Human
acaagaagagucaccuaaagacaggaaacauc

SEQ ID NO: 30526 - RNA, 32 nt, Human
acaagaagauucauacuagagagaaacccuac

SEQ ID NO: 30527 - RNA, 32 nt, Human
acaagaagcccaaacuuuauuuuuauaaaggg

SEQ ID NO: 30528 - RNA, 23 nt, Human
acaagaagcgugagacgccacca

SEQ ID NO: 30529 - RNA, 32 nt, Human
acaagaaggaaagcagggaggaagggagacca

SEQ ID NO: 30530 - RNA, 32 nt, Human
acaagaaggaggaagacaagaaguggacugga

SEQ ID NO: 30531 - RNA, 32 nt, Human
acaagaaggauucccuggagaaaguggaccua

SEQ ID NO: 30532 - RNA, 32 nt, Human
acaagaagggcuuguuaaaauacagaauuuca

SEQ ID NO: 30533 - RNA, 32 nt, Human
acaagaagguggagccagacguacagggcgga

SEQ ID NO: 30534 - RNA, 32 nt, Human
acaagaaguccccagcagcacacacacauuuc

SEQ ID NO: 30535 - RNA, 32 nt, Human
acaagaaugaacaagagggaaaguauccucca

SEQ ID NO: 30536 - RNA, 32 nt, Human
acaagaauuagccagguguggugguccaugcc

SEQ ID NO: 30537 - RNA, 32 nt, Human
acaagaauuagcugggugugguggcgcaugcc

SEQ ID NO: 30538 - RNA, 32 nt, Human
acaagacaccacuuccccuuuacccuggacag

SEQ ID NO: 30539 - RNA, 32 nt, Human
acaagacacgaaagaacccggucuccaguguc

SEQ ID NO: 30540 - RNA, 32 nt, Human
acaagacacuucacaauguaugaagagagcau

SEQ ID NO: 30541 - RNA, 26 nt, Human
acaagacagauauuuugugccuugag

SEQ ID NO: 30542 - RNA, 24 nt, Human
acaagacagauggaagucccggag

SEQ ID NO: 30543 - RNA, 32 nt, Human
acaagacagcacuccagauaggcagccacgac

SEQ ID NO: 30544 - RNA, 32 nt, Human
acaagacaugggcacagagaguagaagcagaa

SEQ ID NO: 30545 - RNA, 32 nt, Human
acaagaccagccuggccaacauggugaaaccc

SEQ ID NO: 30546 - RNA, 32 nt, Human
acaagaccauuugguauuuguaaagagguuau

SEQ ID NO: 30547 - RNA, 32 nt, Human
acaagacccaucucccuagucucagccuuaca

SEQ ID NO: 30548 - RNA, 32 nt, Human
acaagacccaugucuccaucuggucauacucc

SEQ ID NO: 30549 - RNA, 32 nt, Human
acaagacccuuguggucccaccccacacacgc

SEQ ID NO: 30550 - RNA, 32 nt, Human
acaagaccgagacccuggacgaguccgagauc

SEQ ID NO: 30551 - RNA, 32 nt, Human
acaagaccucugucuccguagcauccuggagc

SEQ ID NO: 30552 - RNA, 32 nt, Human
acaagacgacaaaaauuccugcccucauggag

SEQ ID NO: 30553 - RNA, 32 nt, Human
acaagacucagaauccacagugucccauuuuc

SEQ ID NO: 30554 - RNA, 32 nt, Human
acaagacucccacucccuaauccuggagaccc

SEQ ID NO: 30555 - RNA, 32 nt, Human
acaagacuggacucagcacacuccugggaauc

SEQ ID NO: 30556 - RNA, 32 nt, Human
acaagacuguaucuccagcccaaugggacccg

SEQ ID NO: 30557 - RNA, 32 nt, Human
acaagacuuagugggaauuugcuuuaucuacu

SEQ ID NO: 30558 - RNA, 31 nt, Human
acaagacuuggauacauuacagcagacaugg

SEQ ID NO: 30559 - RNA, 32 nt, Human
acaagacuuugaacagaagcaaaugccugaag

SEQ ID NO: 30560 - RNA, 32 nt, Human
acaagagaaaagcaggaggaaaaggggccauu

SEQ ID NO: 30561 - RNA, 32 nt, Human
acaagagaagccaggaggucuaugauggugac

SEQ ID NO: 30562 - RNA, 32 nt, Human
acaagagacagggagacuggagcccaguccca

SEQ ID NO: 30563 - RNA, 32 nt, Human
acaagagaccauucgccccaacauucccggcc

SEQ ID NO: 30564 - RNA, 32 nt, Human
acaagagcaaacaagucugucugaguuucaag

SEQ ID NO: 30565 - RNA, 32 nt, Human
acaagagcaaagaccaugaagccagagucucc

SEQ ID NO: 30566 - RNA, 32 nt, Human
acaagagcagccuguggcaucuuugccuuggg

SEQ ID NO: 30567 - RNA, 32 nt, Human
acaagagcaguugucugccaugagcacccauc

SEQ ID NO: 30568 - RNA, 32 nt, Human
acaagagccacugcacaacagccaaggaacuu

SEQ ID NO: 30569 - RNA, 32 nt, Human
acaagagcccaggagguugagaaugcagugag

SEQ ID NO: 30570 - RNA, 32 nt, Human
acaagagccccagccaguuuacuccagguaga

SEQ ID NO: 30571 - RNA, 32 nt, Human
acaagagcucacugucuccccugucuccacag

SEQ ID NO: 30572 - RNA, 32 nt, Human
acaagagcuccagcaaagacuuucacuguagc

SEQ ID NO: 30573 - RNA, 32 nt, Human
acaagagcugcacucucuugcccgugguggcc

SEQ ID NO: 30574 - RNA, 32 nt, Human
acaagagcuggguuuagaacuuggaucacgug

SEQ ID NO: 30575 - RNA, 32 nt, Human
acaagaggaauuaccaccucagccucuuuugc

SEQ ID NO: 30576 - RNA, 32 nt, Human
acaagaggaggacaucccaugcggcuacuccu

SEQ ID NO: 30577 - RNA, 22 nt, Human
acaagaggcaggaaaaaagaca

SEQ ID NO: 30578 - RNA, 32 nt, Human
acaagaggcauuuaggacuucugugauauucc

SEQ ID NO: 30579 - RNA, 32 nt, Human
acaagaggccaucugagggccauguccaucug

SEQ ID NO: 30580 - RNA, 32 nt, Human
acaagaggcuuugauuuuuaauucugcaaugu

SEQ ID NO: 30581 - RNA, 32 nt, Human
acaagagggaaaaggaugacuaaucguucugc

SEQ ID NO: 30582 - RNA, 32 nt, Human
acaagagggacuguauuucuguggaaaacaau

SEQ ID NO: 30583 - RNA, 32 nt, Human
acaagagggcggaggaagaaguggggagcacc

SEQ ID NO: 30584 - RNA, 32 nt, Human
acaagaggucccggggguggugggagguggcg

SEQ ID NO: 30585 - RNA, 32 nt, Human
acaagagguuagagagaagagagucagcaaca

SEQ ID NO: 30586 - RNA, 32 nt, Human
acaagagugguguuuguuguuuuuccccuccc

SEQ ID NO: 30587 - RNA, 32 nt, Human
acaagauauacuuagcgccacacccauuuaaa

SEQ ID NO: 30588 - RNA, 32 nt, Human
acaagaucacguucucccaaguaccauucguc

SEQ ID NO: 30589 - RNA, 32 nt, Human
acaagaucaggaguucaagaccaggcugggca

SEQ ID NO: 30590 - RNA, 32 nt, Human
acaagaucaggaguucgagaccagccuggcca

SEQ ID NO: 30591 - RNA, 32 nt, Human
acaagauccaggggcuggagcccaaugccaag

SEQ ID NO: 30592 - RNA, 32 nt, Human
acaagauccucccagcuuucucucuacaugua

SEQ ID NO: 30593 - RNA, 32 nt, Human
acaagaucuccuaagaucugugaaugggauua

SEQ ID NO: 30594 - RNA, 32 nt, Human
acaagaucuguagaucugcuauugaaucagaa

SEQ ID NO: 30595 - RNA, 32 nt, Human
acaagaugaaaaagaaaugaaaagaggaagga

SEQ ID NO: 30596 - RNA, 32 nt, Human
acaagaugacaguuaaaaguugccaccuuacu

SEQ ID NO: 30597 - RNA, 32 nt, Human
acaagaugcacagacacauacacacuuaauuc

SEQ ID NO: 30598 - RNA, 32 nt, Human
acaagaugcuuccaguuacagcggcaggagcg

SEQ ID NO: 30599 - RNA, 32 nt, Human
acaagauggacucgcuacauggugugacccuc

SEQ ID NO: 30600 - RNA, 18 nt, Human
acaagauggagaaacaac

SEQ ID NO: 30601 - RNA, 32 nt, Human
acaagaugggcaaagucccugcccucaaccaa

SEQ ID NO: 30602 - RNA, 32 nt, Human
acaagauggugacuucuccuuggggaucuggg

SEQ ID NO: 30603 - RNA, 23 nt, Human
acaagaugguguuuaaaacaauu

SEQ ID NO: 30604 - RNA, 23 nt, Human
acaagauuaaaaguaaaacaauu

SEQ ID NO: 30605 - RNA, 32 nt, Human
acaagauuagaaacuaaaggcagaagacaagg

SEQ ID NO: 30606 - RNA, 32 nt, Human
acaagauuagauggcaggugagagcuccuuga

SEQ ID NO: 30607 - RNA, 32 nt, Human
acaagauuaucuuauuccccugcccaggugug

SEQ ID NO: 30608 - RNA, 21 nt, Human
acaagauucaccugggccucc

SEQ ID NO: 30609 - RNA, 21 nt, Human
acaagauuggcgucuguguug

SEQ ID NO: 30610 - RNA, 32 nt, Human
acaagauuuccauucccacaaauuuuagugag

SEQ ID NO: 30611 - RNA, 32 nt, Human
acaagcaaaguuugcacugggcccacugccga

SEQ ID NO: 30612 - RNA, 32 nt, Human
acaagcaacaacaacaacaaaauaaauaguuc

SEQ ID NO: 30613 - RNA, 32 nt, Human
acaagcaagcagcguggcuggaagcugauggg

SEQ ID NO: 30614 - RNA, 32 nt, Human
acaagcaagcuccuuccugccucuuuuauaag

SEQ ID NO: 30615 - RNA, 22 nt, Human
acaagcaagcugugugugcucu

SEQ ID NO: 30616 - RNA, 32 nt, Human
acaagcaagggucuccuucaagauuaaugcua

SEQ ID NO: 30617 - RNA, 32 nt, Human
acaagcaaguacuauuauuucugauuuuauaa

SEQ ID NO: 30618 - RNA, 32 nt, Human
acaagcaauccaggaacaaaauacucaccagg

SEQ ID NO: 30619 - RNA, 32 nt, Human
acaagcaauuucccaccaacgaauguaguaca

SEQ ID NO: 30620 - RNA, 32 nt, Human
acaagcacacaaaacucagacagcaucccagc

SEQ ID NO: 30621 - RNA, 32 nt, Human
acaagcacacaugcacagagcuucuugacagu

SEQ ID NO: 30622 - RNA, 24 nt, Human
acaagcaccagccaccaugccugg

SEQ ID NO: 30623 - RNA, 32 nt, Human
acaagcaccauaggccacagaccaucaccuca

SEQ ID NO: 30624 - RNA, 32 nt, Human
acaagcaccguggccagucacagggagagacu

SEQ ID NO: 30625 - RNA, 32 nt, Human
acaagcaccucucccuccacaugguagcagcc

SEQ ID NO: 30626 - RNA, 19 nt, Human
acaagcacugcauacgaug

SEQ ID NO: 30627 - RNA, 32 nt, Human
acaagcacuuugagugcugaagacuucuccca

SEQ ID NO: 30628 - RNA, 32 nt, Human
acaagcagaagguaacaaauuucaugcucucc

SEQ ID NO: 30629 - RNA, 32 nt, Human
acaagcagacacacucacacucguccccagcu

SEQ ID NO: 30630 - RNA, 19 nt, Human
acaagcagagcccgggcca

SEQ ID NO: 30631 - RNA, 18 nt, Human
acaagcagcacaaccaca

SEQ ID NO: 30632 - RNA, 32 nt, Human
acaagcagcggaggagaaggaggaggaggcga

SEQ ID NO: 30633 - RNA, 32 nt, Human
acaagcagcuuuguugcugccuuuauggacau

SEQ ID NO: 30634 - RNA, 32 nt, Human
acaagcagcuuuugugacuaagaaggaaaaua

SEQ ID NO: 30635 - RNA, 32 nt, Human
acaagcaguauaguugguaaaagucaucgcca

SEQ ID NO: 30636 - RNA, 22 nt, Human
acaagcaucagugggcaggcca

SEQ ID NO: 30637 - RNA, 32 nt, Human
acaagcaucuccugcccucucuccuuccuccc

SEQ ID NO: 30638 - RNA, 32 nt, Human
acaagcaugagcaggaaaagacccccucaagg

SEQ ID NO: 30639 - RNA, 25 nt, Human
acaagcaugagccaccacaccuggc

SEQ ID NO: 30640 - RNA, 32 nt, Human
acaagcaugcgccgacgaugcccagaauccag

SEQ ID NO: 30641 - RNA, 32 nt, Human
acaagcauggagaaaaugaagaauaggccugu

SEQ ID NO: 30642 - RNA, 32 nt, Human
acaagcauggccccagcauuugcucagcuucu

SEQ ID NO: 30643 - RNA, 32 nt, Human
acaagcauuggacccgaaaugagggagcccag

SEQ ID NO: 30644 - RNA, 32 nt, Human
acaagccaaaaacagagacagggaagaacuca

SEQ ID NO: 30645 - RNA, 32 nt, Human
acaagccaaucacggaaucccggcggccggcg

SEQ ID NO: 30646 - RNA, 32 nt, Human
acaagccacagaaacggccacacauguucaca

SEQ ID NO: 30647 - RNA, 32 nt, Human
acaagccacagaaccccucuuuucuaaaaugg

SEQ ID NO: 30648 - RNA, 32 nt, Human
acaagccacagagggcucaggagcauugcuau

SEQ ID NO: 30649 - RNA, 32 nt, Human
acaagccagaccuggacggaaguggucacagc

SEQ ID NO: 30650 - RNA, 32 nt, Human
acaagccagcagcagcagaacaguaauuacac

SEQ ID NO: 30651 - RNA, 32 nt, Human
acaagccagccugcugucucaggaagcuguag

SEQ ID NO: 30652 - RNA, 32 nt, Human
acaagccauuuugaacuucugcccucaccgga

SEQ ID NO: 30653 - RNA, 32 nt, Human
acaagcccacaccugggcaggcuguugguguc

SEQ ID NO: 30654 - RNA, 32 nt, Human
acaagcccacagcacagcucccugccaaacug

SEQ ID NO: 30655 - RNA, 32 nt, Human
acaagcccacccucccccugccuugguucccc

SEQ ID NO: 30656 - RNA, 32 nt, Human
acaagcccagaauaauauggccaggggaucaa

SEQ ID NO: 30657 - RNA, 32 nt, Human
acaagcccaucuucagcaguugcuaguccauu

SEQ ID NO: 30658 - RNA, 32 nt, Human
acaagcccaugcuagugagccaacacaaacaa

SEQ ID NO: 30659 - RNA, 20 nt, Human
acaagcccccacccccaccg

SEQ ID NO: 30660 - RNA, 32 nt, Human
acaagccccugagcagcaauuugaggcggcug

SEQ ID NO: 30661 - RNA, 32 nt, Human
acaagccccuggggcucuguugaaccugugaa

SEQ ID NO: 30662 - RNA, 32 nt, Human
acaagcccucauuuugccugcugccaucuaua

SEQ ID NO: 30663 - RNA, 32 nt, Human
acaagcccuuuaggaagcaguaccucucgccu

SEQ ID NO: 30664 - RNA, 32 nt, Human
acaagccggacugugcugagguugggacagag

SEQ ID NO: 30665 - RNA, 32 nt, Human
acaagccuacuggaauuauuucccagggagga

SEQ ID NO: 30666 - RNA, 24 nt, Human
acaagccuggccaacaugaugaag

SEQ ID NO: 30667 - RNA, 24 nt, Human
acaagccuggccaacauggugaaa

SEQ ID NO: 30668 - RNA, 24 nt, Human
acaagccugggcaacauggugaaa

SEQ ID NO: 30669 - RNA, 32 nt, Human
acaagccugggcauuauaacgagauccugucc

SEQ ID NO: 30670 - RNA, 32 nt, Human
acaagccugggcuggaagaggauggcagaggc

SEQ ID NO: 30671 - RNA, 32 nt, Human
acaagccuguaaucucugcacuuugggaugcc

SEQ ID NO: 30672 - RNA, 32 nt, Human
acaagccuugcacuggguaaaccacguucaug

SEQ ID NO: 30673 - RNA, 32 nt, Human
acaagcgauguaaaacagcugggagcaguggg

SEQ ID NO: 30674 - RNA, 32 nt, Human
acaagcgcagagcgcagcgcacggccacagac

SEQ ID NO: 30675 - RNA, 32 nt, Human
acaagcgcuagcccugguugcgggcgaagggu

SEQ ID NO: 30676 - RNA, 32 nt, Human
acaagcgcuucagccucguucucugugagcug

SEQ ID NO: 30677 - RNA, 32 nt, Human
acaagcggcagaggcaggaucugcacucagga

SEQ ID NO: 30678 - RNA, 32 nt, Human
acaagcggcugcaggccugucugcagggccag

SEQ ID NO: 30679 - RNA, 25 nt, Human
acaagcggcugccaccacaccuggc

SEQ ID NO: 30680 - RNA, 32 nt, Human
acaagcgugagcuaaccuugcccagccucugg

SEQ ID NO: 30681 - RNA, 32 nt, Human
acaagcguugagccacuaagcagaggaccuug

SEQ ID NO: 30682 - RNA, 32 nt, Human
acaagcucaaagcucaaacucaccaaauuacc

SEQ ID NO: 30683 - RNA, 32 nt, Human
acaagcucaaggagucugaauuuuucacuuua

SEQ ID NO: 30684 - RNA, 32 nt, Human
acaagcucacaucuuccugugggaaaccuucu

SEQ ID NO: 30685 - RNA, 31 nt, Human
acaagcucacucaagaccagauggagaacuu

SEQ ID NO: 30686 - RNA, 32 nt, Human
acaagcucagagauguuccuccccucaucugc

SEQ ID NO: 30687 - RNA, 32 nt, Human
acaagcucaggaguucaagaccagccuggcca

SEQ ID NO: 30688 - RNA, 32 nt, Human
acaagcucaucaggaaccacugccagaagcca

SEQ ID NO: 30689 - RNA, 32 nt, Human
acaagcucuuuagccaaacaagaaguagaaca

SEQ ID NO: 30690 - RNA, 32 nt, Human
acaagcugcccuuccugucuccaccucucagu

SEQ ID NO: 30691 - RNA, 32 nt, Human
acaagcuggacccccugcucccgggggcgagc

SEQ ID NO: 30692 - RNA, 32 nt, Human
acaagcugggcuggggaggacggugucuagga

SEQ ID NO: 30693 - RNA, 32 nt, Human
acaagcugugggauggggcuugggaguugcag

SEQ ID NO: 30694 - RNA, 32 nt, Human
acaagcugugugaccuugggcaaguuacugaa

SEQ ID NO: 30695 - RNA, 29 nt, Human
acaagcuucuuggaagaagaugugacaau

SEQ ID NO: 30696 - RNA, 32 nt, Human
acaagcuugaaggauaaaaagccuuggugcuu

SEQ ID NO: 30697 - RNA, 32 nt, Human
acaagcuugcccgcccuggcucccucugccca

SEQ ID NO: 30698 - RNA, 22 nt, Human
acaaggaaaccuguacuccuca

SEQ ID NO: 30699 - RNA, 31 nt, Human
acaaggaaacuucugccucagguggggagag

SEQ ID NO: 30700 - RNA, 32 nt, Human
acaaggaacaauccaaugucuccuacuccugc

SEQ ID NO: 30701 - RNA, 32 nt, Human
acaaggaagaagagaagagacuugcagugaac

SEQ ID NO: 30702 - RNA, 32 nt, Human
acaaggaagagcagaccaagguugcuucugau

SEQ ID NO: 30703 - RNA, 32 nt, Human
acaaggaagcagagagcagaagaaaagcagaa

SEQ ID NO: 30704 - RNA, 32 nt, Human
acaaggaaggaaaagaaagaagagaaggggag

SEQ ID NO: 30705 - RNA, 31 nt, Human
acaaggaaguuucagcauucccuuauggauc

SEQ ID NO: 30706 - RNA, 32 nt, Human
acaaggaauaucugcagauggcccagaaugga

SEQ ID NO: 30707 - RNA, 24 nt, Human
acaaggacacuuccagcuugugca

SEQ ID NO: 30708 - RNA, 32 nt, Human
acaaggacacuuccagcuugugcagacaccac

SEQ ID NO: 30709 - RNA, 32 nt, Human
acaaggacccagccugagauggucccaucugc

SEQ ID NO: 30710 - RNA, 23 nt, Human
acaaggacuccgaggagcaccac

SEQ ID NO: 30711 - RNA, 32 nt, Human
acaaggagaagaggaagggaggaagggaacag

SEQ ID NO: 30712 - RNA, 21 nt, Human
acaaggagaaggugcacagca

SEQ ID NO: 30713 - RNA, 32 nt, Human
acaaggagacugccuucuccaucaugcccaga

SEQ ID NO: 30714 - RNA, 32 nt, Human
acaaggagagcggagcacaggagcaggaagcc

SEQ ID NO: 30715 - RNA, 18 nt, Human
acaaggagaggagacaag

SEQ ID NO: 30716 - RNA, 32 nt, Human
acaaggagaugucucucccucucccaaagcac

SEQ ID NO: 30717 - RNA, 32 nt, Human
acaaggagcaaaugacguguggggaaggcuau

SEQ ID NO: 30718 - RNA, 32 nt, Human
acaaggagccuccaagcaaaucauccauugcu

SEQ ID NO: 30719 - RNA, 32 nt, Human
acaaggaggaagaaaaagggcuugcagagagu

SEQ ID NO: 30720 - RNA, 32 nt, Human
acaaggaggccugggcccugagauccuccacg

SEQ ID NO: 30721 - RNA, 32 nt, Human
acaaggagggacuugccucucuucucauuauu

SEQ ID NO: 30722 - RNA, 32 nt, Human
acaaggaggucagacuggagugaauguuguaa

SEQ ID NO: 30723 - RNA, 18 nt, Human
acaaggaggucugugcca

SEQ ID NO: 30724 - RNA, 21 nt, Human
acaaggagucccugagccgcc

SEQ ID NO: 30725 - RNA, 24 nt, Human
acaaggagugacggccugaccccc

SEQ ID NO: 30726 - RNA, 18 nt, Human
acaaggaguuaaaagcaa

SEQ ID NO: 30727 - RNA, 32 nt, Human
acaaggaguugcagacccuacucucuauuuug

SEQ ID NO: 30728 - RNA, 32 nt, Human
acaaggaugaauagaaugggccaagguaugac

SEQ ID NO: 30729 - RNA, 20 nt, Human
acaaggauggaaagcaucau

SEQ ID NO: 30730 - RNA, 32 nt, Human
acaaggauucccuuucuuccauuuuccaauaa

SEQ ID NO: 30731 - RNA, 32 nt, Human
acaaggauucuaccugaacugaaaggacugug

SEQ ID NO: 30732 - RNA, 32 nt, Human
acaaggauuugucuuaaguuugcacaauggcu

SEQ ID NO: 30733 - RNA, 32 nt, Human
acaaggcagcagcaagagaaaaugaggaagaa

SEQ ID NO: 30734 - RNA, 32 nt, Human
acaaggcagcagcugagcguggaaggggcugg

SEQ ID NO: 30735 - RNA, 32 nt, Human
acaaggcaggacuuuggcaaugccuuggccuc

SEQ ID NO: 30736 - RNA, 32 nt, Human
acaaggcaucagguaccugaaaaagaagagau

SEQ ID NO: 30737 - RNA, 32 nt, Human
acaaggcaucugcaugagugacuuuaagacuc

SEQ ID NO: 30738 - RNA, 23 nt, Human
acaaggccaagaacuccuggcca

SEQ ID NO: 30739 - RNA, 32 nt, Human
acaaggccagaacuagcaggcacucaauaaac

SEQ ID NO: 30740 - RNA, 32 nt, Human
acaaggccaggaguucgagaccagccuggcca

SEQ ID NO: 30741 - RNA, 32 nt, Human
acaaggccaugggucggccccugcugcugccc

SEQ ID NO: 30742 - RNA, 32 nt, Human
acaaggcccaggaggcuuaguccagucugugc

SEQ ID NO: 30743 - RNA, 32 nt, Human
acaaggcccaggcuggggccagggccagaggg

SEQ ID NO: 30744 - RNA, 32 nt, Human
acaaggcccgaucccccagccacuaguggccc

SEQ ID NO: 30745 - RNA, 32 nt, Human
acaaggcccgugaguccuggcccagccuccgg

SEQ ID NO: 30746 - RNA, 32 nt, Human
acaaggcccgugcacacagcauguugggggcc

SEQ ID NO: 30747 - RNA, 32 nt, Human
acaaggccggccgggugcaguggcucacaccu

SEQ ID NO: 30748 - RNA, 32 nt, Human
acaaggccuacagaagcauaagccgccauguc

SEQ ID NO: 30749 - RNA, 32 nt, Human
acaaggccuccaggcccugaggugggaaggaa

SEQ ID NO: 30750 - RNA, 32 nt, Human
acaaggccugcccuacacccaggcuggugccu

SEQ ID NO: 30751 - RNA, 32 nt, Human
acaaggccuggggcaagccucacaagucuacc

SEQ ID NO: 30752 - RNA, 32 nt, Human
acaaggccuuucucuaucuuccuacugccacc

SEQ ID NO: 30753 - RNA, 32 nt, Human
acaaggcgagccugugacagagcgagacccug

SEQ ID NO: 30754 - RNA, 32 nt, Human
acaaggcuacauguuauacaagcauaggaaaa

SEQ ID NO: 30755 - RNA, 32 nt, Human
acaaggcucaaaggaaccauauccugauuuca

SEQ ID NO: 30756 - RNA, 32 nt, Human
acaaggcucaaggaaguuagguuuggccaaga

SEQ ID NO: 30757 - RNA, 31 nt, Human
acaaggcucaauuccgaacuguugaaggaag

SEQ ID NO: 30758 - RNA, 32 nt, Human
acaaggcucugccugcaccaggccaucccugg

SEQ ID NO: 30759 - RNA, 32 nt, Human
acaaggcugaaaggagggggacuggaggcugc

SEQ ID NO: 30760 - RNA, 32 nt, Human
acaaggcugcugggggccuguucuucagcccc

SEQ ID NO: 30761 - RNA, 32 nt, Human
acaaggcugcuuggaugaccucaugauauggu

SEQ ID NO: 30762 - RNA, 32 nt, Human
acaaggcuggaaaacuggugcauggaggaaag

SEQ ID NO: 30763 - RNA, 32 nt, Human
acaaggcugugucucucuccuggucauuuuug

SEQ ID NO: 30764 - RNA, 32 nt, Human
acaaggcuucucucagccuccccaccagugau

SEQ ID NO: 30765 - RNA, 32 nt, Human
acaaggcuugaagcucuguccugggaaaauau

SEQ ID NO: 30766 - RNA, 32 nt, Human
acaagggaaggccggacucagcaaaggagccc

SEQ ID NO: 30767 - RNA, 20 nt, Human
acaagggaaggggccaaaca

SEQ ID NO: 30768 - RNA, 32 nt, Human
acaagggacagcagauguaagcacagaaauag

SEQ ID NO: 30769 - RNA, 32 nt, Human
acaagggacccacagaauuacagggaaguuac

SEQ ID NO: 30770 - RNA, 32 nt, Human
acaagggacgcugaggcaggaggaucauuuga

SEQ ID NO: 30771 - RNA, 23 nt, Human
acaagggagcacugaaaccugaa

SEQ ID NO: 30772 - RNA, 32 nt, Human
acaagggaggcagagucuggaguuacgcugcc

SEQ ID NO: 30773 - RNA, 32 nt, Human
acaagggaggcuggguagccagggcuggugcu

SEQ ID NO: 30774 - RNA, 32 nt, Human
acaagggaguaccagggcaaagcacaaggagc

SEQ ID NO: 30775 - RNA, 32 nt, Human
acaagggauaugaggccagugccaccagaggg

SEQ ID NO: 30776 - RNA, 32 nt, Human
acaagggcacaagcucagguccugcugccucc

SEQ ID NO: 30777 - RNA, 32 nt, Human
acaagggcagggaagacacagaaggacagaua

SEQ ID NO: 30778 - RNA, 32 nt, Human
acaagggccacagccaugaauggcacagaagg

SEQ ID NO: 30779 - RNA, 32 nt, Human
acaagggccagaggaggugggagcagagggag

SEQ ID NO: 30780 - RNA, 32 nt, Human
acaagggccagccuggccaacauggugaaacc

SEQ ID NO: 30781 - RNA, 32 nt, Human
acaagggcccagcaugucuguguguuuaccca

SEQ ID NO: 30782 - RNA, 32 nt, Human
acaagggcccguuuccauuuccuuccuaaggu

SEQ ID NO: 30783 - RNA, 32 nt, Human
acaagggcgcuggggguggaagugcccuggaa

SEQ ID NO: 30784 - RNA, 32 nt, Human
acaagggcucacugauaaaacucaucaguccc

SEQ ID NO: 30785 - RNA, 32 nt, Human
acaagggcuggcuaaauuuggccgaagaugga

SEQ ID NO: 30786 - RNA, 32 nt, Human
acaagggcuuagaguauacuguauuugcaagu

SEQ ID NO: 30787 - RNA, 32 nt, Human
acaaggggagagaucaguugcgggacagacug

SEQ ID NO: 30788 - RNA, 32 nt, Human
acaaggggagcacccugggccacacaggcgug

SEQ ID NO: 30789 - RNA, 32 nt, Human
acaaggggcuucaccucugagcuguuuuccag

SEQ ID NO: 30790 - RNA, 32 nt, Human
acaagggggccugagugcaguggcucacgucu

SEQ ID NO: 30791 - RNA, 32 nt, Human
acaagggggccuuguggcucucagccaugcca

SEQ ID NO: 30792 - RNA, 32 nt, Human
acaagggggugagggaaagggaaggcuuaaaa

SEQ ID NO: 30793 - RNA, 32 nt, Human
acaagggucacaauacuguugugcgcacaucg

SEQ ID NO: 30794 - RNA, 32 nt, Human
acaagggugcucugggggaccccuggucugug

SEQ ID NO: 30795 - RNA, 23 nt, Human
acaaggguggcuuuucucugcca

SEQ ID NO: 30796 - RNA, 32 nt, Human
acaagguaaaccugagacuuucccagucucca

SEQ ID NO: 30797 - RNA, 32 nt, Human
acaagguaccucuguuggaaaugcagaaauca

SEQ ID NO: 30798 - RNA, 32 nt, Human
acaagguaggcagagguugcagugagccaaga

SEQ ID NO: 30799 - RNA, 32 nt, Human
acaagguagggaguucugagggaagccgcgug

SEQ ID NO: 30800 - RNA, 32 nt, Human
acaagguaguaggaggaaugacuugguguauc

SEQ ID NO: 30801 - RNA, 32 nt, Human
acaaggucaagaguucgagaccagccugacca

SEQ ID NO: 30802 - RNA, 32 nt, Human
acaaggucaagaguucgagaccagccuggcca

SEQ ID NO: 30803 - RNA, 32 nt, Human
acaaggucacacuugacccuuugagacagucc

SEQ ID NO: 30804 - RNA, 32 nt, Human
acaaggucagcaguucaagaccagccugacca

SEQ ID NO: 30805 - RNA, 32 nt, Human
acaaggucaggagaucaagaccauccuggcca

SEQ ID NO: 30806 - RNA, 32 nt, Human
acaaggucaggagaucaagaccauccuggcua

SEQ ID NO: 30807 - RNA, 32 nt, Human
acaaggucaggagaucgagaccagccugacca

SEQ ID NO: 30808 - RNA, 32 nt, Human
acaaggucaggaguucaagaccagccugacca

SEQ ID NO: 30809 - RNA, 32 nt, Human
acaaggucaggaguucaagaccagccuggaca

SEQ ID NO: 30810 - RNA, 32 nt, Human
acaaggucaggaguucaagaccagccuggcca

SEQ ID NO: 30811 - RNA, 32 nt, Human
acaaggucaggaguucaagaccagccuggccc

SEQ ID NO: 30812 - RNA, 32 nt, Human
acaaggucaggaguucaagaccagcugaccaa

SEQ ID NO: 30813 - RNA, 32 nt, Human
acaaggucaggaguuccagaccagccuggcua

SEQ ID NO: 30814 - RNA, 32 nt, Human
acaaggucaggaguucgagaccagccagacca

SEQ ID NO: 30815 - RNA, 32 nt, Human
acaaggucaggaguucgagaccagccugacca

SEQ ID NO: 30816 - RNA, 32 nt, Human
acaaggucaggaguucgagaccagccuggcca

SEQ ID NO: 30817 - RNA, 32 nt, Human
acaaggucaggaguucgagaccagccugguca

SEQ ID NO: 30818 - RNA, 32 nt, Human
acaaggucaggaguuugagaccagccuagcca

SEQ ID NO: 30819 - RNA, 32 nt, Human
acaaggucaggaguuugagaccagccugacca

SEQ ID NO: 30820 - RNA, 32 nt, Human
acaaggucaggaguuugagaccagccuggcca

SEQ ID NO: 30821 - RNA, 32 nt, Human
acaaggucaggaguuugggaccagccugacca

SEQ ID NO: 30822 - RNA, 32 nt, Human
acaaggucaguagaucgagaccagccuggcca

SEQ ID NO: 30823 - RNA, 32 nt, Human
acaagguccagaucacucuggagcaggccagc

SEQ ID NO: 30824 - RNA, 32 nt, Human
acaagguccuuggcugggcaugguggcugaag

SEQ ID NO: 30825 - RNA, 32 nt, Human
acaaggucgggaguuugagaccagccugacua

SEQ ID NO: 30826 - RNA, 32 nt, Human
acaaggucucacuacauugcccagguuggucu

SEQ ID NO: 30827 - RNA, 32 nt, Human
acaaggucucacuauguugcccaggcuggucu

SEQ ID NO: 30828 - RNA, 32 nt, Human
acaaggucucgccauguugccuaggauguucu

SEQ ID NO: 30829 - RNA, 32 nt, Human
acaaggucuugcuauguugcccaggcuagagu

SEQ ID NO: 30830 - RNA, 32 nt, Human
acaaggucuugcuauguugcccaggcugaucu

SEQ ID NO: 30831 - RNA, 32 nt, Human
acaaggucuugcuauguugcccaggcuggucu

SEQ ID NO: 30832 - RNA, 32 nt, Human
acaaggucuugcuauguuguccagacuggucu

SEQ ID NO: 30833 - RNA, 32 nt, Human
acaaggugcacaggcuggaagucuuuugugaa

SEQ ID NO: 30834 - RNA, 32 nt, Human
acaaggugcuaucuacuuuucucucuaggauu

SEQ ID NO: 30835 - RNA, 32 nt, Human
acaaggugggagagagaguuugagacagcucc

SEQ ID NO: 30836 - RNA, 32 nt, Human
acaaggugggucuccuggguaagggaagcaag

SEQ ID NO: 30837 - RNA, 32 nt, Human
acaagguguguguaauggaacaccacuuugag

SEQ ID NO: 30838 - RNA, 32 nt, Human
acaagguuaaagauuccucgaaguucuaggaa

SEQ ID NO: 30839 - RNA, 32 nt, Human
acaagguuaauagccaggcaugguggcucaug

SEQ ID NO: 30840 - RNA, 32 nt, Human
acaagguugcagaaugaacauguaaaguuaca

SEQ ID NO: 30841 - RNA, 32 nt, Human
acaagguugggagcucgagaccagccuggcca

SEQ ID NO: 30842 - RNA, 32 nt, Human
acaagguugugcccuccaccuaccugccggac

SEQ ID NO: 30843 - RNA, 19 nt, Human
acaagguuucaccauguug

SEQ ID NO: 30844 - RNA, 24 nt, Human
acaaguaaaaauuuauaaauauua

SEQ ID NO: 30845 - RNA, 32 nt, Human
acaaguaacacauuuggccacaaaacaccaaa

SEQ ID NO: 30846 - RNA, 32 nt, Human
acaaguaacucuaggcugggugugguggcuca

SEQ ID NO: 30847 - RNA, 32 nt, Human
acaaguacccagcagguggcccagggaggcag

SEQ ID NO: 30848 - RNA, 32 nt, Human
acaaguacuguaguauuacagugacaggaauc

SEQ ID NO: 30849 - RNA, 32 nt, Human
acaaguacuucuugauaccugggauacugugc

SEQ ID NO: 30850 - RNA, 32 nt, Human
acaaguagguuugcuuaagaaauuacuaaaca

SEQ ID NO: 30851 - RNA, 20 nt, Human
acaaguaguuaagagcuaag

SEQ ID NO: 30852 - RNA, 32 nt, Human
acaaguaguucauucaggagggcagggaagac

SEQ ID NO: 30853 - RNA, 32 nt, Human
acaaguauaaugacauuuagaagauuacuuug

SEQ ID NO: 30854 - RNA, 32 nt, Human
acaagucacaaaggagaaugagaacuuaauga

SEQ ID NO: 30855 - RNA, 32 nt, Human
acaagucaccccaaaccuuggaacugucaggg

SEQ ID NO: 30856 - RNA, 32 nt, Human
acaagucacccuacaacuacuacuucuuggga

SEQ ID NO: 30857 - RNA, 32 nt, Human
acaagucacuucucuucuccauaguacaugga

SEQ ID NO: 30858 - RNA, 32 nt, Human
acaagucagaauucacuuugaagagggucuga

SEQ ID NO: 30859 - RNA, 32 nt, Human
acaaguccacacacacucccaccccagccaaa

SEQ ID NO: 30860 - RNA, 24 nt, Human
acaaguccuaucauccucugcuca

SEQ ID NO: 30861 - RNA, 32 nt, Human
acaaguccuggugucuuuaaaaggaucagcuu

SEQ ID NO: 30862 - RNA, 32 nt, Human
acaagucgguggugaugacagacccccuuuug

SEQ ID NO: 30863 - RNA, 32 nt, Human
acaagucuguaaucccagcacuuugggaggcc

SEQ ID NO: 30864 - RNA, 32 nt, Human
acaagucuguggggcaagaggcugcaauauuc

SEQ ID NO: 30865 - RNA, 32 nt, Human
acaagucuuucuccuccagcccuucucuucaa

SEQ ID NO: 30866 - RNA, 32 nt, Human
acaagugacucaguggaagauccagagucaac

SEQ ID NO: 30867 - RNA, 32 nt, Human
acaagugagacggagcugccuccucugacugc

SEQ ID NO: 30868 - RNA, 32 nt, Human
acaagugagccucagcaccacccuccaucccu

SEQ ID NO: 30869 - RNA, 32 nt, Human
acaagugagucucggcuggagugcaguggugc

SEQ ID NO: 30870 - RNA, 32 nt, Human
acaagugauuugcauucucuucuucacgcuuu

SEQ ID NO: 30871 - RNA, 32 nt, Human
acaagugcacacacaucuaugcagacaagcuu

SEQ ID NO: 30872 - RNA, 32 nt, Human
acaagugcacacuguccugguguccugcacug

SEQ ID NO: 30873 - RNA, 32 nt, Human
acaagugcacagaccacacacagcacuaacac

SEQ ID NO: 30874 - RNA, 32 nt, Human
acaagugcagaaggugcaggugcaguggguac

SEQ ID NO: 30875 - RNA, 32 nt, Human
acaagugccagcccccacaucuguagccccug

SEQ ID NO: 30876 - RNA, 32 nt, Human
acaagugcuggaguuagcaccucccucugccc

SEQ ID NO: 30877 - RNA, 32 nt, Human
acaagugcuuuugcuuucuuucuuucuuucuu

SEQ ID NO: 30878 - RNA, 32 nt, Human
acaaguggaacagaugaaagaggccagcagac

SEQ ID NO: 30879 - RNA, 32 nt, Human
acaaguggaauuuaauacauaaaagagaaaaa

SEQ ID NO: 30880 - RNA, 32 nt, Human
acaaguggagagaaguugacguggaaaggguc

SEQ ID NO: 30881 - RNA, 32 nt, Human
acaaguggagccaggguucagggucagagcua

SEQ ID NO: 30882 - RNA, 32 nt, Human
acaaguggauaaagaaauugugguguaucuau

SEQ ID NO: 30883 - RNA, 32 nt, Human
acaagugggaaaaacugugauuagaaagggaa

SEQ ID NO: 30884 - RNA, 32 nt, Human
acaagugggaccgguggagcagccccugggcu

SEQ ID NO: 30885 - RNA, 32 nt, Human
acaaguggguggugagaccauugaaagccuuu

SEQ ID NO: 30886 - RNA, 32 nt, Human
acaagugguuuaguugggcagggcuuugauca

SEQ ID NO: 30887 - RNA, 32 nt, Human
acaaguguccagagaucguagccagacagcca

SEQ ID NO: 30888 - RNA, 32 nt, Human
acaaguguccuccuccagcgccagccuggccc

SEQ ID NO: 30889 - RNA, 32 nt, Human
acaagugugguguuuucccaaggcucccuucc

SEQ ID NO: 30890 - RNA, 32 nt, Human
acaaguguuguggccuuccugaacugggaagu

SEQ ID NO: 30891 - RNA, 32 nt, Human
acaaguuagaaaauucagcuccuuucuguccu

SEQ ID NO: 30892 - RNA, 32 nt, Human
acaaguuaggaucagcagaggguagaggaggg

SEQ ID NO: 30893 - RNA, 32 nt, Human
acaaguuagggaggaagaggcaggcgaugagu

SEQ ID NO: 30894 - RNA, 32 nt, Human
acaaguucaagaccagccuggcaaacauggug

SEQ ID NO: 30895 - RNA, 32 nt, Human
acaaguucaggaggucaagaccauccuggcua

SEQ ID NO: 30896 - RNA, 32 nt, Human
acaaguuccaauagcuuauaugcccagaaggc

SEQ ID NO: 30897 - RNA, 32 nt, Human
acaaguucuggcccaggauucgcucacugacc

SEQ ID NO: 30898 - RNA, 32 nt, Human
acaaguucuggcccaggauucgcucacugauc

SEQ ID NO: 30899 - RNA, 32 nt, Human
acaaguuguuaggccaggugcaauggcucgca

SEQ ID NO: 30900 - RNA, 32 nt, Human
acaaguuuaccucccugcuuuccucuuuucga

SEQ ID NO: 30901 - RNA, 32 nt, Human
acaaguuuagagaugcauuuaagaauuauuca

SEQ ID NO: 30902 - RNA, 32 nt, Human
acaaguuugagaccagccugggcaacauggca

SEQ ID NO: 30903 - RNA, 32 nt, Human
acaaguuugcacagcuagaguguuuuuguaaa

SEQ ID NO: 30904 - RNA, 32 nt, Human
acaaguuugccccauucucuggcuuggggugg

SEQ ID NO: 30905 - RNA, 24 nt, Human
acaaguuuuaguuaaaacucauca

SEQ ID NO: 30906 - RNA, 32 nt, Human
acaaguuuuccucugcuuagcagcucacuuca

SEQ ID NO: 30907 - RNA, 32 nt, Human
acaaguuuucuaauuuuugcaguauggauagg

SEQ ID NO: 30908 - RNA, 32 nt, Human
acaaguuuugcaccacaggccaacacccuuug

SEQ ID NO: 30909 - RNA, 32 nt, Human
acaauaaaacacuugcuuuucuuuuugagaaa

SEQ ID NO: 30910 - RNA, 32 nt, Human
acaauaaacauguaggaaauaaacuugauaca

SEQ ID NO: 30911 - RNA, 32 nt, Human
acaauaaacucucuuuugcaccacagacuucu

SEQ ID NO: 30912 - RNA, 32 nt, Human
acaauaaagcucaugucuggaucucuguuggg

SEQ ID NO: 30913 - RNA, 20 nt, Human
acaauaaauguggcugugca

SEQ ID NO: 30914 - RNA, 32 nt, Human
acaauaacaagaaaagcuuuucaucuaaguuu

SEQ ID NO: 30915 - RNA, 32 nt, Human
acaauaacacaagauaccuguuccucaaagac

SEQ ID NO: 30916 - RNA, 32 nt, Human
acaauaacagaucuggugagugugccaugcca

SEQ ID NO: 30917 - RNA, 32 nt, Human
acaauaagguccaggcugagguagucucagau

SEQ ID NO: 30918 - RNA, 32 nt, Human
acaauaaugcaauuagaauuugggagaagcaa

SEQ ID NO: 30919 - RNA, 21 nt, Human
acaauaauggauuuaaugcuc

SEQ ID NO: 30920 - RNA, 32 nt, Human
acaauacagauaagauuuuuacaugguagauc

SEQ ID NO: 30921 - RNA, 32 nt, Human
acaauacaggaaauguucucagaugcugaugu

SEQ ID NO: 30922 - RNA, 32 nt, Human
acaauacaguacucaggcagugcaguacucag

SEQ ID NO: 30923 - RNA, 32 nt, Human
acaauacauaugcacauaucaugaacagcgua

SEQ ID NO: 30924 - RNA, 32 nt, Human
acaauacaucccuuaccugggaaagggcuguu

SEQ ID NO: 30925 - RNA, 32 nt, Human
acaauacauugaauuugacaacccacugaagu

SEQ ID NO: 30926 - RNA, 32 nt, Human
acaauacccuccccucccuugggcuggacccc

SEQ ID NO: 30927 - RNA, 32 nt, Human
acaauaccgucugugccuaggcugcuugaucu

SEQ ID NO: 30928 - RNA, 32 nt, Human
acaauacgacauguuucuuuugcaauuuauau

SEQ ID NO: 30929 - RNA, 32 nt, Human
acaauacggaaggggagauaggugagaugaua

SEQ ID NO: 30930 - RNA, 32 nt, Human
acaauacugauaguuagaagaaaacuauugua

SEQ ID NO: 30931 - RNA, 32 nt, Human
acaauacugccucuuuuauguuguauuuagaa

SEQ ID NO: 30932 - RNA, 32 nt, Human
acaauacuuguauauuuuuaguaccauacaga

SEQ ID NO: 30933 - RNA, 32 nt, Human
acaauagaaacucaccauguaaaagagucauc

SEQ ID NO: 30934 - RNA, 32 nt, Human
acaauagaaguauuucugaacauaucaaauau

SEQ ID NO: 30935 - RNA, 32 nt, Human
acaauagaauucaagaaaaugcuuaaaagcac

SEQ ID NO: 30936 - RNA, 32 nt, Human
acaauagacauugcaaacucucauguuuuugg

SEQ ID NO: 30937 - RNA, 32 nt, Human
acaauagaggagaauauguaaaggguauacau

SEQ ID NO: 30938 - RNA, 32 nt, Human
acaauagaguugaaagagaggccuuaggauuc

SEQ ID NO: 30939 - RNA, 32 nt, Human
acaauagcaauuaaaagacuaguagggauccu

SEQ ID NO: 30940 - RNA, 32 nt, Human
acaauagcaugagcgaucugugccuuaaggac

SEQ ID NO: 30941 - RNA, 32 nt, Human
acaauagcaugagugaucugugccuuaagaac

SEQ ID NO: 30942 - RNA, 32 nt, Human
acaauagcaugagugaucugugccuuaaggcu

SEQ ID NO: 30943 - RNA, 32 nt, Human
acaauaggacagugacugcacaguugugaaaa

SEQ ID NO: 30944 - RNA, 32 nt, Human
acaauaggcuuagugcuuggcucagacaccua

SEQ ID NO: 30945 - RNA, 32 nt, Human
acaauaggggaagauauaacaaaagccaaaau

SEQ ID NO: 30946 - RNA, 32 nt, Human
acaauaguaccgaucaguuaacucagcgcuga

SEQ ID NO: 30947 - RNA, 32 nt, Human
acaauagucaccacaguggcuggagaugagcc

SEQ ID NO: 30948 - RNA, 32 nt, Human
acaauagucaucuccuagggcucauaguucaa

SEQ ID NO: 30949 - RNA, 32 nt, Human
acaauagugaaagcaugaaaagaggacacaug

SEQ ID NO: 30950 - RNA, 32 nt, Human
acaauaguucccacucaugauuuuccguuaca

SEQ ID NO: 30951 - RNA, 32 nt, Human
acaauaucacagucauucauccaggccacguu

SEQ ID NO: 30952 - RNA, 32 nt, Human
acaauaugcuccugccuugcaccuccaauagg

SEQ ID NO: 30953 - RNA, 32 nt, Human
acaauaugggcucccaaccccugcugaguaca

SEQ ID NO: 30954 - RNA, 32 nt, Human
acaauauggguaaacuucaucccagagacaca

SEQ ID NO: 30955 - RNA, 32 nt, Human
acaauauguuacugagggaaaaauagauuggu

SEQ ID NO: 30956 - RNA, 32 nt, Human
acaauauguuugcaggcuguaugcuugguaga

SEQ ID NO: 30957 - RNA, 32 nt, Human
acaauauugccucacaacccugcuuacauuga

SEQ ID NO: 30958 - RNA, 32 nt, Human
acaauauuggguguuugggagccagaaagcuu

SEQ ID NO: 30959 - RNA, 32 nt, Human
acaauauuguaaucccuacucuaggcacuugc

SEQ ID NO: 30960 - RNA, 32 nt, Human
acaauauuucugcuuuaacaccaucuuucgug

SEQ ID NO: 30961 - RNA, 32 nt, Human
acaaucaaaagauuaacaacacugcaugcggc

SEQ ID NO: 30962 - RNA, 23 nt, Human
acaaucaaaggacuguauggaaa

SEQ ID NO: 30963 - RNA, 32 nt, Human
acaaucaaccugcacugagcacuuugugcggg

SEQ ID NO: 30964 - RNA, 32 nt, Human
acaaucacaaaugaaacaagauucagacuuca

SEQ ID NO: 30965 - RNA, 32 nt, Human
acaaucacaaccacaaccaacaccacaaaccu

SEQ ID NO: 30966 - RNA, 32 nt, Human
acaaucacaagaagauucccaccccugccucc

SEQ ID NO: 30967 - RNA, 32 nt, Human
acaaucacagugaaaaccucagguuggcagcc

SEQ ID NO: 30968 - RNA, 32 nt, Human
acaaucacaucacagaucacacugcaguuucc

SEQ ID NO: 30969 - RNA, 32 nt, Human
acaaucacguucacaaccacaaccacgcagcc

SEQ ID NO: 30970 - RNA, 32 nt, Human
acaaucacucagcuggaaugucugcucucuau

SEQ ID NO: 30971 - RNA, 32 nt, Human
acaaucagaaggauuuuagcuggauaacuuac

SEQ ID NO: 30972 - RNA, 32 nt, Human
acaaucagacuccauccagcuagcugcucauc

SEQ ID NO: 30973 - RNA, 32 nt, Human
acaaucagcuucccugguucugaggcuuucag

SEQ ID NO: 30974 - RNA, 32 nt, Human
acaaucauaccccuucccuucucuccacccaa

SEQ ID NO: 30975 - RNA, 32 nt, Human
acaaucaucucucccuuccucuaugucaagca

SEQ ID NO: 30976 - RNA, 32 nt, Human
acaaucauggcagaaggggaagcaagacauuu

SEQ ID NO: 30977 - RNA, 31 nt, Human
acaaucauggcagaaggugaagaggaaggag

SEQ ID NO: 30978 - RNA, 32 nt, Human
acaaucaugguggaaggcgaaugaggagcaaa

SEQ ID NO: 30979 - RNA, 32 nt, Human
acaaucauugauccuaaagaaaaugugggagu

SEQ ID NO: 30980 - RNA, 32 nt, Human
acaaucauuuugaaucccucuuccucacuuuu

SEQ ID NO: 30981 - RNA, 18 nt, Human
acaauccagagcaggcca

SEQ ID NO: 30982 - RNA, 32 nt, Human
acaauccagccucugcccuggaacugcuggau

SEQ ID NO: 30983 - RNA, 32 nt, Human
acaaucccacacacccucaggguuuacugaga

SEQ ID NO: 30984 - RNA, 32 nt, Human
acaaucccaccugaggacaggauccgcauaug

SEQ ID NO: 30985 - RNA, 22 nt, Human
acaaucccauuuccuauuacca

SEQ ID NO: 30986 - RNA, 32 nt, Human
acaaucccucacugcugccucaacuuccuggg

SEQ ID NO: 30987 - RNA, 25 nt, Human
acaauccuauacauuaaaagaaauu

SEQ ID NO: 30988 - RNA, 32 nt, Human
acaauccucaucagacaaacccaucuguaaaa

SEQ ID NO: 30989 - RNA, 32 nt, Human
acaauccucccaucucagccucugaaguagcu

SEQ ID NO: 30990 - RNA, 32 nt, Human
acaauccuggcccugagccucagccucugcca

SEQ ID NO: 30991 - RNA, 32 nt, Human
acaauccuggggacccacuugaagaagaauag

SEQ ID NO: 30992 - RNA, 21 nt, Human
acaauccugguaucauugcca

SEQ ID NO: 30993 - RNA, 32 nt, Human
acaaucgccacccuagaauuccugguaucagu

SEQ ID NO: 30994 - RNA, 32 nt, Human
acaaucgcuugaaccugggaggcggagguugc

SEQ ID NO: 30995 - RNA, 32 nt, Human
acaaucguaugucugcuuuaccagucuuuccc

SEQ ID NO: 30996 - RNA, 32 nt, Human
acaaucgucacccacauuggagugcaguggua

SEQ ID NO: 30997 - RNA, 32 nt, Human
acaaucuaagucaggucaccagagggaagaga

SEQ ID NO: 30998 - RNA, 18 nt, Human
acaaucuacacugccuua

SEQ ID NO: 30999 - RNA, 32 nt, Human
acaaucuaucaucuguccuacagucccugauc

SEQ ID NO: 31000 - RNA, 32 nt, Human
acaaucucagggacccgagcagcuccaaggac

SEQ ID NO: 31001 - RNA, 32 nt, Human
acaaucuccagugcaggaucuaaugacuguac

SEQ ID NO: 31002 - RNA, 32 nt, Human
acaaucucucuaaccuggugggagacuccucu

SEQ ID NO: 31003 - RNA, 32 nt, Human
acaaucugaaagagucuucaaugauaugcuug

SEQ ID NO: 31004 - RNA, 32 nt, Human
acaaucugacuggauaugacacugcagaauag

SEQ ID NO: 31005 - RNA, 32 nt, Human
acaaucugaggauugauugcugccuuuuaaaa

SEQ ID NO: 31006 - RNA, 32 nt, Human
acaaucugccuuucaccacauggccuugccuc

SEQ ID NO: 31007 - RNA, 22 nt, Human
acaaucuggcucacugcagccu

SEQ ID NO: 31008 - RNA, 32 nt, Human
acaaucuggggacugaaccuuacccagggcug

SEQ ID NO: 31009 - RNA, 22 nt, Human
acaaucuucaggaagccugcua

SEQ ID NO: 31010 - RNA, 32 nt, Human
acaaucuucuaaucuggagucuuugagaucuu

SEQ ID NO: 31011 - RNA, 32 nt, Human
acaaucuucuacagugcuuacucuccagaguc

SEQ ID NO: 31012 - RNA, 32 nt, Human
acaaucuugccucacugcaacgccugccucuc

SEQ ID NO: 31013 - RNA, 32 nt, Human
acaaucuuguauaauuuccucuccuugggugc

SEQ ID NO: 31014 - RNA, 21 nt, Human
acaaucuuucaagaagaaauu

SEQ ID NO: 31015 - RNA, 32 nt, Human
acaaugaacccaaaaccaaauuugcuaagucc

SEQ ID NO: 31016 - RNA, 32 nt, Human
acaaugaagagaaaggaggacucuugaggaau

SEQ ID NO: 31017 - RNA, 32 nt, Human
acaaugaauuacagcacaggcuuuucacaacu

SEQ ID NO: 31018 - RNA, 32 nt, Human
acaaugacaaacacacauuacacacacaacau

SEQ ID NO: 31019 - RNA, 32 nt, Human
acaaugacacaaucauagcucacugcagccuu

SEQ ID NO: 31020 - RNA, 32 nt, Human
acaaugacagcuguaguaacuaugaugggugu

SEQ ID NO: 31021 - RNA, 32 nt, Human
acaaugaccacugcagccuccaccuccuaggc

SEQ ID NO: 31022 - RNA, 32 nt, Human
acaaugacuuuuguaaggauugguacuaucua

SEQ ID NO: 31023 - RNA, 32 nt, Human
acaaugagauaucaucucauccuaauuaaggu

SEQ ID NO: 31024 - RNA, 32 nt, Human
acaaugagcccugguggauuuguggggaaaaa

SEQ ID NO: 31025 - RNA, 19 nt, Human
acaaugagcuaaugcucca

SEQ ID NO: 31026 - RNA, 32 nt, Human
acaaugauacuucuuuuuaucucuuuaguaug

SEQ ID NO: 31027 - RNA, 32 nt, Human
acaaugauagcagcagaugccuagcucauccu

SEQ ID NO: 31028 - RNA, 32 nt, Human
acaaugauagucacauuagagaacaagaaacc

SEQ ID NO: 31029 - RNA, 32 nt, Human
acaaugaugcgaucucagcucacugcaaccuc

SEQ ID NO: 31030 - RNA, 31 nt, Human
acaaugauggaaauagccaaugugaguucuc

SEQ ID NO: 31031 - RNA, 32 nt, Human
acaaugauggcagaacccccaagcgaaugccc

SEQ ID NO: 31032 - RNA, 32 nt, Human
acaaugauggccugguuagagcugugguuugg

SEQ ID NO: 31033 - RNA, 32 nt, Human
acaaugauugucaaacuuuucuaacuggagcu

SEQ ID NO: 31034 - RNA, 32 nt, Human
acaaugauuuucucccuucuuuuacaguagca

SEQ ID NO: 31035 - RNA, 32 nt, Human
acaaugcaaggaaaauggagguuuucaaacac

SEQ ID NO: 31036 - RNA, 32 nt, Human
acaaugcaaggaagucaugucucacuacuuuu

SEQ ID NO: 31037 - RNA, 32 nt, Human
acaaugcaaugccacugagugcuauuuugcuc

SEQ ID NO: 31038 - RNA, 32 nt, Human
acaaugcagcugagcaggcaagcacagcccac

SEQ ID NO: 31039 - RNA, 32 nt, Human
acaaugcauaaauuaucugaauuuuaugucuu

SEQ ID NO: 31040 - RNA, 32 nt, Human
acaaugccaucaugaauauacuuuauuggaaa

SEQ ID NO: 31041 - RNA, 32 nt, Human
acaaugccauuucuccccaccacggaaccuuc

SEQ ID NO: 31042 - RNA, 32 nt, Human
acaaugcccaagcagagggagcccccuugccc

SEQ ID NO: 31043 - RNA, 32 nt, Human
acaaugccuggcacagauuagcgauuuguuga

SEQ ID NO: 31044 - RNA, 32 nt, Human
acaaugcguaaaaggugaaggccagcugaaga

SEQ ID NO: 31045 - RNA, 30 nt, Human
acaaugcuaauaaaauggugacuuuaaaag

SEQ ID NO: 31046 - RNA, 32 nt, Human
acaaugcugccucuguuucugugacgcugugc

SEQ ID NO: 31047 - RNA, 32 nt, Human
acaaugcugcucccuuuuacuccuuucuaagc

SEQ ID NO: 31048 - RNA, 32 nt, Human
acaaugcuguagacucagaaaaggaguggggg

SEQ ID NO: 31049 - RNA, 32 nt, Human
acaaugcuugauuugaaaacaguguggagaaa

SEQ ID NO: 31050 - RNA, 32 nt, Human
acaauggaagcagaggucagagugaugcaauu

SEQ ID NO: 31051 - RNA, 32 nt, Human
acaauggagagggaugggccagguucuugcuc

SEQ ID NO: 31052 - RNA, 32 nt, Human
acaauggagcaaggaagguggagauggaugcu

SEQ ID NO: 31053 - RNA, 32 nt, Human
acaauggaggcagagauuggagcaauuuaucu

SEQ ID NO: 31054 - RNA, 32 nt, Human
acaauggauagaauuauguagucuccguuauc

SEQ ID NO: 31055 - RNA, 32 nt, Human
acaauggcacuauuucagcucacugcaaccuc

SEQ ID NO: 31056 - RNA, 32 nt, Human
acaauggcaugaucucagcucacugcaaccuc

SEQ ID NO: 31057 - RNA, 32 nt, Human
acaauggcccugcuccuuccuccucuaggccc

SEQ ID NO: 31058 - RNA, 22 nt, Human
acaauggcucacgccuguaauc

SEQ ID NO: 31059 - RNA, 32 nt, Human
acaaugggaaccccuugugagcaugcucagua

SEQ ID NO: 31060 - RNA, 32 nt, Human
acaaugggcaggcggguuguacuuaguguggu

SEQ ID NO: 31061 - RNA, 32 nt, Human
acaaugggccuguccacuaucuucuuucauau

SEQ ID NO: 31062 - RNA, 32 nt, Human
acaaugggccuuuuauccccucugaacugcuu

SEQ ID NO: 31063 - RNA, 28 nt, Human
acaauggguccgcgggccacgcgaacgg

SEQ ID NO: 31064 - RNA, 32 nt, Human
acaaugguaccuauuagggauggagauacaga

SEQ ID NO: 31065 - RNA, 32 nt, Human
acaauggucaccaagucccggaacagguugug

SEQ ID NO: 31066 - RNA, 32 nt, Human
acaauggucuuccuccaccccucugggaauca

SEQ ID NO: 31067 - RNA, 32 nt, Human
acaaugguguuagcugggcagaaagaguggca

SEQ ID NO: 31068 - RNA, 32 nt, Human
acaaugguuaggguuguuuucuuaauucuuuu

SEQ ID NO: 31069 - RNA, 32 nt, Human
acaaugguuauccugagguugguuuuuggagg

SEQ ID NO: 31070 - RNA, 32 nt, Human
acaauguacaauauuguauauucuuuguugca

SEQ ID NO: 31071 - RNA, 32 nt, Human
acaauguauagccagagaaggagaagcuccca

SEQ ID NO: 31072 - RNA, 32 nt, Human
acaauguauuaaaauauaaaacauguagaucc

SEQ ID NO: 31073 - RNA, 32 nt, Human
acaauguauuaucaaccuuuucccucucaaaa

SEQ ID NO: 31074 - RNA, 32 nt, Human
acaaugucuaguuccaacuuugcauacuauaa

SEQ ID NO: 31075 - RNA, 32 nt, Human
acaaugucuggaaggcugagcuguaugcugcu

SEQ ID NO: 31076 - RNA, 32 nt, Human
acaaugugaauagcaugcaucacaccauuggg

SEQ ID NO: 31077 - RNA, 23 nt, Human
acaaugugcagaacagucucuga

SEQ ID NO: 31078 - RNA, 32 nt, Human
acaaugugcaguggcauguggaagaaaagaag

SEQ ID NO: 31079 - RNA, 23 nt, Human
acaaugugggaagaggaagaaug

SEQ ID NO: 31080 - RNA, 32 nt, Human
acaauguguacuuugauaguacagcuggcugc

SEQ ID NO: 31081 - RNA, 32 nt, Human
acaaugugucugggucaucacagcagugaaua

SEQ ID NO: 31082 - RNA, 28 nt, Human
acaauguguggacagugucagaguagca

SEQ ID NO: 31083 - RNA, 32 nt, Human
acaauguguggaugauuucuuacacuaaagau

SEQ ID NO: 31084 - RNA, 32 nt, Human
acaauguguguauguuaauaucugauacugua

SEQ ID NO: 31085 - RNA, 32 nt, Human
acaauguucuuggcccaucaugacauugggua

SEQ ID NO: 31086 - RNA, 32 nt, Human
acaauguuucuucugcaacuggcuacuccucu

SEQ ID NO: 31087 - RNA, 32 nt, Human
acaauguuuuacaauaaacagaaagccaagcg

SEQ ID NO: 31088 - RNA, 32 nt, Human
acaauuaacauacaucauuccacacuccuugu

SEQ ID NO: 31089 - RNA, 32 nt, Human
acaauuaaggucucuuccaaauccaagaaccu

SEQ ID NO: 31090 - RNA, 32 nt, Human
acaauuaauguuuaucacaccuuuaucuuggu

SEQ ID NO: 31091 - RNA, 32 nt, Human
acaauuacaacuacacaucuauuucuaaagaa

SEQ ID NO: 31092 - RNA, 32 nt, Human
acaauuaccccacauggaaauuuagggguuuc

SEQ ID NO: 31093 - RNA, 32 nt, Human
acaauuacccuuuaguugaaguccugaaguac

SEQ ID NO: 31094 - RNA, 32 nt, Human
acaauuauacuagauggaagacuugcaucagu

SEQ ID NO: 31095 - RNA, 32 nt, Human
acaauucaaggaccagccuuuuuaccacugca

SEQ ID NO: 31096 - RNA, 32 nt, Human
acaauucagaacuuucaccacaugagauaauu

SEQ ID NO: 31097 - RNA, 32 nt, Human
acaauucaguuccucccaaccaaccagucuuc

SEQ ID NO: 31098 - RNA, 31 nt, Human
acaauucaguuucagcucuggauuacuucag

SEQ ID NO: 31099 - RNA, 32 nt, Human
acaauuccccucccccucgucuuucucuuacc

SEQ ID NO: 31100 - RNA, 32 nt, Human
acaauuccuccaggaugacagauaggacuugg

SEQ ID NO: 31101 - RNA, 32 nt, Human
acaauuccuuuucacauauuccuuucuucucc

SEQ ID NO: 31102 - RNA, 32 nt, Human
acaauucucagacaaaugaaauuggcuugaua

SEQ ID NO: 31103 - RNA, 32 nt, Human
acaauucuccaauccccucuccuuugguccag

SEQ ID NO: 31104 - RNA, 32 nt, Human
acaauucugcuuucccuggaacugugucauuc

SEQ ID NO: 31105 - RNA, 32 nt, Human
acaauucuuacugagggcagagcccagucaga

SEQ ID NO: 31106 - RNA, 20 nt, Human
acaauugaacuuccaggaaa

SEQ ID NO: 31107 - RNA, 32 nt, Human
acaauugaauaucuacauauaaaaagaauuua

SEQ ID NO: 31108 - RNA, 32 nt, Human
acaauugacagccucaagguuccuggcuuuuu

SEQ ID NO: 31109 - RNA, 32 nt, Human
acaauugcaauacuuguacuaaacacuggaau

SEQ ID NO: 31110 - RNA, 32 nt, Human
acaauugcaccaacuucucuaccauguugugg

SEQ ID NO: 31111 - RNA, 32 nt, Human
acaauugcacugcuguuccugcuccaugacug

SEQ ID NO: 31112 - RNA, 32 nt, Human
acaauugcccaccauuuacaauacucaauuuu

SEQ ID NO: 31113 - RNA, 32 nt, Human
acaauugcuaucuauccauagaccauucuuga

SEQ ID NO: 31114 - RNA, 32 nt, Human
acaauugcuguuggccagauagcagucaugac

SEQ ID NO: 31115 - RNA, 32 nt, Human
acaauuggcaagaaauuccuccccagugacau

SEQ ID NO: 31116 - RNA, 32 nt, Human
acaauuggcucuuccuggccucaggcuuuggg

SEQ ID NO: 31117 - RNA, 32 nt, Human
acaauuguagagccaccauucaaagccaggca

SEQ ID NO: 31118 - RNA, 32 nt, Human
acaauuuaaauagagacccacagagcuaaugu

SEQ ID NO: 31119 - RNA, 32 nt, Human
acaauuuacaacagcaaccacacugccuguca

SEQ ID NO: 31120 - RNA, 32 nt, Human
acaauuuaccugucaauaaagcagaagacggc

SEQ ID NO: 31121 - RNA, 32 nt, Human
acaauuuaucgaucucaucaguucucagauuu

SEQ ID NO: 31122 - RNA, 32 nt, Human
acaauuuauguuaguagacaucuuuaaaucuc

SEQ ID NO: 31123 - RNA, 32 nt, Human
acaauuucaaagagaacccacauuugugagau

SEQ ID NO: 31124 - RNA, 31 nt, Human
acaauuucaauaaauuuggggaaaacaaaua

SEQ ID NO: 31125 - RNA, 32 nt, Human
acaauuucagaagaaaucgagggcacaggccc

SEQ ID NO: 31126 - RNA, 32 nt, Human
acaauuucauuguauagauauaccucauuuua

SEQ ID NO: 31127 - RNA, 32 nt, Human
acaauuuccucuucugccaauuaaccacugag

SEQ ID NO: 31128 - RNA, 32 nt, Human
acaauuucuaccccuuuuucugcaauucucau

SEQ ID NO: 31129 - RNA, 32 nt, Human
acaauuucucucaaauuucucuuccauugagc

SEQ ID NO: 31130 - RNA, 32 nt, Human
acaauuucuggcagauguagguaaagaggaaa

SEQ ID NO: 31131 - RNA, 32 nt, Human
acaauuugacaugauggaugguguggcuggga

SEQ ID NO: 31132 - RNA, 32 nt, Human
acaauuugagccugagugaguucuguggagcc

SEQ ID NO: 31133 - RNA, 32 nt, Human
acaauuuggaguuggucucagcaggaccccau

SEQ ID NO: 31134 - RNA, 32 nt, Human
acaauuugggaacccucaaaggcugagaguau

SEQ ID NO: 31135 - RNA, 32 nt, Human
acaauuuguccacccugcagcugccggcccgc

SEQ ID NO: 31136 - RNA, 32 nt, Human
acaauuuuaagaaaaugccccucucuauuacc

SEQ ID NO: 31137 - RNA, 20 nt, Human
acaauuuucucuagcugccu

SEQ ID NO: 31138 - RNA, 32 nt, Human
acaauuuuugcacuugcuuagaagccaucuaa

SEQ ID NO: 31139 - RNA, 32 nt, Human
acacaaaaauuagccaggcaugguggcacacg

SEQ ID NO: 31140 - RNA, 32 nt, Human
acacaaaaauuagccaggcaugguggcgcaug

SEQ ID NO: 31141 - RNA, 32 nt, Human
acacaaaaauuagcuaggcaugguggcguggc

SEQ ID NO: 31142 - RNA, 32 nt, Human
acacaaaaauuagcugagcaugguggcucacg

SEQ ID NO: 31143 - RNA, 32 nt, Human
acacaaaaauuagcugggcaugguggcaggcg

SEQ ID NO: 31144 - RNA, 32 nt, Human
acacaaaaauuagcugggcauuguggcgcaca

SEQ ID NO: 31145 - RNA, 32 nt, Human
acacaaaaauuagcugggcgugguggcacacg

SEQ ID NO: 31146 - RNA, 32 nt, Human
acacaaaaauuagcugggugugguggugcgcg

SEQ ID NO: 31147 - RNA, 23 nt, Human
acacaaaaccaaacacuguuuua

SEQ ID NO: 31148 - RNA, 19 nt, Human
acacaaaacucuaaaaaua

SEQ ID NO: 31149 - RNA, 32 nt, Human
acacaaaaggagagaggggagagcaauagacu

SEQ ID NO: 31150 - RNA, 32 nt, Human
acacaaaagggaggguacaguggugggggcac

SEQ ID NO: 31151 - RNA, 32 nt, Human
acacaaacacaaauagagauuucauagcuuuc

SEQ ID NO: 31152 - RNA, 32 nt, Human
acacaaacagccuucagguuugccagggccug

SEQ ID NO: 31153 - RNA, 32 nt, Human
acacaaacauacacucacacacacaauuacua

SEQ ID NO: 31154 - RNA, 32 nt, Human
acacaaacauuagccggguaugguggcacaug

SEQ ID NO: 31155 - RNA, 32 nt, Human
acacaaaccaaaguuucuggccaucuguggcu

SEQ ID NO: 31156 - RNA, 32 nt, Human
acacaaacccaaauaacucaaccaaagcggac

SEQ ID NO: 31157 - RNA, 32 nt, Human
acacaaaccuuuuggguuaaaagcuuuaacau

SEQ ID NO: 31158 - RNA, 22 nt, Human
acacaaagaaauccugcuuuca

SEQ ID NO: 31159 - RNA, 21 nt, Human
acacaaagaaauucugucuua

SEQ ID NO: 31160 - RNA, 32 nt, Human
acacaaagagcuuauuuuguuaggcaaauaca

SEQ ID NO: 31161 - RNA, 32 nt, Human
acacaaagauugacaguaagaugcuugagaag

SEQ ID NO: 31162 - RNA, 31 nt, Human
acacaaaggaaacugcuuugaagcucucaag

SEQ ID NO: 31163 - RNA, 32 nt, Human
acacaaaggaggugggagacugcguuggugcc

SEQ ID NO: 31164 - RNA, 21 nt, Human
acacaaagggcacgugucuca

SEQ ID NO: 31165 - RNA, 32 nt, Human
acacaaaguaauuauaguucaccuuuauacac

SEQ ID NO: 31166 - RNA, 20 nt, Human
acacaaaucuagaugguagc

SEQ ID NO: 31167 - RNA, 32 nt, Human
acacaaaugaaaugucuccugagaaccauugc

SEQ ID NO: 31168 - RNA, 32 nt, Human
acacaaauguugcccaguaugugcgcauugcc

SEQ ID NO: 31169 - RNA, 32 nt, Human
acacaaauuagccuggugugguggcccgcacc

SEQ ID NO: 31170 - RNA, 32 nt, Human
acacaaauuagcugcgugugguggccuaugac

SEQ ID NO: 31171 - RNA, 32 nt, Human
acacaaauuuguuucaguugggccauaaaugu

SEQ ID NO: 31172 - RNA, 32 nt, Human
acacaacaaaaccaaaccacagaaucaucuuu

SEQ ID NO: 31173 - RNA, 32 nt, Human
acacaacaaagcagcaugcaggaacuagaaac

SEQ ID NO: 31174 - RNA, 32 nt, Human
acacaacaacagcagcagcaagcugcuacugc

SEQ ID NO: 31175 - RNA, 32 nt, Human
acacaacacagcugccguuucuucugccugcu

SEQ ID NO: 31176 - RNA, 19 nt, Human
acacaacacgcaccucgug

SEQ ID NO: 31177 - RNA, 32 nt, Human
acacaacagacacacaucacaaggcgaacaca

SEQ ID NO: 31178 - RNA, 32 nt, Human
acacaacagccccacgagcaucugccauccag

SEQ ID NO: 31179 - RNA, 32 nt, Human
acacaacauaccagaaucucugggacacauuc

SEQ ID NO: 31180 - RNA, 32 nt, Human
acacaacauaccagaaucucugggacacauuu

SEQ ID NO: 31181 - RNA, 32 nt, Human
acacaacauauguaagcaacgcuacugguuca

SEQ ID NO: 31182 - RNA, 32 nt, Human
acacaaccaagcaauccucgcuuuacagauga

SEQ ID NO: 31183 - RNA, 32 nt, Human
acacaaccagaaggagcugaguuuggcaacaa

SEQ ID NO: 31184 - RNA, 22 nt, Human
acacaacccccuauaccuggaa

SEQ ID NO: 31185 - RNA, 32 nt, Human
acacaaccucuuuuuagcaucagaccuaccug

SEQ ID NO: 31186 - RNA, 32 nt, Human
acacaaccugccuggccgggcgugguggcgug

SEQ ID NO: 31187 - RNA, 21 nt, Human
acacaacguugaaaacuuccu

SEQ ID NO: 31188 - RNA, 32 nt, Human
acacaacucagggcuuuugugaagguuccccc

SEQ ID NO: 31189 - RNA, 32 nt, Human
acacaacugcacuccagccugggcaacagaac

SEQ ID NO: 31190 - RNA, 32 nt, Human
acacaacugcacuccagcuugggcaacagggc

SEQ ID NO: 31191 - RNA, 32 nt, Human
acacaacuguggucccagcuacaggggaggcu

SEQ ID NO: 31192 - RNA, 32 nt, Human
acacaagacagugaccaagaaaccacuaauuu

SEQ ID NO: 31193 - RNA, 32 nt, Human
acacaagacaguuugaggcauauuucuuaauc

SEQ ID NO: 31194 - RNA, 32 nt, Human
acacaagaguaguaauguuggcaauuugggua

SEQ ID NO: 31195 - RNA, 22 nt, Human
acacaagaguugauaacuuccu

SEQ ID NO: 31196 - RNA, 32 nt, Human
acacaagcacacacauacacaucuuuguaacu

SEQ ID NO: 31197 - RNA, 32 nt, Human
acacaagcaguacggaugaagacucugagucu

SEQ ID NO: 31198 - RNA, 23 nt, Human
acacaagcccacuugaccuggaa

SEQ ID NO: 31199 - RNA, 32 nt, Human
acacaagccuuuucacacagcacuccccucag

SEQ ID NO: 31200 - RNA, 32 nt, Human
acacaagcuaaguuuccaaggaccauuugcag

SEQ ID NO: 31201 - RNA, 32 nt, Human
acacaagcuacacauuuuauacuuuucauaaa

SEQ ID NO: 31202 - RNA, 21 nt, Human
acacaagcucacuagagugag

SEQ ID NO: 31203 - RNA, 32 nt, Human
acacaagcuccgguagcccauggagcccuggc

SEQ ID NO: 31204 - RNA, 32 nt, Human
acacaaggacagaaagcggaaaaagagaaaga

SEQ ID NO: 31205 - RNA, 32 nt, Human
acacaaggagaaagugagcucagccuggauaa

SEQ ID NO: 31206 - RNA, 32 nt, Human
acacaaggagccaggaguaaucagggcagacc

SEQ ID NO: 31207 - RNA, 32 nt, Human
acacaaggaggcagaggagcuaaccccucuac

SEQ ID NO: 31208 - RNA, 32 nt, Human
acacaaggccggggaagccacagccaagaaau

SEQ ID NO: 31209 - RNA, 32 nt, Human
acacaaggggaaacaggugcagguguguacag

SEQ ID NO: 31210 - RNA, 32 nt, Human
acacaaggguccacagccaaggaaaaggaguc

SEQ ID NO: 31211 - RNA, 32 nt, Human
acacaaggguuccuuauagugauggaagugaa

SEQ ID NO: 31212 - RNA, 32 nt, Human
acacaaggugauuucagacugcagaggggaaa

SEQ ID NO: 31213 - RNA, 32 nt, Human
acacaagugagagagacaauagugaaggcaaa

SEQ ID NO: 31214 - RNA, 31 nt, Human
acacaaguggagagagagguggccugacauu

SEQ ID NO: 31215 - RNA, 32 nt, Human
acacaagugucacccucagugccgagcuggcu

SEQ ID NO: 31216 - RNA, 32 nt, Human
acacaagugucuucucauaagauuuauagaaa

SEQ ID NO: 31217 - RNA, 32 nt, Human
acacaaguucagugaaaaguugauucuuugaa

SEQ ID NO: 31218 - RNA, 32 nt, Human
acacaaguuuucuuuuugaucucccucucccc

SEQ ID NO: 31219 - RNA, 32 nt, Human
acacaauacugugguguuggcaccaauggaca

SEQ ID NO: 31220 - RNA, 32 nt, Human
acacaauagaucagugcuucuuuccuagacaa

SEQ ID NO: 31221 - RNA, 32 nt, Human
acacaaucagcuuuaaccaauggaugaggggg

SEQ ID NO: 31222 - RNA, 32 nt, Human
acacaaucauagcacaccacagccugaaaauc

SEQ ID NO: 31223 - RNA, 32 nt, Human
acacaauccugccucagccuccuauauagcag

SEQ ID NO: 31224 - RNA, 32 nt, Human
acacaaucuuccuauaauccugaaccacaaaa

SEQ ID NO: 31225 - RNA, 20 nt, Human
acacaaugaggaaauaggga

SEQ ID NO: 31226 - RNA, 32 nt, Human
acacaaugugucugagagauucaugcugauug

SEQ ID NO: 31227 - RNA, 32 nt, Human
acacaauucaauuaaagaaagggaaauacaag

SEQ ID NO: 31228 - RNA, 32 nt, Human
acacaauucauuugcauuucuauggcaccaag

SEQ ID NO: 31229 - RNA, 32 nt, Human
acacaauugcagcugcauucugcaucgcugaa

SEQ ID NO: 31230 - RNA, 32 nt, Human
acacaauugcaguccagccugggcagcaagag

SEQ ID NO: 31231 - RNA, 32 nt, Human
acacaauugccuggauaccugaaggaauggag

SEQ ID NO: 31232 - RNA, 32 nt, Human
acacaauuguucugcugaagaguugucaucaa

SEQ ID NO: 31233 - RNA, 32 nt, Human
acacaauuuugccuuuuuguaauucuauuuga

SEQ ID NO: 31234 - RNA, 32 nt, Human
acacacaaacacagaaccacacagccaguccc

SEQ ID NO: 31235 - RNA, 32 nt, Human
acacacaaacauacacucacacacacaauuac

SEQ ID NO: 31236 - RNA, 32 nt, Human
acacacaaauuagccgggcaugguggcuggug

SEQ ID NO: 31237 - RNA, 32 nt, Human
acacacaaauuagcugggcgugguggcggacg

SEQ ID NO: 31238 - RNA, 32 nt, Human
acacacaaauuaggugggcaugguggcaggug

SEQ ID NO: 31239 - RNA, 32 nt, Human
acacacaaccuccuccuccucuuccagcaagg

SEQ ID NO: 31240 - RNA, 32 nt, Human
acacacaacuccagaggcgccauuuacacugu

SEQ ID NO: 31241 - RNA, 32 nt, Human
acacacaagccuuuucugcaggcaggaguuuc

SEQ ID NO: 31242 - RNA, 32 nt, Human
acacacaauauuucccucuaccaaaauaauuu

SEQ ID NO: 31243 - RNA, 26 nt, Human
acacacaaucuauauauguauauaca

SEQ ID NO: 31244 - RNA, 22 nt, Human
acacacacaaaaagaggucagu

SEQ ID NO: 31245 - RNA, 32 nt, Human
acacacacaaacaugcacacacacauaugcau

SEQ ID NO: 31246 - RNA, 18 nt, Human
acacacacaaauccuuga

SEQ ID NO: 31247 - RNA, 32 nt, Human
acacacacaaauuagccgggcaugguggcugg

SEQ ID NO: 31248 - RNA, 32 nt, Human
acacacacaaauuagcugggcgugguggcgga

SEQ ID NO: 31249 - RNA, 32 nt, Human
acacacacaaauuaggugggcaugguggcagg

SEQ ID NO: 31250 - RNA, 20 nt, Human
acacacacaagaggucaguu

SEQ ID NO: 31251 - RNA, 32 nt, Human
acacacacagcucagacccacggacaggaccc

SEQ ID NO: 31252 - RNA, 32 nt, Human
acacacacaggauaccagcaauggauggcagg

SEQ ID NO: 31253 - RNA, 32 nt, Human
acacacacagguggggacugggcacagcucuu

SEQ ID NO: 31254 - RNA, 32 nt, Human
acacacacauacacagagacucuuucauuuuu

SEQ ID NO: 31255 - RNA, 32 nt, Human
acacacacaucacacacacaucacaaugacaa

SEQ ID NO: 31256 - RNA, 32 nt, Human
acacacacauucuuucuuccaucaaagccucc

SEQ ID NO: 31257 - RNA, 32 nt, Human
acacacacccacccacacaccauucagaacau

SEQ ID NO: 31258 - RNA, 32 nt, Human
acacacacccacccccuccugcugacacucuc

SEQ ID NO: 31259 - RNA, 32 nt, Human
acacacaccccacaggcacacagggucaagaa

SEQ ID NO: 31260 - RNA, 18 nt, Human
acacacacgacacaggga

SEQ ID NO: 31261 - RNA, 32 nt, Human
acacacacgcacaaacacacaugcccacacaa

SEQ ID NO: 31262 - RNA, 32 nt, Human
acacacacgcacacaaaccacaccacacacac

SEQ ID NO: 31263 - RNA, 32 nt, Human
acacacacgugugcacacacaaugcacacaac

SEQ ID NO: 31264 - RNA, 32 nt, Human
acacacacucacagacccacacacauacacac

SEQ ID NO: 31265 - RNA, 32 nt, Human
acacacacucacugcggagaaccuugugccug

SEQ ID NO: 31266 - RNA, 32 nt, Human
acacacacuuccucaucacugcagccauugug

SEQ ID NO: 31267 - RNA, 32 nt, Human
acacacacuuccuucaaaagaccaaaagugac

SEQ ID NO: 31268 - RNA, 32 nt, Human
acacacacuugugcacaugugugcacagacac

SEQ ID NO: 31269 - RNA, 32 nt, Human
acacacagacacacaagcagacacacacauau

SEQ ID NO: 31270 - RNA, 32 nt, Human
acacacagacacacagagucacacacacucac

SEQ ID NO: 31271 - RNA, 32 nt, Human
acacacagacacacccucugccacacugcucu

SEQ ID NO: 31272 - RNA, 32 nt, Human
acacacagagagaaggaagagcagacagaggc

SEQ ID NO: 31273 - RNA, 32 nt, Human
acacacagagagacggcgaggaagggaaagac

SEQ ID NO: 31274 - RNA, 32 nt, Human
acacacagagcaaacucccuuucauaaaagcc

SEQ ID NO: 31275 - RNA, 21 nt, Human
acacacagaugcacacacaga

SEQ ID NO: 31276 - RNA, 32 nt, Human
acacacagaugcauaggccugccuuccggaga

SEQ ID NO: 31277 - RNA, 32 nt, Human
acacacagauuccugucccuuugccaacuacu

SEQ ID NO: 31278 - RNA, 21 nt, Human
acacacagccacacacacaga

SEQ ID NO: 31279 - RNA, 32 nt, Human
acacacagccccggaagugcugacugacaagg

SEQ ID NO: 31280 - RNA, 32 nt, Human
acacacagccuccucuuggucugaguaggcau

SEQ ID NO: 31281 - RNA, 32 nt, Human
acacacagcucugggugcacacucagagacag

SEQ ID NO: 31282 - RNA, 32 nt, Human
acacacaggaagagaaagagaucaggcaacag

SEQ ID NO: 31283 - RNA, 25 nt, Human
acacacaggcauacucacacacaga

SEQ ID NO: 31284 - RNA, 32 nt, Human
acacacaggguuucaucauguuguccaggcug

SEQ ID NO: 31285 - RNA, 32 nt, Human
acacacagucuaucauacauguacauacucac

SEQ ID NO: 31286 - RNA, 32 nt, Human
acacacauaaaccauacaacaaacaugagcuu

SEQ ID NO: 31287 - RNA, 21 nt, Human
acacacauaaacguauacaca

SEQ ID NO: 31288 - RNA, 32 nt, Human
acacacauacacaaaugcacacacaugcacac

SEQ ID NO: 31289 - RNA, 32 nt, Human
acacacauacacuccugcgugugcacaagcac

SEQ ID NO: 31290 - RNA, 21 nt, Human
acacacauacauacacacaca

SEQ ID NO: 31291 - RNA, 21 nt, Human
acacacauauacauauauaca

SEQ ID NO: 31292 - RNA, 21 nt, Human
acacacauauauacauacgca

SEQ ID NO: 31293 - RNA, 19 nt, Human
acacacauauauauacaca

SEQ ID NO: 31294 - RNA, 21 nt, Human
acacacauauauguauacgca

SEQ ID NO: 31295 - RNA, 21 nt, Human
acacacauauauguauauaua

SEQ ID NO: 31296 - RNA, 32 nt, Human
acacacauccccaagaaccucgagcucacacc

SEQ ID NO: 31297 - RNA, 32 nt, Human
acacacaucccuugauuccucccugauguggu

SEQ ID NO: 31298 - RNA, 32 nt, Human
acacacauccuccaucccagcauagagaaugg

SEQ ID NO: 31299 - RNA, 32 nt, Human
acacacaugcacacccucucacguccuccaga

SEQ ID NO: 31300 - RNA, 32 nt, Human
acacacaugcaccgcacacauauccaugcaca

SEQ ID NO: 31301 - RNA, 22 nt, Human
acacacaugcagugagaggccu

SEQ ID NO: 31302 - RNA, 21 nt, Human
acacacaugcauacacacaca

SEQ ID NO: 31303 - RNA, 32 nt, Human
acacacaugcgccugcagcacaugcuucuguc

SEQ ID NO: 31304 - RNA, 32 nt, Human
acacacaugugauuucagaagcguucuguggg

SEQ ID NO: 31305 - RNA, 32 nt, Human
acacacauguuuucuuuccagcuuugaagagc

SEQ ID NO: 31306 - RNA, 31 nt, Human
acacacauuacuucuuuucauucuaagaauc

SEQ ID NO: 31307 - RNA, 32 nt, Human
acacacauuagagaaaggacagaggucugcuc

SEQ ID NO: 31308 - RNA, 32 nt, Human
acacacauugauagggcagagcagggagugug

SEQ ID NO: 31309 - RNA, 32 nt, Human
acacacauugcagcuucaacuuuucucuuuag

SEQ ID NO: 31310 - RNA, 32 nt, Human
acacacauugucuccagcuuucaggcuuacug

SEQ ID NO: 31311 - RNA, 23 nt, Human
acacacauuuacuacacacacag

SEQ ID NO: 31312 - RNA, 32 nt, Human
acacaccaagccccacaaagccccuaaaggag

SEQ ID NO: 31313 - RNA, 32 nt, Human
acacaccacacacacucacacucacacacacu

SEQ ID NO: 31314 - RNA, 32 nt, Human
acacaccacacaccacacacaccccacuggca

SEQ ID NO: 31315 - RNA, 23 nt, Human
acacaccacacaucacacacaga

SEQ ID NO: 31316 - RNA, 32 nt, Human
acacaccaccgccugcccucccuccuuccucc

SEQ ID NO: 31317 - RNA, 32 nt, Human
acacaccagcuauauucauuugccaagaucaa

SEQ ID NO: 31318 - RNA, 32 nt, Human
acacaccagguuuaauagauccuggccucagg

SEQ ID NO: 31319 - RNA, 32 nt, Human
acacaccaguaaucccagcuacucgggaggcu

SEQ ID NO: 31320 - RNA, 32 nt, Human
acacaccaguagucccagcuacuagggaggca

SEQ ID NO: 31321 - RNA, 32 nt, Human
acacaccaguagucccagcuacuccugaggcu

SEQ ID NO: 31322 - RNA, 18 nt, Human
acacaccaucaccuuuga

SEQ ID NO: 31323 - RNA, 32 nt, Human
acacacccaaagaugucuuuggagauccccgg

SEQ ID NO: 31324 - RNA, 32 nt, Human
acacacccaagugccccucacaccucgugccu

SEQ ID NO: 31325 - RNA, 32 nt, Human
acacacccacaccaggccucaggauuuugugu

SEQ ID NO: 31326 - RNA, 32 nt, Human
acacacccagagagaagacagagagaaaaucc

SEQ ID NO: 31327 - RNA, 32 nt, Human
acacacccaggccaucguggugauggagugcc

SEQ ID NO: 31328 - RNA, 21 nt, Human
acacacccccacacacacgga

SEQ ID NO: 31329 - RNA, 32 nt, Human
acacaccccuugagaagaagcugcucugggga

SEQ ID NO: 31330 - RNA, 20 nt, Human
acacacccguaguuccagcu

SEQ ID NO: 31331 - RNA, 32 nt, Human
acacacccguaguuccagcuacuugggaggcu

SEQ ID NO: 31332 - RNA, 32 nt, Human
acacacccucugccacacugcucucuuccuuc

SEQ ID NO: 31333 - RNA, 32 nt, Human
acacacccugccacuuucaccaucccauaucc

SEQ ID NO: 31334 - RNA, 20 nt, Human
acacacccugccuuccagcu

SEQ ID NO: 31335 - RNA, 32 nt, Human
acacacccugcguuucucccucccaggcuagg

SEQ ID NO: 31336 - RNA, 32 nt, Human
acacacccugcucugggaucccuugugaggcu

SEQ ID NO: 31337 - RNA, 32 nt, Human
acacacccugggggcagcucucugccagcccc

SEQ ID NO: 31338 - RNA, 25 nt, Human
acacacccuuucucgcacacacaca

SEQ ID NO: 31339 - RNA, 23 nt, Human
acacaccgauguacacacacaga

SEQ ID NO: 31340 - RNA, 25 nt, Human
acacaccgaugugcgcacacacaga

SEQ ID NO: 31341 - RNA, 32 nt, Human
acacaccgcagcaaagagaagacugaaagaca

SEQ ID NO: 31342 - RNA, 25 nt, Human
acacaccgcaggaaagccagggccu

SEQ ID NO: 31343 - RNA, 32 nt, Human
acacaccgguaaucccagcuacucaggaggcu

SEQ ID NO: 31344 - RNA, 21 nt, Human
acacaccguacgauuccagcu

SEQ ID NO: 31345 - RNA, 20 nt, Human
acacaccuaaagucccagcu

SEQ ID NO: 31346 - RNA, 32 nt, Human
acacaccuaaagucccagcuacuugggagguu

SEQ ID NO: 31347 - RNA, 32 nt, Human
acacaccuacucugcuccccucucacacaucu

SEQ ID NO: 31348 - RNA, 32 nt, Human
acacaccuauaaacccagcuacucaggaggcu

SEQ ID NO: 31349 - RNA, 32 nt, Human
acacaccuauaauuccagcuacuugagaggcu

SEQ ID NO: 31350 - RNA, 20 nt, Human
acacaccuauagucccagcu

SEQ ID NO: 31351 - RNA, 32 nt, Human
acacaccuauagucccagcuacuugggaggcu

SEQ ID NO: 31352 - RNA, 32 nt, Human
acacaccuauagucccagcugcccaggaggcu

SEQ ID NO: 31353 - RNA, 32 nt, Human
acacaccuccacuuguuauauaaccuguuugu

SEQ ID NO: 31354 - RNA, 32 nt, Human
acacaccucccugcagccuggcacuggaaacu

SEQ ID NO: 31355 - RNA, 32 nt, Human
acacaccucuacuucuguucuucccucacucc

SEQ ID NO: 31356 - RNA, 32 nt, Human
acacaccugcaaucccagcuacucgggaggcu

SEQ ID NO: 31357 - RNA, 32 nt, Human
acacaccugcagcagcucacacgggaggccau

SEQ ID NO: 31358 - RNA, 32 nt, Human
acacaccugcauucccagcuacuugggaggcu

SEQ ID NO: 31359 - RNA, 32 nt, Human
acacaccugggggcccccacacccaguccuca

SEQ ID NO: 31360 - RNA, 32 nt, Human
acacaccuguaaucccagcuaccggggaggcu

SEQ ID NO: 31361 - RNA, 32 nt, Human
acacaccuguaaucccagcuacucaggaagcu

SEQ ID NO: 31362 - RNA, 32 nt, Human
acacaccuguaaucccagcuacucaggaggcc

SEQ ID NO: 31363 - RNA, 32 nt, Human
acacaccuguaaucccagcuacucaggaggcu

SEQ ID NO: 31364 - RNA, 32 nt, Human
acacaccuguaaucccagcuacucggaggcug

SEQ ID NO: 31365 - RNA, 32 nt, Human
acacaccuguaaucccagcuacucgggaggcu

SEQ ID NO: 31366 - RNA, 32 nt, Human
acacaccuguaaucccagcuacucuggaggcu

SEQ ID NO: 31367 - RNA, 32 nt, Human
acacaccuguaaucccagcuacuugagaggca

SEQ ID NO: 31368 - RNA, 32 nt, Human
acacaccuguaaucccagcuauuugggaggcc

SEQ ID NO: 31369 - RNA, 32 nt, Human
acacaccuguaaucccaguuacucaggaggca

SEQ ID NO: 31370 - RNA, 32 nt, Human
acacaccuguaaucccaguuacuugggaggcu

SEQ ID NO: 31371 - RNA, 32 nt, Human
acacaccuguaaucguagcugaggcaggagaa

SEQ ID NO: 31372 - RNA, 20 nt, Human
acacaccuguaaucucagcu

SEQ ID NO: 31373 - RNA, 32 nt, Human
acacaccuguaaucucagcuacucaggaggcu

SEQ ID NO: 31374 - RNA, 32 nt, Human
acacaccuguaaucucaguuacucaggaggcu

SEQ ID NO: 31375 - RNA, 20 nt, Human
acacaccuguaguaccagcu

SEQ ID NO: 31376 - RNA, 32 nt, Human
acacaccuguaguaccagcuacucuggaggcu

SEQ ID NO: 31377 - RNA, 20 nt, Human
acacaccuguagucccagcu

SEQ ID NO: 31378 - RNA, 32 nt, Human
acacaccuguagucccagcuacaugggaggcu

SEQ ID NO: 31379 - RNA, 32 nt, Human
acacaccuguagucccagcuacucaggaggcu

SEQ ID NO: 31380 - RNA, 32 nt, Human
acacaccuguagucccagcuacucaggagguu

SEQ ID NO: 31381 - RNA, 32 nt, Human
acacaccuguagucccagcuacucagggggcu

SEQ ID NO: 31382 - RNA, 32 nt, Human
acacaccuguagucccagcuacucgaaaggcu

SEQ ID NO: 31383 - RNA, 32 nt, Human
acacaccuguagucccagcuacucgggaagcu

SEQ ID NO: 31384 - RNA, 32 nt, Human
acacaccuguagucccagcuacucgggagccc

SEQ ID NO: 31385 - RNA, 32 nt, Human
acacaccuguagucccagcuacucgggaggcu

SEQ ID NO: 31386 - RNA, 32 nt, Human
acacaccuguagucccagcuacucuagaggcu

SEQ ID NO: 31387 - RNA, 32 nt, Human
acacaccuguagucccagcuacuuaggaggcu

SEQ ID NO: 31388 - RNA, 32 nt, Human
acacaccuguagucccagcuacuugagaggcu

SEQ ID NO: 31389 - RNA, 32 nt, Human
acacaccuguagucccagcuacuuggcaggcu

SEQ ID NO: 31390 - RNA, 32 nt, Human
acacaccuguagucccagcuagucaagaggcu

SEQ ID NO: 31391 - RNA, 32 nt, Human
acacaccuguagucccagcugcucaggaggcu

SEQ ID NO: 31392 - RNA, 32 nt, Human
acacaccuguagucccagcugcuccugaggcu

SEQ ID NO: 31393 - RNA, 21 nt, Human
acacaccuguagucccaggcu

SEQ ID NO: 31394 - RNA, 32 nt, Human
acacaccuguagucccggcuacucgggaggcu

SEQ ID NO: 31395 - RNA, 19 nt, Human
acacaccuguaguccgagc

SEQ ID NO: 31396 - RNA, 20 nt, Human
acacaccuguagucucagcu

SEQ ID NO: 31397 - RNA, 32 nt, Human
acacaccuguaguuccagcuacucaguaggcu

SEQ ID NO: 31398 - RNA, 32 nt, Human
acacaccugugcacacaugccuacaggccagc

SEQ ID NO: 31399 - RNA, 20 nt, Human
acacaccuguggucccagcu

SEQ ID NO: 31400 - RNA, 32 nt, Human
acacaccuguggucccagcuacuagggaggcu

SEQ ID NO: 31401 - RNA, 32 nt, Human
acacaccuguggucccagcuacucgggaggcu

SEQ ID NO: 31402 - RNA, 32 nt, Human
acacaccuguggucccagcugcucgggaggcu

SEQ ID NO: 31403 - RNA, 17 nt, Human
acacaccuuuggccuca

SEQ ID NO: 31404 - RNA, 32 nt, Human
acacacgaauccacagcaauccaucagauaug

SEQ ID NO: 31405 - RNA, 32 nt, Human
acacacgacugcauccuucaucugccaggccc

SEQ ID NO: 31406 - RNA, 32 nt, Human
acacacgagagacagaaggaaagagaggaaga

SEQ ID NO: 31407 - RNA, 21 nt, Human
acacacgaggaggcaggaccu

SEQ ID NO: 31408 - RNA, 32 nt, Human
acacacgcacacacaugcacacacgcacacgc

SEQ ID NO: 31409 - RNA, 32 nt, Human
acacacgcacacacgcacacaaacaugcacac

SEQ ID NO: 31410 - RNA, 32 nt, Human
acacacgccuguaaucccagcugcucgggagg

SEQ ID NO: 31411 - RNA, 32 nt, Human
acacacgccuucagguuugcucagggguucau

SEQ ID NO: 31412 - RNA, 32 nt, Human
acacacgcgggcuggcuuacacaugcucuugc

SEQ ID NO: 31413 - RNA, 32 nt, Human
acacacggaggccagacacaggccgugggacc

SEQ ID NO: 31414 - RNA, 21 nt, Human
acacacggaugcacacacaga

SEQ ID NO: 31415 - RNA, 32 nt, Human
acacacggccccggacggccagaggggaaccg

SEQ ID NO: 31416 - RNA, 32 nt, Human
acacacgggucccuuugcguguuuccaaucuc

SEQ ID NO: 31417 - RNA, 18 nt, Human
acacacgguaauccuugg

SEQ ID NO: 31418 - RNA, 32 nt, Human
acacacgguccuaagagcugggcaccaggaag

SEQ ID NO: 31419 - RNA, 32 nt, Human
acacacgugcgccuucauagcccagccaaggc

SEQ ID NO: 31420 - RNA, 32 nt, Human
acacacgugcuuccucucuugacaucaaggga

SEQ ID NO: 31421 - RNA, 32 nt, Human
acacacgugggugcuggcugggugaggcaagc

SEQ ID NO: 31422 - RNA, 32 nt, Human
acacacguguggucccagcuacucaagaggug

SEQ ID NO: 31423 - RNA, 32 nt, Human
acacacuaaucgaacuaugaacuacaaagcuu

SEQ ID NO: 31424 - RNA, 32 nt, Human
acacacuagcauauaggaaauauuucugcacu

SEQ ID NO: 31425 - RNA, 32 nt, Human
acacacuaugaguguaaugaaagggggauuaa

SEQ ID NO: 31426 - RNA, 32 nt, Human
acacacucaagucacugccgcccagggcuggc

SEQ ID NO: 31427 - RNA, 32 nt, Human
acacacucacacacacaggcauacucacacac

SEQ ID NO: 31428 - RNA, 32 nt, Human
acacacucacacacauccacacacaagcauau

SEQ ID NO: 31429 - RNA, 32 nt, Human
acacacucacacacccuguuuuucuuacacac

SEQ ID NO: 31430 - RNA, 32 nt, Human
acacacucacacucacacacacucacacacac

SEQ ID NO: 31431 - RNA, 32 nt, Human
acacacucacauaggcaggugcacguuaguca

SEQ ID NO: 31432 - RNA, 32 nt, Human
acacacucaggaagccuugucuaccuuucccu

SEQ ID NO: 31433 - RNA, 32 nt, Human
acacacucauaagaagacaccuauauacauuu

SEQ ID NO: 31434 - RNA, 21 nt, Human
acacacucaugcacacacaca

SEQ ID NO: 31435 - RNA, 25 nt, Human
acacacucaugcucacacacacaga

SEQ ID NO: 31436 - RNA, 32 nt, Human
acacacucaugcuuucacauacauacacucac

SEQ ID NO: 31437 - RNA, 32 nt, Human
acacacuccaacaauccaaaggggcauguugc

SEQ ID NO: 31438 - RNA, 32 nt, Human
acacacuccaucagcuuaggggcugcugaccu

SEQ ID NO: 31439 - RNA, 32 nt, Human
acacacucccagcuggcccaguuugugcauga

SEQ ID NO: 31440 - RNA, 32 nt, Human
acacacuccccagggauuugugcauguccuuc

SEQ ID NO: 31441 - RNA, 32 nt, Human
acacacuccuacugaaaauuagcccuccagca

SEQ ID NO: 31442 - RNA, 32 nt, Human
acacacuccuauaauccuagcacuuugggagg

SEQ ID NO: 31443 - RNA, 32 nt, Human
acacacuccuuuuuccccuccuaguuccaaau

SEQ ID NO: 31444 - RNA, 32 nt, Human
acacacucgcucaugcucacacugccccugcu

SEQ ID NO: 31445 - RNA, 20 nt, Human
acacacucggaccccccggg

SEQ ID NO: 31446 - RNA, 23 nt, Human
acacacucucacacucgcccaga

SEQ ID NO: 31447 - RNA, 25 nt, Human
acacacucucacauguacacacaca

SEQ ID NO: 31448 - RNA, 23 nt, Human
acacacucucauucacacacaca

SEQ ID NO: 31449 - RNA, 32 nt, Human
acacacucugagcacauuaucugugauucuuu

SEQ ID NO: 31450 - RNA, 32 nt, Human
acacacucuguagcuuuucuaaaacaguacau

SEQ ID NO: 31451 - RNA, 32 nt, Human
acacacucuugggcugaccuuuauuuuaucaa

SEQ ID NO: 31452 - RNA, 32 nt, Human
acacacugacaccucccgaaguggaccacaag

SEQ ID NO: 31453 - RNA, 32 nt, Human
acacacugcaugcacacacauacaccacagcc

SEQ ID NO: 31454 - RNA, 32 nt, Human
acacacugcccggcucagugcagugccccgcg

SEQ ID NO: 31455 - RNA, 32 nt, Human
acacacugccgcuucaaucuccugggcucaaa

SEQ ID NO: 31456 - RNA, 32 nt, Human
acacacugccuuuggggcuccugggcucauuu

SEQ ID NO: 31457 - RNA, 32 nt, Human
acacacugcuaugcaaaccccaaaggguuggc

SEQ ID NO: 31458 - RNA, 32 nt, Human
acacacuggaaaaaccaccaacaugguccagc

SEQ ID NO: 31459 - RNA, 32 nt, Human
acacacuggacaccaucaccucuuuggaacug

SEQ ID NO: 31460 - RNA, 32 nt, Human
acacacuggaggcucuugcugcucugagccac

SEQ ID NO: 31461 - RNA, 21 nt, Human
acacacuggcacacacacaua

SEQ ID NO: 31462 - RNA, 32 nt, Human
acacacugucauacucacacacucccugacau

SEQ ID NO: 31463 - RNA, 32 nt, Human
acacacugucuuuaaaucuaggccuguauccg

SEQ ID NO: 31464 - RNA, 32 nt, Human
acacacuguggggaggaggaggaagaagagga

SEQ ID NO: 31465 - RNA, 32 nt, Human
acacacuuaauucaaagacauauggguacuua

SEQ ID NO: 31466 - RNA, 32 nt, Human
acacacuucccaaaacguccccagccacagcu

SEQ ID NO: 31467 - RNA, 32 nt, Human
acacacuucugaucuugggggccaguggaguc

SEQ ID NO: 31468 - RNA, 21 nt, Human
acacacuugaguagcccaggc

SEQ ID NO: 31469 - RNA, 32 nt, Human
acacacuugcaccauggggagccaccccaccc

SEQ ID NO: 31470 - RNA, 32 nt, Human
acacacuugcuacaguucgauggggagggugg

SEQ ID NO: 31471 - RNA, 32 nt, Human
acacacuuguagccccagcuacuagggaggcu

SEQ ID NO: 31472 - RNA, 32 nt, Human
acacacuuguaguccgagcuacucgggaggcu

SEQ ID NO: 31473 - RNA, 20 nt, Human
acacacuuuuagcucaguua

SEQ ID NO: 31474 - RNA, 32 nt, Human
acacagaaaacaaaaacccaaccaaaccaagc

SEQ ID NO: 31475 - RNA, 32 nt, Human
acacagaaaauguuaaggauuucaagagcccu

SEQ ID NO: 31476 - RNA, 32 nt, Human
acacagaaagugagaguggggagagagguagu

SEQ ID NO: 31477 - RNA, 32 nt, Human
acacagaacacuguuccaucucagggauugcu

SEQ ID NO: 31478 - RNA, 31 nt, Human
acacagaagagacccugccacaggaggagug

SEQ ID NO: 31479 - RNA, 32 nt, Human
acacagaagcagcccugcccagccuggucauu

SEQ ID NO: 31480 - RNA, 32 nt, Human
acacagaaggcagacugggugaggagaccuag

SEQ ID NO: 31481 - RNA, 32 nt, Human
acacagaagguggagguugcagugagccaagc

SEQ ID NO: 31482 - RNA, 32 nt, Human
acacagaauaugggaauggcagcugcugaacu

SEQ ID NO: 31483 - RNA, 32 nt, Human
acacagaaugucuggagagggcagcaggccuc

SEQ ID NO: 31484 - RNA, 32 nt, Human
acacagacacacaagcagacacacacauauau

SEQ ID NO: 31485 - RNA, 32 nt, Human
acacagacaugcuggcagugagagugaaaggc

SEQ ID NO: 31486 - RNA, 32 nt, Human
acacagacucacccuccuucugagaccuugau

SEQ ID NO: 31487 - RNA, 32 nt, Human
acacagagaccuuugcuuacguuuuccugcug

SEQ ID NO: 31488 - RNA, 32 nt, Human
acacagagagaaaggcuaaaguucucuggagg

SEQ ID NO: 31489 - RNA, 32 nt, Human
acacagagagggacaaacacagccaugaaccc

SEQ ID NO: 31490 - RNA, 32 nt, Human
acacagagauccccuaagguccuggcccaggc

SEQ ID NO: 31491 - RNA, 32 nt, Human
acacagagauguaagaggcaggcuuuaauugc

SEQ ID NO: 31492 - RNA, 32 nt, Human
acacagagcaccagcucccuccugccugaaga

SEQ ID NO: 31493 - RNA, 32 nt, Human
acacagagcccccuagauggugggggaauggc

SEQ ID NO: 31494 - RNA, 32 nt, Human
acacagagccuucugcaugccuguccucccuc

SEQ ID NO: 31495 - RNA, 32 nt, Human
acacagagcuggcugcugugcccacccucagg

SEQ ID NO: 31496 - RNA, 32 nt, Human
acacagaggaagcacuacagccucacagacug

SEQ ID NO: 31497 - RNA, 32 nt, Human
acacagaggagaagauccugugaagagggagg

SEQ ID NO: 31498 - RNA, 32 nt, Human
acacagaggcucagagagguuuagucauuugc

SEQ ID NO: 31499 - RNA, 32 nt, Human
acacagaggggcccuggacggaggcauccacu

SEQ ID NO: 31500 - RNA, 32 nt, Human
acacagaggugcacuggucugcauuugggggc

SEQ ID NO: 31501 - RNA, 32 nt, Human
acacagaggugcaggcaccaggauucuccacu

SEQ ID NO: 31502 - RNA, 32 nt, Human
acacagagguggccaugaaaugguuaauagca

SEQ ID NO: 31503 - RNA, 32 nt, Human
acacagagugggagggagacugaugcaggccu

SEQ ID NO: 31504 - RNA, 32 nt, Human
acacagaguuaaguaauuugcccagggucaca

SEQ ID NO: 31505 - RNA, 32 nt, Human
acacagaguuggcagcacaaagggccugggcc

SEQ ID NO: 31506 - RNA, 32 nt, Human
acacagaguuugagcagcaauaaggcuggguc

SEQ ID NO: 31507 - RNA, 32 nt, Human
acacagauaauauccacauacacauucacugg

SEQ ID NO: 31508 - RNA, 32 nt, Human
acacagaugacccagacccaaagagccuggca

SEQ ID NO: 31509 - RNA, 32 nt, Human
acacagcaaaaugccagcagcgugccggaccc

SEQ ID NO: 31510 - RNA, 32 nt, Human
acacagcaaaggagggaguggaagagagauga

SEQ ID NO: 31511 - RNA, 32 nt, Human
acacagcaaggacugcuguguguggguguguu

SEQ ID NO: 31512 - RNA, 32 nt, Human
acacagcaagggugggagacagcugggcacaa

SEQ ID NO: 31513 - RNA, 19 nt, Human
acacagcaagugcccuuga

SEQ ID NO: 31514 - RNA, 32 nt, Human
acacagcaauacaguccucuugaggcacucaa

SEQ ID NO: 31515 - RNA, 32 nt, Human
acacagcacagagacccugggcccagcccaca

SEQ ID NO: 31516 - RNA, 32 nt, Human
acacagcacaugcacacaggugcacagaccac

SEQ ID NO: 31517 - RNA, 32 nt, Human
acacagcaccucugccaggccuaggagaggac

SEQ ID NO: 31518 - RNA, 32 nt, Human
acacagcagaggaauagcucagccugaacagu

SEQ ID NO: 31519 - RNA, 32 nt, Human
acacagcagauaccuggugagcucagauaguc

SEQ ID NO: 31520 - RNA, 32 nt, Human
acacagcagcaggaugaagccaaccugcagua

SEQ ID NO: 31521 - RNA, 32 nt, Human
acacagcagcggccaccauggccacgccuggg

SEQ ID NO: 31522 - RNA, 22 nt, Human
acacagcagcuccaaccuggag

SEQ ID NO: 31523 - RNA, 32 nt, Human
acacagcaggagccaugaauguucuuugggaa

SEQ ID NO: 31524 - RNA, 32 nt, Human
acacagcagggacauaguggggcugggcaggg

SEQ ID NO: 31525 - RNA, 32 nt, Human
acacagcagggacccaggcaguggggcuguua

SEQ ID NO: 31526 - RNA, 23 nt, Human
acacagcagugucuagagucagu

SEQ ID NO: 31527 - RNA, 26 nt, Human
acacagcaucacaucacacacacaga

SEQ ID NO: 31528 - RNA, 32 nt, Human
acacagccaaccuagccugugcagccuccugg

SEQ ID NO: 31529 - RNA, 32 nt, Human
acacagccaagugcauccgagcagcgcaggau

SEQ ID NO: 31530 - RNA, 32 nt, Human
acacagccacaggugaauggccagcagguggg

SEQ ID NO: 31531 - RNA, 32 nt, Human
acacagccacaucuuccuagaccuaagaguaa

SEQ ID NO: 31532 - RNA, 32 nt, Human
acacagccacgcccccugauucuggaacuccc

SEQ ID NO: 31533 - RNA, 32 nt, Human
acacagccagaacauaguggagugggaacucc

SEQ ID NO: 31534 - RNA, 32 nt, Human
acacagccaguaugugguggcugcaguuggcu

SEQ ID NO: 31535 - RNA, 32 nt, Human
acacagccauccaggcugugcugucccuguac

SEQ ID NO: 31536 - RNA, 32 nt, Human
acacagccauccucaaagugcuggucgaggca

SEQ ID NO: 31537 - RNA, 32 nt, Human
acacagccauuauugccacuugcucagucguc

SEQ ID NO: 31538 - RNA, 32 nt, Human
acacagcccacaucugucacugaaggaggugg

SEQ ID NO: 31539 - RNA, 32 nt, Human
acacagcccagaggaguucucauugguccuau

SEQ ID NO: 31540 - RNA, 18 nt, Human
acacagccccacccuugg

SEQ ID NO: 31541 - RNA, 32 nt, Human
acacagcccccacuccacaaguacucccagca

SEQ ID NO: 31542 - RNA, 32 nt, Human
acacagccccuggauggggaggggguaggagg

SEQ ID NO: 31543 - RNA, 32 nt, Human
acacagccccuuucacacucuguccuccuauc

SEQ ID NO: 31544 - RNA, 32 nt, Human
acacagcccgagagaugggcgcaaggggugcu

SEQ ID NO: 31545 - RNA, 32 nt, Human
acacagcccgggccacugucaggaugagaccu

SEQ ID NO: 31546 - RNA, 32 nt, Human
acacagcccucaccccagcacagccagcaagg

SEQ ID NO: 31547 - RNA, 20 nt, Human
acacagccggcugcccuuga

SEQ ID NO: 31548 - RNA, 32 nt, Human
acacagccuagacguaguagccugggcuucca

SEQ ID NO: 31549 - RNA, 32 nt, Human
acacagccuagcugcccccagggagcucugcu

SEQ ID NO: 31550 - RNA, 32 nt, Human
acacagccugcacccacccccacaucugggcc

SEQ ID NO: 31551 - RNA, 20 nt, Human
acacagccuuccuucugcuc

SEQ ID NO: 31552 - RNA, 32 nt, Human
acacagccuuuccaauccucuggaacauauuc

SEQ ID NO: 31553 - RNA, 32 nt, Human
acacagcgcacacccagacccuccaccaggcu

SEQ ID NO: 31554 - RNA, 32 nt, Human
acacagcgccuccagugggagugcaguuggau

SEQ ID NO: 31555 - RNA, 32 nt, Human
acacagcuagcuccucauccuaccugguuucu

SEQ ID NO: 31556 - RNA, 32 nt, Human
acacagcucacugcagccuugauuucccgggc

SEQ ID NO: 31557 - RNA, 32 nt, Human
acacagcucccaggaaccuccacgcccauggc

SEQ ID NO: 31558 - RNA, 32 nt, Human
acacagcuccccagacuggaggcuggucagag

SEQ ID NO: 31559 - RNA, 32 nt, Human
acacagcucccuauugcugcuaauucccccuc

SEQ ID NO: 31560 - RNA, 32 nt, Human
acacagcucccuggccccugcccccagccccu

SEQ ID NO: 31561 - RNA, 32 nt, Human
acacagcucuucauuccauugacuuagaggca

SEQ ID NO: 31562 - RNA, 32 nt, Human
acacagcugcauccuucugcccucccccagaa

SEQ ID NO: 31563 - RNA, 32 nt, Human
acacagcugccuggcuggggaggcugugcugu

SEQ ID NO: 31564 - RNA, 32 nt, Human
acacagcugcuugcucaggggccgggacagca

SEQ ID NO: 31565 - RNA, 32 nt, Human
acacagcugggggaguccagaccagggcaggg

SEQ ID NO: 31566 - RNA, 32 nt, Human
acacagcuguccauuaugcucuuuauggugag

SEQ ID NO: 31567 - RNA, 32 nt, Human
acacagcuugucucuugccugccacuguguga

SEQ ID NO: 31568 - RNA, 32 nt, Human
acacaggaaagacaaagcaggagcgugcacgc

SEQ ID NO: 31569 - RNA, 32 nt, Human
acacaggaaauggaaaagcaggcacauuauca

SEQ ID NO: 31570 - RNA, 32 nt, Human
acacaggaaauggagaaacauagacaaccuac

SEQ ID NO: 31571 - RNA, 32 nt, Human
acacaggaauuuacauuuucaaagucauuuuu

SEQ ID NO: 31572 - RNA, 32 nt, Human
acacaggacaagggagagagagccaaacaggc

SEQ ID NO: 31573 - RNA, 32 nt, Human
acacaggacagaaaacaugcaaauauacugaa

SEQ ID NO: 31574 - RNA, 32 nt, Human
acacaggacaggccugcugacaaggcugaguc

SEQ ID NO: 31575 - RNA, 32 nt, Human
acacaggacgggaugggggaggagaacccagg

SEQ ID NO: 31576 - RNA, 32 nt, Human
acacaggagcccgucucccagggcagacacgg

SEQ ID NO: 31577 - RNA, 32 nt, Human
acacaggaggaaacugacacacuuuucuuaaa

SEQ ID NO: 31578 - RNA, 32 nt, Human
acacaggaggaaccccuucucugguugagcug

SEQ ID NO: 31579 - RNA, 32 nt, Human
acacaggaggagggaggagcugguagggagau

SEQ ID NO: 31580 - RNA, 32 nt, Human
acacaggaggcagagguugcagcgagcugaga

SEQ ID NO: 31581 - RNA, 32 nt, Human
acacaggaggcagagguugcagugagccgaga

SEQ ID NO: 31582 - RNA, 26 nt, Human
acacaggaggcccauccagagugagu

SEQ ID NO: 31583 - RNA, 32 nt, Human
acacaggaggcugaggcacgagaaucacuuga

SEQ ID NO: 31584 - RNA, 32 nt, Human
acacaggaggcugaggcaggagaaucacuuga

SEQ ID NO: 31585 - RNA, 32 nt, Human
acacaggauauuauaccaggaggcaggaauca

SEQ ID NO: 31586 - RNA, 32 nt, Human
acacaggaugaggaagauuaaggauaaucaau

SEQ ID NO: 31587 - RNA, 32 nt, Human
acacaggcaagaggagugggacaggggaguaa

SEQ ID NO: 31588 - RNA, 32 nt, Human
acacaggcacuuccgcucggguugcaugcucu

SEQ ID NO: 31589 - RNA, 32 nt, Human
acacaggcauuggcaugaccaaagcugaucuc

SEQ ID NO: 31590 - RNA, 32 nt, Human
acacaggccacggaaaccacagggccagcguc

SEQ ID NO: 31591 - RNA, 32 nt, Human
acacaggcccagcaaacacaggcugcacccag

SEQ ID NO: 31592 - RNA, 32 nt, Human
acacaggccugguagucagguggcucuaaacc

SEQ ID NO: 31593 - RNA, 32 nt, Human
acacaggcgcugucucuccagagccauccuuc

SEQ ID NO: 31594 - RNA, 32 nt, Human
acacaggcugaugaccaccuugcccaccuucu

SEQ ID NO: 31595 - RNA, 32 nt, Human
acacaggcuguggugggcucugcccugacugc

SEQ ID NO: 31596 - RNA, 32 nt, Human
acacagggaggcuguagccaggaaacccucuu

SEQ ID NO: 31597 - RNA, 21 nt, Human
acacagggauuuuuaugggaa

SEQ ID NO: 31598 - RNA, 32 nt, Human
acacaggggaggcaggggaagaggcaggaggg

SEQ ID NO: 31599 - RNA, 32 nt, Human
acacaggguaaccgugggcaugacuugggccg

SEQ ID NO: 31600 - RNA, 32 nt, Human
acacagggucaagaacaugcugggcagagcuu

SEQ ID NO: 31601 - RNA, 32 nt, Human
acacagggucagguccagcaggaaagaaugcu

SEQ ID NO: 31602 - RNA, 32 nt, Human
acacagggucuugggacugggguuucggauug

SEQ ID NO: 31603 - RNA, 32 nt, Human
acacaggucacugcucucuaggcggacacacc

SEQ ID NO: 31604 - RNA, 32 nt, Human
acacaggugugcuuugaaaaauggcaauuaag

SEQ ID NO: 31605 - RNA, 32 nt, Human
acacagguugcagguuagcaggagaacaggca

SEQ ID NO: 31606 - RNA, 32 nt, Human
acacaguaaacaccugccaaccccuguacucc

SEQ ID NO: 31607 - RNA, 32 nt, Human
acacaguaccugaauccagcugugcuguguuu

SEQ ID NO: 31608 - RNA, 32 nt, Human
acacaguagcuggucagggcugaguacagucc

SEQ ID NO: 31609 - RNA, 32 nt, Human
acacaguauaguauuuaagugccaaauaucag

SEQ ID NO: 31610 - RNA, 32 nt, Human
acacagucccuggucugcagucagagccacug

SEQ ID NO: 31611 - RNA, 32 nt, Human
acacaguccgaguggaaugggaagggaauggu

SEQ ID NO: 31612 - RNA, 19 nt, Human
acacaguccuccaaaaaua

SEQ ID NO: 31613 - RNA, 32 nt, Human
acacaguccucugcugucuccccacuaggauc

SEQ ID NO: 31614 - RNA, 32 nt, Human
acacaguccuggaggcagagaugcaguuaccu

SEQ ID NO: 31615 - RNA, 32 nt, Human
acacagucucuaugagcuucacuuaugcagcc

SEQ ID NO: 31616 - RNA, 32 nt, Human
acacagucucugugggaaaggcagacagguaa

SEQ ID NO: 31617 - RNA, 32 nt, Human
acacagugaaaccccuucucuacuaaaaauac

SEQ ID NO: 31618 - RNA, 32 nt, Human
acacagugacugugcagaaugagaggagagag

SEQ ID NO: 31619 - RNA, 32 nt, Human
acacagugccuguaaaucucauuuguauuuuc

SEQ ID NO: 31620 - RNA, 22 nt, Human
acacagugcuucccagagugag

SEQ ID NO: 31621 - RNA, 32 nt, Human
acacaguggggaagacacagggcuaagacugu

SEQ ID NO: 31622 - RNA, 32 nt, Human
acacaguguucugcagagccugagcugcugcu

SEQ ID NO: 31623 - RNA, 32 nt, Human
acacaguuaccaggaaccgacccccaguggga

SEQ ID NO: 31624 - RNA, 32 nt, Human
acacaguugagggugacaugcacagaacugga

SEQ ID NO: 31625 - RNA, 32 nt, Human
acacaguuugugccccuuucuucaagucucug

SEQ ID NO: 31626 - RNA, 32 nt, Human
acacaguuuugucuucguagguugugaugaua

SEQ ID NO: 31627 - RNA, 32 nt, Human
acacauaacugcauuggaugugagaguaacgu

SEQ ID NO: 31628 - RNA, 32 nt, Human
acacauaauuacugggugccuacagcaccuag

SEQ ID NO: 31629 - RNA, 32 nt, Human
acacauaauucaggaagcagcuuuccccaugu

SEQ ID NO: 31630 - RNA, 32 nt, Human
acacauacaaaaccuuuaaauuuugggaucug

SEQ ID NO: 31631 - RNA, 32 nt, Human
acacauacacacacaaacauacauguauguau

SEQ ID NO: 31632 - RNA, 32 nt, Human
acacauacacacacuaacacacauaaguuaca

SEQ ID NO: 31633 - RNA, 21 nt, Human
acacauacaccaugcccuuga

SEQ ID NO: 31634 - RNA, 32 nt, Human
acacauacagccgcucaagccgcaggaugcgc

SEQ ID NO: 31635 - RNA, 19 nt, Human
acacauacauacacacaca

SEQ ID NO: 31636 - RNA, 32 nt, Human
acacauacauuucucucaccccuuaaugcauu

SEQ ID NO: 31637 - RNA, 32 nt, Human
acacauaccuguaaucccagcuacuuuggugg

SEQ ID NO: 31638 - RNA, 32 nt, Human
acacauacucccacauacuuacccacauguac

SEQ ID NO: 31639 - RNA, 32 nt, Human
acacauagccugcugugaugagcuuccagguc

SEQ ID NO: 31640 - RNA, 21 nt, Human
acacauaggcccacacacaga

SEQ ID NO: 31641 - RNA, 32 nt, Human
acacauaguagguccacaagcaaaugguuuuc

SEQ ID NO: 31642 - RNA, 21 nt, Human
acacauaguauugaucagaaa

SEQ ID NO: 31643 - RNA, 18 nt, Human
acacauagucauucuuga

SEQ ID NO: 31644 - RNA, 26 nt, Human
acacauauaaacaucacacacacaga

SEQ ID NO: 31645 - RNA, 32 nt, Human
acacauauacaaucaucucccaccucccaacg

SEQ ID NO: 31646 - RNA, 32 nt, Human
acacauauaguguauauaguguaugugugaug

SEQ ID NO: 31647 - RNA, 21 nt, Human
acacauauauauguauauaua

SEQ ID NO: 31648 - RNA, 32 nt, Human
acacauauccggaaacugcagcugcuugaaug

SEQ ID NO: 31649 - RNA, 32 nt, Human
acacauaugcucccaacuaagagaguacuggc

SEQ ID NO: 31650 - RNA, 28 nt, Human
acacauauuaaaacaaauuuuacacagc

SEQ ID NO: 31651 - RNA, 32 nt, Human
acacaucacacagaauuggagugcuguccuuc

SEQ ID NO: 31652 - RNA, 32 nt, Human
acacaucacacagaugccaggagagcugggcc

SEQ ID NO: 31653 - RNA, 31 nt, Human
acacaucacagcugaaaacaugaagagcagu

SEQ ID NO: 31654 - RNA, 32 nt, Human
acacaucacaggcugauuuccacaggcuucuu

SEQ ID NO: 31655 - RNA, 32 nt, Human
acacaucaccuugcaaaugacacuuugccguc

SEQ ID NO: 31656 - RNA, 32 nt, Human
acacaucagcuagcaaaagaaguaacaagagu

SEQ ID NO: 31657 - RNA, 32 nt, Human
acacaucaggugucagaacuugcuugaaggga

SEQ ID NO: 31658 - RNA, 32 nt, Human
acacaucaguaagggccuggagauguguaaag

SEQ ID NO: 31659 - RNA, 32 nt, Human
acacaucauucuggcuggagagugcaaugugu

SEQ ID NO: 31660 - RNA, 32 nt, Human
acacaucauuguagccacacaucauugcuggg

SEQ ID NO: 31661 - RNA, 32 nt, Human
acacauccacacacaagcauaugcauacacac

SEQ ID NO: 31662 - RNA, 31 nt, Human
acacauccacuucucccuccagagcccggcc

SEQ ID NO: 31663 - RNA, 32 nt, Human
acacauccauguucacuguaacaaacugaaua

SEQ ID NO: 31664 - RNA, 32 nt, Human
acacauccccagccagggagcuugccacacuc

SEQ ID NO: 31665 - RNA, 32 nt, Human
acacauccccgguauauccugccugcaguucu

SEQ ID NO: 31666 - RNA, 19 nt, Human
acacaucccuguaguccca

SEQ ID NO: 31667 - RNA, 32 nt, Human
acacauccuagaaggcuaacacgugguuuucu

SEQ ID NO: 31668 - RNA, 27 nt, Human
acacauccucaauaaaaccuguuguau

SEQ ID NO: 31669 - RNA, 32 nt, Human
acacauccugguauccaccacauucggcuuuu

SEQ ID NO: 31670 - RNA, 32 nt, Human
acacauccuuucuccccugggcuuguaagaag

SEQ ID NO: 31671 - RNA, 32 nt, Human
acacaucuaccuuuggccccugguuuuggaaa

SEQ ID NO: 31672 - RNA, 32 nt, Human
acacaucuauaauccccaccccauggcugaca

SEQ ID NO: 31673 - RNA, 32 nt, Human
acacaucuauagucccagcuucucgggaggcu

SEQ ID NO: 31674 - RNA, 32 nt, Human
acacaucucuagucccagcuacucgggaggcu

SEQ ID NO: 31675 - RNA, 32 nt, Human
acacaucugcuccugcucucucuccuccagcg

SEQ ID NO: 31676 - RNA, 32 nt, Human
acacaucuggaaaugcagcaagauggagaaaa

SEQ ID NO: 31677 - RNA, 32 nt, Human
acacaucuguaauccuagcuacuuggcaggcu

SEQ ID NO: 31678 - RNA, 32 nt, Human
acacaucuguagucccagcuacucuggaggcu

SEQ ID NO: 31679 - RNA, 32 nt, Human
acacaucuguauuccagccugggcaauagagc

SEQ ID NO: 31680 - RNA, 32 nt, Human
acacaucuugcccuuccaugaaugaccccuca

SEQ ID NO: 31681 - RNA, 32 nt, Human
acacaugaaguuaccauaaagagggugguucc

SEQ ID NO: 31682 - RNA, 18 nt, Human
acacaugacuaccuuuga

SEQ ID NO: 31683 - RNA, 32 nt, Human
acacaugagaccccaccucccucccugccugc

SEQ ID NO: 31684 - RNA, 32 nt, Human
acacaugagugcaguggcauggaugagugugg

SEQ ID NO: 31685 - RNA, 32 nt, Human
acacaugaucauggcacagaagauaggagguu

SEQ ID NO: 31686 - RNA, 32 nt, Human
acacaugcacacacaaagugcauaggccacac

SEQ ID NO: 31687 - RNA, 32 nt, Human
acacaugcacacacaaauaugcacagaacaca

SEQ ID NO: 31688 - RNA, 32 nt, Human
acacaugcacacacacaugcacacauauaugc

SEQ ID NO: 31689 - RNA, 32 nt, Human
acacaugcacacacagugaauguuuuaaguua

SEQ ID NO: 31690 - RNA, 32 nt, Human
acacaugcacacacauauacacacaugugcca

SEQ ID NO: 31691 - RNA, 32 nt, Human
acacaugcacacacauaugcacacacaugugc

SEQ ID NO: 31692 - RNA, 32 nt, Human
acacaugcacacacgcacacacaugcacacac

SEQ ID NO: 31693 - RNA, 32 nt, Human
acacaugcacacacgcacacgcaugcacacac

SEQ ID NO: 31694 - RNA, 32 nt, Human
acacaugcacacacguacacaaugcacacaug

SEQ ID NO: 31695 - RNA, 32 nt, Human
acacaugcacacacguguagcucacacacagu

SEQ ID NO: 31696 - RNA, 32 nt, Human
acacaugcacacagaccacauagcacacaugu

SEQ ID NO: 31697 - RNA, 32 nt, Human
acacaugcacacauacacgcacaugcacacau

SEQ ID NO: 31698 - RNA, 32 nt, Human
acacaugcacacauauaugcacaggcacacac

SEQ ID NO: 31699 - RNA, 32 nt, Human
acacaugcacacucagacacauggucacacac

SEQ ID NO: 31700 - RNA, 32 nt, Human
acacaugcaccgcacacauauccaugcacaca

SEQ ID NO: 31701 - RNA, 18 nt, Human
acacaugcagaccccugg

SEQ ID NO: 31702 - RNA, 18 nt, Human
acacaugcagccccugga

SEQ ID NO: 31703 - RNA, 18 nt, Human
acacaugcauauacauga

SEQ ID NO: 31704 - RNA, 18 nt, Human
acacaugcaugaaccuug

SEQ ID NO: 31705 - RNA, 18 nt, Human
acacaugcauggcauuug

SEQ ID NO: 31706 - RNA, 18 nt, Human
acacaugcauggucauga

SEQ ID NO: 31707 - RNA, 18 nt, Human
acacaugcauguaucuuu

SEQ ID NO: 31708 - RNA, 18 nt, Human
acacaugcauucaugugg

SEQ ID NO: 31709 - RNA, 32 nt, Human
acacaugccauccaagugaugauggcuuuucc

SEQ ID NO: 31710 - RNA, 20 nt, Human
acacaugcccaggcccuuga

SEQ ID NO: 31711 - RNA, 18 nt, Human
acacaugccuauuucuga

SEQ ID NO: 31712 - RNA, 18 nt, Human
acacaugcguacacauga

SEQ ID NO: 31713 - RNA, 18 nt, Human
acacaugcguguaucuug

SEQ ID NO: 31714 - RNA, 29 nt, Human
acacaugcuacugcugcugcuacugcugc

SEQ ID NO: 31715 - RNA, 32 nt, Human
acacaugcucacaaccauccuggucauucucg

SEQ ID NO: 31716 - RNA, 32 nt, Human
acacaugcucacugccagcuccuguccugagu

SEQ ID NO: 31717 - RNA, 32 nt, Human
acacaugcucacuggugaacagugucuguggg

SEQ ID NO: 31718 - RNA, 18 nt, Human
acacaugcugcagcuuga

SEQ ID NO: 31719 - RNA, 18 nt, Human
acacaugcuuguaucuuu

SEQ ID NO: 31720 - RNA, 32 nt, Human
acacauggagagaaggagaggaacaacagaca

SEQ ID NO: 31721 - RNA, 32 nt, Human
acacauggagcccagcucucuggcugucuuac

SEQ ID NO: 31722 - RNA, 32 nt, Human
acacauggccaccuuggcacaaaagccuugug

SEQ ID NO: 31723 - RNA, 32 nt, Human
acacauggccugauuguuggcaaaggcaucau

SEQ ID NO: 31724 - RNA, 32 nt, Human
acacauggcucugccaaauccuuccagccuuu

SEQ ID NO: 31725 - RNA, 32 nt, Human
acacauggggaucagagcagacuucuccacua

SEQ ID NO: 31726 - RNA, 32 nt, Human
acacaugguccgugccaugucaccuccauagg

SEQ ID NO: 31727 - RNA, 18 nt, Human
acacauguacagcccuug

SEQ ID NO: 31728 - RNA, 23 nt, Human
acacauguacauauguguacaca

SEQ ID NO: 31729 - RNA, 32 nt, Human
acacauguagacacaaacauauacacagacgu

SEQ ID NO: 31730 - RNA, 18 nt, Human
acacauguauccccugga

SEQ ID NO: 31731 - RNA, 32 nt, Human
acacauguccaagaagcccaggaaaggcucca

SEQ ID NO: 31732 - RNA, 32 nt, Human
acacaugugccugcgugggcucugccuugucu

SEQ ID NO: 31733 - RNA, 32 nt, Human
acacaugugccuugccugacagaauugcuuag

SEQ ID NO: 31734 - RNA, 32 nt, Human
acacauguggaucaggcccaggaagggcacag

SEQ ID NO: 31735 - RNA, 32 nt, Human
acacauguggucuuaagacuaaccuuuguucu

SEQ ID NO: 31736 - RNA, 32 nt, Human
acacaugugugggccaaguagacagcaccagc

SEQ ID NO: 31737 - RNA, 32 nt, Human
acacaugugugggccaaguagagagcaccggc

SEQ ID NO: 31738 - RNA, 32 nt, Human
acacaugugugggccaaguagagagcgccggc

SEQ ID NO: 31739 - RNA, 32 nt, Human
acacauguucacagcucacacgcccucuccau

SEQ ID NO: 31740 - RNA, 32 nt, Human
acacauguucugcccucugaggcagucaguga

SEQ ID NO: 31741 - RNA, 22 nt, Human
acacauuagcucuggagugagu

SEQ ID NO: 31742 - RNA, 32 nt, Human
acacauuauacuccaagucccugccgggcucc

SEQ ID NO: 31743 - RNA, 32 nt, Human
acacauucaagcuuuaaaaucugucaguauuc

SEQ ID NO: 31744 - RNA, 32 nt, Human
acacauucaaugcccucccuaucaaaauacca

SEQ ID NO: 31745 - RNA, 32 nt, Human
acacauuccagaaccacauuuucuaaccacag

SEQ ID NO: 31746 - RNA, 32 nt, Human
acacauuccaggaccagaagcauuucaccuuu

SEQ ID NO: 31747 - RNA, 32 nt, Human
acacauuccugucugaucaggcucccucccuc

SEQ ID NO: 31748 - RNA, 32 nt, Human
acacauucucagaauaaacgaugccucucucu

SEQ ID NO: 31749 - RNA, 32 nt, Human
acacauugcaggucagcuucuuccucugccca

SEQ ID NO: 31750 - RNA, 32 nt, Human
acacauugccacggaaacauacagaggaugcc

SEQ ID NO: 31751 - RNA, 32 nt, Human
acacauugcuaccucagugcuccuggaaacuu

SEQ ID NO: 31752 - RNA, 32 nt, Human
acacauuggagcccaugguagcauccucagca

SEQ ID NO: 31753 - RNA, 32 nt, Human
acacauuuaccuccccugccaaguuauggucu

SEQ ID NO: 31754 - RNA, 32 nt, Human
acacauuuacuaccuauguaacaaaccugcac

SEQ ID NO: 31755 - RNA, 32 nt, Human
acacauuuacugcaucuuauuucuggaaaccu

SEQ ID NO: 31756 - RNA, 20 nt, Human
acacauuuauaaacccuuga

SEQ ID NO: 31757 - RNA, 18 nt, Human
acacauuuauaaucucau

SEQ ID NO: 31758 - RNA, 32 nt, Human
acacauuucuacucugagaucuucauggcaca

SEQ ID NO: 31759 - RNA, 32 nt, Human
acacauuugagaagaugagauuaagguuagga

SEQ ID NO: 31760 - RNA, 32 nt, Human
acacauuugccugcuucucucuugccuaauuc

SEQ ID NO: 31761 - RNA, 32 nt, Human
acacauuuggaauagcagagcaaaauauggau

SEQ ID NO: 31762 - RNA, 32 nt, Human
acacauuuguguaaacaguguuuuggaauaaa

SEQ ID NO: 31763 - RNA, 32 nt, Human
acacauuuuauuuguauuucagucacauuuau

SEQ ID NO: 31764 - RNA, 32 nt, Human
acacauuuuguuguuuucuaugucucuguaua

SEQ ID NO: 31765 - RNA, 32 nt, Human
acacauuuuuaguuuacauacauagcauggua

SEQ ID NO: 31766 - RNA, 32 nt, Human
acacauuuuucuguauacaucacagaggcucu

SEQ ID NO: 31767 - RNA, 32 nt, Human
acacauuuuuguucuuagucuaucucuuguac

SEQ ID NO: 31768 - RNA, 32 nt, Human
acaccaaaaaccagugagagccccgcucucua

SEQ ID NO: 31769 - RNA, 32 nt, Human
acaccaaaaggaagaaaacaaucaagcaaaua

SEQ ID NO: 31770 - RNA, 32 nt, Human
acaccaaacccccaggcauaaagcuuuaccua

SEQ ID NO: 31771 - RNA, 32 nt, Human
acaccaaagaggaagaagagcuguggaggcca

SEQ ID NO: 31772 - RNA, 32 nt, Human
acaccaaagcuugaacaccaccguccacagcc

SEQ ID NO: 31773 - RNA, 21 nt, Human
acaccaaagguuaacagugaa

SEQ ID NO: 31774 - RNA, 32 nt, Human
acaccaacuccaggaaacucauucugggccag

SEQ ID NO: 31775 - RNA, 32 nt, Human
acaccaacuucuguuuccauuccagcuagcuu

SEQ ID NO: 31776 - RNA, 32 nt, Human
acaccaagaaacccgacggcuuccauauuuuc

SEQ ID NO: 31777 - RNA, 32 nt, Human
acaccaagcaaguccugaagcuggcgcgggac

SEQ ID NO: 31778 - RNA, 32 nt, Human
acaccaagcacccugaaucgagacugcaggag

SEQ ID NO: 31779 - RNA, 32 nt, Human
acaccaaggaagcagagcaguguuaacuuuaa

SEQ ID NO: 31780 - RNA, 32 nt, Human
acaccaaggagagcgugaaggagaugauugag

SEQ ID NO: 31781 - RNA, 24 nt, Human
acaccaaggcaggacccccagaga

SEQ ID NO: 31782 - RNA, 32 nt, Human
acaccaaggcgcagagaggugacucagccugc

SEQ ID NO: 31783 - RNA, 32 nt, Human
acaccaaggcuacaaugacuguuaaccuggag

SEQ ID NO: 31784 - RNA, 32 nt, Human
acaccaagugcagcccucguccugggucugca

SEQ ID NO: 31785 - RNA, 32 nt, Human
acaccaagugcgcacacacaccgauguacaca

SEQ ID NO: 31786 - RNA, 32 nt, Human
acaccaauagccuuucuugugcuaaaucucuc

SEQ ID NO: 31787 - RNA, 18 nt, Human
acaccaaucacaaaagua

SEQ ID NO: 31788 - RNA, 32 nt, Human
acaccaaugagagagacaaggaggaaagcauc

SEQ ID NO: 31789 - RNA, 32 nt, Human
acaccacacagagguucccugccuuguuugga

SEQ ID NO: 31790 - RNA, 32 nt, Human
acaccacacagcagacaauacacacccacucg

SEQ ID NO: 31791 - RNA, 32 nt, Human
acaccacacaugcacacacguacacaaugcac

SEQ ID NO: 31792 - RNA, 32 nt, Human
acaccacacaugcuuauaacaggcacuagaau

SEQ ID NO: 31793 - RNA, 32 nt, Human
acaccacaccacugcuuuucagcauuguacug

SEQ ID NO: 31794 - RNA, 32 nt, Human
acaccacacccacccacacgcaugaucaugaa

SEQ ID NO: 31795 - RNA, 32 nt, Human
acaccacagaaaccucugaauguaauggaugu

SEQ ID NO: 31796 - RNA, 32 nt, Human
acaccacagaugccagugguucaugccuucuu

SEQ ID NO: 31797 - RNA, 32 nt, Human
acaccacagcacaccucaccacacaacacacc

SEQ ID NO: 31798 - RNA, 32 nt, Human
acaccacagcacaccucaccacaccacaccgc

SEQ ID NO: 31799 - RNA, 32 nt, Human
acaccacagcugcgcacacagcugcuugcuca

SEQ ID NO: 31800 - RNA, 32 nt, Human
acaccacagcuucuccccagcuuggugccuuu

SEQ ID NO: 31801 - RNA, 32 nt, Human
acaccacaguacuccagccuaggugacagagc

SEQ ID NO: 31802 - RNA, 32 nt, Human
acaccacaguucccugccaccuccaggcacaa

SEQ ID NO: 31803 - RNA, 32 nt, Human
acaccaccacacccagccuagaaugaagaaac

SEQ ID NO: 31804 - RNA, 32 nt, Human
acaccacccacggcccaugcagaggugguaga

SEQ ID NO: 31805 - RNA, 32 nt, Human
acaccaccccagccagcauggccggcaggagc

SEQ ID NO: 31806 - RNA, 32 nt, Human
acaccacccccuccagcuucuggggcccagga

SEQ ID NO: 31807 - RNA, 32 nt, Human
acaccaccgcacuccacccugggaagcaaagu

SEQ ID NO: 31808 - RNA, 32 nt, Human
acaccaccucacuccagccugggcaacauagu

SEQ ID NO: 31809 - RNA, 32 nt, Human
acaccaccuguucucagugccugguggauugu

SEQ ID NO: 31810 - RNA, 32 nt, Human
acaccaccuucccaugcuuccuugcauuaggc

SEQ ID NO: 31811 - RNA, 32 nt, Human
acaccaccuuccuccuggcuuccagggggcag

SEQ ID NO: 31812 - RNA, 19 nt, Human
acaccaccuuuuugccuca

SEQ ID NO: 31813 - RNA, 32 nt, Human
acaccacgaacaaagggaucucuugcaugugc

SEQ ID NO: 31814 - RNA, 32 nt, Human
acaccacgccacugcacuccagccugggugac

SEQ ID NO: 31815 - RNA, 32 nt, Human
acaccacggugcuuuuauacauugugcuuauu

SEQ ID NO: 31816 - RNA, 32 nt, Human
acaccacuacacuccagccaaagcaacaagag

SEQ ID NO: 31817 - RNA, 32 nt, Human
acaccacuacacuccagccuaggcaacagagc

SEQ ID NO: 31818 - RNA, 32 nt, Human
acaccacuacacuccagccuggacaacagaaa

SEQ ID NO: 31819 - RNA, 32 nt, Human
acaccacuacacuccagccugggcaacagagc

SEQ ID NO: 31820 - RNA, 32 nt, Human
acaccacuacacuccagccugggcgacagagu

SEQ ID NO: 31821 - RNA, 32 nt, Human
acaccacuacacuccagccugggcgagacggc

SEQ ID NO: 31822 - RNA, 32 nt, Human
acaccacucaugucaccacggcgugcaucaug

SEQ ID NO: 31823 - RNA, 32 nt, Human
acaccacuccacuccagucuggacaacagagu

SEQ ID NO: 31824 - RNA, 32 nt, Human
acaccacugcaauccagccucgguaacacagc

SEQ ID NO: 31825 - RNA, 32 nt, Human
acaccacugcaauccagccugggcgacaaagc

SEQ ID NO: 31826 - RNA, 32 nt, Human
acaccacugcacuacagccucggcaauagagc

SEQ ID NO: 31827 - RNA, 32 nt, Human
acaccacugcacucagccugggugacagagca

SEQ ID NO: 31828 - RNA, 32 nt, Human
acaccacugcacuccaaccuagguaacagaga

SEQ ID NO: 31829 - RNA, 32 nt, Human
acaccacugcacuccaaccuggacaacagagc

SEQ ID NO: 31830 - RNA, 32 nt, Human
acaccacugcacuccaaccugggaaacgcagu

SEQ ID NO: 31831 - RNA, 32 nt, Human
acaccacugcacuccaaccugggcaacagagg

SEQ ID NO: 31832 - RNA, 32 nt, Human
acaccacugcacuccagccagggcaacaguga

SEQ ID NO: 31833 - RNA, 32 nt, Human
acaccacugcacuccagcccaggugacagagc

SEQ ID NO: 31834 - RNA, 32 nt, Human
acaccacugcacuccagccuaggcaacagaga

SEQ ID NO: 31835 - RNA, 32 nt, Human
acaccacugcacuccagccuggacaacagagu

SEQ ID NO: 31836 - RNA, 32 nt, Human
acaccacugcacuccagccuggacgacagagu

SEQ ID NO: 31837 - RNA, 32 nt, Human
acaccacugcacuccagccuggaugacaaagc

SEQ ID NO: 31838 - RNA, 32 nt, Human
acaccacugcacuccagccuggcaacagagcg

SEQ ID NO: 31839 - RNA, 32 nt, Human
acaccacugcacuccagccuggcgacagagag

SEQ ID NO: 31840 - RNA, 32 nt, Human
acaccacugcacuccagccugggcaacaaagc

SEQ ID NO: 31841 - RNA, 32 nt, Human
acaccacugcacuccagccugggcaacaagag

SEQ ID NO: 31842 - RNA, 32 nt, Human
acaccacugcacuccagccugggcaacagaac

SEQ ID NO: 31843 - RNA, 32 nt, Human
acaccacugcacuccagccugggcaacagagc

SEQ ID NO: 31844 - RNA, 32 nt, Human
acaccacugcacuccagccugggcaacagagu

SEQ ID NO: 31845 - RNA, 32 nt, Human
acaccacugcacuccagccugggcaacugagc

SEQ ID NO: 31846 - RNA, 32 nt, Human
acaccacugcacuccagccugggcaauagagu

SEQ ID NO: 31847 - RNA, 32 nt, Human
acaccacugcacuccagccugggcgacagaau

SEQ ID NO: 31848 - RNA, 32 nt, Human
acaccacugcacuccagccugggcgacagaga

SEQ ID NO: 31849 - RNA, 32 nt, Human
acaccacugcacuccagccugggcgacagagc

SEQ ID NO: 31850 - RNA, 32 nt, Human
acaccacugcacuccagccugggcgacagagg

SEQ ID NO: 31851 - RNA, 32 nt, Human
acaccacugcacuccagccugggcgacaguga

SEQ ID NO: 31852 - RNA, 32 nt, Human
acaccacugcacuccagccugggcggcagagc

SEQ ID NO: 31853 - RNA, 32 nt, Human
acaccacugcacuccagccugggcuacagagc

SEQ ID NO: 31854 - RNA, 32 nt, Human
acaccacugcacuccagccugggggacagagc

SEQ ID NO: 31855 - RNA, 32 nt, Human
acaccacugcacuccagccuggggugauagaa

SEQ ID NO: 31856 - RNA, 32 nt, Human
acaccacugcacuccagccugggugacagaga

SEQ ID NO: 31857 - RNA, 32 nt, Human
acaccacugcacuccagccugggugacagagc

SEQ ID NO: 31858 - RNA, 32 nt, Human
acaccacugcacuccagccugggugacagagg

SEQ ID NO: 31859 - RNA, 32 nt, Human
acaccacugcacuccagccugggugacagagu

SEQ ID NO: 31860 - RNA, 32 nt, Human
acaccacugcacuccagccugggugacagauu

SEQ ID NO: 31861 - RNA, 32 nt, Human
acaccacugcacuccagccugggugacagcaa

SEQ ID NO: 31862 - RNA, 32 nt, Human
acaccacugcacuccagccugggugauagagu

SEQ ID NO: 31863 - RNA, 32 nt, Human
acaccacugcacuccagccuggguggcagagc

SEQ ID NO: 31864 - RNA, 32 nt, Human
acaccacugcacuccagccugggugucagagc

SEQ ID NO: 31865 - RNA, 32 nt, Human
acaccacugcacuccagccuggucaacagagc

SEQ ID NO: 31866 - RNA, 32 nt, Human
acaccacugcacuccagccuggugacagagca

SEQ ID NO: 31867 - RNA, 32 nt, Human
acaccacugcacuccagccugugcgacagagg

SEQ ID NO: 31868 - RNA, 32 nt, Human
acaccacugcacuccagccuuggcgacaaacc

SEQ ID NO: 31869 - RNA, 32 nt, Human
acaccacugcacuccagccuuggcgacagagg

SEQ ID NO: 31870 - RNA, 32 nt, Human
acaccacugcacuccagccuuggugacagagu

SEQ ID NO: 31871 - RNA, 32 nt, Human
acaccacugcacuccagcuugggggauagagu

SEQ ID NO: 31872 - RNA, 32 nt, Human
acaccacugcacuccagucuggaugacaaagc

SEQ ID NO: 31873 - RNA, 32 nt, Human
acaccacugcacuccagucugggcaacagugc

SEQ ID NO: 31874 - RNA, 32 nt, Human
acaccacugcacuccagucugggcaccagagc

SEQ ID NO: 31875 - RNA, 32 nt, Human
acaccacugcacuccagugugagcaacagaac

SEQ ID NO: 31876 - RNA, 32 nt, Human
acaccacugcacuccauccagccugggugaca

SEQ ID NO: 31877 - RNA, 32 nt, Human
acaccacugcacuccauccugggcaacagagc

SEQ ID NO: 31878 - RNA, 32 nt, Human
acaccacugcacuccauccugggcaacagagu

SEQ ID NO: 31879 - RNA, 32 nt, Human
acaccacugcacuccggccugggcgacagagc

SEQ ID NO: 31880 - RNA, 32 nt, Human
acaccacugcacuccugccugggcaauagagc

SEQ ID NO: 31881 - RNA, 32 nt, Human
acaccacugcacucuagccugggcaacagagc

SEQ ID NO: 31882 - RNA, 32 nt, Human
acaccacugcacucuagccugggcaacagagu

SEQ ID NO: 31883 - RNA, 32 nt, Human
acaccacugcacucuagccugggugacagagc

SEQ ID NO: 31884 - RNA, 32 nt, Human
acaccacugcacuucagccuggaugacagagu

SEQ ID NO: 31885 - RNA, 32 nt, Human
acaccacugcacuucagccugggcaacagagu

SEQ ID NO: 31886 - RNA, 32 nt, Human
acaccacugcacuucagucugugugacugagc

SEQ ID NO: 31887 - RNA, 32 nt, Human
acaccacugcacuucauccuaggcaacagagc

SEQ ID NO: 31888 - RNA, 32 nt, Human
acaccacugcacuugagccugggcagcagagu

SEQ ID NO: 31889 - RNA, 32 nt, Human
acaccacugcagcuggcaugcuuggcugugug

SEQ ID NO: 31890 - RNA, 32 nt, Human
acaccacugcauuccagccugggcacuagagu

SEQ ID NO: 31891 - RNA, 32 nt, Human
acaccacugcauuccagccugggugacagagu

SEQ ID NO: 31892 - RNA, 32 nt, Human
acaccacugccauuuccuccugggcaacagag

SEQ ID NO: 31893 - RNA, 32 nt, Human
acaccacuggcacuccagccugggcaacagag

SEQ ID NO: 31894 - RNA, 32 nt, Human
acaccacuguacuccagccugagugacaaagu

SEQ ID NO: 31895 - RNA, 32 nt, Human
acaccacuguacuccagccuggaugacagagu

SEQ ID NO: 31896 - RNA, 32 nt, Human
acaccacuguacuccagccugggcaacagagc

SEQ ID NO: 31897 - RNA, 32 nt, Human
acaccacuguacuccagccugggugacaaagu

SEQ ID NO: 31898 - RNA, 32 nt, Human
acaccacuguacuccagccuggugacagagcc

SEQ ID NO: 31899 - RNA, 32 nt, Human
acaccacuguauuccagccugggugacagagu

SEQ ID NO: 31900 - RNA, 32 nt, Human
acaccacuguauuccagccugggugacugaga

SEQ ID NO: 31901 - RNA, 32 nt, Human
acaccagaaagggagagagggagucugcuuag

SEQ ID NO: 31902 - RNA, 25 nt, Human
acaccagacaaacugagacaaugaa

SEQ ID NO: 31903 - RNA, 32 nt, Human
acaccagagcccagggagucccagaggcaagu

SEQ ID NO: 31904 - RNA, 32 nt, Human
acaccagagccgcagccugcucugauucuaug

SEQ ID NO: 31905 - RNA, 32 nt, Human
acaccagaguagcugggaccacaggugugugc

SEQ ID NO: 31906 - RNA, 32 nt, Human
acaccagauuaguguguuaccccaaaugaacg

SEQ ID NO: 31907 - RNA, 32 nt, Human
acaccagcaaaaagaucccaacucaaugaagg

SEQ ID NO: 31908 - RNA, 31 nt, Human
acaccagcacuuuuucugcacauguaucuuc

SEQ ID NO: 31909 - RNA, 19 nt, Human
acaccagcagcugguccug

SEQ ID NO: 31910 - RNA, 32 nt, Human
acaccagcaguagauacaacuaugaugacauu

SEQ ID NO: 31911 - RNA, 21 nt, Human
acaccagcagucagugaggaa

SEQ ID NO: 31912 - RNA, 32 nt, Human
acaccagcauugugugugcagacuucaggaga

SEQ ID NO: 31913 - RNA, 32 nt, Human
acaccagccaagaugcucugcucacagucagu

SEQ ID NO: 31914 - RNA, 23 nt, Human
acaccagccaguccaauuggcca

SEQ ID NO: 31915 - RNA, 32 nt, Human
acaccagcccaggugagagcugcugcggguca

SEQ ID NO: 31916 - RNA, 32 nt, Human
acaccagccucaggaggccucacugagagcug

SEQ ID NO: 31917 - RNA, 32 nt, Human
acaccagccuccagcacgcugaggaugagcug

SEQ ID NO: 31918 - RNA, 32 nt, Human
acaccagccugaccaacauggugaaaccccau

SEQ ID NO: 31919 - RNA, 32 nt, Human
acaccagccuggccagccuccugugggccuug

SEQ ID NO: 31920 - RNA, 23 nt, Human
acaccagccugggcaacauggca

SEQ ID NO: 31921 - RNA, 32 nt, Human
acaccagcuccaaguggucccugccgggaccu

SEQ ID NO: 31922 - RNA, 32 nt, Human
acaccagcugcugcuggagauucaaagcccaa

SEQ ID NO: 31923 - RNA, 32 nt, Human
acaccaggaagaggacaaacugcauggacuca

SEQ ID NO: 31924 - RNA, 32 nt, Human
acaccaggaccagccacuguugcagcaugagu

SEQ ID NO: 31925 - RNA, 32 nt, Human
acaccaggagcagaaaugaaagaggcaagaaa

SEQ ID NO: 31926 - RNA, 32 nt, Human
acaccaggagcugaagccauggccucaaagcc

SEQ ID NO: 31927 - RNA, 32 nt, Human
acaccaggcuccagaagaaagacagcagcuca

SEQ ID NO: 31928 - RNA, 32 nt, Human
acaccaggcugcagagcuaugaugcuucggga

SEQ ID NO: 31929 - RNA, 30 nt, Human
acaccaggcuugcaagcaagaggcucccug

SEQ ID NO: 31930 - RNA, 32 nt, Human
acaccagggcccgcccucccaucacugagcuc

SEQ ID NO: 31931 - RNA, 32 nt, Human
acaccagggggcagaggucaggagaaucaucu

SEQ ID NO: 31932 - RNA, 32 nt, Human
acaccagggugcgagaugccagcucuggaguu

SEQ ID NO: 31933 - RNA, 32 nt, Human
acaccaggugccugugacacauuggguagaca

SEQ ID NO: 31934 - RNA, 32 nt, Human
acaccaguagucccagcuacuccugaggcuga

SEQ ID NO: 31935 - RNA, 32 nt, Human
acaccagucuggagacagagugagaguccguc

SEQ ID NO: 31936 - RNA, 32 nt, Human
acaccagugagaauugguggggcaaguugucc

SEQ ID NO: 31937 - RNA, 32 nt, Human
acaccagugagcuuccaccuugguggguuugg

SEQ ID NO: 31938 - RNA, 32 nt, Human
acaccagugcaagcagaugacaaaaaggugca

SEQ ID NO: 31939 - RNA, 32 nt, Human
acaccagugcacuccagccugggcgacagaga

SEQ ID NO: 31940 - RNA, 32 nt, Human
acaccagugccacccucuagccuugagggacc

SEQ ID NO: 31941 - RNA, 32 nt, Human
acaccaguggcaaggcccagaauggcgaccuc

SEQ ID NO: 31942 - RNA, 32 nt, Human
acaccaguuacuguucauggcacccgggaaug

SEQ ID NO: 31943 - RNA, 32 nt, Human
acaccaguuccugccaaccucuguugccacca

SEQ ID NO: 31944 - RNA, 32 nt, Human
acaccauaacuguuuuugugggagagauuguc

SEQ ID NO: 31945 - RNA, 32 nt, Human
acaccauacaucuuugcccauccacuuccacc

SEQ ID NO: 31946 - RNA, 32 nt, Human
acaccauagguagaauguaaagcuugucugau

SEQ ID NO: 31947 - RNA, 32 nt, Human
acaccauauaaauauucauuaaauaacauaca

SEQ ID NO: 31948 - RNA, 32 nt, Human
acaccauaucggagaaaacuugauagauuagu

SEQ ID NO: 31949 - RNA, 32 nt, Human
acaccaucagugagcgagaggaaaguacguca

SEQ ID NO: 31950 - RNA, 32 nt, Human
acaccaucaugggcuguauuuucaaguugauu

SEQ ID NO: 31951 - RNA, 19 nt, Human
acaccauccaaagcugggg

SEQ ID NO: 31952 - RNA, 32 nt, Human
acaccauccuagcgaggcaccagcacaccuaa

SEQ ID NO: 31953 - RNA, 32 nt, Human
acaccaucgacacccccagacacauccacaca

SEQ ID NO: 31954 - RNA, 32 nt, Human
acaccaucgauacccccagacacauccacaca

SEQ ID NO: 31955 - RNA, 32 nt, Human
acaccaucgcacuccagccuaggcaacaagag

SEQ ID NO: 31956 - RNA, 32 nt, Human
acaccaucuacccuuaaauauccaaccccagc

SEQ ID NO: 31957 - RNA, 32 nt, Human
acaccaugcuccuuuuuccuuuaggauuuuca

SEQ ID NO: 31958 - RNA, 32 nt, Human
acaccaugcugaggcagaaacuagcccagaac

SEQ ID NO: 31959 - RNA, 32 nt, Human
acaccaugugcccgugcacaccagugacuacg

SEQ ID NO: 31960 - RNA, 26 nt, Human
acaccauuaugauaucaggacugguu

SEQ ID NO: 31961 - RNA, 32 nt, Human
acaccauucucuauuauuucucucacauacau

SEQ ID NO: 31962 - RNA, 32 nt, Human
acaccauugcacuccaaccugggcaacaagag

SEQ ID NO: 31963 - RNA, 32 nt, Human
acaccauugcacuccaaccugggcgacagggc

SEQ ID NO: 31964 - RNA, 32 nt, Human
acaccauugcacuccagccuagauaacaagag

SEQ ID NO: 31965 - RNA, 32 nt, Human
acaccauugcacuccagccuaggcaacaagag

SEQ ID NO: 31966 - RNA, 32 nt, Human
acaccauugcacuccagccuaggcauggugag

SEQ ID NO: 31967 - RNA, 32 nt, Human
acaccauugcacuccagccugagcaacagagu

SEQ ID NO: 31968 - RNA, 32 nt, Human
acaccauugcacuccagccugggaaacaagag

SEQ ID NO: 31969 - RNA, 32 nt, Human
acaccauugcacuccagccugggcaaaaagag

SEQ ID NO: 31970 - RNA, 32 nt, Human
acaccauugcacuccagccugggcaacaagaa

SEQ ID NO: 31971 - RNA, 32 nt, Human
acaccauugcacuccagccugggcaacaagag

SEQ ID NO: 31972 - RNA, 32 nt, Human
acaccauugcacuccagccugggcaacagagu

SEQ ID NO: 31973 - RNA, 32 nt, Human
acaccauugcacuccagccugggcgacaagag

SEQ ID NO: 31974 - RNA, 32 nt, Human
acaccauugcacuccagccugggcgacagagu

SEQ ID NO: 31975 - RNA, 32 nt, Human
acaccauugcacuccagccugggcgacagggu

SEQ ID NO: 31976 - RNA, 32 nt, Human
acaccauugcacuccagcuugggcaacaauag

SEQ ID NO: 31977 - RNA, 32 nt, Human
acaccauugcauuccagccuaggcaacagagu

SEQ ID NO: 31978 - RNA, 32 nt, Human
acaccauugcauuccagccugggcaacagagc

SEQ ID NO: 31979 - RNA, 25 nt, Human
acaccauugcccuccagacuggaca

SEQ ID NO: 31980 - RNA, 32 nt, Human
acaccauugcccuccagccugggugacagagu

SEQ ID NO: 31981 - RNA, 32 nt, Human
acaccauugccuggagaugacagaaggcugag

SEQ ID NO: 31982 - RNA, 32 nt, Human
acaccauugcuguccagccugggugacagagc

SEQ ID NO: 31983 - RNA, 32 nt, Human
acaccauugcuguuccccaucugguacuaaug

SEQ ID NO: 31984 - RNA, 32 nt, Human
acaccauuggaccccacccagccuggaucuac

SEQ ID NO: 31985 - RNA, 32 nt, Human
acacccaaggcaggagagcaagagugaugagu

SEQ ID NO: 31986 - RNA, 32 nt, Human
acacccaagguagaccccuaggaaaagcagag

SEQ ID NO: 31987 - RNA, 32 nt, Human
acacccaauguucagaccuuaccucagucuaa

SEQ ID NO: 31988 - RNA, 32 nt, Human
acacccacaacaaaaccuuguucccuuuguuu

SEQ ID NO: 31989 - RNA, 32 nt, Human
acacccacaagcuuuccuuaacucagugugcu

SEQ ID NO: 31990 - RNA, 22 nt, Human
acacccacaauauaaauggguu

SEQ ID NO: 31991 - RNA, 32 nt, Human
acacccacacagaugguguggaccaugcugcc

SEQ ID NO: 31992 - RNA, 32 nt, Human
acacccacacucuggcaccacacacauugucu

SEQ ID NO: 31993 - RNA, 19 nt, Human
acacccacagccccuacuu

SEQ ID NO: 31994 - RNA, 32 nt, Human
acacccacagcugcagcaggugaccuccccuu

SEQ ID NO: 31995 - RNA, 25 nt, Human
acacccacaucagccuggagcucca

SEQ ID NO: 31996 - RNA, 20 nt, Human
acacccaccagcagccgccu

SEQ ID NO: 31997 - RNA, 32 nt, Human
acacccacccucucccccuucagccaugcuga

SEQ ID NO: 31998 - RNA, 32 nt, Human
acacccaccucuccauccaaggcuggucagga

SEQ ID NO: 31999 - RNA, 32 nt, Human
acacccaccucucccugcaccugguucuauuu

SEQ ID NO: 32000 - RNA, 32 nt, Human
acacccaccugccucucuggcuccagaagcug

SEQ ID NO: 32001 - RNA, 32 nt, Human
acacccacgcugaguuagcucugacagcuucu

SEQ ID NO: 32002 - RNA, 32 nt, Human
acacccacugccucugugaccuuggguggguu

SEQ ID NO: 32003 - RNA, 32 nt, Human
acacccacugccugucucacuucugucagaug

SEQ ID NO: 32004 - RNA, 32 nt, Human
acacccacuucuggguucucaggcuggcugac

SEQ ID NO: 32005 - RNA, 32 nt, Human
acacccacuuucuccucccucugccccuauau

SEQ ID NO: 32006 - RNA, 32 nt, Human
acacccagaacugaggcuuggauaucuucuuc

SEQ ID NO: 32007 - RNA, 25 nt, Human
acacccagaauccuuuuguguuuuu

SEQ ID NO: 32008 - RNA, 32 nt, Human
acacccagacacauccacacagacgaccucac

SEQ ID NO: 32009 - RNA, 32 nt, Human
acacccagacacauccccacggaugaccucac

SEQ ID NO: 32010 - RNA, 32 nt, Human
acacccagacaguguuggucaggauggcagaa

SEQ ID NO: 32011 - RNA, 19 nt, Human
acacccagaccccgcgaga

SEQ ID NO: 32012 - RNA, 32 nt, Human
acacccagacggcgcccagcuggcugcagcac

SEQ ID NO: 32013 - RNA, 32 nt, Human
acacccagacucacuucauacacacauagaua

SEQ ID NO: 32014 - RNA, 32 nt, Human
acacccagagcccccuccccagcccucaggcc

SEQ ID NO: 32015 - RNA, 32 nt, Human
acacccagagcugugcggggaggcagggaucu

SEQ ID NO: 32016 - RNA, 22 nt, Human
acacccagagcuuuaauggaca

SEQ ID NO: 32017 - RNA, 32 nt, Human
acacccagaguuuugugccugcuuucaugugg

SEQ ID NO: 32018 - RNA, 32 nt, Human
acacccagauccugugcaggcugccgggcccc

SEQ ID NO: 32019 - RNA, 22 nt, Human
acacccagcaaaguccacccag

SEQ ID NO: 32020 - RNA, 32 nt, Human
acacccagcagaggacuccagccuucucgggg

SEQ ID NO: 32021 - RNA, 32 nt, Human
acacccagccaaggcccugccaaccaacugcc

SEQ ID NO: 32022 - RNA, 32 nt, Human
acacccagccaucuggagucauggagacccac

SEQ ID NO: 32023 - RNA, 30 nt, Human
acacccagccaugaaucagaaauacuuuuu

SEQ ID NO: 32024 - RNA, 32 nt, Human
acacccagcccaggcucauucuuuuaacagcc

SEQ ID NO: 32025 - RNA, 32 nt, Human
acacccagccgaucucccgcucccagacugcu

SEQ ID NO: 32026 - RNA, 32 nt, Human
acacccagccgauuuuuccuuuuugauuaaag

SEQ ID NO: 32027 - RNA, 32 nt, Human
acacccagcucagcauuuccacaccaagcagc

SEQ ID NO: 32028 - RNA, 32 nt, Human
acacccagcucuugucuguaaguggccucugc

SEQ ID NO: 32029 - RNA, 32 nt, Human
acacccagcugccugagacccuccuucaaccu

SEQ ID NO: 32030 - RNA, 32 nt, Human
acacccaggacaagcaaagacacaguggcagu

SEQ ID NO: 32031 - RNA, 32 nt, Human
acacccaggagcugccccugcugugccuggua

SEQ ID NO: 32032 - RNA, 32 nt, Human
acacccaggcccccagagccagcugggccugu

SEQ ID NO: 32033 - RNA, 32 nt, Human
acacccaggccgagcaggaugagcaggugaag

SEQ ID NO: 32034 - RNA, 32 nt, Human
acacccaggcuggagugcaguagcacaaacau

SEQ ID NO: 32035 - RNA, 32 nt, Human
acacccaggcuggagugcaguggugccaucac

SEQ ID NO: 32036 - RNA, 18 nt, Human
acacccagguggcuggca

SEQ ID NO: 32037 - RNA, 32 nt, Human
acaccccaaagagaagaaggggacucuggaua

SEQ ID NO: 32038 - RNA, 32 nt, Human
acaccccaacagcacccucuccagaugcagcc

SEQ ID NO: 32039 - RNA, 32 nt, Human
acaccccaagguucaaacugucucaagcugag

SEQ ID NO: 32040 - RNA, 32 nt, Human
acaccccacaggccugacucccuuccugucug

SEQ ID NO: 32041 - RNA, 32 nt, Human
acaccccaccuuucaaggggaggaauuucaag

SEQ ID NO: 32042 - RNA, 32 nt, Human
acaccccagccuaacuccuccuggggccuggg

SEQ ID NO: 32043 - RNA, 32 nt, Human
acaccccagcugcauuucuuuugcaagauucc

SEQ ID NO: 32044 - RNA, 32 nt, Human
acaccccauccccucacguucucaccccaggc

SEQ ID NO: 32045 - RNA, 32 nt, Human
acaccccauggagcuugucuuggggaggguuc

SEQ ID NO: 32046 - RNA, 32 nt, Human
acacccccaagaaugcaggcucugccuggcac

SEQ ID NO: 32047 - RNA, 32 nt, Human
acacccccacauucucuccucuggacccccag

SEQ ID NO: 32048 - RNA, 32 nt, Human
acacccccaucuucgacuucagagucuucuuc

SEQ ID NO: 32049 - RNA, 19 nt, Human
acacccccgacggccucca

SEQ ID NO: 32050 - RNA, 32 nt, Human
acacccccgccucaauccuccugcugccugaa

SEQ ID NO: 32051 - RNA, 32 nt, Human
acacccccuccaggcccccagacugccaggcu

SEQ ID NO: 32052 - RNA, 32 nt, Human
acacccccucccccaccaucacuaucccugua

SEQ ID NO: 32053 - RNA, 32 nt, Human
acacccccuccccgccuuuaccucacuuccaa

SEQ ID NO: 32054 - RNA, 32 nt, Human
acacccccugccuuaucucugccugcacgccc

SEQ ID NO: 32055 - RNA, 32 nt, Human
acacccccuuccucccccucaucacccauaau

SEQ ID NO: 32056 - RNA, 32 nt, Human
acaccccggagaccuuuuuggaggccuccaag

SEQ ID NO: 32057 - RNA, 32 nt, Human
acaccccuauaauuccagcuacucgggaggcc

SEQ ID NO: 32058 - RNA, 32 nt, Human
acaccccucacacgcaaaacuggcuucuucug

SEQ ID NO: 32059 - RNA, 32 nt, Human
acaccccucacagaugaacaaagugaggcaga

SEQ ID NO: 32060 - RNA, 32 nt, Human
acaccccucagccacaagcaaagcuuuggaca

SEQ ID NO: 32061 - RNA, 32 nt, Human
acaccccuccccugggccgcugaggccccgcg

SEQ ID NO: 32062 - RNA, 32 nt, Human
acaccccucugcugcaacaagcucaucccugg

SEQ ID NO: 32063 - RNA, 32 nt, Human
acaccccugagcuucuuucuucaucugcaaaa

SEQ ID NO: 32064 - RNA, 32 nt, Human
acaccccugcacgaugaacacacaccgggcug

SEQ ID NO: 32065 - RNA, 32 nt, Human
acaccccugcacuccagccugggcggcagagu

SEQ ID NO: 32066 - RNA, 32 nt, Human
acaccccugcacuccagccugggugacagcua

SEQ ID NO: 32067 - RNA, 32 nt, Human
acaccccugcuccccacugccgcugcugccuc

SEQ ID NO: 32068 - RNA, 32 nt, Human
acaccccugcuccggcucacacacgcccugcc

SEQ ID NO: 32069 - RNA, 20 nt, Human
acaccccugcuugggccccc

SEQ ID NO: 32070 - RNA, 32 nt, Human
acaccccuggacuccagcuugggugacacagu

SEQ ID NO: 32071 - RNA, 32 nt, Human
acaccccuguagucccagcuacuugggaggcu

SEQ ID NO: 32072 - RNA, 32 nt, Human
acaccccuguccuccagcaccauagagaggcg

SEQ ID NO: 32073 - RNA, 32 nt, Human
acacccgcaccccugcaaaucucccccuucac

SEQ ID NO: 32074 - RNA, 21 nt, Human
acacccgcaccccugcaccuc

SEQ ID NO: 32075 - RNA, 32 nt, Human
acacccgccugccuggccgcaggugguucucc

SEQ ID NO: 32076 - RNA, 32 nt, Human
acacccgcgagugcccuuucaagccugcuggg

SEQ ID NO: 32077 - RNA, 32 nt, Human
acacccgcggggaugaggagguugucagugau

SEQ ID NO: 32078 - RNA, 18 nt, Human
acacccgcugggcugcug

SEQ ID NO: 32079 - RNA, 32 nt, Human
acacccggaaugugccuugugauuggcagagu

SEQ ID NO: 32080 - RNA, 23 nt, Human
acacccggccccaggccaggaca

SEQ ID NO: 32081 - RNA, 32 nt, Human
acacccgucuggucuuugacaagaccaacgaa

SEQ ID NO: 32082 - RNA, 32 nt, Human
acacccguuucagccacaucuaaaagagcaca

SEQ ID NO: 32083 - RNA, 32 nt, Human
acacccuaaaccaggguccugccugggucuca

SEQ ID NO: 32084 - RNA, 32 nt, Human
acacccucacagcugcucucuggcagagguug

SEQ ID NO: 32085 - RNA, 32 nt, Human
acacccucaccacacagucccuuuggacaaau

SEQ ID NO: 32086 - RNA, 32 nt, Human
acacccucagaggagcugcaagcccguggccu

SEQ ID NO: 32087 - RNA, 32 nt, Human
acacccucagcacucuugccccuguuuuguuc

SEQ ID NO: 32088 - RNA, 32 nt, Human
acacccuccagaccucccacagcuccacccca

SEQ ID NO: 32089 - RNA, 32 nt, Human
acacccuccauuacucuuucagucuccaagca

SEQ ID NO: 32090 - RNA, 32 nt, Human
acacccucccagcugucucuggaggcuggagg

SEQ ID NO: 32091 - RNA, 32 nt, Human
acacccuccucccagggaggguccuccagcuc

SEQ ID NO: 32092 - RNA, 32 nt, Human
acacccucggagggggcaagcagaaccucugg

SEQ ID NO: 32093 - RNA, 32 nt, Human
acacccucuccugguggcaggccacuucccuc

SEQ ID NO: 32094 - RNA, 32 nt, Human
acacccucugccacacugcucucuuccuucca

SEQ ID NO: 32095 - RNA, 32 nt, Human
acacccucugggcccgccucuggagccagcgc

SEQ ID NO: 32096 - RNA, 32 nt, Human
acacccucugggcugaguuccuucuuucccuu

SEQ ID NO: 32097 - RNA, 32 nt, Human
acacccugcacuccugcuugcgccggcagcug

SEQ ID NO: 32098 - RNA, 32 nt, Human
acacccugcccaaggaccccaggaucaugugc

SEQ ID NO: 32099 - RNA, 21 nt, Human
acacccugcguccacaccacu

SEQ ID NO: 32100 - RNA, 22 nt, Human
acacccugcuucuucucucaca

SEQ ID NO: 32101 - RNA, 32 nt, Human
acacccugggauggaaccucaggaugggccaa

SEQ ID NO: 32102 - RNA, 21 nt, Human
acacccugggcccucucucau

SEQ ID NO: 32103 - RNA, 23 nt, Human
acacccugggcccugagcaucca

SEQ ID NO: 32104 - RNA, 32 nt, Human
acacccuggggagcuugcaccccauucugugc

SEQ ID NO: 32105 - RNA, 26 nt, Human
acacccuggugaaccccgggugcuaa

SEQ ID NO: 32106 - RNA, 32 nt, Human
acacccuguccugguggggcuguccgggaaga

SEQ ID NO: 32107 - RNA, 32 nt, Human
acacccugucugcagcaggacauggacaaaua

SEQ ID NO: 32108 - RNA, 32 nt, Human
acacccuuaccucccacccccucagcacagga

SEQ ID NO: 32109 - RNA, 32 nt, Human
acacccuuccacccuccugcuccagccuucca

SEQ ID NO: 32110 - RNA, 32 nt, Human
acacccuucucccacucuccuaggcauucugg

SEQ ID NO: 32111 - RNA, 32 nt, Human
acacccuucuccccuuccugguagaccuuaaa

SEQ ID NO: 32112 - RNA, 32 nt, Human
acacccuucugauggaaggugggagccaacac

SEQ ID NO: 32113 - RNA, 32 nt, Human
acacccuuucaucucagaguccacuguggcac

SEQ ID NO: 32114 - RNA, 20 nt, Human
acacccuuucucaaaagaua

SEQ ID NO: 32115 - RNA, 32 nt, Human
acaccgaaaagcuuuggaggauuucacucuug

SEQ ID NO: 32116 - RNA, 32 nt, Human
acaccgaaggaaaugaaagaagcaagaaggaa

SEQ ID NO: 32117 - RNA, 32 nt, Human
acaccgaaggaaaugggguggugaaaccccac

SEQ ID NO: 32118 - RNA, 32 nt, Human
acaccgaagggcccagcgcagcuacuggcagu

SEQ ID NO: 32119 - RNA, 32 nt, Human
acaccgacacaggcacauguacaugcacaggu

SEQ ID NO: 32120 - RNA, 32 nt, Human
acaccgaccaacaacugaaaacggugacagcu

SEQ ID NO: 32121 - RNA, 32 nt, Human
acaccgacguuguagcagcugcauaauaaaug

SEQ ID NO: 32122 - RNA, 32 nt, Human
acaccgagaacagcagggugacgccagggaca

SEQ ID NO: 32123 - RNA, 32 nt, Human
acaccgagacuggccucagaaauaguuggcua

SEQ ID NO: 32124 - RNA, 32 nt, Human
acaccgagacuggccucagaaauaguuggcuu

SEQ ID NO: 32125 - RNA, 32 nt, Human
acaccgagagcucccuccucugcaccaguggc

SEQ ID NO: 32126 - RNA, 32 nt, Human
acaccgagugugggggccacgccccuugccau

SEQ ID NO: 32127 - RNA, 32 nt, Human
acaccgcagaagcaaagagcagugaggcuccu

SEQ ID NO: 32128 - RNA, 32 nt, Human
acaccgcagcagcaaccgggcccggccagguu

SEQ ID NO: 32129 - RNA, 32 nt, Human
acaccgcaggcagagguugcucggggccuugg

SEQ ID NO: 32130 - RNA, 32 nt, Human
acaccgccacaccaacaccaccacuacaaaaa

SEQ ID NO: 32131 - RNA, 23 nt, Human
acaccgcccucuccaccccaccg

SEQ ID NO: 32132 - RNA, 19 nt, Human
acaccgccugcuaaaaaua

SEQ ID NO: 32133 - RNA, 32 nt, Human
acaccgccuuucugaccccacccugcacuccc

SEQ ID NO: 32134 - RNA, 32 nt, Human
acaccgcgucgacgccuucacugccauccccg

SEQ ID NO: 32135 - RNA, 32 nt, Human
acaccgcugcacucaagccugggugacaguga

SEQ ID NO: 32136 - RNA, 32 nt, Human
acaccgcugcacucaagcuugggugacagagc

SEQ ID NO: 32137 - RNA, 32 nt, Human
acaccgcugcacuccagccugggcaacaagag

SEQ ID NO: 32138 - RNA, 32 nt, Human
acaccggacaugacugcccuccaggaauaacc

SEQ ID NO: 32139 - RNA, 32 nt, Human
acaccggagagggguaggcagaguggugaggc

SEQ ID NO: 32140 - RNA, 32 nt, Human
acaccggagcuuccuagcuuccuuucuuugcu

SEQ ID NO: 32141 - RNA, 32 nt, Human
acaccggaggacaccucuuggagcucaccacc

SEQ ID NO: 32142 - RNA, 32 nt, Human
acaccggcauaaaucuauuuuugcuaccagau

SEQ ID NO: 32143 - RNA, 32 nt, Human
acaccggcccugcuccuuccuccucuaggucc

SEQ ID NO: 32144 - RNA, 32 nt, Human
acaccggcccugcuccuuccuccucugggccc

SEQ ID NO: 32145 - RNA, 32 nt, Human
acaccggggcuggguuucucuuuccucuuuuu

SEQ ID NO: 32146 - RNA, 32 nt, Human
acaccggugaagcuuccuggccgagcauaaac

SEQ ID NO: 32147 - RNA, 32 nt, Human
acaccguaauuuccuacuuuacacucuaacuu

SEQ ID NO: 32148 - RNA, 32 nt, Human
acaccgucaaggccaccaugcccaucugggug

SEQ ID NO: 32149 - RNA, 32 nt, Human
acaccgugaauccauucccaucaguccauucc

SEQ ID NO: 32150 - RNA, 32 nt, Human
acaccgugagccagccaggccuggccgcuggg

SEQ ID NO: 32151 - RNA, 32 nt, Human
acaccgugagccugccuuuguacuucaaacuc

SEQ ID NO: 32152 - RNA, 32 nt, Human
acaccgugcauaguggugaagacugaacgagc

SEQ ID NO: 32153 - RNA, 32 nt, Human
acaccgugggccugaggcgcgagcccggcggc

SEQ ID NO: 32154 - RNA, 32 nt, Human
acaccgugggguccaggcugggccaggagacc

SEQ ID NO: 32155 - RNA, 32 nt, Human
acaccguugagguuggagugggcacaggcaug

SEQ ID NO: 32156 - RNA, 32 nt, Human
acaccguugcccaggcuggagggcagugacgu

SEQ ID NO: 32157 - RNA, 32 nt, Human
acaccuaaaaccaguuuugcugcuauaauucu

SEQ ID NO: 32158 - RNA, 20 nt, Human
acaccuaaggaccaaagaua

SEQ ID NO: 32159 - RNA, 32 nt, Human
acaccuaagugccuccccaaccagggucuguc

SEQ ID NO: 32160 - RNA, 32 nt, Human
acaccuacagcuuuuggucccuugccucuucc

SEQ ID NO: 32161 - RNA, 32 nt, Human
acaccuacaggcucagcauucagcaccccauu

SEQ ID NO: 32162 - RNA, 32 nt, Human
acaccuacaugcagagccauaagagcagcugc

SEQ ID NO: 32163 - RNA, 32 nt, Human
acaccuacuaggguuaaaguucagaugauagu

SEQ ID NO: 32164 - RNA, 32 nt, Human
acaccuacucugcuccccucucacacaucugg

SEQ ID NO: 32165 - RNA, 18 nt, Human
acaccuagcucaaaaaua

SEQ ID NO: 32166 - RNA, 17 nt, Human
acaccuaggacccagga

SEQ ID NO: 32167 - RNA, 32 nt, Human
acaccuagggaaacaugaggccccuuauggga

SEQ ID NO: 32168 - RNA, 32 nt, Human
acaccuauagucccagcacucugagaggcuca

SEQ ID NO: 32169 - RNA, 32 nt, Human
acaccuauuuugcgccagaccucuuaauuguu

SEQ ID NO: 32170 - RNA, 32 nt, Human
acaccucaaauacaaaaagugccugggaacgu

SEQ ID NO: 32171 - RNA, 32 nt, Human
acaccucaacacaccucugccaccccagguuu

SEQ ID NO: 32172 - RNA, 32 nt, Human
acaccucaacuaaauccaaaguccccauucag

SEQ ID NO: 32173 - RNA, 31 nt, Human
acaccucaauaaauguugaaucaugaugaau

SEQ ID NO: 32174 - RNA, 31 nt, Human
acaccucacagcugcccugccaugcagagcc

SEQ ID NO: 32175 - RNA, 32 nt, Human
acaccucacagcugcccugccaugcagagccc

SEQ ID NO: 32176 - RNA, 32 nt, Human
acaccucaccauugaaauuuauaugccaccuu

SEQ ID NO: 32177 - RNA, 32 nt, Human
acaccucacugcacguaaguggguaucuuacu

SEQ ID NO: 32178 - RNA, 32 nt, Human
acaccucacugcagccuuggccucucaggcuc

SEQ ID NO: 32179 - RNA, 32 nt, Human
acaccucagacaugggauagauuuccccauca

SEQ ID NO: 32180 - RNA, 32 nt, Human
acaccucauggacugaggccagagcccccugu

SEQ ID NO: 32181 - RNA, 32 nt, Human
acaccucaugggccuuugugggcugcuggaga

SEQ ID NO: 32182 - RNA, 32 nt, Human
acaccuccaccaaaccuccucuugcacuuucc

SEQ ID NO: 32183 - RNA, 32 nt, Human
acaccuccaggaacuccacucccagucuuaga

SEQ ID NO: 32184 - RNA, 20 nt, Human
acaccucccaccaggcccca

SEQ ID NO: 32185 - RNA, 32 nt, Human
acaccucccaccaggcuccaccuccaacacug

SEQ ID NO: 32186 - RNA, 19 nt, Human
acaccuccccguggcucca

SEQ ID NO: 32187 - RNA, 32 nt, Human
acaccucccugccucgccccgagggcgucacg

SEQ ID NO: 32188 - RNA, 32 nt, Human
acaccucccugcugccccucccucucucuccc

SEQ ID NO: 32189 - RNA, 21 nt, Human
acaccuccgcccccucccgca

SEQ ID NO: 32190 - RNA, 32 nt, Human
acaccuccucaaacucucugcagcagauguaa

SEQ ID NO: 32191 - RNA, 18 nt, Human
acaccuccuccaggaaua

SEQ ID NO: 32192 - RNA, 32 nt, Human
acaccuccucuccagcccaaucuucugggucc

SEQ ID NO: 32193 - RNA, 32 nt, Human
acaccuccugcagcccccagcaugcgggcagg

SEQ ID NO: 32194 - RNA, 19 nt, Human
acaccuccuggaggcccca

SEQ ID NO: 32195 - RNA, 32 nt, Human
acaccuccugguuggaugucaucccccgaccc

SEQ ID NO: 32196 - RNA, 32 nt, Human
acaccucggagcugaauacagccugggccuca

SEQ ID NO: 32197 - RNA, 32 nt, Human
acaccucggcugcugucacuucccugguucgg

SEQ ID NO: 32198 - RNA, 32 nt, Human
acaccucggcuggggaaaccgaggccaccgcc

SEQ ID NO: 32199 - RNA, 32 nt, Human
acaccucuagccccagcuacucaggcuggggu

SEQ ID NO: 32200 - RNA, 32 nt, Human
acaccucucauccgccccuccugcuccaucac

SEQ ID NO: 32201 - RNA, 32 nt, Human
acaccucuccuggguguggagacagcuugguu

SEQ ID NO: 32202 - RNA, 32 nt, Human
acaccucucgcggcagcugucauuuccaugug

SEQ ID NO: 32203 - RNA, 32 nt, Human
acaccucucucaggagcuucugagucagacgc

SEQ ID NO: 32204 - RNA, 32 nt, Human
acaccucucuuugugcugaauuucugggccau

SEQ ID NO: 32205 - RNA, 19 nt, Human
acaccucugaccaaaagua

SEQ ID NO: 32206 - RNA, 32 nt, Human
acaccucugagagaagucagugcagacggccc

SEQ ID NO: 32207 - RNA, 32 nt, Human
acaccucugcacucccuugggcagagauggga

SEQ ID NO: 32208 - RNA, 32 nt, Human
acaccucugccuggccugcugcuagcccugcc

SEQ ID NO: 32209 - RNA, 32 nt, Human
acaccucugggagaaggcugcagccaccuggg

SEQ ID NO: 32210 - RNA, 18 nt, Human
acaccucuuacaaaaaug

SEQ ID NO: 32211 - RNA, 20 nt, Human
acaccucuuacguaaagaua

SEQ ID NO: 32212 - RNA, 32 nt, Human
acaccucuugccaggcugcagagcuaugcagu

SEQ ID NO: 32213 - RNA, 32 nt, Human
acaccugaaucagcuggacauacugcuggagu

SEQ ID NO: 32214 - RNA, 21 nt, Human
acaccugacagccccucccuc

SEQ ID NO: 32215 - RNA, 32 nt, Human
acaccugaccucaggugauccauucgucuugg

SEQ ID NO: 32216 - RNA, 32 nt, Human
acaccugacucugucacucaagccuuucucca

SEQ ID NO: 32217 - RNA, 19 nt, Human
acaccugacugcaaaaaug

SEQ ID NO: 32218 - RNA, 32 nt, Human
acaccugacugcacuccagccuggguggcaaa

SEQ ID NO: 32219 - RNA, 32 nt, Human
acaccugagagucccugggguccagucauugc

SEQ ID NO: 32220 - RNA, 32 nt, Human
acaccugagccaagacuccucuucagaaagag

SEQ ID NO: 32221 - RNA, 32 nt, Human
acaccugagcccaggagguggagguugcacug

SEQ ID NO: 32222 - RNA, 32 nt, Human
acaccugagcuucugagucccuguucuggcac

SEQ ID NO: 32223 - RNA, 32 nt, Human
acaccugagucaguggcucugaaggagaugaa

SEQ ID NO: 32224 - RNA, 32 nt, Human
acaccugcacacaccugcacacucgcuaugcc

SEQ ID NO: 32225 - RNA, 22 nt, Human
acaccugcagaccccugcccca

SEQ ID NO: 32226 - RNA, 32 nt, Human
acaccugcagcucuccccuuggccacagcaag

SEQ ID NO: 32227 - RNA, 32 nt, Human
acaccugccaagcaucacaccugccaagcauc

SEQ ID NO: 32228 - RNA, 32 nt, Human
acaccugccugggaacuuuccccugccaggac

SEQ ID NO: 32229 - RNA, 32 nt, Human
acaccugcuacuuacacauuuccucuuuugga

SEQ ID NO: 32230 - RNA, 21 nt, Human
acaccugcuccucccucccca

SEQ ID NO: 32231 - RNA, 32 nt, Human
acaccugcuggccugggggagcuccagccagg

SEQ ID NO: 32232 - RNA, 32 nt, Human
acaccugcugucccaaacccggagaaguguag

SEQ ID NO: 32233 - RNA, 32 nt, Human
acaccuggaccugcuccuuucccuucaaacgc

SEQ ID NO: 32234 - RNA, 32 nt, Human
acaccuggagccaugggaucuacugaggacca

SEQ ID NO: 32235 - RNA, 21 nt, Human
acaccuggagcugggccuaca

SEQ ID NO: 32236 - RNA, 32 nt, Human
acaccuggagguuuugcuucaaagagaggaga

SEQ ID NO: 32237 - RNA, 17 nt, Human
acaccuggccuaggaga

SEQ ID NO: 32238 - RNA, 32 nt, Human
acaccuggccuggaaggaaccucuuaaaauca

SEQ ID NO: 32239 - RNA, 32 nt, Human
acaccuggcugcagggcugggucagcuggccu

SEQ ID NO: 32240 - RNA, 23 nt, Human
acaccuggcuguccccugcccca

SEQ ID NO: 32241 - RNA, 32 nt, Human
acaccugggacaggcugggcagaggggagaga

SEQ ID NO: 32242 - RNA, 32 nt, Human
acaccugggcaaggaagggcugugcauugagg

SEQ ID NO: 32243 - RNA, 32 nt, Human
acaccugggcaggagugcucucaccacgaggc

SEQ ID NO: 32244 - RNA, 32 nt, Human
acaccugggccgggcuguagaucagguuugcc

SEQ ID NO: 32245 - RNA, 32 nt, Human
acaccugggccuggccuugcuccgggaccugc

SEQ ID NO: 32246 - RNA, 32 nt, Human
acaccugggcuggagugcaguggugcaaucau

SEQ ID NO: 32247 - RNA, 32 nt, Human
acaccugguaccagacccauuuucuacccgug

SEQ ID NO: 32248 - RNA, 32 nt, Human
acaccugguaccucaaagaugacucaucuaca

SEQ ID NO: 32249 - RNA, 32 nt, Human
acaccuggucuugcugcuuccucccaccaccu

SEQ ID NO: 32250 - RNA, 32 nt, Human
acaccuggugagugaggcuucaagggagaugc

SEQ ID NO: 32251 - RNA, 32 nt, Human
acaccugguuagaaggucuaggguucuguaua

SEQ ID NO: 32252 - RNA, 32 nt, Human
acaccuguaauaaucccagcacuuugggaggc

SEQ ID NO: 32253 - RNA, 32 nt, Human
acaccuguaaucacugcacuccaaccuggcaa

SEQ ID NO: 32254 - RNA, 32 nt, Human
acaccuguaaucccagccuggaaugcaguggu

SEQ ID NO: 32255 - RNA, 32 nt, Human
acaccuguacagcacguuacuguacuggauac

SEQ ID NO: 32256 - RNA, 32 nt, Human
acaccuguaggcagaggcugccgagacagacc

SEQ ID NO: 32257 - RNA, 32 nt, Human
acaccuguagucccagcacucugggaggcgga

SEQ ID NO: 32258 - RNA, 32 nt, Human
acaccuguagucccagcugcuccugaggcuga

SEQ ID NO: 32259 - RNA, 32 nt, Human
acaccuguaucaugaaagcaaaaagaaguaaa

SEQ ID NO: 32260 - RNA, 20 nt, Human
acaccugucaaaccaaaaau

SEQ ID NO: 32261 - RNA, 32 nt, Human
acaccugucauugagccaagaaaguccaguuu

SEQ ID NO: 32262 - RNA, 24 nt, Human
acaccugucugcaucugacugagc

SEQ ID NO: 32263 - RNA, 32 nt, Human
acaccugugacauccuccagggccacaggagc

SEQ ID NO: 32264 - RNA, 32 nt, Human
acaccugugaguggcucccagcacuuugagag

SEQ ID NO: 32265 - RNA, 32 nt, Human
acaccugugauucaaagacaccugugucaggc

SEQ ID NO: 32266 - RNA, 32 nt, Human
acaccugugcaggcagcugagaggcagcgugc

SEQ ID NO: 32267 - RNA, 32 nt, Human
acaccugugcagggucccagacccaggcccca

SEQ ID NO: 32268 - RNA, 32 nt, Human
acaccuguggaaucccagcacuucaggaggcc

SEQ ID NO: 32269 - RNA, 32 nt, Human
acaccuguggcauguggaggagacugcccugu

SEQ ID NO: 32270 - RNA, 32 nt, Human
acaccuguggggagacuuuuccagcugggcca

SEQ ID NO: 32271 - RNA, 32 nt, Human
acaccuguuuuuaauaauugccauccuaauga

SEQ ID NO: 32272 - RNA, 32 nt, Human
acaccuuaauaugcugcaacaaaauguagaau

SEQ ID NO: 32273 - RNA, 19 nt, Human
acaccuuaaucucaaaaau

SEQ ID NO: 32274 - RNA, 32 nt, Human
acaccuuaaucugugguuacuaauccagcaaa

SEQ ID NO: 32275 - RNA, 21 nt, Human
acaccuucacagcuuccucgc

SEQ ID NO: 32276 - RNA, 19 nt, Human
acaccuucaugccaaaaau

SEQ ID NO: 32277 - RNA, 32 nt, Human
acaccuucauucucuccagcauccucggcauc

SEQ ID NO: 32278 - RNA, 32 nt, Human
acaccuucccucucugaaugcugagcagaggc

SEQ ID NO: 32279 - RNA, 32 nt, Human
acaccuuccuccacccuccacccugggcugcu

SEQ ID NO: 32280 - RNA, 32 nt, Human
acaccuuccugcagggucccuccugggaggca

SEQ ID NO: 32281 - RNA, 32 nt, Human
acaccuucuccaccauccaggccucccuguca

SEQ ID NO: 32282 - RNA, 32 nt, Human
acaccuucuuuggggcucugcaguuccugcau

SEQ ID NO: 32283 - RNA, 32 nt, Human
acaccuugcucuggucaggaaauguccagugu

SEQ ID NO: 32284 - RNA, 32 nt, Human
acaccuuggaugccuuucucuugcaauguccu

SEQ ID NO: 32285 - RNA, 23 nt, Human
acaccuugguguccugggcccca

SEQ ID NO: 32286 - RNA, 32 nt, Human
acaccuugguucugguuaaacagcuguacuuu

SEQ ID NO: 32287 - RNA, 32 nt, Human
acaccuuuccaucccugacucuauggguuacu

SEQ ID NO: 32288 - RNA, 32 nt, Human
acaccuuucccaugccuccucuggagccuucg

SEQ ID NO: 32289 - RNA, 32 nt, Human
acaccuuuccggaacacauacacacacccugc

SEQ ID NO: 32290 - RNA, 32 nt, Human
acaccuuucuuuucuuuuccucuugugccuag

SEQ ID NO: 32291 - RNA, 23 nt, Human
acaccuuugagucccuucccuca

SEQ ID NO: 32292 - RNA, 32 nt, Human
acaccuuuguauguuccuuguauguuccuauc

SEQ ID NO: 32293 - RNA, 32 nt, Human
acacgaaacauuuuugcuuucuccaguuuucu

SEQ ID NO: 32294 - RNA, 32 nt, Human
acacgaacccaggagugugggccagugcugac

SEQ ID NO: 32295 - RNA, 32 nt, Human
acacgaacucggcuucuuuuguccuagguacg

SEQ ID NO: 32296 - RNA, 32 nt, Human
acacgaagauuugugauccaggccucacuucc

SEQ ID NO: 32297 - RNA, 32 nt, Human
acacgaagucaccagcccauagguccagggag

SEQ ID NO: 32298 - RNA, 32 nt, Human
acacgaagugugaacagaguucuuggaggauu

SEQ ID NO: 32299 - RNA, 32 nt, Human
acacgaaucagagccaccuccaaccagcaaga

SEQ ID NO: 32300 - RNA, 32 nt, Human
acacgaaucgcuuucuggaggaggaggggacc

SEQ ID NO: 32301 - RNA, 32 nt, Human
acacgaccaagcucaagacccuuccccugccc

SEQ ID NO: 32302 - RNA, 32 nt, Human
acacgaccacgacaggccucaggauuuugugu

SEQ ID NO: 32303 - RNA, 32 nt, Human
acacgaccaggagcuacaacggauucaggaac

SEQ ID NO: 32304 - RNA, 32 nt, Human
acacgaccuacaaguagggagcagggaaagaa

SEQ ID NO: 32305 - RNA, 32 nt, Human
acacgacgacuucgcucggaggcacaucggcc

SEQ ID NO: 32306 - RNA, 32 nt, Human
acacgacgugggucucugggacugccugugcc

SEQ ID NO: 32307 - RNA, 32 nt, Human
acacgacuccaucacagggagccugaaaaauu

SEQ ID NO: 32308 - RNA, 32 nt, Human
acacgacuggaggggccuggccccagaacagg

SEQ ID NO: 32309 - RNA, 32 nt, Human
acacgagaagagcuaggguagagaaggacgca

SEQ ID NO: 32310 - RNA, 20 nt, Human
acacgagcagacacccuugg

SEQ ID NO: 32311 - RNA, 32 nt, Human
acacgagccacacgggccacacggugacugcu

SEQ ID NO: 32312 - RNA, 32 nt, Human
acacgagccacaucuggauccccagcagcugg

SEQ ID NO: 32313 - RNA, 32 nt, Human
acacgagccuaaggaggagagauggcuugucc

SEQ ID NO: 32314 - RNA, 32 nt, Human
acacgaggacaugagccaguucugcugagcug

SEQ ID NO: 32315 - RNA, 32 nt, Human
acacgaggcuuguuuauaacaccucuuuuccg

SEQ ID NO: 32316 - RNA, 32 nt, Human
acacgagggcauccccucccagguuuucagcc

SEQ ID NO: 32317 - RNA, 32 nt, Human
acacgagguauuuuauacuggugagaaaccuu

SEQ ID NO: 32318 - RNA, 32 nt, Human
acacgaguccaauacuccuacuucgccaaguc

SEQ ID NO: 32319 - RNA, 32 nt, Human
acacgagugugaaccucucuccccugcgucgc

SEQ ID NO: 32320 - RNA, 32 nt, Human
acacgaucauucuugcucacuucuauaacaaa

SEQ ID NO: 32321 - RNA, 32 nt, Human
acacgaucucagcucacugcaaccucugucuc

SEQ ID NO: 32322 - RNA, 32 nt, Human
acacgaugagccagcacgcacaguggggaucg

SEQ ID NO: 32323 - RNA, 32 nt, Human
acacgauuuggcugaguggcuuugugugaccg

SEQ ID NO: 32324 - RNA, 32 nt, Human
acacgcacacaugcacgcacacacacauaugg

SEQ ID NO: 32325 - RNA, 23 nt, Human
acacgcacaccuccaaccuggga

SEQ ID NO: 32326 - RNA, 32 nt, Human
acacgcaccuaccuggaggacaugagcacaug

SEQ ID NO: 32327 - RNA, 32 nt, Human
acacgcagacacauccccacagaccucacuau

SEQ ID NO: 32328 - RNA, 32 nt, Human
acacgcagagugagagggacaugguggcaggg

SEQ ID NO: 32329 - RNA, 32 nt, Human
acacgcagaguugugauucucaguaccaagcu

SEQ ID NO: 32330 - RNA, 32 nt, Human
acacgcagcagagcagaccugaugucccggug

SEQ ID NO: 32331 - RNA, 32 nt, Human
acacgcagccugggugggugaggggagagacg

SEQ ID NO: 32332 - RNA, 32 nt, Human
acacgcaggagguggggaugcgcgugcggcug

SEQ ID NO: 32333 - RNA, 32 nt, Human
acacgcagguggaggugguugugggugcaggu

SEQ ID NO: 32334 - RNA, 32 nt, Human
acacgcagguggugagccuuaaggacaagcua

SEQ ID NO: 32335 - RNA, 32 nt, Human
acacgcaguuugaccccacgcccagcccuucu

SEQ ID NO: 32336 - RNA, 19 nt, Human
acacgcaugcgccaccacg

SEQ ID NO: 32337 - RNA, 32 nt, Human
acacgcauguaugcaugcacaaacaugugugu

SEQ ID NO: 32338 - RNA, 32 nt, Human
acacgccaagcuuugagaaagcucccagugag

SEQ ID NO: 32339 - RNA, 32 nt, Human
acacgccacugcacuccagccugggugacaga

SEQ ID NO: 32340 - RNA, 32 nt, Human
acacgccaggcuaauguuuuuguauuuuuaau

SEQ ID NO: 32341 - RNA, 32 nt, Human
acacgccauccagcagcgcuaagguggacaug

SEQ ID NO: 32342 - RNA, 32 nt, Human
acacgccauugcacucaagccugggcaauaag

SEQ ID NO: 32343 - RNA, 32 nt, Human
acacgcccaagagaggaagcagagggaggcgg

SEQ ID NO: 32344 - RNA, 32 nt, Human
acacgcccacacagcaccucugccaggccuag

SEQ ID NO: 32345 - RNA, 32 nt, Human
acacgccccugccccucguagcaccugccugc

SEQ ID NO: 32346 - RNA, 32 nt, Human
acacgcccguaaucccagcuacucaggaggcu

SEQ ID NO: 32347 - RNA, 32 nt, Human
acacgcccgucaucucagcuacucaggaggcu

SEQ ID NO: 32348 - RNA, 32 nt, Human
acacgccggggcuggcccugcccucccccacg

SEQ ID NO: 32349 - RNA, 21 nt, Human
acacgccuaauagucccagcu

SEQ ID NO: 32350 - RNA, 32 nt, Human
acacgccuauaaucccagcaccuugggaggcu

SEQ ID NO: 32351 - RNA, 32 nt, Human
acacgccuauaaucccagcuacuuaggaggcu

SEQ ID NO: 32352 - RNA, 32 nt, Human
acacgccuauagucccagcuacucaggaggcu

SEQ ID NO: 32353 - RNA, 20 nt, Human
acacgccugaagucccagcu

SEQ ID NO: 32354 - RNA, 32 nt, Human
acacgccugaagucccagcuacucaggaggcu

SEQ ID NO: 32355 - RNA, 20 nt, Human
acacgccugcagucccagcu

SEQ ID NO: 32356 - RNA, 32 nt, Human
acacgccugcagucccagcuacucaggaggcu

SEQ ID NO: 32357 - RNA, 32 nt, Human
acacgccugccuccuguccccuuauccuuucu

SEQ ID NO: 32358 - RNA, 32 nt, Human
acacgccuguaauaccagcuacucagguggcu

SEQ ID NO: 32359 - RNA, 32 nt, Human
acacgccuguaaucacagcuacuugggaggcu

SEQ ID NO: 32360 - RNA, 32 nt, Human
acacgccuguaaucccagcacuuugggaggcc

SEQ ID NO: 32361 - RNA, 32 nt, Human
acacgccuguaaucccagcuaacccuggaugc

SEQ ID NO: 32362 - RNA, 32 nt, Human
acacgccuguaaucccagcuacaccugaggcu

SEQ ID NO: 32363 - RNA, 32 nt, Human
acacgccuguaaucccagcuacucagauggcu

SEQ ID NO: 32364 - RNA, 32 nt, Human
acacgccuguaaucccagcuacucaggaggcu

SEQ ID NO: 32365 - RNA, 32 nt, Human
acacgccuguaaucccagcuacucgggaagcu

SEQ ID NO: 32366 - RNA, 32 nt, Human
acacgccuguaaucccagcuacucuggaggcu

SEQ ID NO: 32367 - RNA, 32 nt, Human
acacgccuguaaucccagcuacuugggaggcu

SEQ ID NO: 32368 - RNA, 32 nt, Human
acacgccuguaaucccagcugcucgggaggca

SEQ ID NO: 32369 - RNA, 32 nt, Human
acacgccuguaaucccagcugcuugggaggcu

SEQ ID NO: 32370 - RNA, 32 nt, Human
acacgccuguaaucccagguacuuggaaggcu

SEQ ID NO: 32371 - RNA, 32 nt, Human
acacgccuguaaucccaguuacuugggaggcc

SEQ ID NO: 32372 - RNA, 32 nt, Human
acacgccuguaaucucagcuacucaggaggcu

SEQ ID NO: 32373 - RNA, 20 nt, Human
acacgccuguaauuccagcu

SEQ ID NO: 32374 - RNA, 20 nt, Human
acacgccuguagucccagcu

SEQ ID NO: 32375 - RNA, 32 nt, Human
acacgccuguagucccagcuacccgggaggcu

SEQ ID NO: 32376 - RNA, 32 nt, Human
acacgccuguagucccagcuaccuaggaggcu

SEQ ID NO: 32377 - RNA, 32 nt, Human
acacgccuguagucccagcuacucaggaggcu

SEQ ID NO: 32378 - RNA, 32 nt, Human
acacgccuguagucccagcuacucgggagccu

SEQ ID NO: 32379 - RNA, 32 nt, Human
acacgccuguagucccagcuacucgggaggcu

SEQ ID NO: 32380 - RNA, 32 nt, Human
acacgccuguagucccagcuacuggggaggcu

SEQ ID NO: 32381 - RNA, 32 nt, Human
acacgccuguagucccagcuccucgggaggca

SEQ ID NO: 32382 - RNA, 20 nt, Human
acacgccuguagucccaguu

SEQ ID NO: 32383 - RNA, 32 nt, Human
acacgccugucaucccagcuacucgguaggcu

SEQ ID NO: 32384 - RNA, 32 nt, Human
acacgccuguggucucagcuacucgggaggcu

SEQ ID NO: 32385 - RNA, 32 nt, Human
acacgcgaccggcagcuccuggagcgggcgga

SEQ ID NO: 32386 - RNA, 32 nt, Human
acacgcgcacacacgaauacaaauaugccuuc

SEQ ID NO: 32387 - RNA, 22 nt, Human
acacgcgcugccuugcgggagg

SEQ ID NO: 32388 - RNA, 32 nt, Human
acacgcgggagggagagcaguguucugcugga

SEQ ID NO: 32389 - RNA, 32 nt, Human
acacgcuccagcccuucaucagccugggcagu

SEQ ID NO: 32390 - RNA, 32 nt, Human
acacgcucccucccccugccccuucuacacuc

SEQ ID NO: 32391 - RNA, 32 nt, Human
acacgcuccugcacccucuccccguccauacc

SEQ ID NO: 32392 - RNA, 32 nt, Human
acacgcugacuaggaaaaggaggaggcggggc

SEQ ID NO: 32393 - RNA, 32 nt, Human
acacgcugaucuccuaguggagaaggauuuau

SEQ ID NO: 32394 - RNA, 32 nt, Human
acacgcugggggugcuggcugagggaacaugg

SEQ ID NO: 32395 - RNA, 32 nt, Human
acacgcuuacucacugagggugagugggaacg

SEQ ID NO: 32396 - RNA, 32 nt, Human
acacggaccuccaggagcagugagagguggcu

SEQ ID NO: 32397 - RNA, 32 nt, Human
acacggaccuggacacagacauggacauggac

SEQ ID NO: 32398 - RNA, 32 nt, Human
acacggagcaugcccgagagccuggacagccc

SEQ ID NO: 32399 - RNA, 32 nt, Human
acacggagcugcagagggccugggccaccauc

SEQ ID NO: 32400 - RNA, 32 nt, Human
acacggaggacccaacaggaggccguggcucu

SEQ ID NO: 32401 - RNA, 32 nt, Human
acacggaguaggagcagagggaagagagaggg

SEQ ID NO: 32402 - RNA, 32 nt, Human
acacggaucucaaauucacaaauguuaacaug

SEQ ID NO: 32403 - RNA, 32 nt, Human
acacggaucugacagacaaugauccagucacc

SEQ ID NO: 32404 - RNA, 32 nt, Human
acacggauggaagguggagcaaaggaaaauac

SEQ ID NO: 32405 - RNA, 32 nt, Human
acacggcaaccauauuuccucugaaugagaag

SEQ ID NO: 32406 - RNA, 32 nt, Human
acacggcacuucaggcuccacgcacagaaucu

SEQ ID NO: 32407 - RNA, 32 nt, Human
acacggcagcagcaagagaaaaaugaagaagc

SEQ ID NO: 32408 - RNA, 32 nt, Human
acacggcaggcugaggugggaggaucacuuga

SEQ ID NO: 32409 - RNA, 32 nt, Human
acacggcaugaggacagagggaggggcacggg

SEQ ID NO: 32410 - RNA, 18 nt, Human
acacggccacaccaccac

SEQ ID NO: 32411 - RNA, 32 nt, Human
acacggccaggaugacagcggagccaggauca

SEQ ID NO: 32412 - RNA, 32 nt, Human
acacggccaggcgaggaugacagggaaaggga

SEQ ID NO: 32413 - RNA, 32 nt, Human
acacggcucacugcagccucaaccuccuggac

SEQ ID NO: 32414 - RNA, 32 nt, Human
acacggcucacugccgccucaaccucuccugg

SEQ ID NO: 32415 - RNA, 32 nt, Human
acacggcuguaaucccagcacuuugggaggcc

SEQ ID NO: 32416 - RNA, 32 nt, Human
acacggcuuguuccagaugaggaaacugaggu

SEQ ID NO: 32417 - RNA, 32 nt, Human
acacgggaagcugucuugcucccuggacgacu

SEQ ID NO: 32418 - RNA, 32 nt, Human
acacgggaagugagaggcacagugagcuguau

SEQ ID NO: 32419 - RNA, 32 nt, Human
acacgggacaagaacuugggaacugccauaca

SEQ ID NO: 32420 - RNA, 32 nt, Human
acacgggaggcagagguugcagugagcagaga

SEQ ID NO: 32421 - RNA, 23 nt, Human
acacgggaggcggagguugcggu

SEQ ID NO: 32422 - RNA, 32 nt, Human
acacgggccuugagaaauguggcucuuguacc

SEQ ID NO: 32423 - RNA, 32 nt, Human
acacgggggcaauaaaccgagccacccgggcg

SEQ ID NO: 32424 - RNA, 32 nt, Human
acacgggguucuggaaggaccuccucagcaug

SEQ ID NO: 32425 - RNA, 32 nt, Human
acacgggguuugucuguaagcugcagugucug

SEQ ID NO: 32426 - RNA, 32 nt, Human
acacgggugaugauuggcuuucuggggagaga

SEQ ID NO: 32427 - RNA, 32 nt, Human
acacggguggcagcagauggcccagcccaggg

SEQ ID NO: 32428 - RNA, 32 nt, Human
acacggguucaggugauucucuugccucagcc

SEQ ID NO: 32429 - RNA, 32 nt, Human
acacggucaagagaucaagaccauccuggcca

SEQ ID NO: 32430 - RNA, 32 nt, Human
acacggucaucaucccuacccacacacagaug

SEQ ID NO: 32431 - RNA, 32 nt, Human
acacggucuucuccguguaucuuuucacauag

SEQ ID NO: 32432 - RNA, 32 nt, Human
acacgguggguggggagcuaggcucaugcagu

SEQ ID NO: 32433 - RNA, 32 nt, Human
acacgguuaaagcaucgcuaucaacugcguaa

SEQ ID NO: 32434 - RNA, 22 nt, Human
acacgguuguggauccagagaa

SEQ ID NO: 32435 - RNA, 32 nt, Human
acacgucacagcucucaaccuccucucagacc

SEQ ID NO: 32436 - RNA, 32 nt, Human
acacgucaggacuggggugagguggcugggcc

SEQ ID NO: 32437 - RNA, 32 nt, Human
acacguccccugccucaacaggcacagcucuc

SEQ ID NO: 32438 - RNA, 32 nt, Human
acacguccucuuguccuugucucccccagaag

SEQ ID NO: 32439 - RNA, 32 nt, Human
acacgucgaggcuggcaccuggcgcgcucggg

SEQ ID NO: 32440 - RNA, 32 nt, Human
acacgucuauaauuccagcuacucaggaggcu

SEQ ID NO: 32441 - RNA, 32 nt, Human
acacgucuguagucccagcuacucagcaggcu

SEQ ID NO: 32442 - RNA, 32 nt, Human
acacgucuguaguccuagcuacucaggaggcu

SEQ ID NO: 32443 - RNA, 32 nt, Human
acacgucuucaguuuuucagcacagaccagca

SEQ ID NO: 32444 - RNA, 32 nt, Human
acacgugacaacaggcccccuugcagagggca

SEQ ID NO: 32445 - RNA, 32 nt, Human
acacgugagcucgcgguccucccagggagcug

SEQ ID NO: 32446 - RNA, 32 nt, Human
acacgugcaaaccugcuguccucugcauuuac

SEQ ID NO: 32447 - RNA, 18 nt, Human
acacgugcacaacccuga

SEQ ID NO: 32448 - RNA, 32 nt, Human
acacgugcacacacacgcauacacaggcacac

SEQ ID NO: 32449 - RNA, 32 nt, Human
acacgugcacacacgccaacaggcaucugcca

SEQ ID NO: 32450 - RNA, 32 nt, Human
acacgugcacacauacacaggcacacaugcau

SEQ ID NO: 32451 - RNA, 32 nt, Human
acacgugcacacaucguacacaugugagcucc

SEQ ID NO: 32452 - RNA, 32 nt, Human
acacgugccuguagucccagcuacucgggagg

SEQ ID NO: 32453 - RNA, 32 nt, Human
acacgugccuguagucccagcuacucuggagg

SEQ ID NO: 32454 - RNA, 32 nt, Human
acacgugccugucacggaggugaggagugagu

SEQ ID NO: 32455 - RNA, 32 nt, Human
acacguggaaccgcagacagggcccagaagcu

SEQ ID NO: 32456 - RNA, 32 nt, Human
acacguggagacuggaugagggcagaugagga

SEQ ID NO: 32457 - RNA, 32 nt, Human
acacguggagugaauuuaaggagcggagaguu

SEQ ID NO: 32458 - RNA, 32 nt, Human
acacguggccccggaaaucagggagcucuuaa

SEQ ID NO: 32459 - RNA, 21 nt, Human
acacguggggccgcagacaua

SEQ ID NO: 32460 - RNA, 32 nt, Human
acacguggugggggccacugaaaccaggccua

SEQ ID NO: 32461 - RNA, 32 nt, Human
acacguguagcucacacacaguauacacauac

SEQ ID NO: 32462 - RNA, 32 nt, Human
acacguguucucuacagcccguccauggaucc

SEQ ID NO: 32463 - RNA, 32 nt, Human
acacguguuguuuuguuuuugcuuuauugaug

SEQ ID NO: 32464 - RNA, 32 nt, Human
acacguuaaagggccuuaaggcauuuuguuau

SEQ ID NO: 32465 - RNA, 32 nt, Human
acacguuacauacuguuuauuguucuaaugua

SEQ ID NO: 32466 - RNA, 32 nt, Human
acacguucuuuucuaaaugccaaugaguuggc

SEQ ID NO: 32467 - RNA, 32 nt, Human
acacguuuagcuauugagauaaggcugggcgu

SEQ ID NO: 32468 - RNA, 32 nt, Human
acacguuuauuugagccuuacuuuaaaaauau

SEQ ID NO: 32469 - RNA, 32 nt, Human
acacguuuccuugagaagcccauuucucaucu

SEQ ID NO: 32470 - RNA, 32 nt, Human
acacuaaaaauacaaaaaguuagacaggcgug

SEQ ID NO: 32471 - RNA, 32 nt, Human
acacuaaacacaaauagccagucuuaacuugc

SEQ ID NO: 32472 - RNA, 32 nt, Human
acacuaaacacuauucugugugcucaaccuag

SEQ ID NO: 32473 - RNA, 32 nt, Human
acacuaaagaucuggucuuugccgucaagguu

SEQ ID NO: 32474 - RNA, 32 nt, Human
acacuaaccaacuugaggggugcaguggucug

SEQ ID NO: 32475 - RNA, 32 nt, Human
acacuaagaaaaucaaauuuuuaaaaguuauu

SEQ ID NO: 32476 - RNA, 32 nt, Human
acacuaagacuccgccccugaggcuccgcccc

SEQ ID NO: 32477 - RNA, 32 nt, Human
acacuaaggagagguaguaaaugugaaccuug

SEQ ID NO: 32478 - RNA, 32 nt, Human
acacuaaggcuccuuuucugaagaagccuuuu

SEQ ID NO: 32479 - RNA, 32 nt, Human
acacuaauguuccucuggggcagcccccaccu

SEQ ID NO: 32480 - RNA, 32 nt, Human
acacuaauucuaggccauucucuccuucaauc

SEQ ID NO: 32481 - RNA, 32 nt, Human
acacuaauuuugaggaccccagguucaaaagu

SEQ ID NO: 32482 - RNA, 32 nt, Human
acacuacaagucuugaguuaagaaggaaagag

SEQ ID NO: 32483 - RNA, 32 nt, Human
acacuacacaacacaccagccgcugcaggucc

SEQ ID NO: 32484 - RNA, 32 nt, Human
acacuacagccuguaauacugcucucuuucaa

SEQ ID NO: 32485 - RNA, 32 nt, Human
acacuacaggcaggguaugagcagagggaugu

SEQ ID NO: 32486 - RNA, 32 nt, Human
acacuacaguggcugaggcaucagcccccgcc

SEQ ID NO: 32487 - RNA, 32 nt, Human
acacuaccaguggauguccagacaugcucuua

SEQ ID NO: 32488 - RNA, 32 nt, Human
acacuaccuuucugggaaauguuaauaaauuu

SEQ ID NO: 32489 - RNA, 32 nt, Human
acacuacucuucuucaauuccucaguuacucc

SEQ ID NO: 32490 - RNA, 32 nt, Human
acacuacugcacuccagccugggcaacagaac

SEQ ID NO: 32491 - RNA, 32 nt, Human
acacuacugcacuccagccugggcgacaaagc

SEQ ID NO: 32492 - RNA, 32 nt, Human
acacuacugcacuccugcaugggcgacugaga

SEQ ID NO: 32493 - RNA, 32 nt, Human
acacuacugcauuccagccugagcaacagagc

SEQ ID NO: 32494 - RNA, 32 nt, Human
acacuacugcauuccagccugggugacagagu

SEQ ID NO: 32495 - RNA, 32 nt, Human
acacuacugugcccagcuaacuuauuuuuauu

SEQ ID NO: 32496 - RNA, 32 nt, Human
acacuacuguggcaaacuggagaagugccaau

SEQ ID NO: 32497 - RNA, 32 nt, Human
acacuagagaauguugcugagagcagaaacgg

SEQ ID NO: 32498 - RNA, 26 nt, Human
acacuagccugggugacagagcaaga

SEQ ID NO: 32499 - RNA, 32 nt, Human
acacuagcuucccagggcugcccccgacaggc

SEQ ID NO: 32500 - RNA, 32 nt, Human
acacuagcuuucguuccuuagaaugucuuuuc

SEQ ID NO: 32501 - RNA, 32 nt, Human
acacuaggaggacagacacaggcuccaaacuc

SEQ ID NO: 32502 - RNA, 16 nt, Human
acacuaggcugggccc

SEQ ID NO: 32503 - RNA, 32 nt, Human
acacuagggccuuggaaauuccuguacugugu

SEQ ID NO: 32504 - RNA, 17 nt, Human
acacuagucacaaugca

SEQ ID NO: 32505 - RNA, 32 nt, Human
acacuagucuugaacuccuggccucaagcaau

SEQ ID NO: 32506 - RNA, 32 nt, Human
acacuagugcuuccgcuggaguuugcaguuuu

SEQ ID NO: 32507 - RNA, 32 nt, Human
acacuauauaaauaagcuuuuaaacaagucau

SEQ ID NO: 32508 - RNA, 32 nt, Human
acacuauauuggagucucuuucucagacuucc

SEQ ID NO: 32509 - RNA, 32 nt, Human
acacuaucauagauuccuuagguaaauacaau

SEQ ID NO: 32510 - RNA, 32 nt, Human
acacuaugaggacccagguggcaccagcagua

SEQ ID NO: 32511 - RNA, 32 nt, Human
acacuaugaguguuugggauguguuuuauuua

SEQ ID NO: 32512 - RNA, 32 nt, Human
acacuaugugccagacacggugcugagcauug

SEQ ID NO: 32513 - RNA, 31 nt, Human
acacuauuaauaaauaccuuagagaaagauu

SEQ ID NO: 32514 - RNA, 32 nt, Human
acacuauugcacuccagccugggcgacagggc

SEQ ID NO: 32515 - RNA, 32 nt, Human
acacuauuucaucaaucuuuucacaugucauu

SEQ ID NO: 32516 - RNA, 32 nt, Human
acacucacauguuagaaugaaaagagcaguag

SEQ ID NO: 32517 - RNA, 22 nt, Human
acacucaccacucccagcuucu

SEQ ID NO: 32518 - RNA, 32 nt, Human
acacucaccgggaaggucugcagcuucacucc

SEQ ID NO: 32519 - RNA, 32 nt, Human
acacucaccgugaaggucugcagcuucacucc

SEQ ID NO: 32520 - RNA, 22 nt, Human
acacucaccuggcuccagccuc

SEQ ID NO: 32521 - RNA, 32 nt, Human
acacucacggcgaaggucugcagcuucacucc

SEQ ID NO: 32522 - RNA, 32 nt, Human
acacucacuggcugggaaaagacaauguggau

SEQ ID NO: 32523 - RNA, 32 nt, Human
acacucacugggaaugucugcagcuucacucc

SEQ ID NO: 32524 - RNA, 32 nt, Human
acacucacuucuuuuuagcugugugagcauga

SEQ ID NO: 32525 - RNA, 32 nt, Human
acacucagcugcaaguccaaagccacaagugc

SEQ ID NO: 32526 - RNA, 32 nt, Human
acacucagcugcagugagaauacacaggcauc

SEQ ID NO: 32527 - RNA, 32 nt, Human
acacucaggagaagaaggagauugcuuuucag

SEQ ID NO: 32528 - RNA, 32 nt, Human
acacucaggcuggaguggugguaagggacacg

SEQ ID NO: 32529 - RNA, 32 nt, Human
acacucauaacacccauaccucauuccugacu

SEQ ID NO: 32530 - RNA, 23 nt, Human
acacucaucaauaaauaaguguu

SEQ ID NO: 32531 - RNA, 32 nt, Human
acacucauccagacuucucugaagcagaaaac

SEQ ID NO: 32532 - RNA, 32 nt, Human
acacucaucguaugggcucugcaaagggauau

SEQ ID NO: 32533 - RNA, 32 nt, Human
acacucaucuacagagaauauacacuguucuu

SEQ ID NO: 32534 - RNA, 32 nt, Human
acacucaucucugacaagacugaagaugauua

SEQ ID NO: 32535 - RNA, 32 nt, Human
acacucauggacucacacauacacucacaugc

SEQ ID NO: 32536 - RNA, 32 nt, Human
acacucauugcagccaagaugcacaaagcaca

SEQ ID NO: 32537 - RNA, 32 nt, Human
acacucauuggaaggggacgaggaauccaggg

SEQ ID NO: 32538 - RNA, 32 nt, Human
acacucauuuugaggaccccagguucaaaagu

SEQ ID NO: 32539 - RNA, 32 nt, Human
acacuccaaccuaggugacagagcaagacccu

SEQ ID NO: 32540 - RNA, 32 nt, Human
acacuccaaguuucagcaguuuuagcgccacc

SEQ ID NO: 32541 - RNA, 32 nt, Human
acacuccaaugcuuuucaauagcuaaagaauu

SEQ ID NO: 32542 - RNA, 32 nt, Human
acacuccacacucacaccuccaccuuaacaaa

SEQ ID NO: 32543 - RNA, 32 nt, Human
acacuccagcacucagcccccuugcccaccuc

SEQ ID NO: 32544 - RNA, 32 nt, Human
acacuccagcauggacaauagagcaagaaccc

SEQ ID NO: 32545 - RNA, 32 nt, Human
acacuccagccccuuucugggauccuggccac

SEQ ID NO: 32546 - RNA, 32 nt, Human
acacuccagccugagcgacagagcaagacucc

SEQ ID NO: 32547 - RNA, 32 nt, Human
acacuccagccuggauaacagagcgagacccu

SEQ ID NO: 32548 - RNA, 32 nt, Human
acacuccagccuggccacagagcgagacucag

SEQ ID NO: 32549 - RNA, 32 nt, Human
acacuccagccuggcgacagagcgagacuugg

SEQ ID NO: 32550 - RNA, 32 nt, Human
acacuccagccugggcaacagagcaagacucg

SEQ ID NO: 32551 - RNA, 32 nt, Human
acacuccagccuggugacagagugagacucca

SEQ ID NO: 32552 - RNA, 32 nt, Human
acacuccaggaaagagcugaagacugacuagc

SEQ ID NO: 32553 - RNA, 32 nt, Human
acacuccaggugagccaggaucaaucccuggu

SEQ ID NO: 32554 - RNA, 32 nt, Human
acacuccagugaaauguacugaguggauuccg

SEQ ID NO: 32555 - RNA, 32 nt, Human
acacuccauuuucccuccucugaagcuuccaa

SEQ ID NO: 32556 - RNA, 32 nt, Human
acacucccaaagauacccacagaaguccagcc

SEQ ID NO: 32557 - RNA, 32 nt, Human
acacucccaagggaacuggugcuugcugggaa

SEQ ID NO: 32558 - RNA, 32 nt, Human
acacucccacacuccagccuggguaacaguga

SEQ ID NO: 32559 - RNA, 18 nt, Human
acacucccaccccagcca

SEQ ID NO: 32560 - RNA, 32 nt, Human
acacucccagcaccuaguaugcucaguaaaug

SEQ ID NO: 32561 - RNA, 32 nt, Human
acacuccccaaaacaccccuuuccaguuacaa

SEQ ID NO: 32562 - RNA, 32 nt, Human
acacuccccauacccuucagugcaguguacca

SEQ ID NO: 32563 - RNA, 32 nt, Human
acacucccgcguccaccucucccucccugcuu

SEQ ID NO: 32564 - RNA, 32 nt, Human
acacucccugacaugcucacacacugucacac

SEQ ID NO: 32565 - RNA, 32 nt, Human
acacucccugacaugcucacacacugucauac

SEQ ID NO: 32566 - RNA, 32 nt, Human
acacucccugcucagcuccucgugcugcccug

SEQ ID NO: 32567 - RNA, 32 nt, Human
acacucccuguggcugcccuuugugauucccu

SEQ ID NO: 32568 - RNA, 32 nt, Human
acacucccuucccaugacccaggcugggcaag

SEQ ID NO: 32569 - RNA, 20 nt, Human
acacuccgccuugugacuca

SEQ ID NO: 32570 - RNA, 32 nt, Human
acacuccggccucucagaauucacuugagguu

SEQ ID NO: 32571 - RNA, 32 nt, Human
acacuccguggacuccucucuccaucagacug

SEQ ID NO: 32572 - RNA, 32 nt, Human
acacuccuagcagcugguaaaggggugcugga

SEQ ID NO: 32573 - RNA, 32 nt, Human
acacuccucacacugcucaggcuccaacaugu

SEQ ID NO: 32574 - RNA, 32 nt, Human
acacuccucgcacuuccagccuuggagcccuu

SEQ ID NO: 32575 - RNA, 32 nt, Human
acacuccugcaggagucggcggagcaggcaga

SEQ ID NO: 32576 - RNA, 32 nt, Human
acacuccugccuggcagcuccccauguuuagc

SEQ ID NO: 32577 - RNA, 32 nt, Human
acacuccugcugcggcucauguuuggaagcug

SEQ ID NO: 32578 - RNA, 32 nt, Human
acacuccugcuguuccagccucugcaggugaa

SEQ ID NO: 32579 - RNA, 32 nt, Human
acacuccuggacugggcuagccugcacugccu

SEQ ID NO: 32580 - RNA, 32 nt, Human
acacuccuggcaucccagcgucuccagcuugc

SEQ ID NO: 32581 - RNA, 32 nt, Human
acacuccugggagcucaggaggcuucugagcu

SEQ ID NO: 32582 - RNA, 32 nt, Human
acacuccugggcucugaacacacacgccagcu

SEQ ID NO: 32583 - RNA, 32 nt, Human
acacuccuguaaucccagcuacuggggaggcu

SEQ ID NO: 32584 - RNA, 32 nt, Human
acacuccuguaaucccagcuacuuaggaggcu

SEQ ID NO: 32585 - RNA, 32 nt, Human
acacucgaacagauuccucaacggagagcuau

SEQ ID NO: 32586 - RNA, 32 nt, Human
acacucgagucagcuaaaacugcccccagcac

SEQ ID NO: 32587 - RNA, 32 nt, Human
acagucaccagcugggccccggccgcccagag

SEQ ID NO: 32588 - RNA, 32 nt, Human
acagucacccugguuuuaauugcccacaacuc

SEQ ID NO: 32589 - RNA, 32 nt, Human
acagucaccugaccaaauaaauggagaaagcu

SEQ ID NO: 32590 - RNA, 32 nt, Human
acagucacgccacugcauucuauccugggcaa

SEQ ID NO: 32591 - RNA, 32 nt, Human
acagucacugcaaucucuuuaccaccucccca

SEQ ID NO: 32592 - RNA, 27 nt, Human
acagucacugcccagagguacugagga

SEQ ID NO: 32593 - RNA, 32 nt, Human
acagucagaagugggucugugggaucuguggu

SEQ ID NO: 32594 - RNA, 32 nt, Human
acagucagaccagcagugaauagcuaugcuuc

SEQ ID NO: 32595 - RNA, 32 nt, Human
acagucagcccaugggcugggaugggaucccc

SEQ ID NO: 32596 - RNA, 32 nt, Human
acagucagccgcaauacugaugaagcugagaa

SEQ ID NO: 32597 - RNA, 32 nt, Human
acagucagcugcagaaguccugcugaccaccu

SEQ ID NO: 32598 - RNA, 32 nt, Human
acagucagcugggcugaguguauuccaaacgg

SEQ ID NO: 32599 - RNA, 32 nt, Human
acagucagcuuugggguuccuuuuauuagugc

SEQ ID NO: 32600 - RNA, 19 nt, Human
acagucaggacaagggggg

SEQ ID NO: 32601 - RNA, 32 nt, Human
acagucaggagagagcgaugccagagagaacg

SEQ ID NO: 32602 - RNA, 32 nt, Human
acagucaggcaugaauuguaagaaaaaggagu

SEQ ID NO: 32603 - RNA, 32 nt, Human
acagucaggcuuccagcacauucucccccauu

SEQ ID NO: 32604 - RNA, 32 nt, Human
acagucaggggcccugauuccacuuccuuugg

SEQ ID NO: 32605 - RNA, 32 nt, Human
acagucauaucuuccgacguggagauuugaga

SEQ ID NO: 32606 - RNA, 32 nt, Human
acagucauaucuuccgauguggagauuugaga

SEQ ID NO: 32607 - RNA, 32 nt, Human
acagucauaucuuucgauguggagauuugaga

SEQ ID NO: 32608 - RNA, 32 nt, Human
acagucaucacuucuuggaguugguuaccuug

SEQ ID NO: 32609 - RNA, 32 nt, Human
acagucaucaucagggccuggggccugagaga

SEQ ID NO: 32610 - RNA, 18 nt, Human
acagucauccacaaggca

SEQ ID NO: 32611 - RNA, 32 nt, Human
acagucaucccuugauaccugcuggguauugg

SEQ ID NO: 32612 - RNA, 32 nt, Human
acagucaucugccaccacaccuggcuaauuuu

SEQ ID NO: 32613 - RNA, 32 nt, Human
acagucauuuugcuuaucugcgguuucucauu

SEQ ID NO: 32614 - RNA, 32 nt, Human
acaguccaaaagugagcaccugccuggagcug

SEQ ID NO: 32615 - RNA, 32 nt, Human
acaguccagaagccugagagacaguggccccu

SEQ ID NO: 32616 - RNA, 32 nt, Human
acagucccaacaucugccucauagcagauucu

SEQ ID NO: 32617 - RNA, 32 nt, Human
acagucccagcacuuuaagagacucaggcagg

SEQ ID NO: 32618 - RNA, 32 nt, Human
acagucccauggcccacccaaggagagccggc

SEQ ID NO: 32619 - RNA, 32 nt, Human
acaguccccagccuggccaaggccauaguccc

SEQ ID NO: 32620 - RNA, 20 nt, Human
acaguccccguggccauccc

SEQ ID NO: 32621 - RNA, 32 nt, Human
acagucccuccaggguuugggcaggagauggc

SEQ ID NO: 32622 - RNA, 32 nt, Human
acagucccucccacagucuacucugucuccac

SEQ ID NO: 32623 - RNA, 32 nt, Human
acagucccucuucuccccaggaccccagggcc

SEQ ID NO: 32624 - RNA, 32 nt, Human
acagucccugcaggagcagccuccaagcugcc

SEQ ID NO: 32625 - RNA, 24 nt, Human
acagucccuggacaaccuccugcu

SEQ ID NO: 32626 - RNA, 32 nt, Human
acagucccuucucccuucuuccuucuuccuuc

SEQ ID NO: 32627 - RNA, 32 nt, Human
acaguccgaccucacucaauacccacaaccau

SEQ ID NO: 32628 - RNA, 22 nt, Human
acaguccgcuaaagcuaucaaa

SEQ ID NO: 32629 - RNA, 32 nt, Human
acaguccggguaacauaaugagaccuguccuc

SEQ ID NO: 32630 - RNA, 32 nt, Human
acaguccuccaaaaauaaacauuuuauauaga

SEQ ID NO: 32631 - RNA, 32 nt, Human
acaguccuccacccuguccugugguccugugu

SEQ ID NO: 32632 - RNA, 32 nt, Human
acaguccuccugcugcugguccuuagugaaug

SEQ ID NO: 32633 - RNA, 32 nt, Human
acaguccugcagccucauauggcucaauaaaa

SEQ ID NO: 32634 - RNA, 32 nt, Human
acaguccugcagcugcugggucacagaguggc

SEQ ID NO: 32635 - RNA, 32 nt, Human
acaguccuggaggcagagaugcaguuaccuac

SEQ ID NO: 32636 - RNA, 32 nt, Human
acaguccuuacuucucuaccugccucaagaag

SEQ ID NO: 32637 - RNA, 32 nt, Human
acaguccuuggguagacugagaucauggcuag

SEQ ID NO: 32638 - RNA, 32 nt, Human
acaguccuuuguauucugcugagagcuuuccu

SEQ ID NO: 32639 - RNA, 32 nt, Human
acagucgcccgccaccacgcccggcuaauuuu

SEQ ID NO: 32640 - RNA, 32 nt, Human
acagucgccguccugucaagagcgcuaaugaa

SEQ ID NO: 32641 - RNA, 32 nt, Human
acagucgggcuccaggcuccuccugggucuga

SEQ ID NO: 32642 - RNA, 32 nt, Human
acagucgguuuccaucagaguggucaucuuca

SEQ ID NO: 32643 - RNA, 32 nt, Human
acagucguaugauuucuagcccauggguuuaa

SEQ ID NO: 32644 - RNA, 32 nt, Human
acagucguuucuuuuccagccuccuggccuuc

SEQ ID NO: 32645 - RNA, 32 nt, Human
acagucucaaaaccagcaacagcagcaguacc

SEQ ID NO: 32646 - RNA, 32 nt, Human
acagucucacccagacuccaggcugucuuuca

SEQ ID NO: 32647 - RNA, 32 nt, Human
acagucucacuucauuacccaggcuggagugc

SEQ ID NO: 32648 - RNA, 32 nt, Human
acagucucagccacaaaacacuuccucaaaca

SEQ ID NO: 32649 - RNA, 32 nt, Human
acagucucagccccaccgacccacuuucuugg

SEQ ID NO: 32650 - RNA, 32 nt, Human
acagucucagggagguggugggcggggcccuu

SEQ ID NO: 32651 - RNA, 21 nt, Human
acagucucaggugcuguguug

SEQ ID NO: 32652 - RNA, 32 nt, Human
acagucuccuggugucacccaggcuggagugc

SEQ ID NO: 32653 - RNA, 32 nt, Human
acagucucgagggaagagggucugguggaagg

SEQ ID NO: 32654 - RNA, 32 nt, Human
acagucucgccugucugucucuggccuuggug

SEQ ID NO: 32655 - RNA, 32 nt, Human
acagucucuaugcuuauuuacaucuucuacug

SEQ ID NO: 32656 - RNA, 32 nt, Human
acagucucucaggcaugugcaggguccuagga

SEQ ID NO: 32657 - RNA, 32 nt, Human
acagucucucucugucacccaggcuggcgugc

SEQ ID NO: 32658 - RNA, 32 nt, Human
acagucugaagaggaaggaagcagcaguaucu

SEQ ID NO: 32659 - RNA, 32 nt, Human
acagucugaagcucgcauccagacagucgcuc

SEQ ID NO: 32660 - RNA, 32 nt, Human
acagucugagcaagagaccugcagccccuguu

SEQ ID NO: 32661 - RNA, 32 nt, Human
acagucugcaccuggaguccuuguuuguaacc

SEQ ID NO: 32662 - RNA, 32 nt, Human
acagucugcaucuuauagcagugccuuugucu

SEQ ID NO: 32663 - RNA, 32 nt, Human
acagucugcauuccacagugacaguauucuug

SEQ ID NO: 32664 - RNA, 32 nt, Human
acagucugcgaccuucuuguuuggagaugaga

SEQ ID NO: 32665 - RNA, 32 nt, Human
acagucuggagugcuguggugcaauuaugguu

SEQ ID NO: 32666 - RNA, 21 nt, Human
acagucuggcagaccuccacc

SEQ ID NO: 32667 - RNA, 32 nt, Human
acagucuggccaacauggcgaaaccucaucuc

SEQ ID NO: 32668 - RNA, 32 nt, Human
acagucuggcccugucgcccaggcuggagugc

SEQ ID NO: 32669 - RNA, 32 nt, Human
acagucuggcucugcugcccaggcuggaaugc

SEQ ID NO: 32670 - RNA, 31 nt, Human
acagucuggguggaauggggcugaaaccaug

SEQ ID NO: 32671 - RNA, 22 nt, Human
acagucugguaggucuacaacc

SEQ ID NO: 32672 - RNA, 32 nt, Human
acagucugucaccucccuccccgccacuuugu

SEQ ID NO: 32673 - RNA, 32 nt, Human
acagucuuacugaagaacauucccagugcccc

SEQ ID NO: 32674 - RNA, 32 nt, Human
acagucuucaucuuccuccucaagacagcugg

SEQ ID NO: 32675 - RNA, 32 nt, Human
acagucuuccagcuuguaaaugccauugacuu

SEQ ID NO: 32676 - RNA, 32 nt, Human
acagucuugcauucagcagguguuuguucauc

SEQ ID NO: 32677 - RNA, 32 nt, Human
acagucuugccuuucucuugguguuuucuuuc

SEQ ID NO: 32678 - RNA, 21 nt, Human
acagucuugggcuggaugggu

SEQ ID NO: 32679 - RNA, 32 nt, Human
acagucuuguagggaagaucuguauggaauua

SEQ ID NO: 32680 - RNA, 32 nt, Human
acagucuuucuuagauucucuaccucccucuu

SEQ ID NO: 32681 - RNA, 32 nt, Human
acagucuuugugaaauaaaauaacgugcuuca

SEQ ID NO: 32682 - RNA, 32 nt, Human
acagugaaaagaggagugacaggagggaaagg

SEQ ID NO: 32683 - RNA, 32 nt, Human
acagugaaaagcaagaggaaagagaugggaua

SEQ ID NO: 32684 - RNA, 32 nt, Human
acagugaaagugaaucugaagcgaaugaaacc

SEQ ID NO: 32685 - RNA, 32 nt, Human
acagugaaaugagaaagaauucacugggaguu

SEQ ID NO: 32686 - RNA, 24 nt, Human
acagugaaccgagaucacaccacu

SEQ ID NO: 32687 - RNA, 32 nt, Human
acagugaacuuccagaccucagggcaggucua

SEQ ID NO: 32688 - RNA, 32 nt, Human
acagugaagacaucgguggccacuccaauaac

SEQ ID NO: 32689 - RNA, 32 nt, Human
acagugaaggagcugcugcagcaaagacgggc

SEQ ID NO: 32690 - RNA, 32 nt, Human
acagugaaucagguguuaaggaagaugcagag

SEQ ID NO: 32691 - RNA, 32 nt, Human
acagugaaugcagggagaguagacccugggcu

SEQ ID NO: 32692 - RNA, 32 nt, Human
acagugaaugggagguggaggaggguugcagc

SEQ ID NO: 32693 - RNA, 21 nt, Human
acagugaauguaguccgugaa

SEQ ID NO: 32694 - RNA, 32 nt, Human
acagugaccaacaccuucaggacgaacaauau

SEQ ID NO: 32695 - RNA, 18 nt, Human
acagugacccuggccuca

SEQ ID NO: 32696 - RNA, 32 nt, Human
acagugaccugccucugcacacagccagaaug

SEQ ID NO: 32697 - RNA, 32 nt, Human
acagugaccuggcuggaguuaccuggugcaca

SEQ ID NO: 32698 - RNA, 32 nt, Human
acagugacugcaaauggcuucucagguuccca

SEQ ID NO: 32699 - RNA, 32 nt, Human
acagugacugcaaccaguaccuaugggucaca

SEQ ID NO: 32700 - RNA, 32 nt, Human
acagugacuugcuuugggggaggggaggcucu

SEQ ID NO: 32701 - RNA, 32 nt, Human
acagugacuuguuuccuuuuucccucugaacu

SEQ ID NO: 32702 - RNA, 32 nt, Human
acagugagaaggagcaggaaguugcuguuucu

SEQ ID NO: 32703 - RNA, 32 nt, Human
acagugagagaaaagggggagaaggauuggag

SEQ ID NO: 32704 - RNA, 24 nt, Human
acagugagccaagaucacaccacu

SEQ ID NO: 32705 - RNA, 23 nt, Human
acagugagccaugaucacaccac

SEQ ID NO: 32706 - RNA, 32 nt, Human
acagugagcccaacgcccuggcucucgagggg

SEQ ID NO: 32707 - RNA, 24 nt, Human
acagugagccgagaucacaccacu

SEQ ID NO: 32708 - RNA, 32 nt, Human
acagugagcgaguuuucacgagaucugauggu

SEQ ID NO: 32709 - RNA, 24 nt, Human
acagugagcuaugauuacaccacu

SEQ ID NO: 32710 - RNA, 22 nt, Human
acagugagcugagaucacccca

SEQ ID NO: 32711 - RNA, 19 nt, Human
acagugagcugccauucca

SEQ ID NO: 32712 - RNA, 24 nt, Human
acagugagcuguggucacaccacu

SEQ ID NO: 32713 - RNA, 21 nt, Human
acagugagcuuggugcacucc

SEQ ID NO: 32714 - RNA, 32 nt, Human
acagugaggagguggucaucagcaacccagga

SEQ ID NO: 32715 - RNA, 32 nt, Human
acagugaggcauacccagaggacucugagagg

SEQ ID NO: 32716 - RNA, 32 nt, Human
acagugaggcuggggaaggggaagugaauuua

SEQ ID NO: 32717 - RNA, 32 nt, Human
acagugagggagcaagggagagcaggggaggu

SEQ ID NO: 32718 - RNA, 32 nt, Human
acagugagguacucugcugaaguuucagcggu

SEQ ID NO: 32719 - RNA, 32 nt, Human
acagugagguuccaucacaaaggggcaguauu

SEQ ID NO: 32720 - RNA, 32 nt, Human
acagugaguccuccucuuccucuggcaucaau

SEQ ID NO: 32721 - RNA, 32 nt, Human
acagugauaaccacagugacagccaaaagggc

SEQ ID NO: 32722 - RNA, 32 nt, Human
acagugauagagacagaggaacaaaaagagca

SEQ ID NO: 32723 - RNA, 32 nt, Human
acagugaugacaacaagcagugccccaacuuc

SEQ ID NO: 32724 - RNA, 32 nt, Human
acagugaugccaugggggacccuugccuucca

SEQ ID NO: 32725 - RNA, 32 nt, Human
acagugaugcugcugcuaagggcuuccaaaca

SEQ ID NO: 32726 - RNA, 32 nt, Human
acagugcaacagcacuggcucucuccaggauc

SEQ ID NO: 32727 - RNA, 32 nt, Human
acagugcaaggugggagagaccaggggccccg

SEQ ID NO: 32728 - RNA, 17 nt, Human
acagugcaauccggguu

SEQ ID NO: 32729 - RNA, 22 nt, Human
acagugcacaggcuggucuucu

SEQ ID NO: 32730 - RNA, 32 nt, Human
acagugcaccugcccaggggcuguucagagcu

SEQ ID NO: 32731 - RNA, 32 nt, Human
acagugcacuauguuaguuuauuugagcacuu

SEQ ID NO: 32732 - RNA, 32 nt, Human
acagugcagaaaggcuugaaccugccagcuga

SEQ ID NO: 32733 - RNA, 32 nt, Human
acagugcagaagccugcacaccugccaagucu

SEQ ID NO: 32734 - RNA, 32 nt, Human
acagugcaggaaaacuucuuuagggcacaaua

SEQ ID NO: 32735 - RNA, 32 nt, Human
acagugcaggcccggggcccacgggcaacaug

SEQ ID NO: 32736 - RNA, 24 nt, Human
acagugcaggggcuuuuggcuucu

SEQ ID NO: 32737 - RNA, 32 nt, Human
acagugcagguguagacggaguucagaucaga

SEQ ID NO: 32738 - RNA, 32 nt, Human
acagugcagugaauuggaagacuugacugcaa

SEQ ID NO: 32739 - RNA, 32 nt, Human
acagugcaguguguucacaaggccaguuucug

SEQ ID NO: 32740 - RNA, 31 nt, Human
acagugcaguuucaguauguuucauguuagu

SEQ ID NO: 32741 - RNA, 32 nt, Human
acagugcaugcacuccagccugggcaacagac

SEQ ID NO: 32742 - RNA, 32 nt, Human
acagugccacccuccugacccugccgagguac

SEQ ID NO: 32743 - RNA, 32 nt, Human
acagugccaccuccucagcucucagcuugggg

SEQ ID NO: 32744 - RNA, 32 nt, Human
acagugccacggcuuuuggggcucagaccucc

SEQ ID NO: 32745 - RNA, 32 nt, Human
acagugccacugcaauccagccugggcaacag

SEQ ID NO: 32746 - RNA, 32 nt, Human
acagugccagaacccagagagcagagcuuugg

SEQ ID NO: 32747 - RNA, 32 nt, Human
acagugccaggaggaagaaggaaggagucccu

SEQ ID NO: 32748 - RNA, 32 nt, Human
acagugccaugaucauagcucacugcagccuc

SEQ ID NO: 32749 - RNA, 32 nt, Human
acagugccauugcacuccagccugcacaacaa

SEQ ID NO: 32750 - RNA, 32 nt, Human
acagugcccaguccugccccacagggaucuag

SEQ ID NO: 32751 - RNA, 32 nt, Human
acagugcccaucuugccagcagugcccgcccc

SEQ ID NO: 32752 - RNA, 32 nt, Human
acagugcccugagaccucuagagaaaagaugu

SEQ ID NO: 32753 - RNA, 32 nt, Human
acagugcccugccuucugguuuguucacaggg

SEQ ID NO: 32754 - RNA, 32 nt, Human
acagugcccuguuccuggaauguuucagauac

SEQ ID NO: 32755 - RNA, 32 nt, Human
acagugccgagggggagacccuacauucaucu

SEQ ID NO: 32756 - RNA, 32 nt, Human
acagugccgugagacuuagcuccauggccaaa

SEQ ID NO: 32757 - RNA, 32 nt, Human
acagugccuaagggcuaggccacccagagacu

SEQ ID NO: 32758 - RNA, 32 nt, Human
acagugccuagaaugggcucuuuauccaguag

SEQ ID NO: 32759 - RNA, 28 nt, Human
acagugccuagugcugcucauuaugugu

SEQ ID NO: 32760 - RNA, 32 nt, Human
acagugccuaguguugacauuuucuugacacg

SEQ ID NO: 32761 - RNA, 32 nt, Human
acagugccucaaauccugacccaagggccagc

SEQ ID NO: 32762 - RNA, 32 nt, Human
acagugccugggaauguacuuauucugcagca

SEQ ID NO: 32763 - RNA, 20 nt, Human
acagugccugggcucagccu

SEQ ID NO: 32764 - RNA, 32 nt, Human
acagugccugucucgccuccaucagggagagc

SEQ ID NO: 32765 - RNA, 32 nt, Human
acagugccuguucucugcuccaggaacagagc

SEQ ID NO: 32766 - RNA, 22 nt, Human
acagugccuuuccauccgugaa

SEQ ID NO: 32767 - RNA, 32 nt, Human
acagugccuuuccuugcccuguucucaauaac

SEQ ID NO: 32768 - RNA, 32 nt, Human
acagugccuuuuccucuccugcucugagccag

SEQ ID NO: 32769 - RNA, 32 nt, Human
acagugcggcauauucagauucagaccucuuu

SEQ ID NO: 32770 - RNA, 32 nt, Human
acagugcggugggcgauggcccaggugggugg

SEQ ID NO: 32771 - RNA, 32 nt, Human
acagugcuaaagaucgccuggcucagucagac

SEQ ID NO: 32772 - RNA, 32 nt, Human
acagugcuacaaagaauacagcugcucagucc

SEQ ID NO: 32773 - RNA, 32 nt, Human
acagugcuauaaucccagcacuguggaaggcc

SEQ ID NO: 32774 - RNA, 32 nt, Human
acagugcugaaccaucuucccuccuguucucc

SEQ ID NO: 32775 - RNA, 32 nt, Human
acagugcugacgaguacagagcuaaauggagc

SEQ ID NO: 32776 - RNA, 21 nt, Human
acagugcugauugcccaggcc

SEQ ID NO: 32777 - RNA, 32 nt, Human
acagugcuguucuggagcugcuguuccaacag

SEQ ID NO: 32778 - RNA, 32 nt, Human
acagugcuuacccacgaggcaauacuuacuau

SEQ ID NO: 32779 - RNA, 32 nt, Human
acagugcuuuggauucuuccucccaggccuac

SEQ ID NO: 32780 - RNA, 32 nt, Human
acaguggaagccauccccugaaugacaaguca

SEQ ID NO: 32781 - RNA, 32 nt, Human
acaguggacacagcaggcuauuuucuaguuug

SEQ ID NO: 32782 - RNA, 32 nt, Human
acaguggacacccuggccaagcagggugccca

SEQ ID NO: 32783 - RNA, 32 nt, Human
acaguggacagggagaccucacagagaaaggc

SEQ ID NO: 32784 - RNA, 32 nt, Human
acaguggacccuaccagccugcgggaaggugg

SEQ ID NO: 32785 - RNA, 32 nt, Human
acaguggagaagaagacagaaaaggcuguggc

SEQ ID NO: 32786 - RNA, 32 nt, Human
acaguggagaauuuacagucucucucagugau

SEQ ID NO: 32787 - RNA, 32 nt, Human
acaguggagagggcagcagcguggccugaagg

SEQ ID NO: 32788 - RNA, 32 nt, Human
acaguggagagggcuacaaaggaggacaagac

SEQ ID NO: 32789 - RNA, 32 nt, Human
acaguggaugcugcugggccucugccuugucc

SEQ ID NO: 32790 - RNA, 32 nt, Human
acaguggcacgaucucagcucacugcaaccuc

SEQ ID NO: 32791 - RNA, 32 nt, Human
acaguggcagaacaaacuccacccuaaugugg

SEQ ID NO: 32792 - RNA, 32 nt, Human
acaguggcagagcacacaugugcacagguucu

SEQ ID NO: 32793 - RNA, 22 nt, Human
acaguggcagagcccugagcag

SEQ ID NO: 32794 - RNA, 32 nt, Human
acaguggcagcagaagcuaggagccaugugga

SEQ ID NO: 32795 - RNA, 32 nt, Human
acaguggcagcccugaggaagaugguugcaga

SEQ ID NO: 32796 - RNA, 32 nt, Human
acaguggcagguaauaaguggaagagaagaau

SEQ ID NO: 32797 - RNA, 32 nt, Human
acaguggcaugaucauagcucacugcagccuu

SEQ ID NO: 32798 - RNA, 32 nt, Human
acaguggcaugaucucagcucacugcaaacuc

SEQ ID NO: 32799 - RNA, 32 nt, Human
acaguggcauguaccuguugucucagcuaugu

SEQ ID NO: 32800 - RNA, 32 nt, Human
acaguggccacagcccaacaggaggccgggga

SEQ ID NO: 32801 - RNA, 32 nt, Human
acaguggccauggguggaucugaaagcuggug

SEQ ID NO: 32802 - RNA, 32 nt, Human
acaguggcccaggacuugggauguuagaaaua

SEQ ID NO: 32803 - RNA, 19 nt, Human
acaguggccuggccucccu

SEQ ID NO: 32804 - RNA, 22 nt, Human
acaguggcgcacaccuguaauc

SEQ ID NO: 32805 - RNA, 32 nt, Human
acaguggcuaagagggcaggcagcagcagugc

SEQ ID NO: 32806 - RNA, 22 nt, Human
acaguggcucacaccuguaauc

SEQ ID NO: 32807 - RNA, 32 nt, Human
acaguggcucacaccuguaaucccaggacuuu

SEQ ID NO: 32808 - RNA, 32 nt, Human
acaguggcucacaccuguaauuccagcacuuu

SEQ ID NO: 32809 - RNA, 22 nt, Human
acaguggcucacgccuguaauc

SEQ ID NO: 32810 - RNA, 32 nt, Human
acaguggcucaugccuguaaucccagcauuuu

SEQ ID NO: 32811 - RNA, 32 nt, Human
acaguggcugccugugcucccccagggugagc

SEQ ID NO: 32812 - RNA, 32 nt, Human
acaguggcugcucugggaaggggcuuuuagau

SEQ ID NO: 32813 - RNA, 32 nt, Human
acaguggcugcuuuggagacaguaaucauuuu

SEQ ID NO: 32814 - RNA, 32 nt, Human
acaguggcuggagcuugggcacuugucuuauc

SEQ ID NO: 32815 - RNA, 32 nt, Human
acaguggcuguggugaggaguaugucgccugc

SEQ ID NO: 32816 - RNA, 32 nt, Human
acaguggcuucaagaguccuuacugagccagg

SEQ ID NO: 32817 - RNA, 32 nt, Human
acaguggcuuuuaagguggaggugggcuacaa

SEQ ID NO: 32818 - RNA, 32 nt, Human
acagugggaaccccaauagggcuagggcucuc

SEQ ID NO: 32819 - RNA, 32 nt, Human
acagugggagagagaccagugggucccagacg

SEQ ID NO: 32820 - RNA, 21 nt, Human
acagugggagccaagggcaag

SEQ ID NO: 32821 - RNA, 32 nt, Human
acagugggagccaagggcaagugcuagaguug

SEQ ID NO: 32822 - RNA, 32 nt, Human
acagugggagcuguguuacuagcacuauauaa

SEQ ID NO: 32823 - RNA, 32 nt, Human
acagugggagugagaccagccucuagacugug

SEQ ID NO: 32824 - RNA, 32 nt, Human
acagugggccugcuggugggcauggauguccu

SEQ ID NO: 32825 - RNA, 32 nt, Human
acagugggcucugccagggcugccgcaccugu

SEQ ID NO: 32826 - RNA, 32 nt, Human
acaguggggaaggcaugacacaccugggggaa

SEQ ID NO: 32827 - RNA, 31 nt, Human
acaguggggaucagagaaaaggggcuggaaa

SEQ ID NO: 32828 - RNA, 32 nt, Human
acaguggggcugggguguuuaccuggagccug

SEQ ID NO: 32829 - RNA, 20 nt, Human
acagugggggugcuuuguug

SEQ ID NO: 32830 - RNA, 32 nt, Human
acagugggguggugagaagggagcugcaauuu

SEQ ID NO: 32831 - RNA, 32 nt, Human
acagugggucauggguaguaccagccucaaau

SEQ ID NO: 32832 - RNA, 32 nt, Human
acagugggugaaacugacuuucuuuugguugg

SEQ ID NO: 32833 - RNA, 32 nt, Human
acagugggugcugggccucgccccgaagcuuc

SEQ ID NO: 32834 - RNA, 32 nt, Human
acagugguaccaugagaugucaaaaccugggg

SEQ ID NO: 32835 - RNA, 32 nt, Human
acaguggucacugcaaccuccaucucccuggc

SEQ ID NO: 32836 - RNA, 32 nt, Human
acagugguccccaaauauuauguacauauggc

SEQ ID NO: 32837 - RNA, 32 nt, Human
acaguggucugucuguuaguucaguuucucaa

SEQ ID NO: 32838 - RNA, 32 nt, Human
acaguggugagcucuuagcuucaccaggcuca

SEQ ID NO: 32839 - RNA, 32 nt, Human
acaguggugaugacccucaugaaugagccacg

SEQ ID NO: 32840 - RNA, 32 nt, Human
acaguggugcgaucucagcucacugcaacuuc

SEQ ID NO: 32841 - RNA, 32 nt, Human
acagugguggcugacaccccuuguaagaaagc

SEQ ID NO: 32842 - RNA, 32 nt, Human
acagugguggcugggcucacagcuccauccau

SEQ ID NO: 32843 - RNA, 32 nt, Human
acaguggugugaucauagcucacugcagccug

SEQ ID NO: 32844 - RNA, 32 nt, Human
acagugguucucaaaguguggucccagaccag

(The sequence listing continues in the following parts.)

The invention claimed is:

1. An isolated nucleic acid, wherein the sequence of the nucleic acid is selected from the group consisting of:
   (a) SEQ ID NO: 15215;
   (b) a DNA encoding the nucleic acid of (a), wherein the DNA is identical in length to (a); and
   (c) the complement of (a) or (b), wherein the complement is identical in length to (a).

2. A vector comprising the nucleic acid of claim 1.

3. A probe comprising the nucleic acid of claim 1.

4. An isolated nucleic acid, wherein the sequence of the nucleic acid is selected from the group consisting of:
   (a) SEQ ID NO: 1600;
   (b) a DNA encoding the nucleic acid of (a), wherein the DNA is identical in length to (a); and
   (c) the complement of (a) or (b), where in the complement is identical in length to (a).

5. A vector comprising the nucleic acid of claim 4.

6. A probe comprising the nucleic acid of claim 4.

* * * * *